United States Patent 12,642,819 (COMPOSITIONS AND METHODS FOR TREATING INFLAMMATORY BOWEL DISEASE) - sequence listing, part 91

SEQ ID NO: 46 - DNA, 2925777 bp, Eubacterium siraeum (residues 1-1,462,889 of 2,925,777)
  modified_base (770732)..(770830): a, c, t, g, unknown or other
  modified_base (834100)..(834199): a, c, t, g, unknown or other
  modified_base (1189005)..(1189104): a, c, t, g, unknown or other
  modified_base (1741844)..(1741941): a, c, t, g, unknown or other
  modified_base (2117469)..(2117568): a, c, t, g, unknown or other
  modified_base (2292231)..(2292329): a, c, t, g, unknown or other
  modified_base (2598473)..(2598572): a, c, t, g, unknown or other
ttttatgcctctattttatcataaatatgtaaactatgtccttgcacattctgtaaactatgttatcacactatacagcttgcccctcccgaaaaggaatttctcttcagaaatgatattaaaaatacacagtgcgagttttgcgagggcggtagtaataagctaaggttctactgcttttgcaaggtttgtgagaattataggttgggtgcaacgggaggggcgagcccctcccctacgaaaagcggaatatgtcagcgaaaagttttttgacaagcgaaaccaacaaagcgttcatcgaaaggcaagggcggtagttttaaggttctgctacttttgcaaggtttgtgagaattataggttgggtgcaacgggaggggcgagcaaggcaaggatgccttagcgtatgcgcccaagggctttgcaaggacgcaaagccaactaagcacacacagaccctcaccctacgaaagctatgaaatgttgtgccggatttgcagaatgcaaaaccaaaaatgcacacagaacctcaccctacgaaaagtgggaaatgtcagtgcaaaaaatgcacaattgatataaaaacggacaagcaaagtccggacagaaaaagagaaagagaaagaacaagaaaggagcggtgcgaatggttaaaaagatgatgacgaatgtttttgcggtattcgttatttttatcgtgcttgcgattatcattcctctgccgactccgatactggactttcttctgataataaatataggactttctctcgtcatactccttatgacgatgtacataaaaaaagcgcttgaattttcgatattcccgactgtacttcttctgacaacggttttccgactgtcgctgaacgtatcgactacacgaggaatactttcaaaaggctatgccggcgaggtcgtaaagacgttcggtgaattcgtaatgggcggtgacgctattgtcggatttatcatattcgtaatcatagtaatagtaaacttccttgttatcaccaagggttctgagcgtgtatctgaagtagcggcaagatttacccttgacgctatgcccggtaagcagatggctattgacgcagaccttaacacaggcgcaataacagatgaagaggcaaagatacgccgtgcggaagtacagcgtgaaagcgacttcttcggcgcaatggacggtgctacgaagtttgtaaagggcgacgctataatttctatcatcacggcgctcataaaccttatcggcggtgcggtactgggtattatgcacggacaggatataaactctgtgctttccacctactcgctggcaacagtcggtgacggtctttgctcgcagattcctgcacttatgatctccgttgctacaggtatggtagttacccgtgcggcaagcacggacagcttcaatgccgatattaaaaggcagtttacctctcagcctaacgtaatgatgatagccggcattgttattgccgctcttatggttatccccggcttcccgaagctgatacttctcggcgtcggtgcggcactgtttatattcggctggagattatcaaaatcgaaggcgaagaaagaggcggctctcgccgctcaggcagaacgtgaaacgcttgcaaagatgcaggatcagccgacctctgacaatgactactacagggatattgacaatgtattcaagctgttgaatgttgaacagatagagatggagttcggctacagccttctgcatcttgtagacgaaaagagcggcggtcattttatcgaccgtgtggtaatgttccgtaagcagtttgcgatggatatgggtatggtaataccgtctgtacgaatgacggacaaccccgaaataaacccgaaccagtatgttataaagataaaaggcgaggaggtcgcaagaggagaaatcctttccgaccactatttagcgcttgacaacggagatgtggtaaaccctgttgacggcatagacaccgttgagcctgcattcggtatccctgcaaagtggataagcgcagacaagaaggtaatggctgacgttgcgggatatacgcttatcgacccggtttccgtaatgataactcatctgtcagaggtcatcaagcagcactgcagtgagcttttgtcacgtcaggacgtaaagacgatggtggacaacataaagcagaccaacccaactcttatcgacgaccttatccccggcactatctctcttggttatctcgaaaaggtgctttgcctgcttctgcgtgagggcgttccgataagggatatggaaactatcctcgaaacgcttggcgaccacgcaggtgcgcttaaggacattgacattgtaacggaatatgtaagacaagcgctcaagcgtaccataacaagacgctttgcggaggcaaactcgctgagagtaattaccgttgacccgaaggtcgaggatacgatagttgcaagcgtaaagaaatccgaagcaggaagctatcttgcgatggaccccgaccttatacagaaaatcgtcaacataacaagcggagaaatagacaaggtaaaggatgttataccgaatataatcatactgacctctccgatagtaagaatatatttcaagaaactgatagaccagttcataccgaatataacggtgctgtcctacagcgaaatcgacaatacggcgcagatacaggctataggcaatatagcgatgtaaacgccgcacggtcagaaatatccgggaaaggagtgttctatggcagtgcagagcaaggagcggctgaacgagcttcttgaaaaatacaggctgacaggcgatatgaacgtcaggaacgaaatcgtactgatgtatatggatcttgtcaaaatgatagcggtatcaatgcgtaatatctacaccggatatgcggaaagcgacgatattataaatgaaggcgttattgcgcttatggcggctatagacggcttcgatcccgagaagaatgtaaaattcgaaacatacgcaggtatcaggataaagggcgctgttattgattatctgcgaaagctggacagagttccgagaacgctcagaaagctgtcgaaacagcttgacgataattttgcaagacttaattccgagctgtgccgtactccgacagacgaggagcttgcagaaagtatgaatatgaccaccgcacagctttcaaagctgatggcgaatacggcaggaatgataacgctgtcgtttgaggagcttttatacgaggataatcttgacgaaaatatttcggcatcaagcgaaaccgccgacgcaaaaatgtatgagcgtgaaaaaaagcaggtgatagccgacgctgtcgccacgcttcccgaaaaggaaaagcaggtagtgacaatgtattactacgaaagactgaaatactcagagattgccaaagttatgagcattacgcagtcaagagtatgccagatacattcaaaggctatgctgacgctcaaaaacaagctggaaagctatataaacggctgaaaggcttgcatatttatgtgaaaactgatatgatataatcaaggggtcggaggtttaccggctcgcttataatacggaaaatcacgctttacgaaaggaggtgaaaaaacttgcagagagcattttacaatctgacgcaatccatgcttaaccaccagaggtcgcttgacgctatctcgaacaatctaacgaatatcaacacggcgggctacaagaaggacgagataagaatgaacaccttccaggaggagcttatacttgtcagcaaccgcagaaagacaagcggcaaatttgtgcagacgtatgttgatacaagcaagagcaaccttgagcagagcagttttgagtttaccgaaagcccgtttgatataggtattcagggaaacgtgtatttcaatatacagggtactaacggaaatgtatatcagacaaggtgcggtcagtttgaacttgacggagaaggctatttatgccttaacgacagcggacgtgtactcggtcaaaacggtgagatatatatcggaaacgatgatttcattgttgacaacgagggcaatatcctgaacgaaaacggcgaggtaatagaaaagctgaggctcagctacatacccgaaaacgcagacattacgaaggtaggaaacaacctgttttcttatgacggggatatgacgatacccgaaggcgagaagtatgatattatccagggctgttttgaaaagtcaaatgttgacgcaaacaaggagattacttctcttatggaaacgcagagattatttgaagcaagcagtgctgtgctgaagtatatggatactatcaacggcagagcggcaagcgagataatcaagctgtaaaatgaccggatgtgaggatatgtcatgaacattgcattctacacgggtaagacgggccttattgcacagcaggaaggacttaacgtttactcaaacaacattgcaaacgtgaatacggtgggcttcaaggcttcccgtccgagctttgcggactgtatctacacggtacagagaaatacggagcctgactggcagacaggtcacggcgaatatgtgcacagcactcagcttatgtacagcgagggcgtatttacatataccgacaacgaccttgactttgccataccgacagaagaaggcttctttgcggtaatggataagtacggcgatgtaaactacacaagagcgggcgatttccagatgtcgcagataggcgaccactgggagcttgtaagcgcaaacggagaatttgtgcttgactatgagggaaaccacattacagttccctttatagaaggtacgagcaagccggactatgaggcgcttacgaaaatgataggtgtgtacacattcgacaacaactttggactcgaacttctcggcagtaacaagatgactgctacagagaggtcgggagaggcggttgccgacaggagtatcgacaagataagaatggcactcgaacgcagcaatacggatattgcaggcgatatggtacgcattatcgaaacacagcgttcataccagatgagcgcaagggtcgtacagacagccgatgagctggagcgtataaccaataacttaaggggataaggcacgatgcttcgatcctgaattttaaccgtgggtctgtcggtagatataccggcaggctgtgcggttatatacagctataagattaataatttcagaggtctattatgataaacagttacgatgatttaagcccggtacagcttgatgtgcttaaggaaatagggaatatcggctcgggtaatgccgcaacggcgctgtcacagcttcttggcaggagcatagatatgcaggtgcctcaggtaaggcttatggacgtagctgacgcaatagagtcgctcggctctcccgacaagctggtggtaggaatactgatacggcttaaaggggacgcagacggaatgataatgttcctgcttgaagaagcgtttgcgaaaactatcgtaacgggtcttatgggcgaacgctcgttttcgctgtatgagatgagtgccgatgatatatcggtgctgagcgaaataggaaatataatgggtggaagttatgtcaatgctatcgcaaatctcagcggtatggtcattgatatgtcggtacctgcgcttacaacggatatgctcggagctataatgacggttcctgcaacggagctttccgaggcgtatgaaagggtactcatgataagcgaacaatttctgattgattcagttgagatacaatccgatatgcttcttatacctacggtagagtcgctgagaactctgcttgggaaactgggggttgaagaccagtgaacaagataatcgtggggatctccgaccagaagctgtgcaagtcgccggatgtgctggtgacttatgctcttggcagctgcgttgggatatgtatgatagacaaagtgctcggcatagcgggactggcgcatataatgctgcctgacagcagcgctataccgaatgacaagaacaaattcaagtttgccgatacgggcatacagcttctatatgaaagcatgataaaaaacggtgcggcggcatcgagaataaccgcaaaaatagcaggcggagcgaatatgtttgctaccacaacacctgctatgtctataggcgaccgtaacgttgaggccaccaaaaaagcgctggcaaagctcggagtgcctataatcgcatccgacacgggacttaactacggcagaacggtatcgttcaatgcgtcggacggctcgcttgagataatgtcaagtcttaagggaaacaagactatatgacacgacagacacgattgacacgatagatttacgacaggaaggtacaccgatggaaaagacggaaagacaaaaaatggcggatatatccatgtcggagcttatagaacttgaaaaagaagctacttcgtcacttgacggcatcgagcttaacaataagactatgcaacgcccgcaggaaaacaatcctacgctgaatgtagacgcatcggtaaaggtggttgtaagcgacaaccacctggaagcgaatatgtgcgtattttcaccgcagttttccggcaaggatataacagtggaagctatgcggcaggcactcaaggacgaacacgttgtatacggaatagacgaggaacttcttgaggaaatagcggcaaataagttatacgacaagatcttcacggtagcgagcggatatgcggcggttgacggcgaaaacggcagggtaaaaaatctttttgatacagacaagaagctggtgccgagaaagctggaggacggcagtgttgactatcgtgacctcgggcttatagtaaacgtaagagtaaatgaccttatatgcgaaatagtacccgaaacgcagggcgaggagggtatgaacgtatacggtcaggtgattgctccacgtccgggcagacctccgcttgtaccgcagggttcgaacacggtgctttcggcagatggcaccaagctgttcgccgcagaaagcggaaaccttgtatatatgggcggaaggttcaatgttgtaaccacgttccagatttcatccgacatagatgtaaagacgggcaatataaacttcctgggcgatgttgtcatcaagggcagtgtgcaggagggattttcggtaacggcaggaaaaaccataaccgtatcgggaatggtgaccggtgctacacttaccgcacagggcgatataaccgtaaagaacggagtttttgcaagcgccatacagtcgcagtacggcaatatcaatattgctttcggagaaaacgataccataaccacaagaggaaaccttaccagcacgtcgcttgtcggctgtcggataaagatagagggcgaccttgactgcaccaagaaccccggtgcgcttgtgggcggagattgcagtgtaatgggaaaatttgcggtggcacagctcggtaacaagagctatacgcctactataatatcggtaggaagcaccacaaacctcctgcttgagatggattcgctcgaaaagcaatgtaccgcaatcgatgagtacatagaaaaaataaacacgtctatcgaattcctgcaggaaaagaagaggaacggcgaacatcttgacgcagagaaggaagcgtatatttcatctgcgataaggctcaaggtgcaaaagggaatggataagaagcctctgagaacgaggatagaagaaatacagaaaataatcaatgctaaggaaacgctgtcggtacaggtgacaaagtgcgtttatcctaacgtaaggataaatctcaacagctttaccaccacaacatcggcggagtacggcaaatgcaacatagtctgcggtccgaatgacatcgaattcagataacagacactgagaaaggcaaatatcatggcggcaacggcaaaaagcagatatattacggcggtaaaatggtttacggcatttgtatgcgctctgctttgtgcggctgccgtctgctgttttacgggaagcagtgcagacgctgcggcggtaacaaactgtacggtgtcggggctgacgacaaagacctatacgggtaaggcgcagacacagtcgatcacggtaaaatacagaaataaaacgctgaaaaacggtaaagattacacggtaagctatcagaataatataaacgcaggaacggcttatgttattataaaaggcaagggcagttacagcggaacagtaaagcgttcgttcaagataaaccctgcgttgatatacaagcagtgtactttttataaaatcgcctcgcagtattataccggctcgcagataaagcctgttccgaaaatcaagaacggaacaacgacactgaaaaacggaacggacttcacgcttacatatcagaataacgtaaacaagggtactgcgaaagtatatatcaaaggaaaaggcaactacagcggaagctgttcgcttacattcagcataacggcaaggcctgtttctacgctgaaaatcaccgtgccgtcagtgacttataacggaaaggcacaaaaacctgccgttacggtaaaatataataactataagtttaaaaacggtactgattatacgctgagttataaaaataacacgaaaatcggtacggcaaccgttacggttaagggcaagggaaagctcagcggaacaaaaagcgttacattcaagataaacgcaaagccgataaaaaacgcagttattacatataacaactcgctcacatacaacggctcgacgctaagccctgcggttacggtaaaatacggaaacgcaacgcttaaaaagaataccgactataccgttgcctactcgaataacgtaaacgcaggaacgggaacaatcacgataacgggaaaaggcatatacggcggaagcgtaaaaaagacctttacaataaagaagctcggaatatcggcatctgccgtatcgggaacaggaaacaaggtctatacgggaagtgcgataaagcctgtacctgcagttaaagtaggcggcaggacgctgaaaaacggaacggactttaccgtaagctataaaaacaacaccgagccgggaacggcaactctcaaagtgacaggcaagggaaactattcgggcagtgtatcaaagaccttcaaaatcaccgcaagagcgataaacgatgttgaggtaaccgtacccgatacggtatttaccggtgaacaggtaagacccgacgttgtggtaagctacggcagctatcaatttataagcgacagcgactataccctgtcattcaaggacaacatcaatatcggaacggcaagcgtggttgtcacgggcaaaaaccatctcagcggaagcaggacggtaacattccctatagaaaaggcggatatttcaaatacggagatagccgtgaagaacgcaacgtttacgggaagtgcaataaaatccggcgttgatgtaaggctcggtaatgtgacgcttaaggaaggcactcactacacgctttcctataaaaacaacgtcaatgcaggtacggctcaggtgacaatcagcggcaagggaagccttgagggtgctgtaacaaagagcttcactattgcaaaggcggatatttcgaaagcctcgatttctgcaagcggaacgtatgctccggacggtgtaaagatcggcataaacgctaaattcggcaattacacgcttaaaagcagcgactacagttttaccgctccgaccgctgcgggagagcagacactcacaataagcggaaacggcaacttcagcggcaagaccacggtaaaatgcaatgtggcaaaagcggatatagcaaatgccaaatcgtctttatcgctgtcaaccgacggcaagggctataccgtaacggtaatttacgacggtgtgcttttaacgcaggacaaagattataaggtagctgtaacagaatcaaccacaggcgtcagcgcagttattacaggtatcggcaattacggcggaacagcgactatcagcggcataagcaacgagcttgaagcgtttgaaaatgctgttgtcacaataggtaaagtcacatacaacggcacggcacagcttccctcggtgacagtgaagataggctctgtcacgctgaaaagcggaacggactatattctgagcgcttatgataacactaatgcaggaacagctacggcagttatcacaggcaagggaaaatatgaaggtgcggaaaagaaaacgcagttcaagatagcgcctgccgccatatcatctgcaagcataagctgtgaggatcagatatatacgggacagggcgtcaccgcacagcccgttgttacattcaacggcaaaacgcttgctctcggtgttgactactatatatcgggatattcaaacatagtgaatgtcggaacagctaccgttactgtaaagggcaaaggcaatttcacaggcactgcaaaaggcactttcagaatcgtcaagcaggacaatatggaaacgcttgtcaagaagcggcttgatgagatgatggaaggcaagtgggacaggaagatatatgacttctggcacagctatcagcttggcaagtattacaacacgctccttacctctccttgtacctgccactcctactgtgaaacaggcaacgaagcaggctgtacctgtcttataggaagaagtcacgttctgaataattccggcatacagtgtgcaggatttacaatcgaggtgttcgagtatcttttcggcaaaacaaacggaacgggcgaaaataccctcacgataaggaatcgttccgacggaaactggacagaggcggcgctgaagaagtggatgaccgatacgttccgtccgggcgactatctcgcatatgacaacataaagtacggctatccgcactatgtcacgatatactctgttgataccgacggtatatgggtgtacgaggcaaattacggcggaaggtgcaaaatcaatttccgtaagtttacgtttaaggagatttacgaagaaacggacggtttatggcacaggacaccgaataattatgagttgtcggagtattgatctgaatttaaagcggcatggcggaggctgtgccgctttttgctgtgattgcttatttcgacaagccgtaagtgcgtcacacctgcttttaccgtaacagcctgtccgatgcttgacttttgatatgcaatatgatattatgataataaacaagcaagcaactcatattaaaaataatttaaaaaaatcggaggtaattttatgtcaaagtttcaaaaaatcatcatagcactatgcgttataatcattgttattctgggggcggcaacggtagttctgtttaccggcacatcggaagctatcaaaattaacggcacgtttgccgatataagtctgttaaacagcgataatcccgattttgacaagctgtcgcacaaagaaatcagcatagacgcaactttaaccggaaacatttttggtgtgacaggcgcaagcggaaaaattgcagtaggcgatacagagtatgctcttgattccgcaagctcacgaggctctgtgataaatatccattcgcttaacaacgaaggatcatttgatgtaaatgttaagctggaaaagggaacaggcagtgcaatcattaccgtattgcagtcgcaaaactcctctgacagttcaatgtgggcaggacctgcaaccgacagcgagagtctgaaaaatgttcttaaagaacagaatatcatcaactacagtaacacggaagtggtaaaagaaataagctgtacgggagattttgttgatattaacaatgactacagcgttgatatgtacgaacaattaccgcacaagaccgtaagcgtaaacgcaaaaatcctacgcaacatatacggcagggaatatgcggacggaaccttgacgcttgacggcaaggaatacaaaattcaaggcttcaaccgtgataacagcttcgggaaaaacaggatttttatatccgtaataacaagcgacggaaaaaatgcggcaccgggcattactatatgctatacggaaggctcggattacattaccgtcaattcaagacttcagaacaacacctgttatctgataggaactgtaaaggataagaatgaatttgaaacagctttaaaggaactcggatttatagaataagacgcaatcaaaacatcgggaacagaaatacgcacctcaaaatgaggtgcgtatttcagattatagaaaaagtcttgtagttgatgtgcttctactatatcttttagtatttatctatgataacaagctaccgatagttctttttgcgagatagcacttctcgggttcgctattcgaaacaatacacctgtcaacatgaaagagggagacaaccaaaggaatcagggaaagggactgccgcccctatccctgtcccttaggttttctccctcttggctccctctttccttacccatacccttaccccgctggggtgttggcggaactcgaataaccacctgaacattttatgtcctgttaatgcagggacgcttaacgctacatgtccgcaggttagtacatatatctcaggttagtggcgtttttttgaaaggttaatgtcagtgcagttgtaccgatatactcacgaaaatattaatttcttgtcggtgtggaaattgttttaagcggtgttggtgatatatttcactgtgtggctttaataacaataaacgtttcaacagactgaaatacgcacctcaaaacgaggtgcgtattgttttatattcacttttacattgccgctttcaagcgtttcagtgtttcttcttcaccgagcagctgcattatggtatacaggtcgggggaattttttctgccggttatcgctactctgagtattccgcaggcatcggcaaccgagcctttgtaagcgtcggggtttgccttgtattccttgatgttggggcagaagcctaaaggctcgccgactgcctttacaccgtcaaaccaggcactgctgtcaaccttgtggtcataagccgaaatatatgccgataaaaattccttacgctcgtcagctgtcagcttttcgtcaaactcatagctgtcaacgccgtcgccgtagagatacgggaacatctcggacagatcgctccactttgctatatccttgcgtaccttcttgccgttatatttccacagctttatgctttctctgaacttgtcgggcgaagctgtgatataagcgttcagctttttatcgttatcctttgcccatacgcttatctcgtcaaagagcgtttcctcgctcatcttcgatataacgtcacggcttacgcttgccagcttatccatatcgaacaatgcaccgctgacgggcatcttttcaagcttgaacttgaactgcgacatatcggcatcggggttcttcattctccactcctcataatttgagtttgcgatagtcataaggtattcaagcaccgactgaacagggaaaccggcttttgaatagaacgaaacgcttgcctcggggtcttttctcttgctgagctttctctttttattctcgccgccgtccagcttcattatcggggcaatgtgagcatacttcggcattttaaggccgcttgctctgaaaagctgttcgtgcagaggatatgagctaatccactcatcgcctcttataacgtgggtagtacccatcagaaaatcgtctacaacgtgtgcaaagtggtatgtagggataccgtccgactttaaaagcacaacgtccattatgttttcgggcatttcgatattgcctcttataaggtcacggcaggttatcttgttttctgcgttgccgtctgagcgtaagcgcagaacgtattccttgcctgcctttatattggcttctatttcttcaatggacagatttctgcactttgcatagctgccgtaatagcccatatcggctttttcggcctcctgtgcctttcttatttcgtcaagctcctccgccgagcagaagcaaggatatgcaagaccacgcttaacaagatcctttgcaaaggtctggtatatctcttttctcatactctgtctatacggtccgtagctgcccttttcggcctctccgtctgccgccgcaccttcgtcaaagcatactccgtactgcgcaagagatgtgattatctcgtctgctccgtgttcaatttcacgctttttgtcggtatcctcaagacgaaggtagaatacaccgtccgactgtcttgccatacacattgaaataagtgcggcatacagaccgcctatgtgcataaagcctgtggggcttggtgcgaatcttgtcacagccgccttgtcgggaagtgttcttgcgggatattttgcaaacatatcctcaggtgttgtcttgatgtcaccgaacagaagctcggctaaataattgttgtccattttttcgcccttcgttttttattttgtcttgataatttggttctttccgccgaagttctttttgcctatgcggattatctgaagtatagcagggttaagcaccagatttataccaagctctataaagaaattgatgcctactaaacctaccagaataaatacgaataagtttgtaccctctgcaagtccagataaataatcaaagaagaacacatagcttccgagtacaaatattcctgtgttaacaacaggtgcaactacagccgatactataacggctgctatctgatttttcttgcttatcagcttatacacaaaacctgcggcggcacctgcgagtgtgccctttaatattaccgtaattatcgttcctggtatgtttaccgcaaggaacaggtttgcgtcacccgtcagcagtacggtcacaccgaaaacaaagccgagccatgcgcccgagccccagccgtaaagtgcagagcctactacgataggtataagcgtcagcgtaatgctgaatgttccgaaacgcagtcccattgatatgaactgcataaccacaactatagcggtcagaagaccaagacctataatagtgtttgtgttgattttgccttttaatgtgttgtttgtgtttgacataaaaatctcctttgctgaagtcctgttgtcagcaggtacctcgcagggttgtatattttacatatcatccgccgttcagaatatgttcacagccggtaaccgcagaaatagcatctgtcggttccgtccacaatgccgcttacttcttctgatttttcttgtagataatatgcagaccctctaatacaagatcgggatcgacaataagctcacgtctgcaaagcggagctataaggcttgcgtagcctcctgtcgcaactattgtagccttctctccaagctcctcctcatatcgctctatcataccgtctatcatacaggcgataccgccgatgacaccggcacgcatactatcggggctgtttgtgcctatcatttttccgacaggctcagcgcctatgagaggaagggaggctgttttacccgacagagcctcgaatgataatctcggaccgggagctatcgctccgccgagcattgctccgctcttgtcgagcgcaaatattttaagacaagtgcctacatctatgaatatgcagggtgtggggtacttgctttttgccgctacgccgccgcatacaagatcgcttccgagtacggaaggatcgtctatctttatattaagtcctgttttgataccgggtgaaacgataataggctttacattacagagcttttctattcctttttcgagtatgggggttatcggtgatacgacagaggaaatgatacagccggttatagccgcattttcaaagccgtaaagggataatatatccttcagctttatcgcatactgatcttccattcttgaaacctgtgtgttgagccttgatataaagcgcagttcaccgttattgtcaaaaccgccgaatacaatgttagtattgccgacatctaccgcaagtatcattctttgccctccgattcttcggatatatcgctttctattatagcatctgttttatctttgtcaatatcctcgtcattatttaccgcctttgacagctttacgggtttctttatcttgagataaatcagaatcattccgacaaataccgcaatgcctataaccgtcagtataagccctgtgccaagtcctgcggcaaagaatttaaattcgacaacgtgttcgccctcagacagctttactgtcatcagtgcgtcattcagtgcggtatcgtaatctgtctttacaccgtcaacatataccgtccagcccttttcggcagggatagtggtaaacagtatatcgttactttttgcgtttaccgtaaagcgtatgtcggtctgacttaccttttcgacctttgtttcggcattcttttcgtgcatctgagctatcgccgctgtttccgcttcctcattgtatacggcgaactgcggctctctgatataaaggtcgctctttttcagcacgagctttaccgttacttcctcgcccttttcaaacttgccgagatcctttatattatgattgtcgctctcaaagcatacgcccttgtacgagccgtttacataaagcgaaacctcacgctgatagtcggtcggtatgaacatatagatctctccgctctttggcgcagttatcgtatatgttacgcttgcttcgcccgttacatccgtaaagcctatatgctgattttcaaacgagccttttttgcagttttcggcataaggctcgccgtctgcggaaaataccgtgaagaattctctgtttcctccggtcattgcgttaagcagagcgttctggttttcgaacacgtcatactttgacagctcaagtgagggcagcttgctgtttgcaagatagcctacaggcaatgcgtccttgttttccgtgacggttatatcgtctgctgattttatatttccggtcagctcgccctcgcagtcaaggatatatttaacgccgaaaatatcgcaggtcagcggagtgttgcccgaaaaccttgaatagtggccgtttgacgtgaagccgaagaatccgagcatatcaatagctcttgcattcagcgtactgcttgagtgcgacaggccgtacatatttacagccataggatcgtttaccgagcggaagaagtttttctctatcctgtagaagccgtcatcctgcgcctttatctcctccaccttttcacgcagcggaaatataacgctcagatagctgtcccttgtcgagaaggtaatatccttgtgcatttttgtcagcgtatttgttgcattgaagcaaagctccgcacatatcactgcggttacaagtatcacgcctgtctttggcagctcgctctttttcatatagtgccttgccgcatatacggtaatgcctgcgaccgccatgaatactatggcaggaagtgcaacggttataccgtcaaacacctcacgtccgtcgctgtcaagcgtggttatgaaagtatcctgtgcctctgtgtatattacgagagcaatataactgagcgtaattgctccgaccgttctcgctctgaccgctttgagctgttcaaagcaatgtgccgcaagagcgactatgataaacgaaagcataaacgagtagcggtagggaagccagttgggcatctgtccgccgtgccatatcatatcgaccggacggatatacatacttacaacaagcaagcctataagcgcacctgccgcaattttctgcttgaatttaaatgctcccgagcagaaaaatcccgccgcaagcacaagggcaagcgaacagcagaacagcgccggcagaccctccatccttaccgtatcgtaggtattggggaacagctttcttgctatatctataaggttaaaattattaacaagcgaataatccggctcggtgaagctgaatttgccgttctgaagtgaattatatacaggcagtatcataaatgcgctcatcatagcggaaactattccgcatattccgaaaaacgcaccttttgtaacaaatttttttgcgatgttaattcctgtgttgccggcatatgtttcaagcgaaaaataacggcagataaaatacagcaccgagaagatcgccgccataaagcctatgtagaagtttgatacgaacgcatagacaagcgagcctatgagcagtctgaagcggttttcctttatcagcgaatctataccccagcagataagcggaagtgcgataacgcaatcaagccacatagggtccattgtctgcactatcatatatgcacacaaggcatacatcggggcgaataaggccgccgttgtctttgacagcttctgcgacttatgtgcaaaaagtgcaaaggtaacgccgcacgcaccgaactttgcgagcatcattgtaagcaggccttcggttatcatactgcgtgggaatatccatacaagtatattgaacgggcttgcaagataatagccgattatgcccataaactcgcccgacagatttctgctccacgagtacataaggctctcgccgttgcctattacgtcatgcacatagtcgaaatagaaaacatactgtgcgttaaggtcaagcgacagcaccgaccttccgccaaacggatatattccgaacgatatataagctatacccatcagtataacagggataagaaacgccgcaaacagataaccgttcttatagcacaggtgtctgaatgacagcattttttctctgaaatttaccattatttattatcctcgcatctttgtctgcgtcctgattcttcactgactatatatctcggacgctgctttatctcctcgtatatcttgctgagataatatcccataatgccgataccgagcataagtatactgcctattataagcagaagaagtattacggtcgaaaagccgtctgccgcctttcctgtacagaagttgacaagggtctgtatagccagtatcacggcaaatataaagaacagcactcccgaccaggtgattatctgcataggcacgtttgtaaagctggttattgagcttatagcatatctgaacagctttctgaacgaccattttgtcttgcctgcgtttcttggcgcaacgtcaaattcgacacgctctgtcctgaagcctacccagcttgaaagcgcacggaagaaggtcagcctttcgggcatttcgttgagcgcattgacaaccttgcggtccatcagcttataatcgcttgcgccgtcaaggtcaatagccgagctgttcttcatcatacgatagaaggtctttgcaaagagcttgtatattatgccctccttgcctcttgacgctttgaccgcctctacgacctccgcaccgtttttccatgcggcatacatcttttcaagaagctccggcggatgctgtaagtcgcagtcaatcaccgcaacgcaatcgccgtctgcggctttaagtcccgcaaaaacggctccctctttgccgaaatttcttgaaaaatgaagtcctcttatatgctcgtccgtttctccgagctgttttataagctcccacgttccgtcctttgagccgtcgtcaacaaatatcagctcatagtcggacagcggcgctaatatactgccgagcctttctgcagcggcaggtatgttttcctgctcgttgaaggcaggtataactactgagatcatcttattctccgattatatttatttctactgtcttttcacgttcaccgtcaaaatccatatatattatgtactgcgtaaggccgagtgaaatctcgctgtcacagatagcggtaactaccgagccgcctgcaagctggtggcagatagccgctctgagcggttcttcggcaagggtggataccttttcgtaatatttgagataaccgttcagcgcttcaatatcatttgttgcggtgaacaccgacgcagtggtgtgcattgaagaaattgatatgataccgtttctgatattggatctgcgtacgcactccattacatcctcggtaagatccatatagcctgtctttgaggggatggtgatggtgaatgtctgttttacgttattcataaggcttatcctttcatattgcggcactgccgcttttaatttaccgttttatgtttgtatttattcttactctgcccgaaggcgaggttacggctaaatcgtcatcttcggcggctctgccgtcgctcactgccgcaaggccgtttatatagcaacgtgttccctgcgaaatgaccgtgtctgcgtcctttgcaaaatcaatattcactgtgcctgtggaattgacaaggcttccgcccgaaaattcgtctatatacatatttattttaccgctgtcgcagtcgatgccgagcgttcccgagcaggacagcctttctatatcggcgcttccgctcttgcattttatattcaccatatatccgctcaccgcacagcaatgcaggtcggatgacgcagtgtacaggttaaggtttgaaaagggcttgtcgggaagctgtatttcaatcctgtagctgaactgctcacgggtgaacagcgttatcacaaggctcggcacctgctcgactataagccgtccgtcgtcctcgtaaatatcaacctccgtatcgctgacatacgaaacgtgtatcagctcgtccgaagaacgtgttatatataccggaatatccgttgtttcgacagtaaggtactgcgtaaacggaaagctcccgctcccgtgctttacattactgcggtagtccttgtcgattatcagtgcaaacataagcatagcgataaggcatatcgctccgcacaggaaaaatatgcggataagcacctgtaccgccgtcagcttctgcacacggatatggcggaaacggatatgatctttcagcttcattctttagtctttgaaaaaagtctgtagacaaaagatgcggcaaaggggcatattctcgctacgctcagaagtatcagcccaagcccgaagaaaaggcttgccgctccgaaaaacagcatcgtatattccgacaggtcggatacgaaaatactgccctttcctattatgcgtataaatgcggacggcagtgttatcatgccgtttgcggtaagtgcaagcgcaaataccataaggacaagtatgccggtaaatatcaccgcagataaggctataaggcatacggtcctgggaatgcgtgcaaatctgcatactgtttttgtctgcataaaatctcctcatatctatgtcttatgggctgtgttacgctgttttgcgtcttataccccattttgttttacaattacgattattataacatatttaacttgccgttgtcaaattaaagtgccgatttccgcccttgttacgacacgtttttcacaagcacgggtataaaatacaagctgtaagcataacgcaacaagaaaaagggggagtttttacgggtgccggagttgagataataaagcgaaacggcggaataaccgctgtcataagcggagaaatcgggcattttgaagcatcgggaataagaataagaatcgacgcagagcttgagcggcttatgccgtctatgcttattctggatatgtccggcgtatcatttatggacagctcgggtatagggcttatactcggcaggcaacgcattatggaatcgttcggcggcggtgtggcggtaaagaatccgtcgccgtcggtacgcaggataatacaggtggcaggcttgtcacgacttataataagcggtaaaaatacggaggataaaaaatgaagtgcgaaaattatgttaagctttcgtttcctgccctgtcacgaaacgaaagctatgcgagggcggctgtaggggcattcgtttcccagcttgacccgacagttgacgaactggggagcgtcaaggcggcggtttccgaggcggtgactaactgtgtggtacacgcttattcggaatgtgaaacggtgggcatcataaatataaccgcccgtataaaagatgaagaaatatacataaagatagccgacaagggctgtggcatagaagatgtgaaaaaggcgatggaaccgctgtttacaacaaagcctgaacttgagcggagcggacttggctttgcggttatggaaagctgttgcgataaggtaaaggtatcatcaaaggtagggaaaggcacaacggtcacgctcacattccgctttgaaaaaagggtgcttaaatgagcgccgacaaggacaattcgttcatcacggagcatttcgcactggtgcattcgatagcaggcagattcagaaatcgggggatagaatatgacgaactgttttcggcaggctgtgtcggtcttgtaaaggcaggcaacaattttgacgaaagcagggggctgaagttttcaacgtatgcggtaccggtcattatgggggaaataaaacagcttttccgtgacggcggtacagtaaaggtgagccgcagtttaaaagagttgtcgctgaaaatttgcaggctccgtgacgagcttatcaaaaacggcgaagagccgcatatttcggtgctggcggaaaagctcgggataacgcccgaagaagcatcgcttgcgcttggggcttcgcttccgcctgtttcattaagcagttatgacgatgaggaaaacgacgagggcagtttcgacctgcctgttgagcctgaacagccgaaagcacttgacaggatggcactgcgacagcttgtttcccgtcttgagccgatagaccgcaggctaataatactgcgttacagcgaggaatgtacgcagagcagaacggcagaaatactgggaatgacacaggtgcaggtgtcacgcagagagaagaagatactggaggggctgaggaagcagttattgtgttgatgcggcaggttgccgctgacaattcgccgttctttttgcctctgctttgtcgagattacgttatcggcggatatctgtgacagaacgatcggatatgcgcataatcaccaaaaccgattcgggagaggcaagcctctcccgtagcatttgccaccacttgaaccttcatttccgtttataattatcagataggtgcatagattctttcttttctacacaatcaccaaaaccgataagttctgtaggcttttttctctgcattttgacggcgatgttagatactgtaaatttgttgttcaaaagcgtttgtgaaaagtcaataaaaaatgtatgtaaggtttatgtaaaaagattataataaacaaaaaatgttgaaaactcagttgaaactgttgaattgcaacaagggctgtcgggatatacaataggtacaaagaaaaaatctaccgacaggaaaggaagttttcaactatgtcaaacgaaagatacgagcttaacaaaaacctcgcccagatgttaaagggcggtgtaataatggacgttacaacgcctgagcaggcaagaatagcacaggaggcaggcgcttgcgcagttatggcgcttgagcgtatccctgccgatataagagccgcaggcggtgttgcaagaatgagcgaccctgctatgataaagggcattcagaacgcagttacaattcccgttatggcaaagtgccgtatcggtcattttgctgaagcacagatacttgaggctatcgagatagattatattgacgagagcgaggttctttctcctgcagatgacaagtaccacatcgacaagacaaagttcaacgtgcctttcgtatgcggtgcaaaggacttaggcgaggcgctccgccgtatctcagaaggcgcttctatgataagaacaaagggcgagcccggtacaggcgacgttgtacaggctgtaaggcatatgagaatgatgcagcaggaaatccgcaggctgacatctatgtcaaaggacgagctttaccaggccgcaaaggatcttcaggtcgactatgagcttgtaaagtatgttgcggaaaacggcaagctccccgttgtaaacttcgccgcaggcggtgtcgcaactcctgccgatgccgctctgatgatgcagctcggcgctgagggcgtattcgtaggaagcggtatcttcaagtcgggcaaccccgcaaagagagccgccgctatcgtaaaggccgttacaaactacactgacgctaagatgatcgcagagctgtcggaagatctcggtgaagctatggtcggcataaacgaacaggaaatcgctctcctcatggcagaacgaggcaaataagcggcaatgtgccgcttcaaattccgacctttttaaaggttggaacgtagctaagattagtgggacggtcggggataaacgatatttgggcttattgcgatttgcggcaatgtgccgcctcaaattccgacctttgcggcaatgtgccgcttcaaattctgacctttttaaaggttggtgcattgctaacgctatcgaaatggtcggggataaacgatatttggacttattgcgatttgcggcgggtcgccgctgactgttccgacctttgcggcaatgtgccgcttcaaattccgcctttttaaacattagaaataagtaaaggcttgcaaaacggcggatttataaaaagtgctgagcaaaaagaagattgctgtaataaaccgctcagccgaaaggacacaactaatgacagtagcagttcttgcgcttcagggcgcatttgcggaacacgaaaaaattctctcaaagctcggtgcagacagctttgagatacgtcagaaaaaggatattgaccgcagcttcgaccgccttataattcccggcggtgaaagcacggtgcagggaaaactgctccgtgaacttgatctttttgacggcataaagagccgtatcgaaggcggtatgcctgtctacggcacctgcgcaggtcttatcctgcttgcgaagtctatctctaacgacagcgcacagcacctgcagacaatgtccattgttgccaaccgcaacgcttatggcagacagctcggcagcttccataccgaagcgcagtttgagggtatcggagaacttcctatgacgtttatccgtgcgccgtatatcgacaaggtttatgacgatgtacaggttctctcggaggtggacggaaaaatagtagccgcaagacagaaaaatcagcttgtcacagccttccacccggagcttgacggcgatacaagagtacatgagtattttctgaatatgtaaagatatgtcggatccgctgttttttaaacggcggatttcagcttgtaggaaaagtctatttttataaatatagagcaaattctctatccctaaccccaaaccccttccccgtgggaaggggctatattactggggctaccgcccagtccaagcaaggacgcttgcagtcagccacacaaagccactatgcaaggacgcataatgacagccacacaaagccgttgcacgatgcaacggcacaaatggctgtcaatgcacagacgcagtgacacaaatggctgacgacctgtatgggggctacgccccaaagcaaggatgctttggttgcttgccaaaagttttgcacgatgcaaaaccagcagagcaagcaacactcgacaccccatttttatcatcgatagaggtttttcgacagtctggaatccgctgttttttaaacggcggattttttgtttgcatcgctccggtaatgccttgcttgcccctcccgttataaccttatcgctcttgccgacaccgacaattccgcaagctccccaaaaactaagctccattcattttgcatatttttgaaaaatttttcaaaaccctcttgacaaatgccgaaagcagtgatataataaagcctacaaagtcgataggcttttagagattaaaccgaaccgaaaacgaggtaaggatatgaacaagaatatgacaagatatatcagcggtttccgatgttgattttagcagcatcttcaaagtaagacagatatacttttgttgcaactgcaacacacggttttataccgacagaataacaggcgaaaatttgacttaaagtataacagattatgaatcgaaaaggagaaaatcacaatgagaacatttgacaagatcacagaccttataggcggcacacccatattaaagctcaacaactacatagctctgaacgagcttcctgcaaacatctacgcaaagctcgaatacttcaaccccgcaggaagcgtaaaggacagaatcgcaaaggcgatgatagacgatgccgaagctaagggcgcactcaagcccggcgcagttataatcgagcctacaagcggtaacacaggtataggacttgccgctgtagccgcttcaaagggctacagaataatcctcacaatgcccgaaaccatgagcgttgagcgccgtaatctgctcaaggcatacggtgcggagcttgtacttacagacggcgcaaagggtatgaaaggcgcaatcgcaaaggcagaggagcttgcacagcagatcgagggcggattcattcccagccagttcacaaacagcgcaaaccccaccgctcacttcaatacaaccggtcctgagatatgggaagatacagacggaaaggttgacatcttcgtagccggcgtaggcacaggcggtacggtttcaggcgtaggtaagtacctcaagagcaagaacccgaatgtaaaggtagttgcggttgaacccgcaggctcgcccgtgctttcaaagggtgtagcaggacctcataagatacagggtatcggcgcaggctttgttcccgaaacgcttgataccaagatttacgatgaaataatcgcagtcgagaacgaggacgcattcgctacaggcagaacgcttgcaagaaaagagggcttacttgtcggcatctcatccggtgcggctgtatatgcggctacacagcttgctaagcgccccgagaacaagggcaagaacattgttgttcttctccccgatacaggcgaccgttacctctcaacacctatgtttgcagaataattcagaaatttctatacccaattttatatagccatcgcaaaagctgtctcaaacggacagctttttgcattttgtttataaagcgatttcaaataatcgctgaaaatccgcatcataacgttatcttataaccgcattttgcaagttatcaattctaaacttgcacaaacgtgcttgtgctatagcacaaaaccatgtaaaaccggttgaccttactgcttttcggtagtacaatacaggtaaagaaaaaacaagtaccgcaacggcgcaggacgatgaaagttctgcgccgttttgtttacaaaggaaaggatgacgtaaaaatgtatgaatgcagtttagacagaatgaaggataagatctccactttcagcaaattcggtgatgcaggccacggcggtatcacacgttactcgctctcgcccgaggctattatggcccgtaacgagttcatcaagcgtatgaaggctatcggcgcagagatcgagatagatgatgttgctaatatctacgcaacgctccccggcacagaccccgacgcaaagcgtatcgtaatggcttctcactgcgactcggtaaaaaacggcggtaactatgacggtatactcggtgttatgtcggctatggaggtgcttgaaacagtacacgagaagaacatccctcataagcatcctctcaccgctatgatatggacaaacgaggaaggctcgctgtatccgcccgctatgatgtgttcgggtatcgtatgctacgattatctgcccgaagatatcaaatgcaagttcaagtatgaggatatgatgaattcaaagagtatccttgacaatacatcgacattcggtgaagcgcttgacaagtcgggcttcaagggcgacaagaagtaccgcctgtcacccgacagatatatgtatatgtttgaaactcacatcgagcaaggtcctatccttgaagatgcaggaaacgatataggcgttgttgactgtgtactgggtatgttcaactacaggctgaagttctacggacagacgacccatgcaggcacattcccgatgcccaagcgccgtgacgcattctttgccgcttcacaggctctgtgctatctgcacgaggaaatcgacaagctcggctacagcgaccttgtttacacaacgggcgaggttgtatgccacccttgcgtacatacctgcgtacccgactttttcgacttttcgttcgactcacgtcacgaagatccaaaggtacttgaaaaggtactggctatcgtaaaatcctgcgaggaaaaaacgtgggcaggctgtacctgcaaggtagaaaaggcttggaaccgtgatactgtctactgggataagaagctggtaagctatgtaaaggcatctgcagaagaatgcggtatcaagcaccagtatatccactcaggagcaggtcacgacgcacagtttgccgcatatatgctcccgacaactatgatattcgtacagtcgaaggacggtctttcacactgcgagccggaatattcaagccccgagcattgcactgagggcgcaacggttatgctgaatgctgttctcaaggcagataatgattaagcagtctgtcgaaaaacctatataactatttaaaatggggtttggggcgtagccccaagcggggtgagggcggcagccccacactcagccccggcacggacgccgggcgtgtatgcccaaaggctctgcacgatgcagagccaaccaagcatacacagcctttcccgtggaaaggggttttcggcaaggatgccgaaataaggacacgccgagctttgcacgaggcaaagccatcagagtgtcctaaaggggatagggattgcaaacgagcacctttttataaaaacagacttcttctgatagttgtaaatttgacaaccacttctttttttggtatatttcctgactgattttgctttatctgatttactttcacccgcttttacggcgggtgatttttttgctgatagcgttcattgcaggcggtaattaaaaatagtatcagcttgtagaaaaagtctgtttttgaaataaacttctgatttattatccctatccccaaaccccttccccacgggaaggggctatattactggggctaccgcccctagtccctgtcgggggcttcgcccctgcgaccccattttcaaaaaaatataggtttttcaacagactgatagtataataaggcttgattttttatttaaactatggtacaatagtacagtatcagaaatagaacccgtgattatgggtgtaagccctgtgcaagggagtcctgtgaaccatgtcaggcggggaaccgagcagcattaagcagttatgacctgtgccgcagcaagtttacactcataatcatgggttctatttttgcgtatcgttttatttaccgattattatgtactttttcacgggaggttagttatgcatcttgctctttatcgtaagtatcgttctgccacctttgacgaagtaatttcgcaggagcatataaccaccacgctgaaaaaccagataaaggccggcactccggctcacgcttatctgttcacaggttcgagaggtacgggcaagaccacctgtgcgaagctgatggcaaaggcggtaaactgcttatctcccgttgacggcaacccctgcggagaatgtgaaagctgtaaggcaatagccgcaggctgtcctgatataatcgagatggacgcagcctcaaacaacggcgttgacgatgtaagggcattgcgtgacgaggttatgtacgctccgactgtctgccgttataaagtttatataatagacgaggtgcatatgctgtcctcacaggcattcaacgcacttctgaaaaccatagaagaaccgccgccgcacgttatattcatacttgcgactaccgagatacacaaggtgcctgcgactatcgcatcaagatgtcagcagttccgcttttcaagaattgatgtagaagaaagcacaaagcggctgtgcgagatagcaaaaaaagaaaacgtaaatataaccgaggatgccgcaaggctaatctccagattgtcagacggcggtatgagagatgcggtttcgctgctcgaccagtgtataagcgtgagcgccgacatcgacgaggaaaccgtaaggactaccgcaggcatcgcaggaacggagcatctgttcacgcttgcacaatgcatacacgagcagaatgcgcccgaggcactgaaaattctcgatgagcttcacaatcagtcgaaggatcttatgcttcttcttgacgagctgttgtcgcatttcagaaatctgtgcatactgtcggcaacgaactccgacttttctctcatccctgcaggaagcggaacaagaaacgatcttgcaaggcagacaaaggagtttactctcggagaaataatgcggtgtatggatatactgcaggactgcattgcgagaactccgaaaacggcaaagcgtaagacggttgccgaaatgtgccttataaggctgtgtacgccacgtcttgacagtgatacatcggcattgtcgttaaggcttgaaaagctggagaacaggctcgacaagctgtgtgacggcgagataagcattcagccgagagccgcagtgcaaaccgctgaaagcacagaaaagcatataccggcgcaatctgcaaagcccgtaagcgtaaccggcgacagaccgcaggatattattgcagatacgctgaacaggatagaaaataaaatcacatccgctgatgataaacagaaggatatgacagctccgaccgcttcggtacagcagagcggtaccgaccggaatgccgcagacagcaagcctgactggttgtttgagggtacgggcggcgctgatgataacgcaagcgcaggaaacgaagatgttcctccgtttgaccttgacgaaccgcaggcaagcgttgctcccgcttcacaggaacaggcaagcaatacaagcggtgacggtaacaagccggattggctgtatgagggtacgggcggcactgatgataacgcaagtgcaggaaatgaagatgctcctccgtttgaccttgacgaaccgcaggcaagcgttgctcccgctccaccggaacaggcaagcaatacaagcggtgacggtaacaagccggactggctgtatgagggcacgggcggcactgatgataacgcaagtgcaggaaacgaagatgctcctccgtttgaccttgatgaaccgcaggcaagcgttgctccgcaggaacaggcagtaaagacagagaacaatcttcccgaacagcataaaaataatctgtcggcaggcagtgcgcaaagtaccggtaatgccgatccgcaggtaaccgagatactcgacagacttccagttatactgcaggctatactgggacaggtgcagatgtcgctcggtcgggatacggtgaatatcagcggttatcagaaattccagtatgattttctgacaacaggcgactcgaaggaacggcttgagaaagccgccgaggaggtaacaggcagaaggcttgtaatgacctttgacaatatcggcgatacagccgaaagcaaggataaaagcgaccctgtttccgatttcttatcaagagcggaaaaaatgggcgtaaaaataaaatacaaaaaaccaaaaaattaagtcgttgacttaaagatacgaaaggaaaaatcacaatgaaagcaagattacccaaggaataccagaacagaggcgcaaacaacatgaacagcatgataaagcaggctcagaagatgcaggaagacatcgagcgtgtacaggctgagcttgaggcaagagatttcacagcttctgccgcaggcggtatgattgaagttacaatgagcggtgcaaaggtactcaaggaagttaagctcaaccccgaggtagttgacaaggacgctatcgaggatcttcaggacgttatcgtagcaggcgtaaatgccgttatcacacagattgaagaagtaagtgccgcagagatggaaaaggtaacaggcggagttaacattccgggacttgtttaatggctgaatataattctcagccgcttataacggcggcgcaggaattcgccaagctccccggcatcggtcttaaaacggcgcagaggctggcatattatatactgaacgccccggaggaagaagtggagcagtttgcgtccggaattctacgggcaagacgcagtatgaagctgtgcagtgtatgtcagaatatctgcaatacggacaagtgcgatatatgctcggacagccgcaggaaccacaaggtcatatgcgttgtggaaagtcccaaggacgtttccgccatagaacgaagcggcggctttgacggagtgtatcatgtgcttcacgggctgttgtcaccgatgaattcgataggtcctcagcagcttaaaataaaggagcttatggcaaggctgtcggatacggacgaggtcataatggctacaagtccgactatcgagggagaggctacggcaacatatctttcaagaatgataaagcagctgggagtaaaggtgacccgtcttgcgtatggtctgcctgcgggcgcatcgcttgaatatgcggacgatgttacgctccagagggcgcttgaaaaccgtaacgaaatataattttcttcaggaaaggaatataataaatgacacaggaacagttgaatgcaatacaggaacagacaaagaaaataaccaacccgaaactgctcgaagtgatgagaacgctgaaaaaatgcgctgaagaaaaaacaaatcccgaaccgcagtatcaggtggattatatcgacaatctgatggaggcaagacttcttgcgcctgtaaccgtgacggatatgtcaggggagaacgaaaatcagatgaaggtacagttctcgcaccttacaaatcctcagaacgagaaatattttatggtgttcaccgatatggaaacaatgcagaagaacatcaatgatataagcaagatctgcgtaatcgccgttacatataaggatctttccgctatgctgtcacagccgaagtgtgctatgaagggctttgttataaatcccttcaccgagaacattatctgcggtcctaagcaggcagaggtcatagcaaattatataaggcagaaaaaattcaacagcggcgagcttactgtcataaacgaggttacgggcgtgccggacactgttaccaagcctataacgagctattttgacagccgtaaggatattaaaaaggcgtatattatgaatatgcgcaagataaatcagctcaaccgccttataatcgtggatttcgagggtgaggacgataaattcaacgactttaccaaggactttaccgaaaaggtgctgaaggatataaacgacgaaaaagcgccgtttatgataatgaacttcaatcagcctgccgcaaaacaggcgacaaaagaaaaagttccgttctatgtaaaggtttaaaattcgaaaatattgctatttactgttttatcccccaacccctgaccccttcccccaaagggaaggggaaatagcatgggctgccgcccatgagcctgcttggggctacgccccaaaccccttttatgtaacaatagcatagattttcgacaatataaaaagaggcttttgcctcttttttgtttattctgcggaaattttctttaattttttgcatttacttgacgaaaaagcggttatgatatatcattatactgtataaataggtctacggaccggacaggagaaatcatgaaaaacattatctctgcttcaatgcttgcgagcgaccttacaaatatagaaaaagaaatccgccgtaccgaaaacgcacagatcgagtggcttcatatagatgttatggacggggttttcgttgacaatataacctacgggaacaacgttgttgccgctatgcgtaaagtgagcaatatatatttcgacacgcaccttatggtgacagatcccacaaatcttataccgcttttcgcccttgcgggcagtaatatgcttactatccaccttgaaagcaaaggcgacacaacggcaaaccttaagtatataaagaaaagcggtatgaacgcaggacttgccataaagcccgctacagactggaaggaagtaataccttatctgccgctgtgcgatatggtgcttgtaatgaccgttgaacccggctacggcggacagggatttattccgcagtgcgccgacaaggtggcaatgctccgtaaatactgcaacgaaaacggatttgacaaaatgaatatacaggttgacggcggtatcaacacagcaaccgccgcaacagttaaagatgccggtgcaaacgtacttgtagcaggaacatatctgttcagggcgaaggatatgaaggcggcggcagacgctatacgctaaaagcagtcgggcaacagctcagttgctttgtctgtaagcagagtataatattcctccgtgtcgctcatacggctgagatccgtatataacggaaggcggtactccgacacgatgtgccgtataattccgatgcggctttcggacgatttgctctgcggcagatgaatggcaagacggtaatctttcccgtcacggtctgcgtataaggatacacggtctgcgacagttttaagcgccttgcaaagccttgcgagaacgcaaagctctccctcgcagatgaccgccgtaagaggcggtcggcaggatgcgttttttccggacggagtgcctttaaggcaggagatatacaaggtacagcctccgtcgcttttcgggaaagcctcgacaagcagacgttctccgcaaagcccgagattatgatcttcgctgaggcaggatataagtcttgacaaggcaagctctgaggtacgggaatcgcccgaaatatcttcgcatttaatgcggtatccgtccatatccgacggatttagcgtaatttttacggtatttcccgcaagctcatctatctgcatgggacacctcctgttaaaccggttaaacagcttatagtctgaaaggacaaaaagatataatgaatacaaccacaaatgaagctcttcttaagaagatagacgaagctcctttgctgatgtcaaaggaggcggctaagaaaaaactgcgtaagccgagaagcatatacggcgatcagatactttttatgctggcgataaccgtcattgccacctgcttttacggtatgagggtagtaacggtatgtgcctgctcggtgcttgcctgcatactgaccgatatggtcggctgtttcctttcaaagaaggaatacggtgtaaaagacctgtcaaccatagcctacggtatggctcttgctcttatgctccctgcaagcgttgaatattatgtagtgataatcggcgcagtgcttgcaattacggtaaagcatatattcggcggcaaggacaactatatattcaatcctgcggcggttgcgatagcgtttcttataatctgctatccgacacaggtgctgatgtatccacagcttggcgctcatccggaaatattcggagatgcgggaacgcttgtaagcggaatcgagagcagttttataaagaacggcgcaatgccctcactgactccgcttgagatacttatgggaagattccccggccctatgggaactactcatatactcgtactgatagtaagcggtatctgccttatctgcagaagaagcgtgtcgctttccgctactgtgggcggaataaccgtaatgggcgtgctttcctatctcacaagcagtgttgagcctgctatggacgctgttatattccgttttgtaagcggatttgtactgttcggctttatattccttgcgagcgatccgcagacgcttccgtttacaaacggcggaagggtgctatacggcatagcgctcggcgtaatcacggttatattcagaaattccgcaaatatcgagggaatattcgtgttctccctgctgatagtaaacgctctgtcgctgtatcttgacaagctggcattcgtaataggcgtacagacaaaacagcttttaagataccttaagcataacctcggctcgtttgagcgaatgacagaggacgcaaagcagggtaagacgccgaagctttcagatacgcaggaaattatgattgaacctgttaattataatatgccccctatcgacaataaggtcacaaaggtaaaacgtcataaaaagtcggtaatggagaatctttccgacaaaatatcggattcggtaaagaagaagaaagcttcggctcagaccgccggcgaaaaggaaaaggaggcgcagcatggctcagacaaaacagatgaagccggaaaagacacggaaaagtgactttaagttcacccgtgatcttatagacggactggcaaagcagaatgtcgtactgatgacaggcattgtaaacgcacctgtaataatcgccgctacgaccttcaagaagggcgtggtaatcgctcttgcttttgcgataatatcgtttctgacgatagttacctgttcgtttgtaccgaaaaaaatagtttataccctcagagtaattatatatgcgctggtaggctcggtctattatatcccgaccgtacttcttttagagcagatctttccgcttacggtcgagcttataggcatctatatgccgcttataattacaaacgctcttatcttctcgaaaacggaaagccgtttctaccttgaggacaagctgaaaatgataatcgacgtaattttcttcatagcgggtttcgacgcagtgtgcgtccttaccggaggcttcagggagctgatatgcttcggcacgtttgccggaataaagctgtttgatttcaagattgcggcttttgaatcacctttcggcggatttatacttgtcggaataatggcaggtatgttcagggcgctttacaactatctgcgtaaccgcagaataaggcttaacagcgaggagcataacaaggcggcgactcacacctaccgttcaagcaccgaaagcaagccgtctgcaccccatctgcttccctcgcaggacgacaacgtaaaggagcgcagtgatggataaattagcactttttatcaatacggctatgcttgctatgtttgtcgagaatgcgatattctcccgtgcgctcggcacaagcgtggcgttctatgcatcaagaaaaaaagaaagcatattcggactggggctcggcataacatacgttatcgtggtttcaagctgtatcacgttctttatagacggatggcttgccgactggcagtatttttatgttgtcatgccgcttatatacacgctgacggtgagcatagtatatacgggcagtctgcttctcctgtggagattcctgccaaagatattcagaaacatcaagaaatacgttcatctttcagtgttcaatgcggcagtgcttggagcattgttcctgaacacgacataccacgctgatttcttttcgtatatgggattcggtgtcggaatagcggcaggctttttcattgcggtgttcttccttcatatcgcaaacgaaaggctcaattctccgcttattcccgaggccttcagaggaatgccgataatgatggtttttgtcggcattatgtcacttgcattctatgcgctgacaggatataacacgggcgctatctgataatttctaaaatggagatactgatatgagcagaaaaaaaggattcaaggtaaaacgttcaagaagaaatctgtataaaaaacgtaaaagcaccggcaggaagatatttgacgggattcttttcgttgtgatactgggcgcatttgtctttgtgggatactcggtcgcttctccgctgataaagtttttcggcggaaacggggacaattcctctgtgagcgagcctgcgtggacgccgcccgaatcgctccccgaaacatcggacagcaattcgcaggcgaacacttcggataacacgtccgacaactcaggcggcagtgatacaacaaaggataacacctcctcagtgccaaacgaggtaacatctgcttttgcgacggtcgctcccgactctgcactgaaaagcgatgccgcactgaataagttccttgcctcagcaaaagacagcggttataataccgccgtatttacgcttaaaaacaccacaggcgaactgttatacaaatcatcgcttaaggctgtaaaggacaacacagacgtaaataagggcagtttgacggcggctcagatagtaaaggcgtgcaaaacggcaggaatcactcccgttgcggctataacaacgctttacgacagaaagacaccgtatcttttcgacaatgcgggatatataatctctgacggaaactggagctggctggacgccgccgccgataacggcggtaagccgtggactactccctattccgccgatgcggtaaattattatgcggatatatgcggagagcttgcaaaggcagggtttgccgatattgaacttgaaaacacggtcttcccgaacttccagtcctatgactactcgctgttgtcaaaagaactgcagaatgcaaacagaagcgagaaattagccgttcttgcggcatcgtgcgcaaagaaagcaaaggaaggcaacgcaaccgcaacggttgaaataaaggctgatgcactgcttacaatgtcggcaacgacttatgacggtacggctgaaatatggtctgcgaaggataagatgggcgagagcagtgtgcttgtcacaatggatatgtcgctacttggcacaaagctgcagacttcggcagataagacagtaacggtcgaaaaggacaaggtcaaggcggtaaatcagatattcgcacttgtaaagaaggctgtcggcgacaaggaaatatcggtcggaataacaggcagtgcaaatttaacggctgacgaaatcaaaaattgtaaaacggcactcgaaaagctcggatttaccgatataagattcgaataaatacacaaaagtgcttgcatttgcggcatttttaaggtataattagagaataacgtaagagcgaatatcgcacggaaaagaaaggaatacaaaatgacagaattactgacattattaacaagcggacagacagcaacaaccacaggacagggtggaaacgatatagtgagcattctcacaatgcttatcccccttgcacttatggtagttatattctacttccttatcataagacccgaaaagaagcgtggcaagaagatgcaggaaatgctcaacaaccttgaggttgctgacgaagtagtaacaacaggcggtattgtcggcagagtattaagagttacagatgatactgtacttatcgaaacaggctctgacagaacaaagattcgtgtattaaagagcagcattgctgagaacagaactgttcacgatgatacagaatcaaagtaagagattctgagatattacaaaatatacaccctcacggcataagctgtgagggtgttttttgcgaaaaaatccatcgtacttgccggaagattaccggcaagtacgatggatttaacttattgtgccgatatgcgacattaagcggttacatatcaaacaggtttatcacttcaatacctttggcttcagccatgcgtaccgtctgtcctgtaccgctcctgctgttgctttggtcataatatgccacacagcagtctgcaagttctgtcaggcgggcattacgctgtttcatacagtccttggtgtattcactgccgatatactcaatgctgtcagccgccatcattatcgcataaaactcctgcttatcgttgtaactccagttctttgtctgttcctcgtttgagcaggggagtacaaggtggagttttatatcgagtgccttgcgttttctcagatacagcaccatatgagcgcacatagtgtcgaagccgagagcaccgccgcagtagaagtcggtgacgccacgcttgacaagtccgcatattgtgctgtcaagcagagatttaagcgcatacatatccgggctgtcaattttacgatgccctgtaaagcaaaccgatgtcatacgcaaagcctccttttagttacgataaaaagaaaaataagccgtatctgcgtctgacaaatacggctgatgtgctaaagctagatgtaaatcagtctgcaaccttttcttcgatgaacttaacgatgtcaccgacagtcttgatcttttcaacctgatcatcgggaatctcgatgtcgaactcttcttcaaagctcattacgagatctactacgtcaagtgaatcagcgccgaggtcgtctgtgatgcttgcagcctcagtaaccttgtcttcttcaacgtcgagctggtcaacgattatcttctttaccttatcaaataccatttgaaatctcctccgtgtttttaaaaagaaattttctttcgttaatattatacggcattacgccgaaataatcaagtcgtatttacaacaaatacattaaaaaaatgtctaaatttacagggtgtatttctacactttgcacaagtttataatagcatcgttatgttattccatagcgataaacgaaaatggttttatatgtttttaagctaccgttagttctattcgtcggataacacttctcgggttcgctattctatacgataacgttgctgctatttacgagggaaagaaccaaagggactagggagagtctgagcctcgcttacgcaaggctcgtgcactccgctaaagctccgctggacttgccgcagtgaagcaaagcgaaacgattgagcacttgccaaaggttagtgctcagccctatccctatcccttaggttctctccctcgtggctccctctttccttacccacacccttaccccgctgagaagtgttggcgataagacccacatacgacttaattctaaaagtcaagtaaagacggacgctaaaacgctacttagtggtataaagcgtaaagaaccaagggaacattgtttatgcttgttatatgcaaaatgtttgtggaacgcaaacaaacaatctgccgttttttaattcatataagaatacaacaagtaatcaaatctactcggaaaacataccgattttgcggaatttcttgtagcggttgtcaagcagggtaggaatatctatccttgacagcctttcgaccgcacttataagatattccgatatattgtccgctgtctgtgcagggtcggtatgagcgccgcccaccgactctgaaataatcttgtcacacacaccgaagttatataaatcttctgccgtaatcttcataagatcggccgcttccttttctcttgaaggatccttccatagaatagaagcaaagcctctgggagaaattacggaatataaagcgtgttcaagcatagcaagctcatcgcatacggcaagtgcaagtgcgccgccgcttccgccttcaccgagaactaccgatataacgggggttttcagcgtcataaactcggcaatattctttgctatagcctcgccctgacctcttttttcggcttcaactccgcagaatgcgcccggtgtatcaacaaagcagataacgggtctgtggaacttctccgcctgatatgcaagcctgagagcctttctgtagccctcgggatgaggcattgagaaattcgacttcttgttttcctcaaggtttctgccctttacctgtgcaatcactgtgacgggagtgctgttaagagtagctatacccgataatattgcggcatcgtcaccgtagtggcggtcgccgtgaagctcggtgaagtggttgaatatagcgggaatatagtcgtttacggttggacgattcttttctcttattatctcaagatgctgtgtagcagtcatatttgacattatcattaccgtcctttcaaccgtgctgccaatcagcgccgatttttttatagttatgcagtcttaatatattcgacagcgttttacgcattgagcgtctgtcggctatcgcatcaacaaaaccgctttcaagcaggaattctgctgtctggaaatcgtcggggagcttctgctttatagtgtcctgtataacacgtctgcctgcgaatcctacaagcaccttaggctcggcaaggattatatctccaagacttgcaaaggacgctgtaacaccgcctgttgtggggtcggtaagcaccgtgatataaagtccgcctgcatcgctgtgacgttttaccgcaccgcttgtctttgccatctgcataagggagattataccctcctgcattctcgcaccgcccgacgctgtgaagagtataactggcagcttatgctctgtggcatattcaaacgctcttgttatcttttcacctacaacactgcccatgctcgccatcataaaattggaatccataatgccgatgaccgcacggtagcctcgtatagtgcattcgcccgtcactactgcgtccttcagtcccgtgctttcctgcatactctttatcttcttctcatagtcggggaagccgataggattcagtgacaccatattttcgtcaaacggcttgaagctgtccttgtcaaccgttatatcaagacgctccttagcggaaagccttgcgtgatagttgcagacagggcaggttttcttacgcttttcaaactcgtccatatagaacacgttctgacagcggggacatttgaacagcaggtccttgggtatttcgagggcggaggaatccgcctcttccttctgttcctcattaaaacggtccttgaccattttaaacagatcttctaacaattaaagcaccgccttttcgtttgcttgtggcattatcaataattcgtcagatccttgcggttaaggaagcctatatcgaaattaccgctttcgacatcctcgtcacgcaggagattgagctggaaatcaatgttggtgttgataccctctatgagaaattcggagagggctaccttcatcttctggatagcctctttcctgtcctcgccctttacaagcacctttgctatcatactgtcatagtaagggggtatctcgtagccctgatataccgccgtatcaatacgcacaccgaaaccgccgggcatatgaatcgactttatcttacctgggcaggggcgaaagttgttcttaggctcttccgcatttatacggcactcgataacgtgaccgctgagctttatatcctcctgcttatactgcaggggaagtcctgcggcgatgtttatctgcgcctttacaagatccacgccggtcaccatttcggttacggggtgttcgacctgtattcttgcgttcatctccataaagtagaagtttaaatccttgtctacaaggaattctaccgttcctgcgtttgcatagccgcaagcctttgccgctcttactgccgcttctcccattcttctgcggagatcctccgtcataatggggctggggctttcttcaagcaccttctgattacggcgctgtaacgagcagtcacgctcaccgagataaattacatttccgtgctcgtccgcaaggagctgtatctcgacgtgtcggggatttacaatgaacttctcgatatatatatcatcgtttgcaaagaactgtttagcctcctgctttgcggcggtcattgccgcttcaagctcctcgggcttttcaacaagtcttatgcctcgtccgccgccgcctgcgctcgcctttaccattaccggatagccgatctttgcggcaatctcctgagcctcctcaagcgtcccaacaacaccgtcggagccgggaactacgggaacgtcgttttctatcatcgtcttctttgcgtttgctttatcacccatagcgtccatagcgtcagcgcccggacctatgaactttattccgcacttgtcgcaaagacgtacaaagtggctgttttcggaaaggaaaccgaagccggggtgaattgcctgtgcgcccgttatctcgcaggcggcaagcagtgcctttgaattaagatagctgtcctttgacggagcaggtcctatacataccgcctcgtcagctatctgtgcgtgaagcgcagtcttgtcggctgtcgaatatactgcgacagtctttactccaagctctctgcacgcacggattattcttatagcaatctcgcctctgttggcgatcagaatcttattgaacatacagcgtttgccttccgtttacttgatagcaaaggtgatctctgcggataccgccttttcaccgtttactgtggcaagagccttgccgacaccgataggacctttgacctttattatctcgacttcgagctttaaaagatcgccgggtactacctgtcttctgaacttagcgtccttgacgccgccgaacagacctatcttgcccttgttttcggggagtgcaagcattgccactgcgcctgcctgtgcaagcatctcaagcataagtacgccgggtactacggggtatccggggaagtgtcccttgaaccagaactcgtcctctttcatatactttgtggcaaccacacgctgaccgggttccatttcttcgatagtatcaataagcaggaacggatctctgtgagggattatctccattatctgctctttattcataagcgacatatacagtcctccgttattctattatgatgagcggctgaccgaattcaacagcctctccgtcctttacggcaatagactttacagtgccggaaatatccgcctgtatctcgttcattaccttcatactctcaacgatgcatactgtgtcgccctcgtttaccttatcgccgacctttacaaagggaggctttgtgggggagggggcagagtagaatgtgccgacaatggggctttttatgctcttgccggtatcggcaggtgccgcagcaggagcctgtgtctgcggtgctgatgtcggtactgcgggagcagccgccatagccataggaggcattgcgggcatcacagggggtgcgggagggggattcttctgaccaagctcaagctcgaacttgtcgttctttacatacatataggacagaccgctgtccttcataataccgataaattcctttacggcatcggtaagcgaattagtttcaaactgcatattgtgtcaacctttctcttagtcctctacgggagcaaatgctatacaagcgttatgaccgccgaagccgagcgaattgctgagtgcgcctgtaatcttcatatctctcgtgccgtcagccgcatagtcaagatcgcattcgggatctgccaccttaagacctaatgtgcggtgcaccttgctgttctttatctgaagggcgcaggctaccgcttctacaccgcctgccgcacctaagaggtggcctgtcattgactttgtggagttgatgaccatattctttgcgtgttcgccgaataccagctttacagcggctgtttcggtcttatcgttcataggtgtggatgtgccgtgtgcgtttacatagttgaaggtttcgggcgctctgcctgattcctttacagcgaactccatagcctttgcgccgcccttgccctcggggtcggggcttgtttcgtggtaagcgtcgcaggtagcaccgtagccgatgacctcagcatagatgtttgcgcctcttgcctttgcgtgctcgtattcttcaagaattacgataccgcttccgtcaccgagaacgaagccgcttctctctgcgtcaaaggggatgcttgctctgtcaacatcggtggactttgttatagcgtgcatattgttgaagcctgcataggcaaagcctatcgagcatttctctgtgccgcctgctatggcaacgtccatatagccgttctttatagcgtggaatgcctcgcctatagcgtgtgtaccgctggcgcaagcagataccgtgcagtagtttactcccttgaagcctgtacggatagcaaccgtacctgccgccatattgcctatcatcttggggatagtgaatactgaaactctcttgttgcccttgttgtgatatgcgagaagctcttcctgcgttgtttccataccgccgatacccgagccgattattacgccgcatctgtaaggatcgagatccttgaagtcgcttcctgcgtcctttatagccttgtcagccgcatatacggcatactgtgtgattatatctgtacggcgaagctctttcttgtcaaaaaggccgtctgcgctgaaatcctttacggaagcctttacgttaagttcttcgctctgaccggggaaccactgctctaatgtaaagccgtgcttgccctccataagactgttccagaattcttccttggtgtttcctatggggcttactacgcccacaccggtaattacaactctgctcattttttgtatttcctttcgtggcttgtctttacattgataagccgccgcttatctctattacctgacctgttacatagcttgcatcctttgaagcgaggaatgatacaacgcctgctatttcctcgacctcgccgcatctgcccatagctatctgctttaccattgccgctctcagctcttccgaaagagcgtcggtcattgctgtgtggataaatccgggcgctactgcgttacaggtgatgtttctcgggccaagctcctttgcggtggtctttgtcataccgattatagccgcctttgtagcggagtagttcatctgaccggggttgccgtaaagacctgctacgcttgcaaggttgataatcctgccgctgcgctgtttcatcataacagagcctgcgaactttgtcatattgaatacgcttttctggtttaccgcaacaacgaggtcgtagttttcttcgctcattcttacaagcagaccgtcacgggttatacctgcgttgttaacgagtacgtcaatactgccgaaatcggcttttacgctctttacgaatgcttcacactgatcgtactttgatacgtcagcgatgtacttttcgcactttacgccttctgcttttatcttgtcgattatatcgttgttttcaaagcagctctcggcgatgtcgtttaatgcgatgtcatatccgtcctttgcaagacggagagctattgccgcacctattcctcttgcagagcctgtgatgattgcagttgccattgattttctcctttgttttatcgttttatcgttttatcgttttatcttacttgttcagcagtttttcagcctctgcgaacatttcttccacaatttcctttgcaggctgtaccttctttaccatacctgcgatagcgccgcataagaacgagccttcctcaaggttgccgtcctgtactgccttacgcagtgagccgagcgttatctgctcgaattcatcgggtgttatcgttccgttcatctcgccgcttgcgagcttcttcgagaactttgtctttacgttacggcaggggtgacccgtcgttctgcctgttactatactgtctgtatcctttgcgtcaacaacaagctgtttatatgtaggatgaatctggcactcctcggcggcaaggaatcttgttcctacctgtacgccctctgcgccgagcataaagctggcggcaattcctctgccgtctgcgataccgcctgcggcgataacggggatggatacagcgtcaactacctgcggaacaaggcacatagtggtattttcgcctatgtgaccgcccgattctgttccctctgcgattactgcggacgcaccgcttctttccattctctttgcaagtgcaacactgggtactacggggataaccttgatacctgcgttgttccacgcctccataaacttgccggggttgcccgcaccggtcgttatcatcggaaccttttcatctataacgagctgtgcaagatcctctgcgttggggctcataagcattatattaacgccgaatggcttatctgtcagcgactttgctcttcttatctgatctctcagatagtcaataggagcagaaccgcctgcgattatacctactccgccagcgtttgaaacagccgacgcaagtgtgctttcggctatccatgccataccgccctggaatatggggtactttataccgagtaattttgtgatccttgtttccattgtttttatcctttcagctgtggattaatattcgaaaatagttgcgccgtaggtaagtcctgcgccgaagccgacaaggcatatcttcatgccacgcttaagcctgccctggcggtcaagctccgcaaggcacataggaatacacgagcttgatgtgttgccgtgtgtttcaaggtttgtgaacaccttgtcaagatcaacgttcatcttcttgagtgcggactggattattcttatattcgcctgatggggaataacaagatctatatcatcaagagatatgccggaatgttcgcatacatattctaccgcatttgccatagcgtcaacggcgaacttgtataccgcctttccgtccatctgtaaataacgctccttgttcggagtgtctattatatccttaaggcagtcgtcacccttgaaataggggttgttcctgtcgtagaaattcttgcagtaaaggctctggagcatatcgccctctgcgccggagtggctgtagtattccttgccctctcccttttcgataactaccgcacctgcgccgtcaccgaaaagtatgcagcttgctctgtccgtatagtctatctgacttgtcagacgctcgctggctactatcagcaccgtcttataggtatcgtttgcaaggaagtttcttgcaatgtcaaccgctgttataaagcctgtgcaggcggtatttacgtccatgcaggcacagggctgtgcgccgatcagattctgtacaaggcaggctgtgttaggataatagaaatcgggcgagcaggtcgaaacgatgatgcagtctatatccttcgccgtctttcctgcgcttgcaagtgcggcctttgccgccttggtagccatcataaaattgggcttgtcggggctcatacgtctttcacggataccagtccttgtggttatccattcatctgtagtatcaatgaactttgtgaacatttcattggtgactacggtttcgggagtgtattctcccgtacccagtatcgttataccgttcatatccttttccttccgtgcggcgttcctgactgccgtatattatatattaattgttgattttattctctttttgttgtataataaatcagtaactgcggattttatcgtccgcaaggcatagttaccccgtaaaggtaaacgtgcttatatttcattttactctatttcggtactgtttgtcaacaattatttgcataattgtatcgcaacagagtaaacagtgacattatatttcagaatttctgcaatatatgacaaattataccgttaaaataattaaactacaaggagaaacagaaaaatggcagataagacaaaaaccatattccttttttcaggacaaggctcgcagtacaaagatatgggtaaggaattttacgataccatacccgaatgcaaaaaggtaatcgagcttggcagtgacattctcggctttgaccttgccgctaagatattcggcggagatgaaaaggagctttcacgcacgataatctcacagcctgctatactcgcaatgtcgcttatggcgcttgaagcggctaaatcaaagggcattgaggcatcggctgttgcgggacactctctcggagaatatgcggcaatggcggcaagcggcatgctgacatacgagaacgcatttaaagcgataaagtaccgtagcgaagctatggacaaggcggctcaggctaaccccggaggaatggcggctgttctcggtcttaaggctgacgttatagagcagacttgcaaggagattgaggacggcggagaatatgttactcccgtaaactacaattcgcccgtacagaccgttatcgcaggtactgcggcaggtatcgaaaaggctaaggaagcgctttcggcaaagggcgcaaagcgtatagttcctcttgccgtttcagccgccttccactcaaggctcatggcaggcgcatcggaggaatttgcggtaaaggtaaaggatattcccttcagcacaccctcgatgaagttctactgcaacgtatacggaaacgagcttacggacttctcggatatgcccgcttatcttgcaaagcatatctgctcgcccgtaagatttacctcagagcttgacgttatctcaaaggacggttacgatacctatatcgagcttggtccgggcaaggtgctgacaggtcttgtaaagaaaactcttgacggcgttacggctgtaaacgttgaaaacattgatacgcttgaaaaggcggcggctctctgatgatcgagagtataacggcgcttgacttgtcgatactcgactttatccgtaacacgctttcaagtccggttgcggatattataatgaagtgcctcacatacagcatagagtacggcgcaatggctatcctcgtgttcatcgttatgatgtttgttaagaaaatgcgtaagacgggctttgcggtaatgggagcaacgctctccgtactgctgttcggcgaacttatcctgaagcatatagtctgccgcccacgcccgtttgccgtaaacagtgccattgacattatcataaaagcaccgtcgggattttcgttcccgtcaagccacacggcgacctgcttcgctatggctacggcaatatatctgtttcacaaaaggctcggcattatcgcatatatctatgcatcgctggtcgcattttcgagaatgtacctttatgtacactatccgtcggacattttcggcggagtaatactcggtatatgctgtggcataggtgcgacagcgcttgtaaagctgatatgcaaaaagacagaaaatcaaaaagaatccgaagcagaacaaaaggagcaataaatatgacggaaaacaaaaacgtattcggcattctgggacaccctctcggtcacaccctttcgcctcagatacacacaaggctttttgaaatatcgggcgagcaggcggagtataaaattctcgacactccccccgaaaagctgacagacagttttgaatatttcaaaagtctgacaggcttcaacattacaattccctataagatagatataataaagatgtgcgatacgcttgacgatacagccaagcgttacaacagcgtaaactgtatagcaaacgtaaacggcgtttctacgggatacaacaccgactgcacaggctttacaaaggctatcggcgcaatgggcatgacccttacaaacaaagtattactgctcggctgcggcggcgtaggcagaatgatggctattgaagctgtccgtgagggcggcgagctgactattgcggtaagagatgccgacattcccgttgcaaaggctttatgcgaagaaataaagcagaattataacagcgcaaaggtcggattttgcctgctgagcgaagtaaagggcgactttgaccttatggtaaacgctactcccgtaggtatgtatccgaataccgacgcaagccctcttaccgaagaaacgcttggcagaataacgctgaacggcttctttgacgctatatacaacccccgtgaaacaaagctgatgaagatggtttccgacaagggcgtgaagaaggtcagcggcggtatgcagatgcttgtatggcaggcggctgtggctcatactatatggagcggcgcagaatacacagcagagcaggtgcaggctatctctgacgaaatgatgaggcttgtttaatgcgccccgtgtatctatgcggctttatgggctgcggtaaaagccatataggaagaatgctcgcaagagaatgtacggctgtgttcatcgaccttgacagatacatagtcgataatcagaaaatgaccatcccagaaatattcgctcagaagggcgaaccgtatttcagggatcttgaggcgcagtatataagaaacttcagaggaagaacgatagtcgctacaggcggcggagcaatactccgtgacgaaacggcagagtttgcaagagaacagggcgttgtgatttttctcaacgcaggctttgacacctgctatgaacgtataaagaacgattcgaaccgtcctcttgtagtgaacaacacgaaagaacagcttaaggcaatctatgattcaagactgcctgtttacagaaaaaacagcacctttgaagtgaatgcaaacgcatcggacagaataatcgcaggcgagatcataaagctggtcgagcttgacgcaaaaaggcacaggaaaacgaaaggataaatatgtacatttacaatgcgaacgtcataactatggcggataaaaactacgaaaacggatttatccttatagaaaacgataaaatcaaggctgtcggcgatatgtcgcagttgaaggacttttcgccgtccgacagtgatatagacgcaaagggcagaaccgcatatcccggctttgtagacgctcacacgcatatcggcgcatgggaggacgggcttgcgttcgagggcgacgacggaaacgaggatacagacccctctaccccgaaccttcgtgcgatagatatgataaatccgctcgaccactgcttcgaagaagcggcgcaggcaggcgttacctcggtggtatgcggaatgggaagtgcaaaccccatcggcggaacttttcttgctatgaaaacggcaggctcaaagaggatagacaagaggataataaaaaatcccgttgcagtaaaatttgcactcggagaaaatcccaagaacgtatataaggataaggataccgctccggtcacccgtatggctaccgccgccataatccgtgaacagcttttcaaggcaagacgttatcttgacgatatgatagactatgaaagctcggccggtaccgatgacgagggcgaccgccccgaatatgacgcaaagtgcgaggcgcttatgccgcttttaaagcacgagatacccgcacatttccacgcccacagggcagacgatatattcacggcaataaggcttgcgaaggagtttgacatagattatgtcatcatccacgcaacagagggccaccttatagccgacgagcttcttgaggataacgcacggacgatagtagggcctgtcatcagcgagcgctgtaagcctgagcttcgtaatcatacgatagaaacagcaggcatactgaataaggcaggtgtgcctatgtgtatatgcaccgaccaccccgttgtccccgagcagtatctgccgctctcggcagggcttgcggtaagaggcggtcttgacaggaacgaggcgctgaaggcgattacgatatatcctgcacagataacgggaattgcagacagggtaggcagtatagaagtcggcaaggacgcagatatagttatcttttcgggcgatccgttatccgtatgcgatactccggatatggtcatcgtaaacggcacggtaatataatcttaatacaggcagtaatatcaaaagcaatataaacggagggaatattcatgcgtgagataagcgttgagcttgttaaaaagacagttgaagaactttgcgtaaaagcaaacctttatctgcccgacggaatgaaagagaagataaattcatgtatcggctgtgaaaaaagtccgctgtcaaagcaggtactgggcgatattgtaaggaatatcgactgtgcgaaggagcttgaagtgccgatatgtcaggatacgggaatggctgtgatattccttgaagtcggacaggacgtgcatttcacgggaggaaatctcacagaggcaataaacgagggcgttgcaagcggatatgtgaacggcaagctgcgtttatcggtggtcgaagatccgcttgagcgtaagaacacaaacaacaatacccccgccatagtacatacaagcattgtgccgggcgacaaggtgcatataatggtagcgccgaaaggcttcggcagtgagaatatgagtgcgcttaaaatgttcaccccctctgcaacaagagaggatatagtgaactttgtcgttgaaacggtatcaaaggcaggaagcaatccgtgtcctcctataacggtgggcgtcggtatcggcggcgactttgagctgtccgccatacttgcgaaaaaggctctttgcagggatcttaaaataagaaaccccaagccgctttatgcggatatggagagcgaaatgctcgaaaagataaacaagctcggaataggcccgcagggcttcggcggtactgtgacggcgctgtatgtaaacatcgaacagtacccgacgcatattgcagggcttcctgttgcggtcaatataggctgtcacgttacacgtcacgcagaggctgagctgtaatgggcaagggtaaggtcataggcactgtagcggcggcggtcgtgatacctgccgcagcggttgtcggtgcgatatatatacttccgctgctcgatataacatcaagcaacacgctgtattacttcggcaatgatgcttctgttgccgcagacggtacaatatcgctcggcaaggaggaagtgcttggctacagctcgaaatactccgacactatgacgggatatttcaaggcacagcttaacgagaacgaaacatatatctacaatgcggttatgtacgcaagcgaaaacggctacagcgatatatttctgcctgaagatgtattcgacggcggttatgacaagctgcaggagcttgaatatgttataacctttttaagctgtgacagtccgtttgttgcacataattacacgacaaacagcaagctgaccggaaacgttgaacaattcgcaggaaaaagctatcatcatatacagcttgaaacgctcggagcggaatatacatcccgccgtgaagccgcctatgaaaaggcaaaatcggtagtagcgtcaattcctcaggagtgtaatacagacagaaagaaagcacagtatctgtataattacgttgcggagaactcggtatatgttactgacggctacagcacaagaaacgttccgatagccgacctgcttattgacggtaaggcgatatgtgacggatatgcggatacggtcactatgcttttcaatatggcaggtatagaaacagcttcggcaaacggcacaaataacagcaaaaacgagggacacacagtaaattttgcgaagctggacggcgaatactactactttgacgcaagcgcagacagcataataaacgaaaagggcttcaagcctgccttctattttggtatgtcgtggaaggaagcttccgacagctttacatttgccgatgaatttgcaaacagatgtcctaaagcagaaaaaagccttctgtctgacagcacagacatagttataagcgacaattccgaagaaacggtcaaaaaggcggcagagcttataagatcgggcggcgacacgggcataatcgtaaggcttgacgaaagcataaccgatgaagagcgtaaaagcataacaaacgatacagcggaaaaagtcggagaaccgcttgcttctttatctgcggcaaacaggctgtacggcataaaaatctataaggaatgatttttcgatggaactgaatattgtacttgtcgaaccgcagataccgcagaacacgggtaatatagcccgtacctgtgcggttacgggggcaagactgcatatagtgaagcctatgggctttcagatagacgataaaaagctgaagcacgcagggcttgactactggcattatcttgatataacctattatgacgggcttgacgatttctttgagagaaataaggacagtgaattcttctacttcaccacaaaaggcagaaatacttactgcgatgcagagtataaagataaaacttatatagtgttcggcagagaggataaggggcttcccgaggaactgttatttcacaataaacagcactgcgtaaggatacctatgggcagtaatatgagaagtcttaatctttccaacagtgtggcgataggcgcatatgaggtgctgaggcaatggggctttcctgagcttcagaactacggttcgcttacaaaatacgactggagcaaagccgaataaagcagacaaaccgaaaggaaaacaaaacgatgaaagtaaaacttatcaccgacagcgcaagcgacattacccccgaggacgaaaagaaatacggcattgacattatgccgttcgacattacacttggcgacgaaagccttagggaacgtgttgattttaccgctcccgaatttcttgagatgatagacaaatcgcagtatcttccgaaaacctcacagataactgagatacgctttgaggaaaaatttgagcattactataacgagggctatgacgctgtcattatggtgcttataaattcgacaggctcaaagacttatgaaaacgcactgcttgcaaggaagaatctgcttgaggagcatcccgaaatggcaaagatgcgtattgagataatcgacagccactgttattctctcggctacggttatcctgtaatcgaagcggcaaaaaagctgattgcaggacagagcgttgacaacgttgtagcatatcttaccgatatgttcaataactgcgagatctacataatcggcttcaatctgcgccatatgaagaagtcgggaagaataaacgccgcagcggctttcttaggcgagcttatggggcttaaaccgctcatttcgcttatagacggcgaaagcgaggtagtaaaaaagagccgtggcgaaaagaatgcaatagcagacgcagtccagtatatttcaggcagagccgttcccgaaacgccgtgggaaatactgcgtaccagcgtcacagcgcttgaggacgaatttataaagcagtacagcgcaaaggtcggcagacctcccgaaatgcagagcatagcaggtgcggctgttgccagcaacacaggtccttatatcataggcgttatcataagaggtaatgcaagaagataaagataacagaaaatgcggtcacgttccaaagcaaatcgtgaccgcattatttattcagctttccgtatcgtttttttccgctgtcgcagatgatgacgggaatctgtttttaagtatcttcacagaatggaagaacgcagggaagaggaacagatcggcaagcacccatgccgcagggctggcaagacatacggcgacatatccgaaagcgggaacaagtcccagtgccacaccgcctctcgctatcatctcgaatactccggcaaaaacggcaagctggctgttgccaagtccctgtatcgaaaagcggataatgtttacgaatgcaagcggaatgtagaacaacacattaagccacagaaactgctttgcaaggtcgagtatctcggtctgtgtgccgtctataaacagctttgaaaattcgccgccgaaaggtattatcacgataagggcgattatcgcataggctatgccgagcatcgagcatttcttaacgccgctttcgatacggtcaaccctgccagcgcctacgttctgaccgcagtaggtagccatcgtagaacccattgcatcaaacggacagcacaggaactgtgtgaccttgcttcctgcagttacagccgccatataggtttcaccgagcgagtttaccgccgactgtaaaagaatacttccgatagcggtaatggaatactgaagtcccataggcacgcccatagcgcaaagcctgctcattgaataagcatcgggttttaaatccttcctcgataagtgcagaatatcaaagcgctttatcatatatacaaggcaggcgataccggatataagctgtgcaaggacggtagcccagcctgcgccggctacgcccatatcaaacaccagaatgaacagcaaatcaaagccgacattgagtatgctcgaaataatcagaatgacaacgggggattttgaatcgccgagcgaacggataaatcccgaaaggatattgtagaggaacgttacggggatgcctaagaaaatcacgaagatatagtcatacgcctctttaaaaaccgtgtcgggagtattcatccagtggaggatatttccgcaaagcaggcaggtcgctgttgtcattactgcggcgaagcctatgccaagccatatcgtattgccggcaaacttacgcagaccgtcaaaatccttctctccgaatttctgcgcaacgggtattgcaaagcctgcgcatacacccatgcagaagccgagaacaaggaagttcaccgagcctgtcgagcctactcctgcgagtgcgtttacaccgaggaactgtccgacgactattgtatcgaccatattgtagaactgctgaaagagaagtcctaacagcatagggagcataaatccgagtatgagcttcataggtgagccttttgtaaggtcttttactgctgacatattatcttttcctttcttcaacttaatatcgccgttatatgtataacgctgtacacgaatatattgttttttcgggaggggcaagcccctcccctacaaaaagttttaaatatatgatataagcaaaacggcttttcaatatcagccgattgctaagcaattatactatattgcccgtcctgtttcaatcggtaaaatgcacaaggtatttaaggcaaaaccgcataattattgtcatgcgattgcgcagtcagatttttcgtcagattgtataaattgagtgcaggcaggccggcgcctgtcaagcgaaatttgtgcaagatggcggaaaatatgcaagcaagcgtgtgacaaaggtgatagccgttaattatgcggtattgcctttaagttatcaaggcggtttagtctattatgcaacgctgtattgctttatttcatatcgggctattcaacacagtaatatcggaggatttgaaaaaatttatggaaatttcaaaaaaacacttgacaaacggttttacagcggatataatgaacgcagaatatgttaaacctatgagtgagagtagtagcacccgtcactgtatgacagagagttgccggtcggtgtaaaggcaatgatacatacgcttgtgaatggactcacgagggcaaaccgagaatatcagtttttgatattttaggggcgacggatacctccgttacagggtcgcacatatgatagtatgtgtagcgagtgaccgtgttttattatacggtaatttgggtggtaccgcaggtaaactatactcctgtcccaattgggacgggagttttttgttttcccggacattcaatctctacgttgaagctatcatcatggcatatggcatgacagcaaggcatagccgacataatgcgttgctgaataagatacaggctgtcggacagtggaatgttccacgaagaacttaagcactccgccaaaacagctttcgggaaggctaaacggcacggtaaagcacacaatgttttgttatcctcgttatgcggattattttataacaacaaaacaaaacgttcaaaacacaccatgttttatccccgccgttacaaaagcaatttccatagcagaaagcaaatcaaaggcggaatatgaagcggcacattgccgccgctgcgtagaaaggaaaattattatggcaaacagagagatcccgtacaaaatttatcttgaagaaaacgagcttccccgtcagtggtacaacgtaagagcggatatgaagaacaagcctgctccgctgttaaaccctgcaacacatcagccctgtacgctcgaggaactgagccacgtattctgtacagagcttgcaaagcaggagcttgacgatacaactccctacatcgacattccccaggagataatcgacttctacaagatgtacagacctgctcccttagtaagagcatattgtcttgaaaaggcactcggtacacctgcgaagatctactacaaattcgagggcaacaacacaagcggttcacacaagctgaacagtgcgatagctcaagcttattacgccaagaaccagggcttgaagggtgttacaacagaaacaggtgcaggtcagtggggcacagcgctttcaatggcttgcgcatatctcggacttgactgcaaggtatttatggttaaatgctcatacgagcagaagcccttcagacgtgaggttatgagaacctacggtgcaaacgttactccctctccctcaatggaaacagaggtaggaaagaagataaacgctgaattccccggcacgacaggctcgctcggctgtgcgatttccgaagcagttgaatgtgcaacaacgcacgagggctacagatatgttctcggctcggtactgtcgcaggtacttctgcaccagtcgatcatcggtcttgaaacaaagactgcctgcgaaaagtacgacataaagcccgatatgatcatcggctgtgcaggcggcggatctaacctcggcggtcttatctctccctttatgggcgaaaagctccgtggcgaagccgactatgaattcatcgccgttgagcctgcgtcctgcccctcgctcacaagaggcgtttatgcttacgacttctgcgacacaggcgctgtttgcccgctcgctaagatgtacacgctcggcagtacgttcattccctccgcaaaccacgcaggcggtctgcgctaccacggcatgagcagtgttctttcacagctctaccacgacggatatatcacagcacgctcagttgagcagacaagcgtattcgccgccgcagaacagttcgcaagaacagagggtatcctccccgctcccgagagcagccacgcaatcagagttgcgatagacgaggctatgaagtgtaaggaaacaggcgaagaaaagactatcctcttcggtcttacaggcacaggctactttgatatggtcgcataccagaagttcaacgatcacgaaatgagcgactacattcccacagacgaggagcttaaggtcagcatggagcgtatgcctaagattgactgagcatataatactattgtccttcataatatttgatatatgaaaataccgccgggagtgatgttccggcggtgttttttatttggtcgatcttttagtctttcagggcggtgattgggacgatgtatacgccgtcggggcgcttgtaggcggcgtttgacaggccgcatacgacgcataatgctttcggtgctctgccattttcgctttttatggcattgcttattgatataagattttcggcggcggcatctatctgatttgcgccgagcttgatttctattgcgagccactcaccgtccggatattctataacggcatcaatttccttgcccgaatagtcctgatagtgatacagcacaccatcgtttacatcggcatatatcctcaggtcacgctcacacagcgcctcaaacataaagccggcgcattcaagatcgccaagcaatctttcgggagtagcgccaagcaatgcacacgcaagcgacggatcgacaaaatgccgctttaccgcctgttttacccgaaccgatgagcgtatatttgacgaaaacggcaactgattatcggtaatgaaaagccgctcgaatatatcaagatattcggctaccgtgtcaacgctgatgtcctcgttatccgtctgagatatatcgtttttcagctttttattcgttgcggtcgtgctttcatttctcgcaagcgatttaagcaaaagtcgcattttctgagtattccgcttcacgccgtctatgcggaacgcatcgtcatctataaccgcattcagatattcatcgggaatcagcattgcttgtttcagcggaatgcctatattacccggccagccgcctctgactataaggcggaaaagctccataagctccacttctccggtcatttcagcctgcattgtgccgtccgctatacttttaagagatattttacccgacgaatcacccgattcatacagcgacatcggacgcattcttatcttggctatcctgcctgcgccgctgtgcataatgcccttgtggttaggcgttgccgagcctgttaatatgaactgtcccttttcggcacgtttgtcaacctcataacgcactgcgtcccatatcggcggcacttcctgccattcgtctataagtcggggagtttcaccgctgagtatgagttcgggcgacatttcggcaagctttctgttctgaaagttattttcggggttgcctatcaatatctgactttcagcgtgaaacgccgatgtccacgtcttgccgcaccacttagcgccctcaacgcacaccgctccgaacgccttaaggtattcgtctattttcttatctatcagtctgggcctgtatttatcgttacgcatattccgctcctttcgtaagctatataaataatataacatattacgagagattttgcaatatcattacgagagattttaagttttaaacacgtgagatttcgacttttcaacccatgagattttgagttttcattacgagagattttgtttttgcgataaaggctgactttatatcagtatgtcacgaaatgagcaactgcattcttaccgattgggagatgatagggaaataccgccgggacgtgatgttccggcggtgtttcttattcggtcggtattttaatctttcagggcaattgtaggaggcgcttgataagccacatataacaaacggtgctatcaactatatattatctttcaaaaactaaattagttattttttcgtatctttcatatctgggtatcgcccggattttagaatttccatccatttcttcaacgtcgatttttttagaatcatacgagaacgaacttcaaattttccttttttctttacgccgtcttccaaagcaaaaacaatatcactaccatttttgtagccatacatcgcaagtctgccatgtgcgaacgcatttctgatatgataacaaatactcaaaaattcattataacgccccttatagatagcaattcgttctttgcctcggtttttatgaaaatcttttttaagtgatgtcttctcacagatagctttcatttcatctgttttacttgcaaccgcaaacgaagaattgcgttctaagccagctatgctaaacagatagttttttagtctatcgtttttccaaacatcttttccccaaccgtactcagttaatttaataccactactgcttaagtcatcacaaggtgtattgataacataaaacattatcaaatcttttaaaacgtcatctgcataattatccggtactcgtttttttatccaccctggggtaagagatgctattacataaccattattatttgccatataagctccttatccactattatctatttaatatttaccactcatttcaccctttgtcaagcaagactaatccacattgcaggacgaacagcgcctatagcgccgactccaccgccctttgtataaatctcaccggtactaaacacttcagtagcataactctgataagcaccaggtgacctaagccaccaactacagtagttgccttttgctccattggcaacggcgtaatctgtagatttgcaccgccttttactatttgaactgagatacttattcatttcctttacactgagcaaaaacagcctatcttgtgttgctttaccggaagatgtgctatagtccggattcttatccgcagataccttcactgaaggaatcatagttttttcagtggcagaaaacgcagagtttataaaatcattatttagccaattgcgtaaagagcatgtttcccaagtaacatttgtactggaagtattatacggtttacaatccaaggcgtatttgctaatgactaacgcttttccgtctttcacttcaagcaccaaccactctatcttttccttgccgtttgatgtgttattatcttgctcatatttgccaaatgacacataatgaccgacttttttatcaaaagaatgctgctttttgtaaatgtcttttgctttgtctgcgctgtcactgtattccccaagttcctcaaaaacagctatcgcaccgtcataatcaccgttctgagacataaacatagctttgttatacttggtttcatttattttgtcagcactgtcattataatcccctagctcaccaaatatctctatcgccgtatcaaactccttatttgatactaaattctctgcttttttgtacttagtttccggtatcttatcagcactgtcactataatccccaagttcctcaaaaatcgcaatcgcttcatcatagttcttgttctcaaccgctgtaacagccatattataccttatcgccggtataataacataaacacaaagcaaagctaaaaccacacagatagctgtagttgaaggtaaaattattgcaatatttctgtttcttttcttcgcttttgcctttctctctttttcagccttttccctctcggcttttattctttcttcctctgtccttatctcctcagccttatccctgcactgctgtactctctcggctgaatccttgtaagtaccaagctcttcaaactgtttcgcggctctgagttgattatcctcgctttgtacagtctgaattttcaaagcggaattataaagactttcaagtctgcattcctccgccttttcctcgcactctttctttttttcgtcagcgtccttgtagccgggtatttcggctaaatcttctataatgattttgtaagatatctcatcacgggcatatcccatatcatagacagcctttttatatatactctcaatacgctttttctcattcctgtcctttatatacgcattatattcttccagcgtatttttgagttcttcagctgcaaagcggacggtcttacggtacatatcctcgctgtcaaacggctgtgcctgatttctgaggtcttccgttttgcgtacctccatcttcgccataagcttatacagataagcctgtgcgttctcggggtcgctgtcaagcacacgctcgcagtattcgtctgcttcctgccagtttccgtcctctaagaaaagtgaaatacgcttgagtaacggagcaacacccgaatttaccgtctgacccgcagcagcggtttcctttgcggcagactttggctcgtccttatttataaccttctttatgccacgcactatatcgttgataaagcctatcttgcccatatcctgtgcctgtaaatgtgcaaattcttccggcagttcataagcgtccatatccttgtagcaggggataagcagttttgagcggtcggctttcataagcttaagataacgtgaccactcgttctttacccataccgccgtgaaatattccggctttgagccgatgacaagcataacctttgcgctgttcagtgcggcgaatatgtaaggctcatattcctgcccgagcttgtcctcaagagttatcgccgcataaaataccttaaagccctcctgcgtcagctggtgatatatgtcgttcgcaagcacgctgtcctgtgtgcgctttccgctttcatcggtttccttatagcagataaatacatcgtaaggcttttcattctgcgagatagtgagaatacctttctgtatctcgtctatcgcctttgcctccgcctcatagataattttctgacttatatcggcatactgaatagcgagcttgtagtcctcatcggcagtgatagcatcataggacgttctgtgacaggtgggtacacgcttataggtcgtggggtcttcaacgtattcaatgccgtatttgcacagaattatgccccagtaagcctcagactgcgtgttgtcaagtccgacaattttattatatatctcctccgccttgtcaaactcggactttaaacggagcgtattcgcacggttgaaaagattgccgaccacatcgtcggttatcttcggtattgtctgctccgtaccgcagtattcgcaggttgcggtcgtttcgttttcgtttatttccagtgtgccgccgcacattttgcatttcaatgttgacattttaatttttcccttcatttttgccgtagctgtacggctatttttacttcagtgcctttacctttgcgtttctctcggaaatcagcctgcaaagctcctccgccagctgccgagaattatccgcactgttctttacactgtcggaaaacgcactgaattttaccgaaatatcgctttcaataccgctgagtaacgggttgctcacagggtcggaatagcgtacagcctcgtacaccttgtcacaggcttgtcttgcgttatcatccgccgcataacctttcaggctctcagcgtccgctgtcagcaggcggataaactgcgtctgcgtcttgatttttgcatctgtctgctcaactgcttcgattgcaagcttcgcctttgcaacagtgattatatatgctccgagaacaactgcgcaggctattattccgacaaaagagaacgtgtcggggataagcattgtaagcgagccgagcacaagcatagcaacaagtccgccgtagctgagcgaaatcaaagatacattatagaagaactttttaagcgaatcagccctgaacgcaaaataagcgcataaaagctgacctatgaaagccgccgtgactgcaccgtatcctataaagaatgatgcgttcagctcttttcccgtattcagcgcaactgtaaatgaaaccacattaaatacaacgagtgcgaccgcccagattaccgcatatataccgaatttctttttcatttaaatatcccccttagattttttcgccgcactcaaggcagaactttgctccctcaggaagctcgtttccgcatttcgggcatatcgttacaaatttgtgaccgcattcgggacagaatttgccctttaccactgtcttgttacactcgggacacactaccattccgtcgggaacggcaggctttaccttttctccgcattcaaggcagaacttagcgttttgcggtaaatctgcgccgcatttttcgcatttgattaccgtttcttttttctcgggtgcaggtgatgactgctgaaccgtctgaccgatgttgccggtcatattgtcaagctgtcccatcatagcgcccgccattttcattcctgccaccatgctgaccatatccgaggctactccgccgcctgccgagccgccgttagaacccatatttcctatgccctcggcataagccttctgaatttcagcctgcaatacgtctttctgattatagcccttcgcctgcataatctcggcttccgcaaagcctgtggctttcattgctgttgcttctgcctgcgccgctataacggctctttccgcttcacgctttgctatctcggtctgtgtcgtctgtttttcaagctcggtctgacgctttgccgctgttatctccgcttcggctttagcctgtgcagtgccgtatctggcttccgcctcagcctttgcggtgcggatatcagcctcagcttcaaacattctcttttgcaaagctatagtatgtaattcccgtattctcttgaagttcgggtcgttatcgggcagaactacagtagtcagataaaactgagggattgtcagaccgtactcctcaaatccgggcattattaccgatttcaacacctctgacagctccgcaagatgctcgtctatttcaagaagatagatattcttcgacttgatagcagtagaaaggtttgattttaccactgtggaaataagcggacggaaacaatcctgcaacgactttgaaaaggcgatgttgttatcgtcccacgctattccgttcattgtgccgacaagctttatcaacagctttctgctgtcgcttaccataagattcatattgccgcacgcaccgagttcaacaggtattcccgaatcggggtcgatataacgaacctttgtatccgttccccatttgagcgacatttgaaccgttttattgataaaatatacttcgcagtggaacggcgtctgatcgcctgttgccctgttcagcagtttgccgagttttggtatgttctgcgtttcaagtgtatatctgcccggtccgaacagatcgagcgcctgaccgttcataaagaaaacggcttcctggctttcgtggactataagctcggtaaggctgttgaaatcttcgttagggtgcttccacacaaatgtggaattatccccttcgtatttgattatctgtgctatctgtcccataaatcacacctcatcgtctataaatttttgtctgttaatctttttagacttctttgcattaaaaagtgcctaatatgactaattatgctttaattatagtcatatcaggcacttttgtcaacaattttcaatctgatatgataaaatctgtacaggaggggtgagtatggcacattatcagagattacgggatctgcgtgaagatgcagacaagacacagcaggagatagccgactatctcggcacatctgcgcaacactacggaaaatacgaatcgggtaaagcagaaataccgcttgagcgtgcagtcctgcttgctaaatattataatgtcagccttgattatatcgcaggaatttcctcaagccgccaccctctgacatctgacagctccctttcacctatcgggatactttcggacaaaataacacgcctttccgaaagcgaaaagcaagctgtaaaagatacactcagttctgttatagatatgatcaaataaagataccgccgcagaggaaatgctctgcggcggtgttttcgtgcatcaaattggaatatgagtaaaagcaagaataatattacagctcctattgaattttttgcaactttagcactaaattttcaatagaaagcaataccaccaggaatcaccgcaaatgctccccggcggtctttcttattcttccgtgcctatctgtgccgtgctatcctcgccgacgttcataagctgtttgtttatcgctctggttcttactccgacaagcgtttcaagatcgctgtcgacctgctgtaaatgcttcttagtctttgtcagcgcatcttcaaaagtctcaaattctttctttacgctgctcagtatcttccatacctcactgcttcgcttctgcacggcaagagtacggaagcccatatacaatgagttcagcaatgcggacattgtggtagggcctgctatgctcaccccgtagttacgctgtagctcctccaccagcccgagctttacgacctcggcatacagtccctcaaacggcagaaacattaccgcaaagttggtcgtgtacggaggacagatatatttatcgtgaatatccttcgcacatttctttatcgctacaacaagcgcctttgacgcttcttcaatcattaccttgtctccgctgtcataagcgttgcaaagggctgtgtaggtgtcgccggggaattttgagtcaatcggaaggtacaccgtgtcatcattcttgcccggcagctttaccgcaaactcaacgtgattacggctgtcggggactacagcgacctcagtgtcatactgttcgggagcgagaatatccgcaagaatcgctccgagctgcatctctccgagtatacctctgttctttacgttggacagaacttttttaaggtcgcctacccctgcggcaaggctctgcatttcacccagtccgctgtacaccttgttaagctgttcgctgactgtcgcaaatgaacggcttatcttatcatcaagcgtggtctgcagcttttctcctaccattccacgcatttcttcaagctgatttttggtattcgcatttatgtttccgagctgtaccgccatttcgttacgcatattctgcatatcggcggcattcctctgctcaatgctctgaagacgctgttcaaactgcgacagcagccttgctgttccgtcggagttctgcttttgtgtgtcggtaagcgtgtttccgagatttgtcacaaggttcacaagctcggtccttagcaccgattcgccgcttacacggtttgcctgtgccgtatcgaattttgccgaaagctgtgcggtacgatcggaaagcatttcaagctgttttgcggtctgctcgtccgttatcttgttcacgccgatattttcggcaagcctcttctgcgtaagaagcgttattaccgatattatcaccgaaactacgcacgcaacaagcgttattataataagtatttccatattccttgctccttttaaagtaatctaatgatattatagtagattttccgccttaggtcaatgctttaaaagcaagctgtacggtttataggacagaaaaacggtcatccgaagatgaccgttaagtaagcgatattctattcagcttgtagaataagtccgctcataagactcagacgtgcagcttctcaacctgctcgttaagcagccttgcctgtgcggaaagctcctcgcaggaagcggctgtttcctctgctgttgcggagtttgtcgcaatgacacgggaaatctgatctattcctgcggtcacctgacgaacggcatttgcctgttcttctgcggcaacagaaatatccgcaacgagctttgcgctttcctgagaaagctccgttacctgacgaagcgtttctgcggtctgctttgctatatccgagccgttatccaccgcctctatggtagaagctatcagattacgggtgctgtttgcgaattctgccgacttggatgcaagattccgtacctcgtccgctacgaccgcaaatcccttgcctgcctcgcctgccctggcggcctcgatagccgcattgagtgcgagtatgttggtctggaatgcaatatcctcaatggacgtgataacctgtgagatagcctcagattgcttctgtatcttatccatagcttcaagcagacgctccatatcctcactctgatgcatcatctgctgtgcgcagttgtcagaaagtccgcttgccctgccggagttctccgcagttttgctgatatggtcggatattaccgaaattgtcgaagacagtttatctaccgcagttgcctgatttgttgtaccctctgccagtatctgcgaaccgtcagccatctgctgtgagcctgccgtaacattgcttgcagaagaattcatactgagaataacgttgctcagcgtttcctttatactgcggaacgaacagtttatctcctcaaagctgccgacatattccattgaaggctgtgcagaaaagtcgcctgtacccatctgtgacagcactcgtgaaatatcgtcaacgtagctgctcagcgtgtgctttgcttcagtaagattttcggcaatatcacccatttcatcgccgctgaatctgaaagcggaatccggagcgttaagctcgcctgagcggagctgtccgcagatatttacgacttctgctacaggcttacgcaccagcttcttcattactctgaacaacagcaccgctataccgccgcatacaataataagcactcccagcgaaaccagaatagactttatcagctctccgtccgccttggctgtggtatagcctgcaaaataagcgcctaccacctcgccgctgtaatcgaccatcggcgtatagttgacataatagttcataccgccgataaccgtttttccgatatatgtattattgccctgtacctgctgccagataccgccgtccatctgagttcctatgtttcgttcaccggaggaattcatcatcgtagtattgtaacgtgtgtcgccgcagaacagcgtaagctctgcaccggtctttgccttgacggaatcgacatattccgagtcgttcagatctatgcagacaaccagtgcgccgttctctaccttaagcccgtataccgtatacagcttgtcgccgtcagccataatgccctttatttcaccgttcgtaatgcgctctacagcgctttcgccgagcggaaagccctcactgctccataccacagctccgccgtttatataagccgcatagctgttggcattaggcttgttggcagtccagaagctgtcatagtccgtattgcttgtctgactgtcagagcttgcaacgaacagctcagccacatcgcccatttcgtcaatgtcgccctcaacctcggcggcaagaacatttacgcctgtcgcagtttcgtcctcctgtatggttctgacaaatgacataaacacgattattgtgacaagcgccatggatattgcggccataacggcggcaatacacgaaataaccgttatttttgtcccgattctcattgatcttttcactgtaaaaagcatcctttcatatataatattagctctgtgtaagtccgcagaccgtacttatatcacgcaacaccgaagccgagaatttcgacatatgtcatcttatcctcgccgttctgtgtaacaggcttcacgctgaccttatgcgttccctccgcaccggaatatgcaagagttgcaacgggattgttccagccgtcgcttgcgcttgtggctatagtcgtatacttctcgccgtcaacggtaaattcaagagaaccgtagaccttgctgtttgcacacttatagacaagcataagattcttacccgtgaattcaaattccataggctcacattctgacggcttgcccttataactccagccgtcaggaaagctcgtcagtgtttccttttcagtgtcaaacgtgcctgttgacaatattttcagcttgtcggaagaatgagttctgtcgatgaatgtcatatcagcaaatctgtcggaatatacccatgtatccggcaggggagagatagttacatctcccattgtctttatcttatcggtcgccttgtcaaacatattcataataaggtcggctgtcatcttgtgaccccactcgttcgggtgggattcgtcgtcggaataatcctcccacttcattctgcccgtttcaaactcgtgggaaagtacgttgttcagcgacaccataggcagaccgtaagcctttcctacctgcgacatatattcctcgcaggtgtgtccgctctttataacggtgaaatacagcgcaacggcaggctgattttcctgcgagagaattttccttatcattgcgtcatagctgtccttgtatatctgatcgtttccgtcatttaccgcaaactcaacaaacaccatatccggcttatgatcaagcacatcacgctgaagacggatgtttccgagtacgctcggcgttccgctgagtcctgcgtttacatagtttatctttgtatcgggatacttttcgcaaaggcggtcatacgtcagctttgcccagcacttttcgggtcctgccgtaaggccctcggtgatgcttccgccgatgaaggctatagttacctcctgtttgctttcgagcttcccgataaacttcgacattctttcaaggtttccgagatccataagcgacctttcaaccatattgtcatatatctgctcctcggtgagcttgctttcatctttactgcttgtttcagatgatgtatccgaactgctgtcggtcgattccgatacagatgatgttgtctgtgtatcggacgtactgtccgatgatacgacagaaccgccgcttgcgctgttatccgcacaacctgcaagcattgacgcacacagcaccgcacacagtgttatcttgaattttttattcatatttacctccgtcagaaaaaatatgtctatactattatatattaacgccgaccgataatcaaccgttatttacccgaaaacgatcaatttcactaaaatccgactgcagtaatatactatataaaccgaccgccttacaaacggtcagttgctgtataattccgtgcagacggttaaaaataaccgtgtacatcagatacgttcaaagcatcgcatacgaacagaaaggaagaaaaccatgtttgtaaaaagaggagagatatactacgcagatctgagccccgtggtaggaagcgaacaaggcggtatgcgtcccgtacttatagtccagaacgatgtcggaaaccgccacagccctaccgttatcgccgccgcaataacaagtcagaaggataaatcacggcttccgactcacatttctataaatgccgaccgttgcggtcttgcgaaggattcgatagtcctgctcgaacaagtaagaacgcttgataaacaaaggctcaaggaacgtatgggcgagcttgacgagggagcaatgaacaaggtcgataatgcgctgtcggtcagcttcgggctttcgggaaacaattaatgaatattaccttaacattatgtaacgccgttacacagcatctcatatttcggactatgtaaaggttatcattaacagccgctttagctaaagctacaaaattcaagccgttttcagttttcaggttgtaaaattgtcattataatggtacaataatcaccggaaatcttgcagtaatgcaaaagacgaaacggagaaaagataatgaatatagcagttgcacagtcgggcggtcctacggcggcgataaattcatcgctttgcggagtttttgacgaggcggagaagtacaacgagattgacagaatatacggctcgctgaacggcatagagggtatactgaacgataacctcatcgacctcaaggaagtgcttatcacagaaaacgacaagcagttactgaagcgcactccctcgacggtgcttggctcgtgccgtttcaagctgaaaaacagcagtgacgatgacagcgactacaagcgtatcacgcagaactttgcaaagcataatataaaggcttttttctatatcggcggcaacgattcgatggatacagtaatgaagctggacgcttatttcagagaaaaccacattgatataaaggttgtcggcgtaccgaaaacgatagacaacgatttaccgcttaccgaccatactcccggtttcggctctgcggcaaaatacgttgctacaacactgcaggaaatcatccgtgacagcagggtatactccattccgtccgttacgatagtagaaataatgggacgtgacgcaggctggctcacggcttcgtcctgcgtactgcgtgcaaacggcgaacccgcaccacaccttatctatcttcccgaaagcgacttttcggaagaacattaccttgaagacgtgaaaagaatatccgaaagatacaaggctgttatcgttgccgtatccgagggcatagactgccttgcgagccgctcggaagccaccgacgcattcggtcataaatatctgtcgggtgtcggtaaatatcttgaagagcttacccgtgaccatataggctgcaaggtgcgttcaatagagcttaacgtaatgcagaggtgcggctcgcatatagcctctctgaccgaccttgacgaagcgtggagaataggtgcggcggctgtgaacgaggcactgaaatacggcggcagcggcgtaatgatgggattcagacgaatcagcaacaacccttaccgtgtagggattgctccgcttgacgtaagagaatgtgcaaacaaggctaaatatttcccgaaggaatggataacccccgagggaaacaacgttacgatagatgcactgaattactttctgcctcttatacagggcgagccgaagatagattacctgaacggcatacccgtgcatttcaggcttgaccagtagaagatataagcaaaacgggcatcggccgcttaagaccgatgcccgttttttctttttgaactcaatcaaatttcgttatctgcggattcctgcagtgctgtaataaatacagcacctcctcgctctttacaaaataagactttgaataggtatcatcgacatagaagtcgagcaggaacttatcctcccattcgtgaagggataccttgagcttttcctttatctcgtcatacttatcgccgaataaagctctcagcccttttcctctgcgtaaaaagccgtaaacgaacattgctccccgaaagcacggtaaaagctgcgagtagatcggagagtcacggcggaactcgataactaccttctgctctgtaagccctccgggtgcatccctgtcctcagggagtaccgttctgaacttttcgggcggcattatcgtgccaagctcaatgaattctgcattttcatagggtgctgtcataatatatccttcctttcgtcctcatataaaactgtcggtgtctttattatatatgcgtcatccggctacttcaatgagccgccgcacaatatacttaaactacggcacagcttataaaaactcctttataaaaaatgaaagcataagccttagcttgtcctcataattcagctcacagcccagtatcacctttatccttctcagcttgtagtttactgtattgcggtgaacgaatgtaatccttgcgacctcctgcacactgctgtcattttcaagatagcacttgagcgtttccatataatccgtgccgttggcgctgtcgaattcttcaagcgtacccagcgtttcgtcatatatctcgtgaagtaccgatgtatcttttatatgtacaagcagcttgtatatgcccatatcgctgtaggctacacagttttcgccgtgcagagtagccaccttgagcgccattacggccttgcggtagccgtccgagatagccgcatacccttgctttgacgggcttatgccgcaggtgagcgtcgctccctccccgcctgaattgaaaatagtatcaaatatcgaaagaatcttccgtacatcctcctctttacagtcggggcatactgtcacaagatttttatcctgaaagaagaagctgaattgccttccgcttgtattcagcaccttctgcatagcgcttgtggcggcttttttcagctcatcgtcgccaagatcggtttcagaaaagccgcatacgcctacgcaatagtcggatgacgggaaataactgcgccgttcaagcgtcgatttatatcccgcttcgttctccggcgaaaatataaggtttcttagggcggtggcaagcgccgtttctatctcctcgcccgttactatcctgtggcagaagtcgtaggttatatctatcagctttacctcccacggtacactaaacaacggcagggaattaatatcacagcagtcctttacgctttgcggtatactctttatatatttacctgtgttgataacaagcgcactgcagcgtttttctatcagttcctcgacaaacctcagcaggtgaccttcatcgtttattccgacccctgtcataaagaccatttcgttgccgtgaagaaaaagtgacacatcagcgttttcaaccagatgcacccagcggacgtagtttcccagtccctcttttcccgcaacaagcttcataacgtaattcgcctgtgcatttgcacatagctttgataccgtaattgacatattctcacccctttttcttttaagatagcaaaaaccgccgaagctcccttgtttcccgacagctccggcggtgttcatcttgtttattgatatagagtatagcacggttttgcataattgtcaagagaatattgcaaaatccaactacagcacaaacaaaacatctttctttaggcgctctgcacaattcagcacaaatgctattgtaatgcgatttcaagcgtgatataatgcagttaaaccgaaaggaaacagtgaaataaaacaaaaagaaacttgcaacggcgcagaaagtgatttctgcgccgttttgttttgcaagaataaaaagataagacttgcaaaacaggaaagaaaggagtgcttagaaatgagtgaaaaggtaaatgcaccggagatttcggtaaagaacgtcagtatggtgttcttggacagcaagggaaatccggtacaggcacttaagaatgtaagcattgatattcagaaaggtgagttcatatcgcttctcggcccttcgggttgcggtaagtccacacttcttcgtatagtatcggatctgctgacccccacctcaggcgaggttacggtctgtggcaagacaccgagagaaacaagacttgagcagaagttcggtatcgtgttccagaaccccgtgcttctcgactggagaacggtaagaaagaacataagacttccgcttgagatgatgaaggttccgaaagaggagcaggcgagccgtatcgaacaggtactggagcttgtcggacttaaggaattcggaaacagctaccccggacagctttcgggcggtatgcagcagagagtaggcatagcaagagcgcttgcgatacagcccgacatactgctgatggacgaaccgttctcggcactcgacgagttcacaagagaaaagctcaacgacgatgtgctttcaatatggagaaagacaaacaagactgtgcttttcgtaacacacaacatatccgagtcggtatatatgtccgacaggatctgcgttttatctcctcacccgggcagattatccgcaatagtggacgttaatcttcccagaccgagaaacgcagacatgagaggtactcccgagtttgccgctcttgttgagaaggtaagaaacagcttcgagggtatataaagccgaaaggagcgttaagaaatgataaaaaggataacttcctccaaaggcatagtaactgccgtatgggtgctgggtcttgtagtgatatgggagatatgcgcatttatagtaggagcgacacagcgtacacccgtaaacgttcttccgcatctgtaccagataatcggctcgttctttgatacaaagtcgataaccggttcgggcgatacgatagcaacactggttttctccagtgccgcagaaacactttcaagagcgcttatcggttttataatcggtatggtgctgggctacatactggctttgctgatgcacctgtcgcacatagtcgaaaagatagcgttcccgtatcttatgataatccagatgatacctattctcggtatggcgcctatcgtactttcgataacgggcgatatatcaagcgcacgaatcataatcgccgcaatactcacattctaccccgtttcgacaaatacgctggcaggcttcaagtcggtcggacgtgaaagacacgagctgatgagatcctacggtgcaagcaagctccagctttacacaaagatgcttatcccgtcggcaatgtcatacttcttcacgggtcttaagatctcagcacctatggcgataacggcatctatccttgtagatacgcttcagggcggcaacggtcttggctgtatgctctcccagtcgctgaaaggctcgatgacaagattcgtattctgggatatagtaatattcagcgccgttataggcgtgctcagcttctatcttatgggcgttatcgaaagagcgataacaccggcaaaaagaaaggcaaagaaaaaagcacagtaaggaaaggactgatcgtacttgaaaggcaaggcaatcaaaaacatcataacaacagtcggtccgcccgtactgttcggagcattgatattcacactgtggcagacaaagattctgcacgcactgttcaaaacggatgagataatccttccgctcccgacaagaataggctcaatcataggcgataacttcacgaatatgttaccgcagatagcgtcaactcttatagtggcgctcggaggacttgtactcggctcgatactcggttacttcatcggcgttgccggtgcggtattcaagaagtggggcatgggcggtctgaccatagtatccgcattcaatgcaattccgcttgtagcgctcgctccggttatcaacaactggacaagggatctgtcgagcgtggtagatataagaagtacagtggctaagataatcaccgttacgatattctgcacagcttcaatgagcgtaaacgcatacagaggtctgacggaggtaaaaccgttctcggaggatctgttcgcatcatacggttcaagcaagctgaaaatgttcttcaagctgaggctcccgaactcactgccctatgtattcacggctttaagagtaagcgttccgtcctgtataatcggtgcggtagtaagcgaatacttcgcagagcaggtaatcggtgtcggcagacagataagagagaacatagtcaagggtcagtttccgacagcgtgggcatatataacgatagcctgcgtaatgggtatactgatgtacatcatactcctcacagttgaggcaatcgtgctgaaaaaccgccgtgcaagataagcaaaagagcggtttcagatataaggcgtatcggcactatcattcaacgcccatccgatgccataatttccgtattacttcgttgctttttcttgacatacaaaacagtatgcctacaaaaaagcgcctcgttctacgaaaattcggctatcgcctgaacgtttcagatagcaccgacacacctaaactaaaaccagttttaaagacgagaaaggatgaaacattatgaaaaacaaaagagtgttagcagcattactcgcagcaagctgtcttgcagcatcattcaccgcttgttccggtgacacctcatcgagcagcacagcagaaagctcagccgcatcggcagacgcttcttcaagtgccgcagagggttcttcggaaagcacaggtcttatgagcgatgaagagatcatcaagaaggcttcaagcgaaaacaaggtcggcaactggggtctcggcaacgagtacgaaattcaggctttgctttcaaagtacggtctgcccacagattatatcacaatggacttcacaatggatcagatagataaggatactattacactggcatcagcaatgacattcaacgagcttggtcttatcaagaacaactatgacggcggttataactacggcgatgagatcggcgtcattgatatgaacgacgagggtgttgcgatgcttgaggataacctgttctgcacaaaggaatttgcaaagaacaaccccaacacagtaaaggcattcgttgccgcatcaatgaagggctggacatatgcgtgcgagcatcccgatgaagccgcagaaatcgtattcaagtacggctcatcggtatcggctgaccaccagaagtatatggcttcagaggttgcaaagcttgtaacgacagatacaaagggcaatgcggtttccgcttcggatgtaggtaagatggacgaagatgcaatgcagcagacacttgaccttgctaagcagtacatcaagcttgatgatgctacagcggcagacaagctcgctaagcttacacttgatgacatccgttcttccgactatctgacatatgacggcggagcagttgagaagtctgacctcaaggttcagcttaaatggttaccgcaggctcagttcatgggctattatgtagcacttgacaaaggctactacaaggataacggccttaacgtagagattgtaagcggcggcggtgacgtttctgaaacagttgcagtaagcaacggtactgttgacttcggtgtaacgtgggtttctaaccttatcaacgccaacgcaggcggtatggagcttctcgaagtagctcaggtatatcagagatcgggtcttgtactttgctacaagaagagccggttcactaagtaattcacggtttcggatcactccggaagctgaaaggcggtatatatgagcgaaaagaaaatacttgtaagcggttgccttttcggctggcattgccgctatgatgacggcgatacgccgtgtctgcacccacagttccttaagtggaaagaagagggcagactgataccggtatgtcccgaagtgttcggcggtcttccgaccccacgtcccgattgtcagcgtacaggcgataaggtgatgagctgcgtaggcggcgactgcaccgagcagtacacaaaaggcgcaaacgaggcgttaagacttgcaaaggaaaacgatgttgccctttgcataatgaaagaagacagcccctcctgcggaagcacccacatatatgacggtaccttcacagatacgattatcgagggacaggggcttgcggtagaatatctcagaaacgcaggctacaaggtattcagcgagaatatgattgaagaagtcataaaggcactcgcaaagtaaacactacagcaacttatacagtaagttcagtatcgcacgagcagttaaataccgttcgtgcgatcgggaaagacgtcagggcggacgtatcacggcatagcggtcgttttgctccgacgtttttcccgataaaaatacaaactttatcaagagcagaaggaaagagggtataacagtggtattcagatcaccaccaacgattatttacggcaagggtacagttacctcagtcggagagcaggcggctcgcttcggaaaaaaggcggtgcttgtctgcggaaaaggctcactgagaaaaagcggagtgcttgatattatagtatcgagcctcgaaaaagcaggcgtttcctgtgcggtatacgaccgtgtaggctcagacccaacaacatcggacgttgacgagggtgcggcttttgcaaaggaaaacggctgtgatgtgatagtagcggcaggcggaggaagtcctcttgatgcggcgaagggaatcggaatgctgctcacaaacggcggcaaggtgaccgattacgaaaagaccgctcccgaaaaggagtcgctccccattatcgcaataccgaccacagccggcacaggcagtgaagcgacaagatactcggttataacagataccgacagaaacataaagatgctgttatcgaccgacggaataattccgaaggcagcgattcttgactttgcgataacaaaatcattaccgccgtttatgacagcggcaaccggaatggacgctctgacccacgcaatagagagctacataaacgtcaacgcatcgcctatgacaaagatgtattcgcttgaagcgataaggcttatatcaaagagtcttataccggctgtccttgacggcagaaacgagcaggcaagagaggatatgctccttgccgccttatatgccggaatcgcaatatgcagtgcgccgacagcgcttgttcactcaatgtcaagaccgctcggagcgtggtttcatattccgcacggactggcaaacgcaatgctgttaagctcggttatggaatataaccgcccgtcctgtcccgaaaagttccgcgatatcgcaattgcgatgggtgagaatgtcgagggcttgtcggtaagagaggcaagtatagcagctgttgacgctatcgccgcaatagcggacgaaacgggacttccgaagctgctctcctcgcagggagtaacagaggataagataccgactttagcaaaggacgcattcgccgcaggaagtacggcaaataacccgagagttcctacggtagaagaaatagaaacgatatataaaagcgtattctgataaaagaaaggaagaaataaaatgagatacggatttaaaaacgcagaagaggtaaaagaagcctcccttaaatacaacctccattcatggagcgttcagggcaagctgaaccccgcagtagtagaaaaggcggagggaatttattactacaccgcagacggcaagaagatggctgatatgtcaagccagctcgtaaacctgaatgtcggctacggcaacaaggatattatcgacgctatcaaggagcaggctgaaaagctcgcttacatcagccccgcttatgctatcgactgccgttcaaagctcgccgagatggtggtaaaggtagcaccgaagaatatgggcaaggtattcttcaccttaggcggcgcggacgcaaacgaaaacgcaataaagatcgcaaagcttgtaacaggcagatacaagatattctcaagataccgtgcatatcacggaagctcattcggagcaggtaaccttaccggcgaacccagaagatatacgcttgagcccggtatccccggatttgtaaagttcacagatccttatctgtatcacgctccgttcccctttgagagcgaagaacaggctacagagtattatctcggacagctccgcgaccagatcatatacgaaaatcccgatgcagttgccgctgtcgtaatggagtcggtaacaggttcaaacggtatcatcattccgcctaaaggctacttacagggtgtacgcaagatatgtgacgagttcggtatcatgatggtctgcgacgaggtaatggcaggctggggcagaacaggcgaatacttcgcttgcgaaaactggggcatcgagcctgatatgataaccttcgcaaagggcgttacctgcggatacgctcctctcggcggcgttatcgtaagcaagaagattgcagagttcttcgatacacacaagctcgactgcggtcttacatattcagctcatcctctgggctgtgccgcaggtgttgcgtgccttaacttctatgaaaaagaacacattatggataaggtaaaggaacgtggcaagcagttaggcgcactccttgaggatataaaggcaaagcacaagagcgtgggtgatgtacgttatatcggcctgttctcctgcgtagagcttacaaaggataaggcaacacacgagcctctcgttcctttcggcaaggaccctgagggcattatgggcaagatagtcggaatgttaaaggcaaagggcttcaacacatattcacacgaggcttgcatattcgtctgcccgcctctcattatcacagaagaagagcttgctgagaatatggcgatactggacgaagttctgacagaagtagacaagatggtctgataagcaacagttattacgggaaaggacggtaagttatggatctcataatcaaaaacggtacgatagtttcaccaacggctacattcaaagccgatgtgtgcgtggataacggcaagatagttgctataacggcagatgccggcacagatgccgacaaggtggtagacgcaagcggcaagatggtgctccccggtgccattgatgcacatacccaccttgcaatgcccttcggcggcacaatttcatccgatgactactacgcaggcacaagagcagctgcctgcggcggtacgacaacggtattcgacttcattttacaggatttcggtgaaacaatggtcgatgccatcaagcgccgtgacgcattgtgcgctcccgatgcggctgtcgattacgcattccacgttgcagtaaaggacgtttctaacggacttatcgacactatagaggacgctgtaaactacggcgtatcttccttcaaggtatttatggtctacgatttcggtgtaacagacggcgtattctacaaggtacttgaaaaggcaaaatcctgcggcgctatgatttcggtacacgccgagaacaagcagttaatagacgttctgacggagcgttatctgtcagagggcaagacaagtgcttggtatcactatatgagccgtccggaatttgtcgagggcgaggctgatataagagctatccagcttgcaaagagtcttgactccaagctgtacatcgtacaccttgcaaacaaggaaggtgtgcaggcggttgaaagagcaagaaacgagggctatcagatatatgccgaaacctgtccgcagtaccttgaatttacctccgaggtatacaaaagagcagacggcagaaactttgtatgctctcctccgatgaagggcgaggaaagcagacttgctctgtgggaggctatcaataaaggtcttatcacaacaatcgctaccgaccactgcccgttccagtcatatgaaaaagactggggcaaggacgatttcacaaagattcccaacggctgtgcaggtatcgagaatatgtacccatatatgctgtcagccgctaacgagggtaagataacattcaacaaggcagttgagctttgctcatataaccccgccaagattttcggctgtgacgcaaagggcgctatcgaagtcggcaaggacgcagatattgttatctacaatcccacgaaggacttcactattacaaacgacaagatgcacagcgactgcgaccacactatctgggaaggcatcaaggtcaagggctatcccgaggctacctactcaagaggcaagctcgtattcaaggacggcgagttcttgggcgagcgtggctggggcaagttcataaagagaagctcaagcggtaacttataataaacaaaagcgatacataacaggggagagcaatatctcccctgtatctgtaacagcacaaaggaaaaggagagaatacttatgccattcgtaaaaaatacagctatagaagaaagcgcccgttgccttttatgcctcgacgctccctgcacaaaagcctgtccgagcggcgcacagcccgacagatttatccgctcactgcgtttcgataatttaaacggcgcaaaagcctttgtgaaaaactgcgccgattgctccgctccctgtatgaccgcctgcacaagagcgaaaatagacagacccgttgaaataagacagacagcggagtatatcgcttctgccgcaaaggatgcagagccgaaagtcgatttatcaatgaccttctgcggtcttaagtgcgaaaacccgttcttcttatcctcatccgtagtagcaagcggctacgatatgtgcgcaaaggcgctcgatatgggctgggcaggtatcgtatacaagacgataggctttgcaaagatgaacgaggtatctccccgtttcgatattctgaacaaggaaacgacaccctatataggcttcaagaaccttgaacagatttccgaccatcctcttgaagaaaaccttgctatactcaaaaagctgaaggaaaactatccctcaaagataatcgtttcttcaataatgggcgaaagcgaggacgagtggacagcgcttgcaagactgtctgaggaagccggtgtcgatatgatagagtgcaacttctcctgcccgcagatgacaagtcacagtatgggcagtgacgtgggtacgaatccggagcttgtcacaaagtataccgccgcagtaagacgtggcacaaagctccctgtgcttgcaaaaatgacgcccaatataaccaatatggaaataccggctattgcggcagtaaacgcaggtgcggacggcattgcggcaataaacaccgtcaagagcatcacaaacgtcgatcttgacagcttcgttcctacccccgacattaacggcaagtccgctgtcggcggatattcgggcaaggcggtaaagcctatcgctctgcgtttcatctcggatatgaaaagaaacgaaacgcttgaaaatgtcgagatcagcggtatgggcggcatagaaacgtggcgtgacggtctggagtttatccttatgggctgtacgaatctacaggtaacgacctcagtaatgcagtacggctacagaataatagacgatatgcttgacggtttatcacgctggctcactgccgcaggctacagcagtgtgtcggaggtagtcggccttgcaaataagaatatgaccgatgccggcagccttgaccgtgacaccgttacatatcctatattcgacaaaaacaagtgcataggctgcggcagatgctacattgcctgctatgacgcagggcatcaggcacttgactttgacagcaaaacaagaaagcccgtcttcctcggctcaaagtgcgtaggctgtcatctctgcgctaccgtctgccccgtaaattgcatttcgaaggctaaaagagttgcaaaaaaacactgatttttcgataagaatcttcataaaatacggctgtttcacaaaacagccgtattttagactgtcgataaacctcttgtaaatattaaaaatggggtcgcaggggcgtagcccccgacagggtctaggggcggtagccccagtaatatagcccctttcctggggaaaggggtttggggatagggattgagaacaagcacttttttgataaaacagactttttctacaagatgatacggctgtttcacaagacagccgtatttttcacatctcgtaaacccgcataaacactcacttcaccccacttttttaaaaactttttaaaaattttttaaaatttctgaaactttttcgcccctgccgccgactaccgatatgtaagcagttgataaagagatattcaaaaaaacttttgaattttttaaaaaacttgaaacttttcgagaaaacctcgtgactgcacatatgaaaaagctaaaacgtgcttaacaagcacagaatacatggaggacaaagaaatgaaaaagattttagcaacagtagcttcaattgcaatggtagcagcttgctcaacagcagctttcgcagcaggtgacatcggtaagtctgagacagttacacccggtgcttcttcaggcaacacaaacacaggtgttgtacttacagtagttcccgtagctctcgctgcaggtgctcttacagtaagcggtatcgtattaaagaagaagaacaagtaatttaattacttgatagattcgatattaatcgcatttggcggttaagaaggacaatgttcggatttataaccccgttatcttcggataacggggttttcgttttatataactgttttgcccgccttttttatccgcaaataaaaaatctacaatttttcatataaaatcccccataaaaataaactttaacgtaaaactgccgataaaataagtgtaaaagaatttttaggctaagtttgcccgaagggagctgaaaataaatggaaataaagaatatcagcggcattgtcaatgtctacaacaagattaaacttaacagcggtaaaacaaaggtcgctcccgcagagaagaagacagataagatagaattcaattttgcacgcagcgtagaggcggcaaaggccgaccttgccgcagcggtaaacgaaaatacatcggcggagcgtatcgaggcactttcagacagcgttgcaagcggcagctatgatgtaagtcccgagatgatcgcagactcgatactgatgttctgatgaacacggcagaaaggaacggtaccgatgactatagaaacagccgatagaattatcggatttcttgaaaaatacaacggcgtatatcgtgatatggtagcatttcttaccgaaaagcaggcgaaggtcatggcggacgatctgctctggctgctcgattctgttgaggatgaacaggcgctggttatgaagatacagtcggaagaatccgcaaggtcggctctttttgaggagcttggactcggtgaaataaaagcaaaacagcttatagaagctgtgcccgacgaaagaaagtcaaaacttactctgctttatgacgagcttaccggatatgtggcaaggataaagcagttaaacaacattatcgttgaaacggtagaaaagaaactgtcagttcaggaggaactgatgcggaagacagggatgacactcacagaaacctataacggctacggtgctaagataaagcacacctcagcgccgaagggttttctcggtaacatataatttcggaggataaatgagagcttcatttttaggattagagatccagaaaagatcggtacagatggcgcagaaggcgctcgatgtgaccggcaacaacctgtcgaaccgtgacacagtaggctatacaagacagcgccttgacgtatattccagctatatgaatatgaacgggatatacaccacaaagctcgcccgtctgggactttcgagccagggcgtattcgcaagcggcgtaagtcagacaagagatgattatcttgacaagcgttacagggacaataactgtttcgttgccgaatataatcagcaggcatctataatgagcgagattgaaacggcgctgacgaacttctccgatacatacgagaatgtcggtatggcacatcagtttgaccagttcaaatccgccctgcgtaaatatgcggaggacagtgccgacagagaggagcttgcaagcgttgtaagaaaccaggcatacaatatatgcaagttgtttactcagcagagtatggatcttaaaaaccttgaaaatcagaccttatacgatctgcactcaacgcttgaagacgcaaaccgtataattgaggagatagtcgaatataacaagcagatagtaaacgaatatgcgataacaggcgcagacctcatatacaacggcttatccgttacaggcggatacggtcccaacgaaatgcttgacgcaagaaacaatcttatcgaccagctaagcgagttcggtgatattcacgttgacgataactttgacggctcggtaaagattacaatgggcggtcttacgattatagacggcaaaaagagtaacctttttgttaccggcaaggattttgacgcatacaacgcaaagtacgaggaaaacggcgcagttgtgctgaagctgaccgacggcaacgatatggtgcttgaaagcggctcgataaaagcctacaccgatatgataaacggtaacggcgcatacgcatcaggcaagcagaccaccgactacggtataaaatattatcagtcggcagtggacgaattcgcaaagcagttcgcagggcttatgaacaagctcaacggcggcaacgagtccgacgacagacttatgttcacaagtgcggacggctcacctataaacgcaggaaacataagaatatcggatgcgtggcttaaggacgctacgatgatagcgaagatatacaacgaaaagacaggtacttacgattatcccgtaaaccttgacggcaatgcggtaaacaagctgcttctcggtatggatgacagcgttcagataggcaagggcgactatgaaggctcaagctatgacttcattctcttcctcaacaaccgccttgcacagaatatcgaatttgccgaaaagcagtgcgatatgtataccgatacggcaacctcattacttgacagcagagatgcgataatgggcgtttccgaaacggaggagggcgttaatatgctgaactattccaagtggttcaacgcttcttcaagaatgctcacaacgctcgacgaggcgcttgatactataatagaaaaaatgggacttgtcggcagataagcggaaaggatagattaacatgagaataacacagagcatgaccaacagacgctatatgtcacagcttaatgccgctctcgaaagaaagaatgcctccgagcgaaagataaattcgaccaagagatacaacagagcgagcgaagatccgataagcgccgcaaaagcgctgagaacaaggaaggctatttcaaatacaaacgattatctgggtaacctggaaaccgcagagcagatatataacggcgcagacagcgttctgatgaacgtaaacgacattctcgacaatataatcgaaaaggttacatacgccgcaaacggcacgcagcatgacgaagacgaggaaatactcgcccagactgttgaaactttcgcagacgagatagtaagacttttcaacaccgatatagccgaaagaagaattttcggcggtgtaaacaatgacaccaccgtattcaagattgaaaatgccggcggcaaaaagacgattacctacaacggagttgatataaactccattgacgatcccgataaattcccctactctgagtcgagctttaccgacatcggtacaggaatggtgatagaccccgcaacaggcagggtagatccccagtcggcacttcccgtaaccttcaacggcgcaaagataacaggctgcggcaaggatgatgaaggcgactccaagaatataatccagataactctcgatgccgcacaggcggtaagagaaggcgataaaataaaggctatggactatatcgacaagctgagagcggctcagacaagcgtcagcgttgctcacgccgacataggtaacaagcaggaatatatcgaatataacaaaaaccgtctcacaaacaatatggaaactctgcttgaacagcagaacaaccttgaaggcactgatatgggtgcggaaacaaccaactggaaaacgcttgatgcaatttacaacgtttcactccagtttgcttcatcggtaattccgatgagcatattccagtttatttcataagctgtcgctctttatgggaggagcgaaaaattaaaatggggaggaagatacaatgaatccgaatttgcttaagattacgagcataccgataagcatcgaggtaaatgtcacaaacggttcgttaaaggcaccggaggacaaggagccgctcaagatcgacataaaccgcacacccggcggatataagatggagagcagacctgcaaagataaacattgatacttatgcggcacgttcaagcatgggctacggcgaatacaatgcctccgacttcaatcagagggaagccgacagaggtttcaagatagcctatcagggagtagcaagaatagtaagcgagggcgaccagcttgcaagaggtgtttcgccgtcggagattgccgcacagcagatgcgtgcaggcgcaactatagaaacggcaatagattttctgcctaagggcggagcggacgtatcctttgataagggtacgctcagcataaactacactcctaccgatataaatatcgactgggagaatataaattcctccgttgtcgagtttgttcccggcaatatcgaatttatagtaaaagaacatcccagagtggaaatagaatatgtgggcgagcctatatacgttccgccgagtgcaaatccggcttatgttgcgcccaaaaagctcaacaccaagggctgataaatcagaaatctgaaaggaaacggtaaagatcaatggagataatgaccagagatttcggcaaagtaaatgtagacgaaagcaagatattcaacttcccgtccggactttttgcatttgaagaatgcaggcagtttgccctgctcagcccgctcggagatggcgtataccctatgtggctgcagtctaccgaaaatgttacgccgtgttttatcgttttcgacccggcaataatagacggagcatataagataacgcttaacagctccgaaaagaaactgctgaagatagacgacagttcaaatgtcagatgcttatccatagcagtcgtaccggaggactacaaaaagactacggtgaatatgaaatgccccatagttataaactcagacgagaatctcgccgcacaggtcatactccccgaaaagtatgagatacgtctgccgatatatgtggataagggggcaaagtaatgcttgtagtaacacgaaaaacagacgaaagtcttacaatatccgacaacattgagataaccgtccttgaaataggcaaggacagagtcaagataggaatctccgcacctaaggatgtaaagataatccgcaatgagctgagagatgcgcaggatatgaataaagaatcatcgcaggcactgcccaaggcggctatggaagccctgctcggtatgaaaaaagactgaaaggaagagataagatatggcaacaacaaacagcagcagcgtattaagattcagcggtatgaactcaggtcttgataccgaatctatcgtaaacgctatgacagcggctacaaaactgaaaatcacaaaacagaaccgtaaggcgataacgctcaaatggaaacaggaagcgtatcagggcataacaacaaagctcacagacttccagaacaaatatcttgatatgctcaattccaaggtcaacctgaaaagtaaatccacctttacaaaatacggcgcaacggtttccacgttaaacgcagacggcatactcaaggagggtactcctgccggcgtatctgtacgctcaggcacaaacgcagtacccggtacatataaagtaaaggttctccagaccgctacacaggcaaaatatcaaggtagtgcgatggacgcaagctcgcttgacttatcacagtacagcgacgcttcacagaactattcgttcaacataacagtaggcacaaagtcaactgttataaacttcaacggcggcagtgccgacagtgtacgctcgcagataaacagccagctcaaagacgcatacggttcttcgaatacaagcggtcagggtcttgtttatgtaaatgacagcggtaagattatatcctccgacagacaggcaatgtcgcttaccggtgttgcgaatatgtacggcaacttcacgtttgatttaaacacaagcataagcgcaggcacaaacaaattcaatataaccgtcggtgacgaaacagtaagcgtttcgtttgacagctacacggccgactatttcaaccagacagacagcacaacgctcggcgctcagaaaagggaagaattccagggcatttattttgacgagcaggctgaaaagctgtataatgcggcaaaggcagacggttctgtagattttgacgcattgaaggcgcaggcttacgataaggcaaagcaggcggattacgacaaaaagttcgaaagcgaaaagacaaaggcaatggccgagtatgacgaagagcttaagaccaactatgacaacggcatagcagacggctctatagcagaaggcacgagctttgaggactggaaaaaaacgcaggctgaatttgacgagaacgctttcaagacagcgtttgacgagcagtacgcaaaggactttgacgaaaccgcattcagagcgcagtttgacaaggattatgacgagctttccgcatataaggatacgcttaatgccgatgatttcaagctgtctaacgaggatcttgccgcttatgcaaacaagcacgagctgaacaaggccataggcaaggtaaagctgtcggacggaaccggtcttaacatagacgaaaacggcaccgtaacagccgcaaacggcaagaagctctctgtagccgcagaccccgcaacgaagaacacattcggtgcgtctacagccagaacgactacggcacaggtaacaacagccacaacgcttaaggatttaggtgttgaggacagtgcgaccttcactataaacggcacgaagttcaccttcacatctgactacacggtagcaaaaatgatgagcgaaattaacgccagcaagaacgcccacgcaactatgacgttcagcacgcttacaaacagctttgctctcagctcatcgggctacggcacatctgcatctattgaattctccgcagaaaacggaagtgcgggtgcagagcttctcagcacactcggtcttacatcaggtacgctgacgcagggacgcaacctgcagcttgaagtaaacggcgaaacaatagaaacctcgtcaaacagcttcactgcggacggcacaacaatgaccttcacatccgccgcacagggcgcagagttctcttacgaggtaaagaaggacaacagcagtgcgatagacgctataaagtcattcgttgaagattacaacaagattatcgaagaagtttacggtcagcttgaccagaagccgaactccgactactacgcacttaccgatgacgatattgaggatatggacttatccgaaaaacagcaggagaagtgggaagaaaaggctaaggaaggtctgctttacaatgacagcacagtttcgacagtaatgcagaagatgcgttccgttctttattcaacggtaaagacagcggacggacagacattcagcctgttcagcatgggcattacgacaagcgatgactggggcgaccacggcaagctcgagctggacgaaacaaagcttgaggcggcatttgagcagtacgccgaccagatagctgacctgttcgcaggtacaactgtcgatgaaaacggcaacaccgtaaagacaggcataatgcacaagcttgatgatgtgcttacgggtgcagttaagacgaccggtgcaagaaaagacaagggtacacttgtacagcttgcaggtacaaagacaggtacatcggctaccgacaactctatatatgaccagttaaagagcatttcaacgcttatctcgtcacttgaaacaagatatgagaagcagcaggacagatactggaagcagttctctaatcttgaaacaatgatgggctcgctcaacagccagaccagctacattcagcagctgatgcagttctgataaaccctaaataacacaaagcgtaaggaatacgatatgaataacgcattttctgcatataaaaaacagtctgttacaacgctcacacccggtgacgttgtggtaaagctgtatatggaggcggaacgtcagctcaacagagcgtcctactacattccgctcaagaattacgaggaaacaaacaaggctcttataaaggcgcaggacgtaataaacgctctgcgttcctgccttgatatgaaaatacccgtttccaaaaatctcgactcgctgtatgaatatttcaaccgtgaaatagttgaggcaaacattaaaaaggataaagccaaggtagatgcgctccttcctatgatagccgagctgcgtgaagcattcgccgagatcaacagcatgagcagagaacagatggaagcgcaggaaaaagcggcgcaatccgcaatgcaggagcaggcttaaatcacacggtgcttaacccccaccggaaaggaatccgatataatgaaaaaggcagatgcacaaacactgcttacgctcatggatgagctgacggagcttatgaccgagtatgaccgccgcacagacagaatggttacaaatgatcttgaagtcattcagcaggtgcttttatcccgtaatgagcttatggataaaatgcgtcaggtaaagcaatctataatggatattgcaaacgctcaggttcctgccgagcgtgagcttatccgtgatatactgaacaataaacccgtcaccgaaaacctctcgtatgagttaagacagttacagtcaaaaatgcgccatcttcacgatataaaaagtggaattgacgaaaaggataaaaaggtgaccgctgttgtccgccaaagctacgaggatgtaaaggcagagcttgaatcgctgaaggtcgataaaaagaaaatcgactactacagtagcgttaagctgggcggaaagggcagaaccttcaacacaaattcataacaccggaaagcacgaccgaaaatcgtgctttttctttttgcaacgccgctccacaccgcccaaaaaattttttaaattttttcattttccctattgacaaaacctataagtttagtgtataatacaaacataccaaacagataggttttgagagtaagaaaacctatccgagtgtgaataaaagaaaggaggcacatttgatgaatataatcgcaaaagccatcaggcacaatttcaggaacggacgaatgtgccgctgtatagcataacgtaaaccgtgcttaaagcacgcccttaagaaaaaaacaaaaataagaatttgacaggctataagccgattaaaagaaagaggtatttacaatgagctatacatacgataacaactacagatttgagacaattcagcttcacgcaggtcaggaaactcccgaccccgcatcagacgcaagagcagttccgatatatcagacaacatcatacgttttcaagaacagcgcacacgctgccgcacgtttcggtcttgctgacgcaggcaatatctacggcagacttacaaactcaacacagggcgctttcgaaacaagaattgccgctcttgagggcggtgttgccgcactcgctacagcatcgggcgcagccgctataacttacgctattcaggctctcgcttacgcaggtgagcatatcgtagcacagaagacaatctacggcggcagctacaacctgcttgcgcatacgcttccccagtacggcatcagcactacattcgtagatgcacataaccttgaagaagttgaaaacgcaattcaggataacacaaaggctatctatcttgaaacgctcggcaaccccaacagcgacattcccgatattgacgctatcgcagagatagcacacaagcacggacttccgcttgtaatagacaatacattcggtactccttaccttatccgtcctatcgagcacggcgcagacgttgtagtacactcggctacaaagttcatcggcggtcacggaacaacgctcggcggtgttattgttgactccggcaagttcgactggaagaagagcggtaagtacgctcccatcgcagagcctaaccccagctatcacggcgtatcatttgtagatgctgcaggtcctgccgcatttgttacatatataagagctattcttctgcgtgatacaggcgctacaatttcacccttcaacgcattcctgctcttacagggcacagaaacactctcattaagacttgaccgtcatatcgagaacacaaagaaggtagtagaattccttgctaatcaccccaaggttgaaaaggtaaatcacccctcactgcccgaccatcccgaccacgcactttatacaaaatatttcaaaaacggcggtgcgtctatcttcacattcaacatcaagggcggacaggaagaagctcacaagtttatcgacagcttacagatattctctctgctcgcaaacgttgcagatgtaaagagccttgtaattcaccccgctacaacaactcactcacagctgacagatgaggagcttgcagaccagggtataggcagaaatactatccgtctttcaatcggtacagagcatatcgacgacataatcgccgatctctcccaggcatttgataaagtatgattgtgtgccgaagcggcacagcaaattccgcctttgatacagtttctgctatgcccgacataatgaaacagcggaatttaaaacaaattattttgatttgaaagaatcgttcctccctaaattgacctttcaattcagtaaaaacaatcacagccataaattatgtgtgatattccgaataacgagccgacagttaaaatgctgtcggctttcgttgatattcagaaaggattaaaatgaacaataaggcagtaatcgcaatgagcggcggcgttgattcaagcgtggcggcttaccttatgaaacagcgtggatttgattgcatcggcgttacgatgaaattatttgcaaacgaggatataggcatttcaagagagcatagctgttgttcgcttgacgatgtagaggacgcaaggagcgttgcttactcgcttgatatgccgtattacgttttcaatttctccgacagatttgaaaccgatgtgatagaccgcttcataaacgcatacgagaacggcataactccgaacccttgcatagactgcaacaggtatctcaagttcgacaagctgtatatgagagcaaaagagcttggccgtgactatgtggtgacaggtcactatgcaagggtagaaaaggacgaaaacggcagatttctgctgaaaaaagcgctcgatgataccaaagatcagagctatgttctctactgtcttacacaggagcaattaagccatacgatatttccgctcggtgagatgagaaaatcgcaggcgagagagattgccgaatcgcagggatttataaatgcccgtaaagccgacagccaggatatatgctttgtacaaaacggcagctatgccgactttatagagcagtacacaggcaagaattacccggacggcgattttctcgatacaaacggcaacgttatcggcaggcacaagggcgttatccgctataccgtgggtcagcgtaagggtcttggcatttccgctcccgaaccgctttatgtaaaggcggtgaaccctgtaagcaacaccgtaaccctgtcatataacgacgggctgtacagcagtattgtaaaggcaggagatataaatcttatctccgtacccgaaataaagggcgagatgcgtgttaaagccaaagtccgctaccgccacacagagcagtgggcgaccgtaacgcaaaacggcgaaactctcacggcggttttcgatgagccgcagagagcggtcacctgcggtcaggcactggtgctgtatgacggggatactgtggttggcggtgggactataattgaggtggaataatattcggagttttcataaaggcgaaaaacggtctgagaacctttacctctcagaccattttaatataaagcgacaaataaaatgcttgttaacacatggaaaatatgttataataacctcagacataaaatccgcaaaaagtggattttaccgtgcaaaagcacggcttgcggtacaccgcctgtctgagaacattgaaacacgattttattttgcctgataggcaaaatttgcggcatttgccgctatgtgccttgatggcacattaaaatcgtgttataataaaatcagaaattcagatgttacatttctacataagcaggtaaaaagatgaatgaacttacgcttgaacaaataatatcattagcgacaaatacagctaatatcgttatgtctgcacacgcaaacaaacagtgcctgaaaagagagataaatgcagaggatattcttgaaactttactgaaaggatcaataatagaacaatatccaacggactttccttttccgagctgtcttatgctgggttttacaagtaaacacaaacctatgcatgtttgctgtgcaataggcgataataaattatggattattacagcttattatccaacagaagaaaaatgggaaagcgactacaaaacaagaaaggcggtaaaaaacaatgacttgtttattttgtaaaggcaatatggtaaacagtacaacaacattcacagcgaatcttgaacacggtatagttattgtaaaaaatgtgccgtgctttaaatgtgaccaatgcggtgaagaatcgtttccgtttgaagtcacagtccgacttgaaaaaatcattgacagatgtaaagatgcgcttaccgaaatagcagtagttaattattcggcggcgtaaaccggcaaaagctatataacaaaaacggtctgagaacctttacctctcagaccgtttaatgtttcatataaaaaataaatctgtataaacgtcaatagggtgcgctgcaagcgcccgccggtaacgtaaccttcgcaaatcactaacaatcagaacggcgaattgtcagcggcgacctgccgctccatctgggtttcacggacgaacattcccatcttttcgtaaaaatgacgtgcgctgtcgttgccctcccagacgttcagagtaactgtgtaacaacctgtctgctttgcaaaatccattacatagtcaaaaagcgtagttcctatatgccgaccccttgcgttgctgtcaacacataagtcatctatatacagcgtttttatatctgtcatatttgttgcaaaagcaggctctttgagtatacagaacgcatatccctgcaccgtatcgctgtcatcaacagccacaaatacaggtgtcttttcatcagcaaatatatccgacagctgattttccgtgtactttaccgtaccgtgtatgaacaaatcgggacgcagatcggcgtgaagctccagcacctgagcaagcaactccgtaacacgcttaatatccttgtcctgcgctcttcttactcttatcatcttatgcctttactatcttgcagtagctctttttacccttcttgattacggcaaattcgcctatctctatcatagccgcagggtcggtcaccttttcatcgtttacgctgataccgccgcctgttacgtttgttcttgcctctctctttgacgggcagagctttgatgcaacaagagcgtcaagaataccgatcttaccgtcgtttacaagctcggcaggcataaccgcagtaggcatatcgccgctgacgcccttaccgccgaacagttcctttgcggcggctaaagccttttcagcttcttcctcgccgtgtaccagcttagtaagctcgtaagcgagcatttccttagccttgttgagctgtgcgccctcccagctttccatctctcttatctgttcaagcggcaggaatgtaagcatctttatgcacttcataacatctgcgtcagcaacgtttctccagtactggaagaattcaaacgggcttgtcttttcggggtcgagccatacagcacccttttcggtcttacccatcttcttgccctcggaattcaagagcagggtaatggtcattgcgtgtgcgtccttgccgagcttctttctgataagctctgtaccgccgagcatattgctccactgatcgtcaccgccgaactgcatattacagccgtaatccttgtacagcttgtagaagtcgtagctctgcattatcatatagttgaattcgaggaacgaaagacctctttccattctctgcttgtagcactcagcactcagcatcttgtttacagaaaagcaagcgcccacctcacgcagtacgtctacataattaaggctcagcagccagtctgcattgtttacaagcagtgccttgccgtccgagaaatctataaaacggctcatctgctttttgaagcaggcgatattatgctcaatatcttcctttgtgagcatctttctcatatccgtcttgccggaggggtcgcctatcatacccgtaccgccgccgagaagcgcaataggcttgttgccagccatctgcagacgcttcataaggcacagcgccataaagtgaccaacgtgcagagaatcggctgtcgggtcaaagcctatgtagaacgtagccttgccctcatttatcatcttgcttatttcttcctcattcgtaacctgagcgataagccctctttcaataagttcttcgtaaagtgtcattttcttcttcctttcggtttattttattattttcaagacaaacgtctgtgtgtccgtttacaatatcatgctgtcatctgataggagcattgtttacccatttgcactaattcccggctctcttgccaaagggagctaaatgtgatagttcttcgcacaaattttcaacaaacctcaaatcaatcacgcactatcattaaaccccgaccgttccgctatcctgcgaaaatccgcaacgttatcaaaggtcggaacagtcagcggcgacccgccgcaaaatctgcatagcaccatcgctaaactccgaccgttccgttatccctcaaaaatccgcaacattatcaaaggtcggaatttactgtagctttcagctacagttgttcggctaagctgtagatgagcttttctgtcttttcccagccaagacacgggtcggttatcgacttgccgtaaaccgcatcgtctgtgctctggcttccgtcctcaatgtagctttctatcataagtcccttgacaaagccctcaagatccttgctgtgacgacggctgtggagaatctcatttgctattcttacctgctcaagatacttcttgcccgaatttgagtgattggtatcaactatgactgccttgttctgaaggtcctgcttgcagtaaagctcatagagcagtgacagatcctcgtagtgataattcggtatggtttcaccgtgcttgtttacagcaccacgcaggatagcgtgtgcaagcggatttccgcttgtgtgcgtttcccagcctctgtatatgaaagtatggctcgcctgcgccgcacggatagaattgagcattaccgacatagttccgctcgtgggatttttcattcctacaggaatatcaagtccgcttgcggtaagcctgtgctgctgatcctctacagagcgagcgccgaccgcaacataagacaggagatcggacagatagcggtcattttcggggtacagcatttcgtccgcacaggtaaagccggtctgctctatggcgtgaagatgaagctgtcttaccttgataagtccctcgagcatatcctcgtgctttgtggggtcgggctgatgtatcatacccttatatccttcacctgttgtacgtggcttgttcgtgtaaattctcggtataatcagtatcttttcctttacctgctcctgaacgggcacaagccttgaaatataatcaatgactggctcttccttatcagcggagcaaggtcctattatcagcaggaacttattgctctttcccgtgaatacatcggctatttgcttatccctctgcgcctttattttctttaccttttcgcttgcagggtactttttcttgatttcctcaggatcgggcagacgtaccagtaaatccatgctcattgtctttcgacctccaaaaaataaattttggtcttgtatcttctggtggaaaattaaaaagccctccgtgcaaaaatgcacagagggcgaattatcgcggtaccacctcagtttatccgtgcgtttagaccatttcacacgaacctcaaaagctataacgtagctaccgttcccgaaggacagctcaggggtgtatcttcacattaaaacgtctgccgtttcacaccgaccaacgactctctgaaagcacgtttcacgctactttttcccttcaaagcctttaatatatcgctttaaaccgattgtagcatatccttgctgttttgtcaagagaaaatttcgtttaaattttttgcttataatcccttacgcaacctttgagtaatcaataattgaaacttcctgcatcatctttctacaatgttctatgatttcttcaatcttttttaccacatcacctgtataggtcacttcattacactgagtacatttataacacggaacatttcttataattataaggcaattgcctaaatcggtaacactggttgtaaaacccttttcggctcttgagccacaatttgcacataacattatcagttcctccttgttttgaaattatcttgccaatgctgttcatcaggataataagcagtaatgagatatatataatcttcattgcaacttacaaccacatgaatatatttgcctttaagctctactcctaaaatcaggcagcttggaaacggtttatcattttcatattgttcaataattttgccgttttctacacagcaaataacatcatcaattgttatattacgctcaaataaccttattcttgcatgttcggttatcatataatgattagctgtgttcaattgtcgaagtacatctatacttatcattaaatcaatccttatgccagattctttatctttattataccaccgatatacaaaaaattcaagcggtcacccgccggtaacgtaacctccgcaaatcgccaaccgtcagaacggcgaatttgatgcggctcacagccgcccgccacccaccgtttataaatcgccgcttcgtgtaactccgccgtatcgccatcttttgctgtattgcaacagcattaaaggctgaacttgaagtgggtcacaactgcaaaaaaggataccgcaaacttaaaccggttgcagtatccttttaattatacttgaatctgtattaacgtcaatagggtgtgacctcagtcacccgccggtaacgtaaccctcgccattctccaacaatcagaacggcgaattgtcagcggcgacccgccgttagttcatgtattcgccgttgtattcgagaagcgttacactgtcaacaccgtcgatagccttgaatcttgaaagctgtgttgtgtcattatttgcagtctttatctcgatagtcagctcaatgcggtcgtttatctgcgtcttgttcttcagcttgtacttgagcgttccgagaagtgcgttaacattgctatcagcgtccgtaacgtaacgtacaacaagaagatagcaacggcgctccttcttcaccatagtaagaattatgtacagtgccgcaacaaaaacagtacctatgattgcaacaaagtaaagtcctgcgcctgccgtgatacctgcgcctactccccagaataagaagcccacatcgagcgggtcctttatcgccgagcggaatcgcacgatagacaacgcaccgaccataccgagcgacagtacaaggtttgcactgatagtcattatgataaacgccgtaactaccgtgataagcagtacaagtatgttgaaattgtcgctgtagacaactcctctgtagaacatacggtaaacaagataaattattgctccgcacagtgtagctgtgagcagtgcgagcagtattctcggcagtgacaggctctcaagctgtgccgtaatatcaaagctctgtcctataagggataataagtcgtccccagtgctttccgcaagtgcggtcagatgttgtaacatttttaattttcctccgatcagttttccatgttgctgtttatgtccgcatattaaggcttgtcagcttgtcatggcacaatataaatttagataccgagtcctgcctcagttcgataccgccgagcagatccattagataagacggcagataatcgtcatactttatctctataaccgccgtgaaatcctcaacaggcaggtatctgacgctttgcgacagcatatcatccgaaaaagctcccgctttgaatccgctgtcaatggtgaatcgcacattgccctcgggatttataaacgcctgcctcttataatccactataacagacgggcggagcagagccagcgaattgctgtaagatgcgtcctcaaggatagtgccctcatattcaccgctccatacaaaagaataatctcctcttaatatagagtaatactgctccgggcttatccatatcccacgctttgacgtcatatccctgtccttgtacttgcattcaaaatgcagcagcttgtccgacaggtcataggttcttatacggtatttcttacgggtatccgcacctatcagcttatcgttataagccgtccggtacacatcgtcgagatatacgctcgttatgcgataacaaccgttctctccgtgtgcgtcaggcgccataaccgcagagaaacgctccctcagtatttcgcactgtgccgctgtcgcaggaaacttgtattcgtgccgcaatgcacgctctctgtatatcattacgtccctccccgcaatcaaaatcgtataatcgcattcatcttaaataaacgcagtatcagtatagcatatccgcccgtaaatttcaacatatttttctcatattcagtcttattttttgttgtaattttatgtaatgtaaaatctgctatcgggttttcataaaatcgctttacctgttgaaatggtaattgtaaaatttcattcggagtttttcaccgcctgttaaaaatagtttttcttcttattaacacccgtacaagctcattttaagcggagttattcacatattcaacggagttttcaactaaaaaaacaaaaaactgaccaaagagcagttaaaaacgtatatctttcaacattttcaaccgtcacacctgttgaaaagtgggtaaatcggttcattataccctttgtaaacagcttacagcttatgtaaacttgttacaatatacatactgacaatatgataactctctgttttttcgaaaataaaaacaattatcgtttattttcctttttgtgccatcttataacattatttgtaaatcacatttttcaatttcaaccgcccacggaaaaatcgtatttttagtttttatcggaagtttaaacagtttcaacggagttttcaacagtttctgaccgattttcaccaagacaagttgaaaacacagtagttttccacacttttctgttgaaaactaatatccgcagcgtataatttaacatatttttcctataatacattttgtaatcttaaaatgttgaaaaaaggagcgtatataattggtaaaagcggttaacaaactggtgcttgaaataaacaacaccgaaaacgagtattttgaaaaggcaattttctacatccgccccgaaatgtcgtgcaacagcaagctgagaagtcaggcacagctttaccttaacaaaataagccttgaaaaaccgggaaaattccgcagtaacggcaagctcccttatataataggtatagctgccggcatttcggcggcgctcataattaccgccgtactgctttttgcaggcattatatgacagcctcccgtactgatattccttatgtaaagttattgtaaaatctgtcaccggattcttttttctgttgacttgcaaagtaaaaaaatgttatactgattatgaccgtttttaatatactgacggtatgaaaaatgtatggacagctttaacggaagaaaggatatttatgaaaaagacaaagatagtatgcaccttaggtcctgcaacagataatgacaacgttctgcgtgaacttataaagagcggtatggactgcgcacgcttcaatttctcacatggtacccacgaggatcacaaaaagcgttacgagcaggttgaaagaataagaaaggaactcagacttcctataccggctattcttgacacaaagggtcccgaggtaagaataaagagcttcaaggacgataagcccgtagagcttaagacgggcagtgaatataccctcacgacagaagatgttatcggtgatgaaaaaagagccgccataaactatcccaatcttgcaagcgacattgaaacaggtgttactatccttatagacgacggcctgcttgaactcaaggtaacagagattgaccgcaaggagagcggcgacgatattcgctgtaaggttatccacggcggtattttaaaaccaaacaaaagctgtaacttccccggcatacatctttcaatgccctatctcagcgagcgtgacaagagcgatctgcttttcggcataaagacagggtttgatatagttgcggcaagctttgtgacccgtgacgaagatataatacagataagaaagctgcttgacgagaacggcggcaaggatataagcataattgcaaagattgaaaaccaggacggcgttgacaatatcgacgatattctccgtgttgctgacggtataatggtggcaagaggagatatgggcgtagagattccgtttgttgaaatacccagaatccagaaagaacttatccacaagggctacaacgcaggcaagcaggtaataaccgctacccagatgcttgattcgatgataaagaatccccgcccgacaagagcggaaacgacagacgttgcaaatgccatctatgacggcacaagcgcaattatgctttcgggcgaaaccgccgcaggcgcatatcctattgatgcggtaaaaacaatgaaggctattgctgtaaagacagagcaggatatagattaccgcaagcgtttcttctcaagagaaaacgagggtgtaccgaacgttacaaacgcaatagcgcacgcaacggtaacaacctcgatagacctcggcgcaaccgctatacttactgtaacaaaaggcggacgcacagcaagaacactgtcaaagttccgtcccacctgtccgataattgcagctaccacaagtgaaagagcacagcgccagcttaatctttcgtggggggttatcccgataaagtcggaagaaatgagcgacagcgactcgctttttgaccacgctgtaacaagagctatggaagaaggacttttaaaggacggagatcttatagttatcaccgcaggacttccgctcggagtttccggtacaacgaatatgatgaaggtgcatattgtcggagatgttctgcttaaaggcaagggtgcgaccgcaaaagcagtgaccgcccccgtctgcgtatgcaagaacgaggaggacgcaataaagctctgccattccggtgatattcttgttatccccaagacgagcaataatataatgtctgttttgaagagtgccgcaggaattgtagtagaggatacaaaccccgactgccatgcggctgttgtaggtcaggctcttgatattcccgtgatttacggcgcagaaaatgcctcaaacgttttaaagagcggtgtcacagttacaattgatgccgaaaaaggcctgatccgctcctccaacaactaagcggcgggtcgccgctgacaattccgacctttttaaaggttggtgcgttattaaggttagcaaaacggtcgggaataaacgttgaaagaggaaaattaaaagtttcgattgacccttttcaaagggtcacggatttttaaggcggagccttaaatcgctttccgcagaaagcgaaatttcttaatacaaggcgaatttttgaagggtcagggaaactttttgcaagataaaaagtttccctgaacttataaattgttgctttttatcctcaaaaaaggtgccgggggcacgttttttgacagcgggcggctgtgagccgcttcaaattccgtctgcggcaagtcgccgctgacaattcgccgttctgacggttgttgttcagctaaggttagttaaacggcggagttacacaaatcaataaaacagataagcggtcacagtgcaatgctgtgaccgctttttgtattattatattttaactgtcatctctcctcaccaaccttcccaaaaccgcactatcactctcgctctgcaccaacactgccggaaacactttccgcattgacaaggaattaatattttcgtgagtgtatcagtgcaactaatctaacattgactcttcaaaaaaacgccactaacctgagatatatgtactaatatgcggacgtgtagcgttaagcgtccctgcattgacaggatatacaatgttcaggtggttattcgagtttggggaaaggggtttggggataggggttgagaacaagcactttttttgaaaaaacatactttttctacaagctgaagcacccccgttcaactgaacgggggtgctgttattatttattctgccgattaaagctcgataacaatatcattctcagcctttaagatgctgtcaagaatgagcttgccttcaatcttttcaccgtttaccgttacgctcttaacgccgtgttcactgccgttcgggttcttaacggtaacattcagcttcttgcctctgaatgtcttcttcattgtgtattccttccactctgaagggatagaaggatcaatcacgataccctttgtttcggggttaagaccgaggataccttctgtagtacctaccataacggtagaagctgtacctgtcagccagtgtacatgagcacgacctgcaaaggggctgtccttaccttcaacgaactgaccgtaaacatagggctcaagaactctgtgctctgcgttttcgttgtaggttgcgggagctgcttccttccagtacttatatgcacggttgccgtgaccgagctttgactctgcgagtatcagccaaccctgaggctgtgagaagatacctgcattttcctttgtgcacttgttgaagcactgcataagagcgccgtcaaagccgtgcttaacataaggaggatacataaccattgcgccgtaaggagtgttaagctctctttctacgctgtccatagccttttcagcctgttccttgcttgcaaagccggagataactgaccaagactgaggattgagccacattgaagcctcggggtctgttctctgaccgataacagtgccgtcttccttgtagcctcttatccatctgtcctcgttccagcaagctgacagtatctcgtcgagcttagcctttacttcgtcaaggtactttgcgtactctgcgtcgttcttttcaagagcatatgtctttaagatctttattgcgtaaacaagctggaatgctacgaatgtagattcgcccttcttgccaagacgtaagcagtcgttccagtcagcgtgaagacctgcgggcataccgtggttgccgaggtggttcatcgagaagtcgatagctctctttaagtgatcgtatactgtgccggattcgccgtcgtttgcatacgagataacttcgtcaaggaatgcgtggtcgccgctttcggagatgtacttgtaaactgtcgggaacagccacagagcgtcatctgcacggtatgaggggtgacctgtctgcttagcgtatacgctgttttcatcgttttcgtcggggtggttttcctgtcctgccttgtgatcgtacttaacgaggggcagacctgcgccgtttgtaacctgagcagagagcatgaatacgatctgcttcttagccatttcgggtgcaaggtggataacgccctgaatatcctgtacagtatcacggtagccgaagccgtttctcagaccgcaatactggaatgatgcggctcttgaccagatgaatgtgatgaagcagttgtaagcgttccatacatttaccatattgttgaagtctgcatcgggagtatttacctgcagattgtcgagctttgagtgccagtagttcttaagctctgcaagatcctcctctacagcgttctcattctcgtacttagcgatgatagcctcaatttcagcctctgtcttctgaccgccgagaacataagtgagtacctttgtttcgccgggctgtaaaacgatgtcgctctggagtgcgccgcatgagtttgtgttgtagtttaagtcgccctttaagccttcttcgatgcccttggggttgttgtatgttctgtaagagcctacgaaagcgtcacgatcgccgcagtaagcgtcaaccttagctgaagcaagacctaagaaacgtccgctgttggggttgtatatctcattctgcatctggtggatatacttgttcttgaagtatgtttttgtgatgaacagggtgtactggaggttgacctgatcctgctcgtagttgggatcgttaacgaactcgcagtagcctgtaacgctcagcttacggggctttgtgtctgtgttggttatctttgcggcccatacttcataagtagcgtccataggaacgtagtatgtaacctcagactttatcttcttgtactccgaggtgatgacagtgtaggctgtaccgtgacggcactcgctcttgtagctgtcgaggggcttgcatacgggcgcccacgaagccgaccagaaatcattgtcctcagcgtccttgatatatacatatctgccgggctgatcgttgggaacagcattgaaacggtaacggataacacgtccgtttgcaccggatttaacgaagctgtagccgcctgcgttgtttgaaatgatagcaccgtattcgggtgagcctaagtagtttgcccaagccgacggagtatcgggtcttgtgatgacatattccttgttttcaaggtcaaaatgtccgtaattcatcagaaagtcctccttgatattatattccccgtaaacaagctgtttcacgggttttaaattcctttgcgtaacttcattatatcaggaaatcgttttcatttcaagggcggtattgtgcacaaatttagctgtctttttttgtgcagtattgacatatcactgattgacgcccgacagatgaaatttatctgtgaaaaatactgaaaattaccgctcattcccctgtttacagtattttaacattgattttaccgattttaagtagtataattattcaaagaaaaataaaaagaacaaaagacaagaggtaaacttatgaactgggcaattattgagcaggtcgttataatgggtctgctcgcaggcgtcggcatactttgccgtaagctgaagctgcttgacgatgcctgcaccaaaaagctttcaaccgttgtgcttaatttcgcaacacctatggttattctggtatcctatcagaagccgttcgaccccgaaacgctgaacacactgcttttatcattcctcatagcgataataagctatgtcatagcgtttatacttgttccgttgataatacgcagtaaggacaaggagggccagctgatagagcgtttcagctgcctttactcaaactgcgcctttatgggcataccgctgatacagggcgtatatggcactgagggcgtattctgccttacggcatacgttactatgttcaatctctgctcgtggacgcacggagttgttatgatgaagggcggaaagccgaactttaagcagatgctgaagtcgctgttatctccgagcatcatcgttacaataatcggtattatcctgttcctttgcaacttcactctgccgaatgttattcttgaagcggcacagcaccttgcaaatatcaacacaccgctcgcaatgataatagcaggctcaactatagctacggtaaagctgctccctgcgctgaaaaagccaagactttactacacctgctttgtaaagctgttcctgcttcctgcactgcttaccgttatctgccttgtgtttaagatagatcagaccgtagctggcgtaaacatactcgctaccgcctgccccgccgctgctatgtgtacaatgtttgccctgctttatgacagggacgcaggctacagtgcggaggtatttgcggtaagcaccatactttcgatggtcacactgccgcttacactgatgtactatacggcgcttgcaggggtattcatgtaatttaagcgttataaaggagcatatctcatgacaaatatcacaacagaaaactgtgccgcattgcttgatatactcagggagaagaatccccttgtacattgcatcacaaactatgttaccgcaaacaccgttgcaaacggacttcttgcggcaggcgcatctcccgttatggcggacagcccgcttgacgctgaggatataaccgcaaaggcatcggcggtactgttcaatatgggtacgctcagcaaggacaggcttcgtgcaatgctgatttccgcacagaaggcggcggatatgtcaaagccgatagtgcttgaccctgtaggcgcaggctctacagataacagattacgaagcactatgcagcttctgcgtcagttcagattcgccgcagtaagaggcaacgcttccgaaatatccgcactgctttcgacaagccctattactatgaaggcggaaaagggcgtggacagtgccgaaacaacgcttgaggacaaaatatcgcttgccaaaaaagcggcaaagcgttacagctgtaccgttatggtaacaggcagtaccgatgtcatagcaaacggcggcagggtagcgcttgtttcaaacggtgtgcctatgatgagcaagattaccggcacgggctgtcttgcgtccggacttgtagcggcgctgtgcggctgtacagaggacagctttgaggcggcggtaacagcggcggcgcttatcggaacggtaggcgaaattgcaagcgaaaccgcaaagggtacaggctcgctgtatgtcggtatgcttgacacgctgacgaatattactcccgacattttcacacaatacgcaaagatagaaaattacacaggagaataataagatggaagacctggataagatccgtgagtttttcgcaaaagaccgtttcgctacggaaaacggcgcagtgattgaagctgtagggaaaaatacagctacagtcggtatgaagatagaatcacgtcatcgcaatgccgcaggaatagtaatgggcggagcgattttcacccttgccgattttgcctttgcggtagcgtcaaaccacgaaaaattaggcactgtatcgctaaacgcaaatattacgtttttaagagcctccaagggcgataagctcatagcaacggctgaatgcgtccgtgacggaagaacgacctgttattatcgtgtttcggttatagataataccggcgcacttatagccgaaattacaacaagcggatataagacaaactgacttgagcaagaccgcagggcagttttcaaagtataatacttttcggcggaatattcttaactcctcttaaatcttaattgccgtcaagcatagattttatgccgttttacgccatatttcgaccgttatacgccacgctattgacaaaaaagcgtgagtatggtaaaatgtgtttgtattacagtgctgagaagtactgtaatacggttatattttaggttgatcggatataggaggattttattatgaacaaaactgcggcaatacttattgcatttttcctcggcggacttggcgttcatcgctttatggcaggaaaaatcggaacaggcattatctggcttctcacaggcggatgcttcggtataggctggctcgtagacctgattcaggtttgcacaggcaagtttacaactaaggacggcgcaccctgggtaacagaataatctgtaaatgacaactcccgacttatgctgagcataggtcgggagttttttctttatcggttgctgacgctgtatgcgatcttcttttcgtcaagatagtccttgacggcgttgaacgctttgagcgaagatttttcatcgtttatttttattgtagcaccggcttcaagtccgtctatttctgattttaattcttcgattccgatttcgtgattattaacaaaatacttgtcctcggaaatagttatctccagcgcaaagctgtcggtgttgcccggatttccgccctcggcggatacgttgcttgtctgcgcttccgatgaattatccgcactgcttatgtcagatgccgtatttgcttcggaagacgttaccgtttgttcgccgtttatcagcttgctgatttcgggatagccgaaatataccaaagcgccgcatacggcaagcaggagtatcacaataataaactttttcatattgtacctctttactgtgcttcgataaagctgatgctgttttccgacagtttggctttaagagctttgtatgccttaagagatgagccttcatcggctatctttacgggcagattcttgtcgagcgactttatgctgtcgataagctcgtcaagggtaacctttttgttatcgtatatgtattcgttgcccgacacggtgacattgatatattcaagctcctctacaaccgatacggtgtttgagttatccgcaatgcctgagccttcaccgtcgccgtttccgccgccaaagccgaagcccttgaacgcaaataccgcaacaatcgccagagcggcaacaactaataatattataagtccgacaggtactgcacctttattatttatctttttcatttaagctccttcgtatcagcccgcaaaaaccgaaacatcggtttccgagtagaatagatgtgtatattcgcttttcatcgtgtttattattttcatggtgtcaagatatgccgaggtagttccgctttctgtagcgttatacgaaaactctataagaatagtattatcggcggtgtagccctgctctttgaacagctcccgcacttcatcggtcattacgcttatatcggctttcggtatttccttaactatttcttcgccttttgcaaatttcagcgtccagccgttctcaccgctcatatcaagatgcagcttaaggttcttgttctcgctgaaatccattatcgcatctgtgttttcgccgcttctgtcaacagcagaatcggcttcttcaagccgtttgtccgcctgctcgtttttctcctgcgcttcaccgagaagctcgtctgccttgtcgtttttcgcttttgcttcttccagttcggcgcttacctgctgctgtttatcttcaagatctttcttcagattgtccgtttccagactgctgaagattataaagaagaacaggataatcattataacatcaagcagagaagtgaagtcgaggattatctgtcgtttcttcattttctgctgcttccctttttggtgtagtggctttttacgagaatatcaattttttcaatcgccgattctaccgttgtctgaaaaaccgaattcagcaccttgaaaaaaatcgagaacacaagaccccatgcggtagtgtcaagcgctaagaagaagtttgctttcagttcctgtgttgcaccgcccgttatatcaagtgacaataacgcaagcaccgttccgagcatacccagcagaggaaatattgatacaagcgcaataaaagcagagtagcagaagtttatccagttgaacgaggtgttcttatagtcgatttcgttgtttacgctcatacttttcagtatcttcctcgaccataccaccgatatgataagaagggtaaggcacaccgggaacaaggcaaatataagcggtgacacgaatggtccgaaatttttcaatgcgtctgttaaagctcccatagccattacctccgtctttcgacaaaatcctttaaatttctacataattatatcaccgacaaagttaaaagtcaattaaaagaaagtatttgattttgtagttttacgggatcattcctgaaccgatacacctatatcggtcagtgttgcaattgccctcttgtctgtctgtgcaaaccgctgtgacagatacctcagagccgcaccaagctctccgtccggtccgccgtactgcgacagaatatagcttgcgagcttcggattgcggtttttgatgacgacaggtatctgcgtccttttttcaaatataaacataagccctccttataatatccactgaccgctcagccagtcccaaccgcaatcttttcctgcacacgaggctctcagcggatagaattcgttctcaaacgcacaacggcacgcttcggtctgcttcactgcctcacggtacagctccagagccttttcatcgtccgtgtgggtgtcgaggaacagctttaagtcctgtgcatagaagtctgcggcggacagctgtcttaacagctgggaagctcttgacggcatattatacgccattgtaaagccccctttcatattcgtccaacgtaatgttaagttcggggaagacagttcccgctctcattgccgtttcaggatcgtacagctttccgagccgctggaacggtgcgtaagcatatcctgccttcttttttacaggaatactgccgtcactttccgtgcagcagaaaaatccgtccttattcatattcgttttgctcctttcattcgtgttttttcggctttacagtacattttatgcgtatttgcacttgtatgttacaaatgggatattttgacatatacataacaatggtatctcaaaaacagcattgacaccgccgcaaatgtgttatatactgtgtctgtcagacagatcctatacgattttaacatctataaagcaagggagctcgtgaacgggctgagagggaattgcaattccgacctttgaacctgatttggataatgccaacgtagggaacggttgttttagtgcgcataaaaacatcggctcccgcagacagtgtgggagcttttttgacggacaaaagaaaagaggtatttttgtatgaataaaaaggtaagtattcagaaactcgcaatttcaggcgttctcatcgcattggcggtagtgctgagcggattttcaatcccgataggagcgtcaaagtgtttccccattcagcatatggtaaacgtgatagcaggcacactgctcggaccgtggtacgctgtgggaatggcatttgttacatcgcttataagacttataatgggtacaggcacactgcttgctttccccggaagtatggtaggcgcactctgctgcggacttgctttcagatacattttcccgaaatggtcgtttgctaagcgtgttccgatagctttcctcggtgagataatcggcacaggtattctcggtgctatggcggctttccctattgccacatttgtaatgggcaaagaggcggctttattcacctacgttatccccttcggtgttagcacggtaggcggtgcgctcatagcatccgttcttatgttcgccctcgcaaagacgggagttataaatatgatgttcagacagacaagcgagaaaaaagcgtaaacgtccataaataaatcaaagccacagagattattccctgtggctttttcttattctcctgaaccgctgtcctttgtctgttcattcttcttatgatacttctttatcataaccgccgtaagcagcgatgtaaacggcacggtcagcacaattcctatagtaccggatattccctgcattatctcgatgcagatattgttcgagtttataagctgataatacgaaagatcgtagcagtagtcaatcatcagcgtgactatcgagccgccgacaaacgcaagtatcagcgtgttggacattgtacccatcatatccctgccgacatttataccgctcctgaaaagctccgatacgctgagctccggcttcttttcgtgtatttcatctatagttgacgcaagcgacattcccacgtccattactgcgccgagtgttgatatgagaatacccgagaataaaagtccacctatatttataggtatattctgcccgataaacagcagactttctacttcggatacattataaccgttgattccggcaagttgaccgaatatcagagccagcacgcctgccaccagcactccgaatgccgttcctgcgatagcactgacagatttcacattcgctcccgcaacaaagaatatcgttatgacggtagacaggacgcatataatcgccgccgcccagaacggcgaaaagcctctgtatacaagcggaaagtaaacgaaaatcgtcagcacgaatgtaagagcaagacataccgcagattttatgccttttttaccgcccaccagccacagcatgattacaaacagcgcaacaaaggcatatacaacatattctctgtcacggctgtaaacagtcacaacaggctctccgccatcattggcgctgactatggctactacgtcaagacctaccgtacacggcgcaccgaaaagatttccgttagggcttatcgcactcagctccttgcctgcatagcttcccgtctttatctttagaactacctcctgattgccgtaccgctcgccgtcttcctcaaggttatccttggtgatttttgttacggttgctttttcaaacgtcctgttgtatgtcgatacaagctccaccttgtcgaatgagttgagcaatacaataagcaccgcacttaatgcaataccgacaagcgctattatatatcctatgattttaccttttgtcaaattcagcttattcatctttatcatatctttctgaatacggttatccccaccgcttttacacagtggggacttccgttattttatgtgtttacttggaagatttcttattcttgatagcctcgggtactaccatacctgccagagcgattgcactgagtaccgagagagtggcaaagggagcaaccgataccatattacctgtgttggggtttgtgatgttgtcgtcaggcttgcttgtgtcatcaggcttgcttgtgtcgtcaggcttgcttacatctgagcttgtatcgtcatctgcgggttcttcgggctttgctttaagagcggcaaccgcttcgttgagataagctgtagcttctgcaatcttgtcgcttgtagactgattgtctgcgatgatcgtttcggcattcttgatagcctcgtttaccttggcaacgctttcgtctgtgtacttgtcagcctcaagctgtttctttgcggcttcgacagcctcgttcagtgcggttgtatcagccttctttacaattgtgtatgcagatgagccttcaagcaccttgtttgtatctgcgtcataggttgtgattgttactgcggtttctgtcatattgattaccgagtagctgggtgtccaagtctggcttctttcagctatgtaatcctgctgtgcggggataagctcatagtactttgaacccgtagctgagttagcctccatatataccgtaccctcagggtcaactatcgtgccagtaacaaggtctgagtttatcgtgtagcagttgttctgagtaagataatcctcgccgtaggcattgcttctgtcgaatgccgtatgttctttaccgtcaccgcttaactgatagcttcttgaatatgtgtgatcgtgaccctgtaaagctacgtcaatgtcgaactcgtcaaagataggagtaagctgtgttcttaagatgataccgtcagagtcggagtggtcaagaccggagccgtatatatcctggtggaacattacgattctccacttcttgtccttgttttcgtttacggccttttcgattacatttctgtgagtagcacagttgtagttgttcgtgtcgattacgatgaacagtgcatcgccgtatgtgtagtagtaatctgtgcctgcgtttgtgtgtccgagagcgtaagttgtatcgtcaaggtcgaatgagttgggcgtgttgaagtggtaagaatactgatatgatccgctgtcgtggttgcctattgtagtggataccgggagagaagcgagagccgaagcgttaagataaccggcatattcatattccctgtcggcatagtttacctggtcgcctgcacttaacataaagctgacctcagggtgagctgtaattgcgttattaagtgtcttgttccagttgaaagcgtcattccttgcggcgatctcattcttcattttttcattttcactgcttatctgattcttgcacgcaccgatctgggggtcgcctacataaaggaatgagaacgaatcggggttgccggtctttacgctttcgaccttctgccattcgccgtttttgaatacctgataatagtactgcgtttccttttcaagattctttacggttaccttgttagagaaataaccgtcaagagcctcaatgtttattgaaacttgtgtgccggtaaactctgttgcgtccttcatatcctctttctttgcgattcttaccttaggctgttcaacagtctttgagtaccacgcaaagccaagctgtgtttcgtctgcgcctatgtttaccgaaaccttttcgtaatcgttcttgactgtttcccagtctgttttccactgtgtccattcggtcgtagctccctgcgaaccgtcattccagtgctctgtagcggcataagctgtcatagccgcacttgataccataatagcggcgagtgtgcctgccattactttctttcctgtcttcatgtttctcatgatgatgtcctttcatttgttcatttatacctcttgtgtacaagccgattataacaccgtcagagaaaattaatcaccaagagaatttaaagagtttgtaaaatgtgtaacggcctgcgtttgcaagccgttacttatatacctatccttttgtttatccttttgttatatacagcctcttagtccccgtattctcgcagaaatatctgtcatgctctgcaagaagcattgtcggcgtattcgcaccgagcagccgctcaagctgtatccttgaaataatatcgacgaagttcagcggttcatcccatatatagagattagcaggcgtagccagactgccggctataagcaccttctttttctgtccggcactgagattttccgtccggtcgataagttccctgcgtgaaaatccgagttttgcgagtatcgcacggacaagctcggcatcaacaccgagccgctccgagaattcgtcaagcgttccgcaaagcccatttgtatcctgcggtaataccgatattttaagtcccggtgcttttgctatacttccgctgtagcttatatccgcccctgcgatgattttaaggattgtagattttccacagccgtttttgcccgacagacacagcctttccccgtcggacagcgtaaatgaaacaggcttgcataaagcgttgctgttatcgttatcgcaatagtcgcaatagtacggcacaagattctgcaccgaaagcaccgttgccgattttgcctttattgacggtattttcagcgtatcaatgcattcacggtttttcagaagctccgatttttcatctatagctgtctgcctgcggctttccaccgccttcatacgtttcatcatagctttcgccttagcaccctcgacagctctcctgtcaagcgatttttccgttttcgtcgggtcgatccctatctttctgctttccgctgtgtcagcccactttttactgcgctctgcggcggctttgagatgccctatctcgcttttcagcttcttgtcacgcataagttcgtttgcttcttttctgtcaaagttctctttccacacgctgtagttaccgtttattatttcggtatcactgcgacccagtgacagtatgtggtcggtgcatttgtcgagcaggtcacgatcgtgcgacacaagtataaatccgctctttgctttaagataatcgcctatcgcttctcttgcttcaaggtcaaggcagttggtcggctcgtctatcagcaggaaagcgttgtcacgcaaaaacagcaggcacagcagaagccttgtctgttcaccgcccgacagcgtgttgaacggtctgtacagaatttcgcagtccgtacccatataagacagctcacggattacctcccattcctgcatctcaggacagattatcccgataagttcactgccgctcatattcttgtcctctacatcaaacggaaagtacaggaactctgcctttgtgtttaccgcaccgccgttttcaagttcgcccgtcaacagcttcagaagtgtggttttgccacgtccgttcctgccgataagccccgttttccacgttgtgtcaagcgtgaatgacgcattttcgtacacggcttcatcacagccgtcataataataggttaaattgtttacactgattatagacataatatcatacccctttctgtatcaaaaaagccgcaggaacatacgctcccacggctttttatcccgattttcgcataaacacacggcgaaaaagggcataatacaagaccgacagcaatacattcctgcattgcagacacgaaaccaagcccgtttcatcacccgtattatcatatagggcggcaaaggctataagggtatttcgttctgctcttatcaggaatttgtacgcattgcattcggtcctttcattttgaatttagaatatcggaacttccgatacaagcggattataacacagcttactttatttgtcaagagacagactgaaaattcagctccgcatttgagcggtttacggcgaaatttagactagttgacaaaaaataacttatatgctataatttattttacagggatattttgcctgtattttacttgaaagccgaatgcgatactattaacgatactattaaaaggagcgattcgaccgatgaaaattaaaaaccgttttaaaaaagctgtggcggtactgatgcttgtcacaatgaccgcaatttccgtatgcgcctgtgccgataagagcggatctgacaagtcaggcgagcctggtgcggtgcagggaaactactatcttgacgcagacaaatcaaagcaatacatcagctttaacgaggacaacagcttcagatttgtcggatatgattttgaagtgctcgcaaaagaccttgtcggtgatatgatagaagataagacggctcttgccgaaaggcttgacgatgcttatacatatcattttgataaggatacgaatgagatttggtttaacgttctgcagtccgatagctccgattccgctgaatttgtgattccgatgcagctcggaggcgacaaacagagcgtgacgtttctgaataaaacatataaaattgcacagtaacaattacggcacacttaatatacacggtgtgccgtttttggtatcggagggataacttatgggcggtataatgtaccggacggaaaatcttaataaaagctatgctgacggtgacggagtgtgctatgctctgagggatgtaaatcttgatataagcaagggtcagatggtggcaattgtcggcgagtcggggagcggaaaatcaacgcttttaaatatactcggagcgatagacagcgcaaccggcggaaaggtcatagcgaacggaaaaaatatagcaggtctgtcggaagaacagcttagcacttaccgcagtaaaactgtgggatttgtttttcaggcgtttcatatcattgattgctacacggtatatgacaatatcgagcttccgcttataataaacaaagtgccgggatcacagcgtgacgatatgatcaggaaagcggtcgcacgggtggggcttgatgataagctgagaaccaagtgcaacaagctgtcgggcggagaaaagcagagggtggctattgcaagggcgcttgttcattcgcctgatgtaatacttgcggatgagccttgcggaaatctggacagccgtaacagtgaaagcataatggaactgttgcgtgggcttgtcgatgaagatactcttgtggtgatggtcactcacagcaagacagacgcacggttgtgcgacagaataattacgctcagtgacggtatggtggtaagcgatgaaattatacgatgaaataaggctagctgtaagagaaggaaaaaagtgtctgccttatcttattattaccgcacttatgtttgcgatagtttctgcggttgcgtcctgtctgtttctgacagcagtgaatttacggcgggattattacgattatcttgataaacagacgcagggaggacacgaattcattgtaacctgcggttatactgccggtgttaaggacaaactgtcggagtgcggctttgataaagctgtacatctgtcgtcggcggattatgatgccggtatatatgtgtctgacagcggaaagaaaatcgggcttctgcaaaatcttccgctgtacttcattgatgagctgcttagcgagttctcaggcttcgactgtgaaatgatcggcggtgaggatataaaaccgtgtttcgatactccgggatctgacagtatgtggatagatgaatatatagccctttcggaatcgcttgccgtcggtgataagctgagtgttaaaagtaaagaaaaaacgataaaggaatacacgatagcaggaatatacagcggagagaacacattttttgcgtatcccgttatcgttccgtttaattcatattacgacagtgcggttgcaaataaccgacagattgacagcgttttttcatgcacgataaacagcatgcaccaatatgacaaaacggtcacggcggcaaggcaaaacgggtttgatatagatgcaagtgcgtttgaaatgggtataaccgctattaactatgcgtacatactttttatcgggctggctgttttgtttgcagggatagctttcttttctgttttaaatacattttcggtaacaatagcgaaacgctcgcatataatgacaaatttcatactgttgggggcgaaaaaaaacaacgtatacgcaatatattttatcccttatttttcatcactgctgctcggcgctgcaatcggatttttgctgatgcacctgctgttttcctatgtttcatccctgacaaaaagcctgctttgttttgaggtggctttggaaacagcaagcggcattgtgggcatatcggcattcgctctcttgtttatagccgtacttgcggttatgctttattgcaaattccgcacgctgagcggaataaacctctctgacacggtaagagaatatgacagataacagaaaggcgtaagatgaaaataaccgatatattaaagctggcaatgaagaatctgaccggacacaagcgtattatgctgagggtggctgtaagcgttttgactgttgtgctgctgtgttgctctgcggctgtttttgtgtcggcagttaccgatgaattatcggatatacagtacaagcatatagatcaggcgtgtgcaacggtgtttccatattccgataccgcaaagcaggcagaggatactgcggacgatattatatcaaaaataaccgccgtgtcagaagtaatctcctgcaacgtcggttatcaatacgatatatatacgacaagcgaatatctgaattccatatcacagtcaaattacagtgaagaccatctggtgaaggatataacgcttatctgcggtgacgatatgaaaaaaactgcgtctgtggatatgatgcggcagtacaagcatattcttgcggtagatatgcggtatgatgtgatttcggaaaatcagcgcatcggctttgaacacaactatcccgacaaacagatctttttgtacggcagaaacataagcggcgatgacgaggtcgttatttcggaagattttctgtccgaactgggatttacccgtgaggaaatggaaaggctgacaggcaatcgtgtttcactgaaacgtaccgacaacggtgaaatatatcttgacgggtttaccgtttgcggaatagcaagcagtgaggctgccgcaagcgtgttcgaacaaagctcgatgatgattacaaaaagcgccgccgaaaaaacaaaactctgctacagcgatgccacagtaaatctgtattatgacagctttcagaaagcgcttgaagcgtgtgagcaagccgaaaaaaacggtattcacgcaactgtcggacgcgatcttatgatatattcaagaatagacagagtaagtacctttatcgaaaagattctgattgttatactgccgcttatatgtgtttcaatgctgctgtcggcggcatccgcacttttgctgtattattcggacaccgcacagagaatagctgtgatgagagcgctcggagccacaaaaacggatgtgtacggaataactcttgcggaaacggttcttgctgtttttgtttcgggtatagccggatttctgctgtcggtcggtgtaaatgccatgtataacatatggcttgaaagctattttgatttatctgtgcagattataagcactgttcagcttatcgcaggtgcggtatcctgtatgtttatgtttgcttgtgtacttacagcgtcttttgtaacaacgataaaaatctcatctgcatctatagaccgtatgctgaaaggcgagcgttgacgccctcacgcctgcatcgctcccttcagcatttgtctgtcacgaggacgctttcttatgcggaaaataatatccgacacgataaatgaagctataaggcctgcaagcagtatcaccactgcaagcaatgccgcaacaggcagactgtcggaaagctcggtcggcataaacgcaaagccgtctgccatatatccgtccccgaaaaagcacgacagtaagttgaatatcgagtatccgcagaagaccatccacatgaggaaataagccgatgaaagcggcagactgatgccgattattattgccgatacaagcaaaaagtcgggcagagcggaggggttcacaacagcggtaacaataaccgccggtatctgagctgcaacgcttatcatcagcaaaaatacctgcacagcccttgtccgcagacacttgtaaagcccgcttgtacggatatagacgcttgcataaatgtctgaatacaacgatgacaagccgaaagataagaacactgtcagaaacggttcagtcgccagataaaacggataatcttcactgcctcttatttcagtcacagccgccataacaacggttagtgccgcaataactgcggcaaagcatataagccacgcaatattggcggcaataagcctgaaaacacgctttataacgaatctaagcgataaaagaaaattcttcatatcttcatatacctcctcagaactgccagttttccttgatataacggcaggcggatactgttgatacagccgttccgaccgctccgaccacagttaatataatgctcgcagtaagtgcggcgatgtagcttatatggctcgccgccgttgctgttgctgacagaataaacatagcgacaagcaatgttatcaaaagaagaacgcttcttgcgttagcggtttttgttgatacgagcggacgtatcagaatgcctgacagaagcgatgcgccgagtgaaaacagcaccataggcggcagatctgtaagctcaaggtcaccgcctgcaagcgtgaaaattccgagtacgagcgatactgccaccgcagtaacagacgagattataacagagcctgcaagcgacttgccgaacttttctccgccgtgctttatcgtccttgcgtacttactgccgtcaaccttgtagtaaaggtttatagcgttgccgtttattaagagcgcacctgcaaagccgataacacagcacactgtgttaagggcggaatatgcgacatcgtcattttcctcggctacagctgtattgtcatcggcgttttctctgtcgctttttcctgcggcagagccgacaaagaagcctataacataaattgccgcaaccataacgatcatagcgagtgaaaccttgaacagcgtgttagcattgaataagcgtaccgatttcatcatacttatgcctcctttttaagagcaaggcgtttttcttccgcaatcttcataaggtcaatgctgagctggcttaatgtaggacgttccgtaacagcacccagtgcttcgagcttcagcttgttttcggctaaggcaagacctgttgctgtggacgatgaatgggaagagcagagcagaagcggcgatattttgtcaaggctttcaggctcggcactgagggcaatatacttgtccttcaggtcctctgtgaagccctgctcgactaccttgccgttatccataaatattacatagtctgcggcattttccatatcggcgatgttgtgagtcgagaagattatactcctttcgccgttaccgctgtctatatagtcacggaagcggtcgcacagcctgtcacgcataagcggatcgagcgatgagcccggctcgtcaagcaccaacagatcggtttctcttgcaaaggccgacgccaagaacactctcatcttcataccgtccgacatactcgataaaggctttttgctgtttttctcatcggtaacgccaagctcaccgagaagtgaataaaatctgtccttgctgaatttatcgaacgcaaggctcatagaaagtgcaatatccctcaccttccagttagccgggaacatcgcctgtgatgcacagtagccgatgcgctccttgatattgccgctgtcggcattatcggtttctccgaaatatgtcaccgtgccgtctgtctttgcggtgatgccgcagattatatccataagtgttgtttttcctgcaccgttagcaccgataagcgccgttgcgaagcctttcgggaatgaaaggtcaacaggacccagcgaaaaatctttatattttctggtaagattacttaccttgattacctcttccatattatctccttttagatgaatcattcaatactgccgagtgttttcagcacctcgcatacctcgtcaacggatagccccgcaagccttgcacagtcgagtgcatcctgcagatgctgttcgagaaggcgcatatactgttcctttatcatacccgtgtcctgagcgttgactatatagcccttgccctgaactgcgctgacaagcccctccgaacaaagctcctcatatgccttcatagtggttattacgctgattttaagctcttttgcaagtcctcttatcgagggaagatattccccggcggaaatcgtgccgttcataatacgttccttgaaatcggctgagatctgcttgtatatcggaatatcggaattaagaagaattttcatatttcctccttttcagattcgtaagcttacgtcacataacaggtgatcaaactgtttatgtgttatatatacagtatatactgatacaggcgatttgtcaatagggaaaatgaaaaaagtcggggaatttcttcttcaggttgtagaaaaagtctgtttttataaaatagtgcaaattctctaaccctaaccccaaaccccttccccgtggtgaagggctgtgtatgctttgttggctttgcgtcctgcaaagcccttgtgcatacacgcccggcatccatgccggggctgagtgtggggctaccgcccctagtccctgtcgggggctccgcccctgcgaccccatttttaaacaagcaggaggttttttgacagactgtttcttcttttcataattttttcaccctcagttattattcaattaacaaacaggcgttataatttagccatagtcgaaggaaaaggatttccgacggcgataaggcgagtgccttgataaccgctcaggcggtactattataggggcgcagttaccgcagatgcgataccgctccggctaagtacaacgaaagtttatatacatcccctcgatcaataagcaggaactcccccgatgataagtcgggggagttcttgtgtgcctgccgaaaaaaccattgttattaaagctgtacaacgaaatatatcgccaacgccacttaaaacattttccgtaccgacaaggcattaatatttccgtgaccttatcagtgcaactgcactgacattaatctttcaaaaaaacgctactaacctgagatatatgtactaacctgcggacgtgtagcgttaagcgtccctgtattgacaagatatacaatgttcaggtagttttacgagtttcgccaacaccccagcagggtaagggtatgggtaaggaaagagggagccaagagggagaaaacctaagggacagggtatagggctgagcactaacctttggcaagtgctcaatcgtttcgctttgcttcactgcggcagtccagcggagctttagcggagtgcacgagccttgcgtaagcgaggctcagactctccctgatccttttggttgtctccctctttcatattgacaagtgcacccattcgaatagcgaacccgagaagtgctatccggcaaaaagaactatcggcagctaatttactacagataaacgctaaatctcactttaacacagttttttaccctccaacgcttgcaaatagactcgcaatgttgtataatagttaaagtataactataatgggtcagtaggttctgccacaaacggcagaaaaagccccgcaggaaaggaatgacggcataatggatataaagaccattgaccatctgtgtaatctgagtaagctcaattataccgatgagggtaaagaaaaggtaatgggcgaaatgagcgcaataatcgagcttatggataccgtaaaggaatttgacgtagtttacgatgataccaaggataataacagcataagctatgacgaggtaagaaaagacgttgcaaagccctcattccccacagagaagctgctcagcaacacacagcccagcggaaactgctatgtagttccgaagatggtagactgataaacgagccgaaaggataagagaataaatggagctaaaaaaacagacgctcggctctctgcgtgaaatgctcgatacaaagcagataagcgccgcagagctttgcaaggaatattcagacagcataaaggctaaagattccgatgtactcggatatatcacagtgaccgaagacgaggcactgaaaaatgcggaaaaggcgcaggagattatagacaagggcgaggcaaaggcactcaccggtatacctcttgcaataaaggataacatctgcacggacggaataagaacgacctgtgcgtcaaagatgctcgaaaactttgttccgccttatgatgcaaacgtaatagaaaagctgaaggccgagaattatgtgcttctcggaaaaacaagtatggacgaatttgcaatgggcggctctacacagacaagcgcatttgcaaagacaagaaaccccttcgacttatcccgtgtacccggcggttcaagcggcggctctgcggctgtagtatctgcaggacttgcacctgcggcactcggaagcgacacaggcggctctataagacagcctgcttcattctgcggcgttactggccttaagccaacctacggcagagtatcacgctacggtctggtggcattcgcaagctcgcttgaccagataggccctatcgcaaacagtgcggttgactgcggtactatactgaacgttatctgcggcaaggacagccgtgacgcaacaagcgcaaacaagcccgccgaggacttcaacgccaaggtcggcaaggatataaagggaatgaagatagcactccccaaagaattcttcgcagacagcacagacgatgaagtaaagaatgcggttcttgcggcggctaagaaatacgaagaaatgggcgcaacgctcgttgattgctcgatgaagagccttaagtacgcagtatcggcttactaccttgtggcaagtgccgaggcggcatccaacctttcacgtttcgacggcatcaagtatggacttcgaggcgagggcagaacctttgacgaaatgattcgtgacagccgtacaagaggcttcggcgatgaggtaaagcgccgtatacttctcggtaactatgcgctttcaagcggttactatgacgcatactatttaaaggcgctggcattaaaacagcagattataaaggaatataacgagatattcgagaatgcggacgttattctgacccctaccgctcctacagtagcatataagataggcgagcaggaaactgaccctgtaaagatgtatcttgcagatatatgcaccgtaacggtaaacatcgcatcgctcccggcaatctccgtaccctgcggatataacgcagacggtatgcccataggaatgtcgcttgtcggcagaaagtgggacgaggctacgctgatacagacggcagacgcttttgaaaagacgtttgaaagacgttacagcgaggtttaagaagggacggtaacaatatgaaattatatcctaccataggacttgaaatacacgcagagcttctcacaaactcaaaggtgttctgcacctgctctgctgagttcggcggcgagcctaactcaagatgctgtcctgtctgctccggacttcccggaacgctccccgtgcttaactcaaaggctgttgagtacattataaaagcaggctacatcatgaactgcgaaatatcacgctttacaaagtgggacagaaagaattatttctaccccgacctgcccaaagcatatcagatttcgcagatgccccgtcccgtgtgtctgggcggtcacgttgacgtaacggttgacggcgagcagaagacgatgagaataaaccgtatacatcttgaagaagacgcaggaaagctggttcacgacgacatcgagcgtgtcagccttgcagactataaccgttgcggaattccgcttatcgagatagttaccgagcctgatttccattcagccgccgaggtcatagcgttctttgagaagataagacttatgctccagtacgcaggcgtatgcgacggtaagctcgaacagggttcaatgagatgcgacgttaatatttcgcttgccgaaaaggattcagacaagcttggaacaagaacagaggtaaagaaccttaactccacaaaggctatacaaagagccatcgaatacgagatataccgccagacagagcttatcgagaacggcgaaagagtagtacaggaaacgcttcacttcaatgacgctacgggcgaaacaagctcgcttcgttccaaggaggacgctcacgattaccgttatttccccgaccccgatataccgccgataatcttcacggaagaagagcttgcggctatcaaggcggacattcccgaaatgcccgagcagagagtggcacgttacacaggcgaatacggcatttctgcggctgacgcaaaggtgctgacagattcaaagcgtgtcagcgacctgtttgaaaatgcgctgaaggcatataataaccccaagcctataggcacgttcatagtggttgagcttatgagaagaataaatctcggtgagcttgatcttgataatatgaaatttaccgcagaggatttagcaaagctgatagagcttgccgaaaacggtaaaatatcaaaggataaccgtaagattatccttcgtgaaatgcttgaaacaggcaagaagcccgaaactatcgctgaagaacagcagctgtggataaaggaagacaacgcactgcttgaaaagacgataaacggcataatggaggctaatcctaaggctgtcgagcagtacagaagcggtgaaacaaaggtgttcggcttccttatgggacagtgcaacaaggcactcaagggagcggcttcacccgcaagtataaaggcaatgcttgaagaaaagctcaagggctgattataaagaaagaaaggcaagaaagaaatgtttttagagaacaagtaccgcactcacacctgtgaaatgctgagcgaaaacgacatcggcaagaccgttcgtgttgcaggctgggtagagaacatccgtgaccacggaggaatcaagtttatagatctgcgtgaccattacggctatgtgcagattacattccagaagaacgagggccttcttgagggcgtaaacaaggagtgtgccgttacaataggcggtacggtaataaagagagcagagggtacttacaacgataagatttccacgggtactatcgagatagtagccgaaagtcttgaggtactgggcaaggtaactgttgaacagcttccgtttgaagttcccacctcgacagaaacaaaggaagatatacgcttaaagtaccgttatctcgatctgcgtaacaagagaatgcacaacaacatcgtactgcgttcacaggttatctcattcttacgcagtaagatgaccgagatgggattccttgaaatacagacccccatcctttcaacaagctcacccgagggagcaagagattaccttatccccagccgtaagcaccacggaaagttctacgctctgccgcaggcaccgcagatatttaagcagctgcttatggtatccggctttgataagtatttccagatagcgccctgtttccgtgacgaagacgcaagagcggaccgttcacccggcgaattctatcagcttgactttgaaatggcatttgcaacacaggaagacgtttttgcaaacgcagaagaggttttatctgctgtatttgaaaagttcggcggtaagcccgtatctcccgcacccttcaagcgtatcccctacgccgagtcaatgctgaagtacggcacagacaagcccgacctgcgtaaccctcttattataacagagctgtccgacttattcgttgacagcgacttcaagcctttcgcaaacaagtgcgtaagaggcatcagagttcccggcatggcaagtcagtcaaagggcttctttgagaagatggaagcattcgctaaggaaatcggcatgaagggtcttggatatgtcaaggtagacgagagcttcaagtatctcggccctatcgacaagttcctgaatgacgagcagagagaagagcttaagaacagatgtgctcttgaagtgggcgatgttctttacttcatagccgacaacaagaagatggcgcccaagtttgcaggtcagatccgtacagaagtcgcaaagcgtatggatatgattgactatgacagatatgaaatgtgctttatcgttgacttcccgatgtacgaggaggacgaggaaacaggcaagactatattcactcacaaccccttctcaatgccgcagggcggtcttgaagcgcttaagacaaagaatccgcttgacatacttgcataccagtacgatattgtctgcaacggtgttgagctttcaagcggcgctgtaagaaaccacgaccttgagataatgataaaggctttcgagattgccggctacacagagcaggacgttgccgagaagttcggcgctctttacaatgcgttccagtatggtgctccgccccacgcaggtatggcgcccggtgtagaccgtatgataatgctcctcacaggcgatgagagcataagagaggttatcgcattcccgatgaactccaacgcacaggatctcctgctcggcgcacccacagaggtaaccgaacagcagctgcgtgaagtacacataaaggtacgccagaaacccaccgtctaaggtggcaacgccaccggtaattccgcctttggcaatgatattgttttgctgaacatagcgaaacggcgggaattaacggtatcataaattttataagcgaattacggcagatatgcgaaagcgtatctgctgttttgcggcgatgcgccgcaccaaattccgccttttgaatagtcagagctatccgcaggatagcgaaacggcggaaataaacggtatcataaattttataagcgaattacggcagatatgcgaaagcgtatctgccgttgttgcgtttaaacattttaatcatattgcaattttgcactgaaccttgtcattttcacaatagttataaattatcacaaaccgttcgtcctgcaccaagcctcttggctcccttgccaaagggcgctggattgcgacaaggctatttcttatcataaattgccatactttgcgttttaagtatcttaaatattcactcaaacctttatgtcgcaagactgagggatcgttgcaccgaatactgccttcccacaaaagccccacaaataagattttaacaagccgattaaatccccccacatcgcaaattctcatttccgctattgtaatttcactcggattggtgtataataaataatgtatatttatatactgaaatttctatcggaaggaatgtaaaaaaacatgactatcacaaaggattcaataatcggcgatattttagacgcatacggagaggtaacagcccccttctttcttgaaatgggtatgcactgcttaggctgccctgcgtcaagaggtgaaactgttgcacaggcgtgcgatgttcacggtgttgatgcggacgagttggttaagaagctgaacgaggctgtcggtaactgatgcacgagccgatactctcgccaagacttgcggcggcggcaggaatggtgcgtaaaggcggagagatctgcgatgtcggtacggatcacgccctgctcccttgcaggctctatcttgacggtgaaagaaagctcacggcggcggatataaacgaaggccctttgctttcggcaaaacagacggtaatgcactacataggaaaagaagatgctgtgcgtcttgtgctgtcggacggacttgaaaaaatagattatgccgacgatgtgataatcgcaggtatgggcggcgagcttatagcaagaattgttctcggttgccgtttcttaagccgtgatacacattttatcctccagcctatgacaaaggctgagatattaagaaaagaactgtacaaaaacggcttttatatagaaaaagagcttaccgcaagggaaaacgacagaaattacgttattatgtcggtgtactatgacggcgagagccgtgagataaccgacgcttttgcatattccggaaaggtaacggacaaggagtatcttagcttggtgtgccgtaagctaagacatacaggagaatgctgctcatcgtccgatacggcaaaaagcgagaagctgtgcaatacagcacaggaaatagaaaatataataacaacattatgattttttggggtgaaggttatgaaagtaagcgctatctacgagtttctgaatgaatacgcaccgttttcggtgcaggataagtttgacaacagcggatttcttgtcggtgatatgaatgccccagttaagggcatatgcctttgccttgacataaccaacgctgtgataaaagaggcagtggcgaacaaagccaaccttataatatcgcatcaccctgttattttcgatccgctgaaaagcgttacggagggtatgccggtttacgagcttataaagaataagctgaacgctgtatgcgttcataccaatgcggatatgaccaaaaacggcgttaccgatattatgctcgatctgctcgaatttgagcgctccgacaagatattagaacccgttatgcccgacggaacaggctacggtaaaatatgcgaactgcctatagccactcacgccaaggctctcgctgagtgttgtaagaaagcgtttgactgcacggtggtacgctataccgaaaccgacagaccgataaagcgtgtagctgtttgttccggcgcaggcggaagcaccttgccgcttgccgctgccgcaggctgtgacgctcttataactggcgatataaagcacgatgtatggatagacgctgtcaacagggatttctgccttattgacgcaggtcacttccacacggaaaatatactttgcaattatctttgcggtgttcttagccgcaaatttcacaatacacagatatttgtcgcacagagcagtaaagacccctgctcatatataatttaacgtgtgacggaaaggactgccgatgtcacttgacggcacttttcttcactgtgtggtatccgaaatgctgtcggcagggcttgtcggcggaagaatagacaagatctatcagccctcccgtgaggagataattatttcgatacgcagtgcaggaaagcataataagatattgataagctcaaattcaatgtcggcacgggtgtgcatgacagagcgtgcggcggaaaatccgtccgcccctcctatgttctgtatgcttctcagaaagcacctcagcggaggaaaactgctggatataacgcaggacggacttgagcgtataataaactttgattttgagtgcatgaacgaaataggcgatatggtagtaaaccgccttaccgccgaaataatgggcaggcacagcaatataatacttatggcaaaaaaggacggcgtgtaccgtgttaccgatagcataaagcgtatcacggacgatgtttcctcggtaagacgtatacttccgaatatcgtatacgaaacaccgccgagagatctgacccgtgtaaacttccttatttgttcggacagcgagtttataaacgctgtaaaacagggcgagggaaaacggctgtcaaagcacctgaccgcctgtcttgagggcatatcccccgtatttgcgagggagtgcgcttattattcgtgcagggataccgattttgcggttgacgatatgacggatgataactatgaccgcctgctgttttttataaaacgtgcaagagaatatgttacagataaaaacggttttacgattctgcgtgacctgaacggcacatataaggatttctgctttatgccgatagagcaatacggcacgcagatgcttgtatcccacgcagacggcgcaaacgcactgcttgatatattctacggcagtaaagcggaaaacgaacggatgaaacagcgttcaagggatttgctgaaaatgctgatgaatacctatgagcgaatagcaagaaagctggagcttcagaagggcgagcttgcacagtgcggagaaagggaggtattccgagtccgtggcgatgttgtaagtgcgaatatataccgtatggaaaaaggtatgaccgagcttaccgccgaggattacagcacgggcgaaaccgtgaccgttccgcttgacgtaaggctcacaccctcgcagaacgcccagaaatactatgcggaatacaagaagcttgaaaaagccgaaagaatgcttacaaagctgatagcggacggcgaaaacgagcttatatatatcgacagcgtattcgatgccgcatcccgtgccacctccaatgcggagataagcgagataaagcaggaattagcggcaaacggctatatccacacgaataccgtcaataaaaagacgcaggtaaaaccgaaacctcctatgcactttgtgaccgatgacggttacgatgtgtatataggcaggaacaacatacagaatgacaagctgaccgtaaaaaccgccgagccggacgatatgtggcttcatacgaagaacatagcaggctcgcacgtcataataaaggcgaagaacggcgaaatatcggataatgccattctgcaggcggcaagccttgcggcatactgctcaaaggcgcagaacagcacaaaagtgcctgttgactacacgcggataagatttgtgaagaagcccaacggcgcaaagccgggtatggtgatattcacaaacaattacacagtgcttgtagaccccgatgaacagctttttgcaagggtagaggcgtagaaaggttaatatttatgagtaaagctctattgcccaaatatgaatacacagataatattcgtcacggcttcagcaacttcataagtaacaccaaaaataaactgtttatacttgctataggctcatgtgtaatagcaagcaaagaaggttattacacagcggttttgaaatacaacgacaaggttagcgtgttaaataatcaagtcatcaccaatagtgctaatgtttgtattttaacgggtataatggcagcgatagacaaaataaagaagccgaccgatgtttatattgtggttagcacacctttagggtttgcaactaaaaatagtccgaatagagttttatgcttacaggtgcaacaagctcttttagaaaagaattgtcatgcagagttaatcgaattaacggggcaaggcaccgagttgtctgattatatctgcaaaataagtaacttgcagtaatcaaagaaaggataaaaataaaatgaagaaagaactcgcaaagacctattctcctaaggattttgaggacaggctttatcacgaatgggaggaaaagaagtacttccacgcagaaatagaccccaagaagaagccctatacgatagttatcccccctccgaacataaccggacagcttcatatgggacacgctcttgacaacacattgcaggatattcttatccgctataagagaatgcagggctacagcgcactgtggctgcccggcacagaccacgcttcaatcgctacagaggcaaagatagtaaacgctatgaaggaagagggtcttaccaaggacgatgtaggcagagaaggcttccttgagcgtgcgtgggaatggaaaaaggtttacggcggacgtatcgttcagcagttaaagaagctcggctcgtcttgcgactgggacagagagcgtttcactcttgacgagggctgttcaaaggctgtacagaaggtattcatcgacctttacaacaagggtcttatctatcacggcgaaagaatcatcaactggtgtccgaactgtaagacatcaatttccgatattgaatgcgaatatgaagaacaggacggcttcttctggcatatcaattatcccctttcagacggaagcggcagtgtagagatagctacaacacgtcccgaaacactgctcggtgacagcgctatagccgttaaccccgatgacgaaagatacaagagcatagtaggcaagatggttaagctccctcttaccgacagagagattcccgttattgccgatgaatatgttgatatggaattcggtacaggcgtagttaagattacacccgcacatgaccctaacgactttgaggtaggcaagcgccacaacttacctatcattcatatgatgaacgatgacgctactattatggacggtatcggcggcaagtacgcaggtatggacagatatgaagcaagaaatgctatggtagccgaccttgaggcacagggcttactcgtaaaggtcgagcctcacaagcacaatgtaggctgctgtcagcgttgcggtactaccgttgaacccagagcaagctatcagtggttcgtatctatgaaacagcttgcgcagcctgctatagacgtagtaaagagcggtgagctgagatatacccctcagagatttgaaaacggctatctttactggatggaaaatatccgtgactggtgcatttcacgtcagctgtggtggggtcacagaatacctgcttactactgccagaataaagaatgcggacacacagagattactcttgacggtatagacacctgccccaagtgcggcgcacctatgaagcaggacgaggacactctcgatacttggttctcatctgcattatggccgttctcaacgctcggctggcctgaaaagacagcagatcttgagtatttctatcctacaaatacgcttgttacaggctatgatataattccgttctgggttgcaagaatgatattcagcggacttgagcatacaggtcagaagccgttcaaggatgtacttatacacggtcttgtccgtgacgagctgggcagaaagatgagcaagtcgctcggcaacggcgtagatccgcttgaggtcatcgacaagtacggtgctgacgcactgcgtcttactcttgttacaggtaacgcacccggtaacgatatgcgctggacagaaacaaaggttacaaattcccgtaactttgcaaacaagctgtggaatgcttcaagatatatccttatgaatcttcccgaggatatgcagggcgcagttctccccgaaaatcttcccatcgaggataagtggatattatcgctgtacaacgaccttataaagaacgttacgtcaaatctcgacagctacgagcttggtgttgcggtacagaatctgttcgactttatctgggatgtttactgcgactggtatatcgagcttacgaagccccgtatcgcagagggcggagaaacagcccgtgccgctcagaacgtactcgtttacgttatgcagggcattttaaagctgttacacccctttatgccgttcataacagaggaaatatggcagtcaatgcccatagttgccgataaggacaacaaccccgaaagcataatgatttcggcttggccggtatatgatgaaaagcttcactttgcggctgaacagacagacttcacaaaggtcgttgacgctatccgtgctatccgtgtacagcgtaacgagcttaacgtaccgccgtcaaagaaggtcacaatgtacatcgaaacagccgaaacggcactgttcaagggcgcaaaggcattcttcgagcgtcttgcaggcgcaggcgagctgacagtatccgaaaaggcagaaacaagcgacgatatggtaacaatcgttaccgcaaacgcaagaatatttatgcctatgggcgagcttgttgacaaggaaaaggagcttgcaagacttgaaaaggagcgcaaggcggctcagaaggacatcgacttcctttcgggtaagctcagcaatcagggcttcctgtcaaaagcacccgcacagcagattgaaaacgagcgtgtaaagcttgctaaggcacaggaaaagatggaaaagataatgctttctatcgagaagatgaagtaataagccgattatggctttcacatttcccccggtttttatgaccgggggatttttgcatattcggtaacaatgcacaaaggttcaaggtatttgtgtgaaaaatatacaaatttgtattttaggaattgaaaatatgagcttaggtatgttattatcagattaaggaaactctgtcgacggaataactgattaaaatacgaatgcgaggtaatatttatggcactatctaaacgtttaatttctgctttaattgctttctcaatgtcggctacaattgcaacaacggcatttgcacaaacagataatagcattacactgaatgaagaacaaaatcaactacaaacggttgaaccgtcacaggaggaaaagatttctattaagtacgcaaacattcctgaacaacttgatgttgtagaacttaaagcacaaggtttctcagcaagagtcaaaagcgaagaaaccgatttaagcgatattgttcttgaaaaaaatgacggtacaagagcactctatattttcgattctcctgttaagtatatatcagatgacggtgatgtcgttgataaatcaaacaaagtcataaaaaaaggcaatgtgtttaaaagtgaaagtaatgatatagaggtcacacttccgttttcgctctcgtcaggaatagcagtggatgacgaagaactaaatttgtcaatgcgacctattagtaataacaatttagtaagagttttgtcagtaggcaaaaaatccggtgaagaaagtgtaaagtatgaagatgtatttgatgaatatactgatattgaatatacatatacttacgatggagtaaaagaagatattattttagaaaaatacaatggaactaacaaattcgattttgagcttttaactaacggattagagctatgtgaagataaaggagtgcttttactcaaagacaataacggaaatgtacgagctgttattggtgaaattgttgtgttttctgctgataataaaaacaacacaatgggaaaataccaaataatagagaaagaaaaaaataattgttatgtgatttctgtaacggtcgataatgagtatctgacaagtgaaaaaactaagtatccggttacaattgacccgtatattaaatcgaatacaggcgacggcggaatagaagatatgcaggtttttaaaggaacagacggtaaaggagataaagaaaaatctgccggattatcaggtgtgtcaagagtaggctggagtgactggggtgcttgtagaacgcttttgaaatttaaacaaaaaaatgtgctcaacaatcacggaataacactaaaaggtcagataatttcggcaagtattgaaatgcgtgatcttatgtgccaaggtgatgaagtgccggtgtattgcactcaatttgcaggaaaaagttggaacgaatccggtcaatatacatggaatgcactgaatgccgaaaacacaggcaaaggcggaagtatgctgccggtttcgtatgcgaacggaaaaaagaaatcagacaccaatccttcaacagatacaatgtcacattggtttaaatggaacgtttctaatatcgtcaagaattgggtcggaaattcttctgatatcgaaagaggcatagaattttacgcattgccgatgcttgagggatcttctgtatatgcgtcatatatgaagacgtttggttcggttcaggcagatgcaaaatataaaccgtattttcatatcgaatataacaataagacagctattttagtgtctataaaatacacaggtcatgatcatgtttctaaactagcagcgttaaaagataaattgcaagggaatcagtataatgcagaagtatacaatggttcatattcaggctcatatataaagaagttaatttgcaatgggaatactgatattgttgttacacgttcacatggtactacgcataaaaactgttcatatatcactacggataacaaaacaagtgaagcattgttcccgtcggactttaaagatggtactgatttatctcacataaagattgcattatttgtaggatgtaatactgcaaaaaatgaagtaaatttaccaagcagaatgaacgcacttggcgcaaaatatacgcttggctttaaagaaacaatctattgtaatgaaggcaatgaattcgttaaactattttttgataatctgttggcaggcaacgctgcaagagaatctgcaaactcagctgccagagcaattcaaaaaaagaatccctctacaacaattgacaaattcttggattatggggatcgtaatttagtatataagaaataaaagaccaggaggaacctattatgaaaaaaatcacagcactgtttcctttaactctcgctttatctttggttatgcttattacgtcttgctctcagaacaacgagttaagttccgacagtacagaaagtcaatatgaatttgaggacaaatatgatgttgttctgtacggcaagtatctgccaaccgacattgcggatattaataagcccgaacagttgatagacgatagccttaattccgagtttgatccagagtctgttcatcaaatagatttttgcggtaaaacgtttaatataaagtataaagacgataaatacgcaaacggcgtatatgattattatatgtacagctattctgtaaccgacaccgatacagatgcatatgaatttgtactttcatcagacggcggaaaattcgcttctgcgtctatgataggtgcggatgttgaaacattgacggatgtgggtacggaaaaacgcaccgaaaaggtgaaaaaatttgctgaaagccttatagatcttggtaagtaccgttttgacggagaagaaaagaccgttttgggaacacattattatgaaggaagcgagccgtttgacgaggtaagatatatatataggtttatcaaatacagctcggatataaaaaccgatgaaatgttatatatattggcagatattgagggtactgtggaggatgttactaaggtatatatcggtgagttcaacaatgacagcgtaaacgcctttgatgttgaacattccgtggaagctgcaaaagacaaaatcaagtctgtggataataaggatgtatacacagttacacagattgatgaaccgatcctttgcaaataccgtggaaaaaatgcactgaaagtcaattttaaatatgataatacgaccgatagcgattatatttcgcatgaagatggtatggtaattatagtgcctaaagaatagcagaaacaccgccgtgatgaatttacatcacggcggcgggctttattatattgtattcgattttgctacagcttatttataatgtctaaaaagcattattgttcaatcccgaccgtttcactatcctgcgaaaatccgcaacattatcaaaggtcggaatttgtagcggctcacagccgcaaggtcggaatttactgtagctttcagctacagttgttcggctaagctgtagatgagcttttcagtcttttcccagccaagacacgggtcggttatcgacttgccgtaaaccgcatcgtctgtgctttggcttccgtcctcgatgtagctttcaatcataagtcccttgacaaatccctcaagatccttgctgtgacggcggctgtgaagaatctcgtttgcgattcttacctgctctaaatacttcttacccgaatttgagtggtttgtatccactatgaccgccatattctgaagatttttcttgcagtacagctcgtacagcagtgacagatcctcgtagtgatagttcgggatagtctgaccgtgcttgtttacagcacctctcagtatagcgtgcgcaagcggatttccgcttgtgacggtttcccagcctctgtatatgaatgtgtggcttgcctgtgccgcacggatagagttgagcataacagacatatcgcctgccgtggggtttttcataccgacaggaatatccattccgcttgatgtaagtctgtgctgctgatcctcgaccgagcgagcgccgatagcaacataagacaaaagatcggacagataacggtagttttcagggtagagcatttcatccgcacaggtaaatcccgtctgctcgatagcctttgtatgaaggcttcttaccttgataagtccctcaagcatatcctctttctttgtcgggtcgggctgatgtatcatgcccttgtagccttctcctgttgtacggggcttgttcgtgtatattctgggaattatcagtatcttatcctttacctgctcctggacgggtaccagccttgaaatatagtcaaggacaggctcctccttgtcagcagagcaaggtcctattatcagcaggaacttattgctctttcccgtgaatacatcggctatttccttgtcacgttgtttctttgtttccactatcttgtccgacagaggatacagctcctttatctccttgggagttgggagctttcttatcatgttcatactcatcgcttttctttccttcctattgcgtatcataattatacatcacacccggaattttatgagttccgtataatcaaaaaccgccctcagattattcctaatctgagggcggatatatatccacggtaccacctcaattcaccgtacaggtgcacagcactggtatacggtctttaaagctgtaacgggcttacccgaatggcttacaggctctgcgctttcggctcatctctccggaatgaattcaggctttatattctgtcggctcgcacctaatccgactctctgtgagaaatctgccgccttacttttttccatctgcgatttgtggtgtatattcggtttaatacccgtttttcgggtacaatgtaagtataccacggcactcggtatttgtcaatagattttttactcaatttaaagtggaaaagcgttaaagcggaagatttttctgaaaaatgcgtataaaacggaaaataacgttaaaactacaaatgcagtaaagcataacttgaaaggaaaaaagctatggataagataactaccggaaagataaaaaagtttttcaagggcaaaggttttgcgggagcgttatgtctgagcgttgttgctataggaatatcaacatatctgacctacgacagcacattaaagacaatagccgacgaagaacctcaaaagcccgattctgccgtatcagcagagcaggtggacaacacgcagagcggtatacctaaggacgaaacctcaaagagcgaagccgacagctcagccgcacccgcaaataactttgtaagaagcacagcaaagcgtgtaatgccgattgagggcgaggtgatatgggaatacagcaacggcgagcttgtaaagagcgaaactctcggcgtatggaagacccacgacggaatggacatcgccgcatcggtcggaacggatgtaaaagctgcctgcacgggcaaggtcaaggagattaaggacgatcccctgtggggaatatgcgttgtgatagatcacggcgacggctacgaaacgcattactgcggacttgacaagtcgcttgaggtcaaagagggaagcaatgtcgaatccggtcagaagataggcgttacagggactatcgaatgcgagtcgaagctggcacctcatcttcactttgcagtaaagcaaaacggaaagtggatatctccaaaagagtatatcaacggttaagattaatcgggtacggcacagtacccgattttttctgttacagtgcagaatatcgacaacagataaatcgccgcaccaacccttgccctacaccatcacacttgcctcccttgtcaaaggtgaggtgctgtcgcccgaaaaaattcgagcgactaccggagggattgctagccccccttcgcttcgcaccacattcttaccgccccttgtcaaaggtgaggtgctgtcgcccgaaaaaattcgggcgactaccggagggattgtcacacttaccgtaccctttccgtttctctgacacctccgttaacaatctctcattccacacccaaccctcgcaaaaccgcaccatccctcgaaaatcgccaacacccttgccttgcattgcaccatcacccttgcctcccctcgaaaaaggggaggtgtcttgacggcatcgcaaaatcgttattctacataatcttcattttgtaatttaccgaactgtttccaaaattgctatactttttgccgtcaagacggtgggggttgtttccccttagcaccatcattacgctgttaccctctaacatttaaaagggtgaggttctgttgctcggtcaagccgatccaactatggtggggattgtgaacgctccgaagtttttaaagtagcactcctatcttaaaacctctaagcaattacaattcacctttaacaagcatatcaatatattcacagacgttgcggaaatttgtgtgaatctgattattagcaatatgtattactcttatcccgtgttcttcaagaaatctgtttctttcatcatcataggttaagcccttttcttcgtaatgctgactgccgtcaagctctataactaaatttgccgtcgggcaataaaaatccgctatatatttatacaccactttttgtcgaaaaaatcttaccgggtaatttctgagaaagcagtaccacagcttacgttcttcgtccgtcattcttttcctcagaatttttgcgtttttaattaaatctttgttgtattttgtattcatatttcaatttttcatcagatatataaaatccgcccccgttttcacgggggcgaactcatcaagtcattaatttataaatattaagccctgaaactcacgctgttctcagattactggagtaactggagaatagcctgaggctgctggttagcctgagcgagcatagcctgagatgcctgctgaagaatgttattcttagtgtagttgatcatctctgtagccatatctgtatctctgatctgagattcagctgctgtcaggttctcatttgttgttgtcaggttgttaactgtgtactcaagtctgttctgaagagcaccaagacctgctctctgcatagatactgtcttaacagcagcgtctaccatgtcgatagcagcatttgcagaatcctgagtagaaacatcagcattagcaacacctatagcagaagatgacatatcgttaacgttcagcgtaactctctgatcctcaacgccgttagcaccgatctggaatgtaagacccttaccgttgttaggaactgaatccttaccaacacctgcaccgtctgtgatagctacttctgcatcacccttaacgttgaagtagatcttaccatctgcatcgccatcggtgtttgtagtatcttcaagcttaacgctatagtcatagcctgcttccttaaggatgttttcaatatccttttctgtgtatgtcttacccgttgaaaggtggagctttatttcagcggctgtagccggattacctgcagctgcgtctgcaggctttgcggctttagttacctcaacattttccttgcctgctgctacatctgtagatatagtaatcttagaagccatacctgtatcgtatgctttaccatatgaattagcagtaaatgttacctggtcagatgaaccgtgagcaccgctctttttatcaccgacaagcttgataacgtcagctgaatttgaacctgtagcacgaagacctgctactgtagcatctgtgtcacctgccttagaagctgtcataacaccgtttgcaagcttaatagaaatttctgagggcgcctgtgtctgaccgccatccttagactgtgtagcgttagcgatcaggttatcgatatccttctgagtgtaagtttcgccggcaacaaggttcatagtaagtgtcttaccatcagctgaccaaagagcattttcgccgcccttacctgatgctgcataagctgttgtaaccttaacgcctgctatattagatgtgattgtagcaccgacaagatcagtatctgccgttgaaacggcaccgtacttagcgccgaattctgtaacagcctttgagccgccgagtgaaccatcgaggagcttcatgccgttgtactctgtagaagaagcgattctgtcgatttcgctcttgagtgcgtcaacttcgagctggatagcttcacggtctgtatcatcctggtatgtaccgttagctgactgaactgcaagctctctcattctctgaagaattgagtgagtttcgtttaagccgccttcagctgtctggataagagagataccgtcgttggcattctttgtagcctgtgaaagaccacggatctgtgaacgcatcttttcagatatagccagacctgcagcgttatcgcctgcacggttgatctgataacctgaagataacttctcagttgccttctttgtacctgaaacgttgatgttcatcttgttgttagcattgatcgcatttaagttatgctgtactaccatacctgccattttgttttcctccttgaatgtactcccgaaatccttttcggaagtcgttgcccttatagggacttgtttttgttagtgtgaccttgctttgcgctaagctaaagtcatttggtgtttgttttgcaaaacactgcggaagttatctccgcctccgcacagggctctgtgacccttacatttattatatcggcacttgtttttctaaactttagcctttttgaaaacttttttataattttgctgagaaattttatagggagtttgtgtaaaatttacaatattaactgtcggctttgctaatagcaaaaaccgccctgcgtcacagagcggttatatgactgacttattttacgataagtgcaaggtgacctgccgaataacagtttatctcctttaagtaatctattatcattttcactctgtcaggattatgacaaagcggatgagaagcaagacagaccgctgttttaaacctctcaaatatttcgtttggattatcactgccggctgcagcggcagcaccgaaaaagtctataagtgctacagatgcacaaaaatatgcgtagttatcaaaaatattataattattatctgaaaacggcataaactcacacatataaagacatcttactatgtttcttatcataaacggtttagttgaacatattttatagaacttttcgagattagttatatatgtttgtattgcaacggaaaatttgccttcgatgttcttttttctgattgacgacaatatttctgacagtttatcacctacagctgtaccgtcaagcatacactgcacagcgccaagcttaaccttataattcggttcaatatccgaaagagattttacaagtgccgggctgtttatctgttttgataaagcggatataccctccggtattctgtccggcgatgacatttccagctttgaaagcgtttgagtcgcaagtgttcctataatcatcgatgtatgtatatcacgttttttatcactaagaatgccgtggaaaaaatcaaaaagctgatttctgtatttaagacccggattgctttttacgtcgtcaattgtgtcgggtttaaatatcagagcgtcttccggctcatattctttaccataaatataaacgtcacaagatttttcgttatttgcaataatatcaaatacagcaggacaactcaaaaatctgatttttgtaattacgttattatttatagtaccgcttataggataattccgacatacagcagaaaggtattctgccccaagttctttctgaattttacaaagtctgtcctctttatcgtgaaaaggacaatcaccgtcatcagacagctttatcgaatttgttattccgtcacacttcaaaaatgatctttgaataagcttgtcaaggctttcggaatgctcggaatttttcaatttttcaatttcttcgtctgtccatattatatcccaattccggcaacaatccatcgtgcactttccgcctatacactgaaaatcgttgacgtactgtgctgttttaagtatatatcccatatctttaccctttccggaatcttttccaaaaataatatctttattatagcaccgaattgcaggaatttcaacctgtagcaaaaggaaaggaggagcgtgagagcatagcaaaaaccgccctgcgtcacagagcggttttgcttgaataatagagaggtatatatgaaaactttcgttgtacttgggcggagcgtgtatagggcggctgttgccgtcttgccggctcctgttatgttaaccgtgcttgtcggcacgatatttttcaagccgaaacctatcggctgatttcggtcgtcggaatcctttcctctgactgtgactatagtataccccctttttatgaatcatataataacgggcgatgaaagaaatgtgaaaaatcttgaaacgcaggtgtatgtatcgtggggaatgtcctttaatgacgggcaaatttcatcacaaaaagtaaatctgaagccatacattgctatccgccgataatgcaacttacgcaatccgccaaccgtcagaacggcgaatttgaagcggcacatttccgcccgccaaagggcagaattaaacgttgctgtataaatcaactatatatttatctgacgttaatcacaatcaccttttcctatttctgctcagaagaaacgttaaaagggtgtaccgtaaggcactcgccgtacatcgttgttacgccaatctcaaacatacagaaaggcgaatttgaagcggcacactgccgcccgccacggaaaagccccttgtaccttagggggtggtacaaggggctttcctttgggttataattcagaggctatataaatagatgaaatcgaatttagcagctgcgatctcagaaatatcagaaatcaacttctgtatcgtagtagcagcacttaagcagcttctccatctcttcctgtgtaggaatacgagggttagaacctgtgcaagcgtctgcgatagcattcttagcgatctcaggtaatctctccaggaatacgttttcgggaacgaaaccgttttctgtaggatagctgtctgcgccgtagttcttgatgcagtgaggaatcttcagttcgtcattcatcttacgcagataagcgatgaggagctttaccttttcgtcgtcatttgcaccgccaagacccataaagtcagcgattacgccgtaacgcttcttagctgtttcgtcctttgcgttgaatgcgataaccttaggaagatacatagcgtttgcggcaccgtgtatgatgtgtgcgccgtaatcagcgaatgcggcacctgtcttgtgagccattgagtgaacgataccgagcagagcatttgagaatgccatacctgcgaggcactgtgcgttgtgcattgcatcacgcttagccatatcgccgttgtaagaaccaacgaggtcgttctggatcatcttgattgcgtgaagcgcaagaggatctgtaaagtcgcagttagctgttgaaacatatgcttcgatagcgtgtgtcatagcgtccatacctgtatgtgctacgagcttctgaggcattgtttctgcaaggtcgggatcaacgatagcaacatcgggagtaatctcgaagtcagcgataggatacttgatacccttgtggtaatctgtgatgattgagaatgcggtaacttcagtagctgtacccgatgtagaagaaatagcgcagaagtgagctttctttctgagttcgggaataccgaataccttacacatatcttcaaatgtgcagtcggggtactcgtactttatccacatagccttagctgcgtcgataggagaaccgccgcctattgctacgatccagtcgggctggaacttgagcattgcgtctgcacccttcataactgtttcaacagaaggatcgggttctacattctcaaagagctcaacctccatgcctgcttccttaagataagcctcagccttctgtaagaagccgaaacgcttcatcgaaccgccgccaacgacgatcattgccttcttgcccttaaagctctttaatgcctcaagtgcgcccttgccgtgataaacatctcttggtaatgtaaatctcatatgaaattcctcctgttcggcttatagccgttattaatctatatttagctgttatcattgtacgccctgcgttatgtatttgtgttgcaggacttctttcttttgttcgttattattttaacacactgagtcggaattgtaaaatatattttaggaatatcggtatataattatctatataacagtatcgaataaaatccgcataaatctgctctgcatcggcatttgccgtagtaaagccgtttgtgagccttttgtaacaaaattgtgaaaagtgcgtaaaaagctaaatgtaaatatatgtctgattttttaatggataaatattgcattactggaacttaccaaagtgtctgccgcccctgtctgccgcagataaccgctttgaaaatcaaagaacgcagagcatacaccctgcgtccgccgtttattcttcttcctttgtgttctgatacgtctttaatatgtcctccgcaacggctctttgcgtctttctcagatccattgcctgcttttgaatatgtctgtgcgcctgttcctccgtcagattcagatactgcataagcattgactttgcacggtttactatcttcatatccgataactgctgtgacagctggcggttttcctcctccagctttgccattccgatatgagctacctcggcaagctttattgtctgtataagcatagccttgttgaagggtcttgggagaacgaatgcaccggtaaaccgtatctttttctgcacctcgtcggcaatctcgtgcttggcaagcaccactacgccgttttttgcgtcttttgctatatctgcgacaagatcaagcccgaattcgtccgaaaggggagtggagatgatgacgctgtcaaaccttgatatgtctacgcctcttacgatagcgccgcttgtgaaagtcgagatgttgtcgcagtcaagctcaatcagaagtcctgctatgctgtcgcagatttcgcttgttttgcctgctataagtacattcattccgacaccctctttcgtggtattgaagctccccgtaccgctgtgtattacgatagcgaagccgctttatctatatctattttcgtctgttgtcagttatgcgtgtaaagctgcttgtacgggcttgctgtattcggtgacagcttgtagaatctgccctttaacagctcgtttgtgttatatccgaaattctttgcgaattcatcgacatattctcttatatcggccttgtcactgtcgtctgcgacctcgcacgaaacctgtacgggaagacccttaggcgcttcgtcgcttcttatatacatatgaccgccgtgcattcccgttccgcagaacgagcctatcggcgctttgccgtcacagcctatgccgagaacgattattattccgcctgcctgatattcgcccagaaaatctccgaccttgccgccgatgattattttcggatagaattcgtgatattccttcatatgtattcctacacggtagcctgcgttgccctttacgaatatcttgcctgaacgcatcgcatatcctgtcgtatcaccgcagtttccgtggatgaatatttcgccgttgttcattgtgtcgccgatagcgtcctgaccgttgccgtgtactatgatagtgcttccgtcaagatatgcgcccagagcgtttccgggagttccctcaaccgttatcgtcttgcccgcaacaccgcagccgatataacgctgtcccatagcgtcggttatcgttatatcgttgtcgtcacattcgactatctttttattaaggtcgtaataacctatttcgttagcgtttaatactgtcatggcttatcctccgttattgcagacattaagggcatcatcagtgctttttgcctgcgagcttttcttcacgtcttgccttgccgaacatcatcatctgcggcttatccctgagaagatcaagatctacctcggtaagcggtatctgctcctttatcatagaggtatagatacctgctcttgctacgtcgcccataagtatgaagcccttcagcagaccgtccttgaataccagcttcttgtagatttccttgtctgcgtcctcggtgatgtcctcatctccgtcatagcttcctgctgttatgatatgcagaccgtagaagcctatggcattcatcggtatagcgttcagataaagcgtttcctcgcctgccatattcttgcctgcgacctcgccctgcataaatgcgttaggcagaagtgcgagtatcctgtcggtatttgacgaacaatcgtggcttactgtgcagtcgcctgcggcataaacgttgtcaatcgttgtctgctggtgaaggtcggttattatacccttttcaaccttgccgcccgcatcgcttacaagctctgtgttaggtcttacgccgacagctattacaagaatatcaaaatccaccgtttcgccgtttgtcagcttagcactgttttttgagaactgctcaacgcttgtgccgaggataaatttcgttcctttatcctcaatgtgcttctgcattatctcgcctgcacggacatcaagaatactcgggagtatcctgtccgcaaggtcaactacagtaatatcggcattcagatgatgaagtgcctccgcacatttaagaccgataagacctgctcctattataagtacctttgtgccggctgtgactttttcacggatagcctttgcactgtcccacgtcataaatgtgaacttgtcctcgactttatcaatgtccttcatcggaggaacaaacggttttgaacccgttgctaccaataacttatcatactgtactttctctccgttgtcaagtaccacacagccgttttcgattttctcggcacgcaccgagaagatgacctttacattgttcttctcgtagaaatcaggctctctgtagtatatcttgtcgtcggcaaccttgccctcaagccagtagcttataagcggtcttgaatatgtgtgatatgcctcgtccgtgattatcgttatactgccgtccctgtcaaccgagcgtattccctgtaccgcacctattgcggcggcggagtttcctatgataacatactttttcatttcgctcctccttatctttcttcaaggacgatagccttgttcggacagccctttacacaggcaggctctccgttgttgttcttcatacaaaggtcgcatttctgtatgacctttgaatcctcgcttgttacgatacagccgtaaggacaggcaagcacgcaggtgtagcagcctacacaacggctctcgtcacacgaaataacgccgtccttctgcgataaagcgcctgttatacagctctttacgcaaagaggagtttcacagtgacggcactgcacggcaaaatttattccgctgccttcctcgacctttattctcggtatcggctttttgccgtttgcaaaagcctttatcatattttcggctccgctgtttgcggcggcacagtaatattcgcacagatggcacgcaaggcaccagtcctcgttaacgtaaactcttttcattttacttctcctttatcactgacctgcgtgctgtatgccgagtatctcaagttctttttcattaaggccgatacctctgagcataagtctgttgccctttagagcctctacggagttgatacccataccgcccatcatttccttgatctcgtgatcccacgcatgaacaagatttacaagacgctgataaccgatgttggggttaagacgctttacaaggtcaggacgctgtgttgcgataccccagttgcacttgcctgtctgacagcttctgcaaaggtgacagccgagcgccagcagagcggcagtgccgatataacaagcgtccgcaccgagtgcgatagcctttaccacgtccgagcttgaacggatagagcctgcgactactacagagacctcgtttctgataccctcgtcacgcagacgctggtcaacgcttgcgagtgcaagctcgatcgggatacctacattatctcttattcttgtgggagccgcacccgtaccgcctctgtaaccgtctattgcaataatatccgcacccgagcgggcaatgcccgatgcgatagcggcaacgttatgaactgcggcaatctttacgatgacaggctttttgtactctgtagcctctttcagcgaaagaacaagctgacgtaagtcctctatcgaatatatatcgtggtggggagcaggggagatagcgtccgttcccatagggatcattcttgttcttgaaacatcctcaaggatctttgcaccggggagatgtccgccgataccgggctttgcaccctgacccatcttgatttctattgccgcacccgtttcaagataatccttgaatacgccgaaacgtcccgatgcgacctgtactatagtgttggggccgtactgatagaagtccttgtgcagaccgccctcgcccgtgttatagaatatgccaagctccgtagccgctcttgcgaggctctcgtgagcattacggctgatagagccgtatgacatagccgagaacatgatgggcgtcgaaagctcaagcgtaggtgtcgtttccgtctttacactgccgtcctcgttgaaagaaacgttcttcggcttctttccgaggaatacctttgtttccataggctcacgcagagggtcgataggcggattcgttacctgagaagcgttgagcagtatcttgtcccagtaaacgggatattccttcgggttacccattgccgaaagaagaacgccgcccgtttctgcctgcttgtagacctcagtcattatctgctggctccagttggagttgttcctgaacttgttggggttatctactatcttcaatgcgcccgtaggacagatacatacgcatctctggcagtcaacgcactgctggctgtccgagatcatcatatcaagatctgcgtcatatctgtgtacctcgtttgaacactgtcttgcacacgcctgacattttatgcaacggtccttatctcttataacatcaaataaaggctgaaaataattaagtgccactgttaccgctccctttcttacttcttttcgttcagcttgacgatgataggctctccgcctctcggtgaccagatacggtcaacaacgggacagatggctcttatcgcacattcctcgctcgcaaggtaaaccatatcgcccttttctgcggcaaccattgaacgcagcttaagtctgtcgttgagtgccataaggcctccgtcaaagccgaggattatcgagaacggtcctgttatcagcaggcttgagaatacgtttctgaagtatctcagcttctgtctttcgctctcgctgtacttatccgagtctatctcgctccagaaaggagcggcgattatcttcgctatatcttcaagacacagcttctgttttctgttgaggaagtctattatatatgtgattacctctgtatctgtaagcaggttgcatttgtaaccgtacatttcaatatatcttctgtttgcgtcgtaggaagaaatctcgccgttatgtactatggtataatcaagcagtgcaaacggatgagcgccgccccaccagcccggagtgttcgtagggtatctgccgtgcgctgtccaggcatatcctgcgtattcctcaagtctgtagaactttccgacatcctcagggtatcctaccgccttgaatacgcccatatttttaccgcttgagaaaacgtatgaaccgtttatcttgtcgtttatgtttataacgcactgagcgacaaactctctttcgtcaagctgactttcggtgagctttgtcggcaggggattcacgaaatatctccatatcagcggctcgtttgtaatattcgggtgctttctcgtggggatacgggaaaggttcaccacgtcaaaatgcttgtcaagaaaacgctcggtttccacccttgcctcgtttgaatcgtagaaaatatggaatgcgtactgatccttgtactccggatagattccgtatcctgcaaatccgccgcccagaccgtttgatctgtcgtgcatataagatatagactttactatcttgtcaccgcatattctgttgccgtccctgcttataaagcctgagatagcgcagccggcggggattctgacctgaccttctttttccagcataagctcactcctgttcggtgtctgtttgtttctgaacgttttttggacgttttgaatccgataatttcatttttggggacaaaaacagcaggcaacagatgaatcgacctgcaaatctgcggaaatttgtaaattaaccgtaaattcaaggagtatttgcagtaaaatgaaacgtttgtttcaaatttaccgccatctgaaacagctttgtttcgttaattgcctgcagtcgttttgactacggttgtaattatatcacgggtttgcaatgctgtcaatatatttttgcaagttttttaaatgaaacttgcaaaatattttcttgcaatttcacattccgattatgcaaaatgacggcagaaccgctgtaccgtcatttcgcaaaaaccgattgttattataactgcactgtgaaatatatcaccaacaccgctaaaacattttctgtgccgacaaggcattaatattttcgtgagtataccagtacaactgctctaacaatggctcttcaaaaaaacgcactatccctcgaaaagcactatatccttgcctcccctcgaaaaaggggaggtggattgacggcattacaaaaccgttattctacataatcttcattttgtaatttaccggactgtttccaaaattgctatactttttgccgtcaagacggtggggattgaaattgatagaacttctatcccactcgcttttcgtaacgctaacatccatatatgcttgtttgctttcgcatccgcactatcccactcgcttttcgtagggcgaggggcttgcccctcccgttgcaccgaatactgccatttccactatcattgtaaaaggacaaccatccttcgctttgcaccatcacccttgccatatgaacgctctgttggctttgcgtccgttgcaatcgtggtcgtttgcggtcggtgcgtcctgcaccgactttttgcgaccacttgtaagcatccgtgcttaaagcctttgggcgttcaacttcaggcatccatgcccatcccttgtcaaaggtgaggttctgtcgcccgcaaaaatccaggcgactaccggagggattgctacacccaacctctccatcccacattcgcactttccggacaaagtgataaagcacccttccgcaacatatatttgtactaaaaaacgaaagcaggtaacgctatggtaaaacgcagaagttacaaagcggctataaagaagctcagaccttttgtgaaaggagctgtagccggaacagtgacagcggcggtttttaccgttatcggtgcatttttgtttaatattgccgatgctccttcgggagcagacagcgtaatggcgtatgtttcgctcggcgcatccgctgtcgtctgcggaatgttcttcggcggcggcagagggaaaaacggctttgcgtggggaacgctcggcggccttgcaatgttcgccctttgctttgcaatcacgcttatatccggcggatttaccggaacggaatttctgcctaagctgataagctcagcagtgtgcggctgtatcggcggaataatcggtgtcaatattgcggcagagcgataaaggcctgccgatagaatatttctatagacaaacaaagaaaaatgtggtagaattactttattacccgtgtataacagggtatttaacgctgatgtaaaaggaaggataaaaatgaacagttattcaatagaaacgcttgcggttcacgcaggctatgaaacggacgaagctacaatgtcggtaactccgcccctgtacgaaacaaatgcctatgtgttcaaggatgccgaacatgcaagaacgctctttgagcttaaagagccgggcaacatctactcaagactccagaatcctacctgcgatattcttgaacgtaaggtaacggctatggacggcggtgttgcggcactctcgtttgcatccggacatgccgctatattcaatactataataaacctctgcagtgagggtgacgagcttgtttcgtccataaacatctatggcggtgcgataaacctgctcggaatcacattaaagagaatgggcatcacggtaaagttcgttgaccccgatgacctttccgcctgggaaaatgccgtaaccgacaagacaaggctgttcttcaccgagcttatcggcaaccccaacgcaaacgtagcggatatcgaggagatcggcaagatagcccacaagcacggcatcccgtttgtagtagacagcaccttcacaacaccctatctttgcagacctatagagtggggcgcagaccttgttatccactccgcaacaaagtttttgggcggtcacggcagtgtaatggcaggtgttgtagtagacagcggaaagttcgctttcaagggtaatcccagattcccgctcttcaacgagcctgacgtatcctatcacggtgtagtgttcgccgatctcggagaaatggcattcatctcaagactccgtgcgctcataacaagagatataggcgcctgcctttcagcatctgcggctcacacctgccttacaggtatggaaacgcttgctttgcgtatgcagcgccattgcgaaaacgcacttgcggtagcaaaattccttgaagcccaccctgccgttgaaaaggtaaattatcctgcactgccctcaaacaagtattacgagctttgcaaaaagtattgtcccaagggagcaggcggtgtgttcacattcgttatcaagggcggcaagcccgcaggcgagaagttcatgaacagccttgagcttttacagatagttgcaaacgtcggcgatgtaagaagccaggttatccaccccgcttcaacaacgcacagccagttatcgcccgaacagctcgtagccgcaggaataagcgagggtacggtaagacttactatcggtatcgaggatataaacgatattattgcggatatttctcaggcactcgataaagcgactaagtaacataaaatgatgttttatggggtttggggcgttgccccaagcgggatgagggcggcagccccacaattagcccggcacggacgccgggcgtgtatgcccaaaggctctgcacgatgcagagccaacaaagcatacacagcccttcccatggggaaggggtttggggttagggatagagaatttactctatttttaaaaaaaacagacttttctacaagttggtattagcgcccaaacccgcccccgttttttataaaaattttataaaaccccttgacaaactcttttcgatgtgctaaaatatattagtaaatttacaagatatgcgccaatagctcagctggatagagtatctggctacgaaccagagggtcgggggttcgaatccctcttggcgtgccaatttacattagttacacttttagggatactacagtagtagtgtccttgaaactgtaaataaaatcatatatcacacagcagagcaggtgcaactgctccactgtgataatatacattttgtgttccgactcatagtttcgattaacgctctcgcatctctccgtagcttaacacctacccagtccgatgtagctcaactgtatcagtagtacagtatgtatactcgctccgcagaatgtgcggcgtttctgaactgtgactgttagtcggtggtttgcagtaaatcggtgtttactgttcctctcccgtgttactcacgcgatgttctcagaactaatgcgtagttatctcggctgtaggtcatctctgacgatggtcggcattcaatttgtactgcctttgatatgcggcaggtggggatatacactgcggatttacgccttgtatatcagattaaaaacacaagagcctccagcgtctggtaaacttctgaaagctcttgcaaaattgtataaaattgtattaaatgtgctataataaagcacactaaaggcactattgcactaagtcagtcagatggtttcgcatcgagctgatgaggggctgtatcgttcttgcaggaactatacagcctgtgtgtggtgttttttcatttactctattatacaacacttttacagttttgtcaattcaattgatgtaatgtatagtatacagaattgacaaaaatgcgggtgagtgtttgtgcaattttttgttttgtgaagcggacaattacacaaggacaaagcgaatgtacggagaaataaaagaaatagtgatcatattgtaaaaaggagtaactatatataaccgattttctgtttgcgcttttatcatttttcacttcttttcatttttctagtattgaatataccatgaaattttctattatatagcatcccttattttcaaaaaaccggtagatggtatctatataggtgcaaattttatgagaatcaaaatagccaaactttacatatctcccgttgtgtttcacggctatgttgaaataaaaaaagagtcccttctcgaaatggaaaaacacgaacttgttattttctttttgagtggagcggttggcaatgtcttcttgattggagtttcactattacttgttagcaatttcattaatttttatttttccattgttaatatctgttatgcaaccgcaagcgtactgccctttataataggaaataatgatatgactacaatgataaaggttttgaaagaaaaacaaaagatgtctaaaactgatatttgatatagcattaatgattagaaaggtgattaggttggtatgtccttactgcaacaatgaaatggaaagcggaatgattgttatttctgccacaggaagtgtaccgtgtgcaattatcgagtggtactctgaataaaaatgcaaatgggaatattcggcatatccaaaaaaagcaaggtcaatataaaagatcgaaaaaatggacatttttgctcacactattgttctcattgttgtaaagcgttttgtgaatttgaaacaaagaaaaacggaatcgctttaaatttagtgttctgaaaaaattatcgtttttatagagatgagcaaaacatgaaacaaaaactaacagaagtcgcaaaataggcaagtatcaaataaaaaagcagaaaaacggcacagcaaagctgacatcagacgaacagagctgaaatccggcagaaatattcaaaacaactcgtcaagcaatacacttaacggatttaagactgcgataagagctttcgaatttagtgacaacagttgcgtgagcgacagcgagcaaagcaatatgagcaacagaattaaggttttgtgcagcattaaagctatgcacccaaagacgttcctgaccggtctgcttgaaacgagagttgtaacgctcagcctctgttctgagtgcataaatcttcttgaacgaaacacattcacggtcaatggaaagtcagtaatcatcgggaagcgtgacatatttagtacaaccgcgagtttttttgccattgttccaattcttgtgattgcatggacaacagcctgattttgaacgtttgaacggacagcagtatttttggcgagttctgccattgtcagagaatttgccgtctttgtgcatagcgagaccggcttcacaaatcggatgacctgttgaaagcttcttcggatttttagtgttacgcttgttgatgggaataaagcattcgccgtgataaatatctttgacggcattgtaaattgccttaacatcgtaacctttatcagcaaaaaatgtgcattcctcaattgaaagaaaatcattggtttggcttagaatatcaagaacgacagtgctgtcggcaacatcggcagtagttgtcatttcaaagattggtaagcctgtaatgcagtcaactagaatatgattcttgtaaccccaatagtattcaaaattacgctcgttatgctgatttgaagcggtatgaacatccaaaccgcagtcttcgtcagacttaggctgattgccttttgcaaacttgtttttagcgaaagattttgggttattctgcttagtatttgcacttatgggagtagagtcgagagctatgaatgaagtgtcgataatacccattttggacaacttcagcacttgagactgcataagctttttaagcagagcgttatcaagatttctgatgaaacggtcgaaagtccagtaggacggcaatggtttcatgatattgaaaccgcagtaatgtgcgattatcagattgttattgagatagtccactaaatctgtgatacaggaaaaacattcgcattttataacaataaaagtgcaaaaccttgctctttttgaaaaaccgattctccctgtttttgcggcagcttcgggaaaatgagataggcgagattaagaaaaagcttctcatagaattgtgctttcggtgcagatgtgaacaatgtgatgtcctgtaaaatttcttggcgatagataacagccagcccctttcgtgtggttttcgtacaatttaattataccaaagttggttggctgtttctatatatttttagtgataaaattattttttgtgtcctgcaaatccgcttcttttctacgtttgcggcgttttgctcagggctacaaagaatggacagtggaggtggcagatgttacgataatgcaaggtgcgaaagtgtgatagtaataatgaaggaggagatgttttacagtcataaggaaaatctgaaaattatacaatttataaggcagtatttcctgagttataatatattgatgaaaggattggcgaaaaaacaaatatatataaatttttgaagttatgttaaaaattgatacagataattgatttttatgatgtatcaagttgtaacctaatgccgcaatgttccccgcctttataggcggcatgttccattcagactatcgtaggtgaattactgccttacagaaaagctgagtagctaacgctcctgcggcaagatttcttcgtcacagccgatgaaaagctatgcttacatcgggctttattccgagttaaaattaaaggaaattatcaaatgaagcttaagttcatacataaagcaaaaagaatatttataaccatctcatcattgtcaataattgcggcgatctctatagcggttgcatcatcggccagtgccgcaacacattttacaagctacacccctaaaatcaaatataataatggcaacattgattactgctattatgttgatggttctaaaaatgttaatcttactgcaggcgagtattttgtaaatggtaaatcatcttgttcagcacatagtgttatcagtcctgaggcatcaactgcaacatgtggatgttttgacggttgttatcaatgctatgggtttgcagcatttgtgtataaaggtgtatttactaaaaatttatctgaatcaaaatgtaatgattttggttgggggaagcgacaacaatgattatttattcctaaccgcaagaaacttgaaaattatgatttccgatttaccggtgggcacgcatttgagagtaagaacatcaaacaataataaccactctatagttttagcgggaaaaactgatacaacaattacagtttatgatgctaacgggtgcggatctaattccagcttattagaagctggatcgtcaaattattcaggacattgccaaataaacaaacaggttttcacatacaagaattttgccaaaagatatcctcgactcgattatatgcataaaggagcttaatatgaatgacagattaagattaatattgttggttatggctttatcggtcacagtagctttaacaggctgttctcagcccgaacaaaacagtagtatagcggcagatgataatacaacgtccttacaaagcagtatcgatactgttaccgatacttcaaaaaccgggagtataacagcacccgaaggtagtgagcttgtaaaaacgcttaccgataacaataataacaccgtggagctttacggatataaatcgggttccgatgagccgtttatatgctttatttcaattaaagataacgacaaaaaaccgattcagcaaatagaaataaacaaattcaaaacctttaccacagacagcggagataatgtatatgtttatgcagatgagaaaaccaaacaaggctatagaattatattaaacacagacaatagtattaaatcggtagaatattgtgaggacgcattacaatacataaaactcatagaggatattaataaaggcaatacatctatcgaagaacctgtggaggaattgccggaattctataccgaagaccccgaaaatgaaatgtacctcggcaacggcgaatttgtaaagcttgccgaccttgaagccgatcccaatgcggcaggttcatatattatccgtggttcaatgggcggttatgaatatgaaccgtttgacaacaacagcataagaaatccagatgattacgatttgaacgaaatgaaatgtataggctctcaaaaaggacccgtggtaagcaaggataaaataatagtacatgaaggcgacagcatcggcagtaagggtctgatagtagactcgtgctacatcagcgtagcacctcgcgtaatgtatagcgaaacgctaaaaaaagatataggcataggctatgatgtaatggacgcaaaaataactctgacgggtgaagtaacctttacgggtatactgcttgccgaacgctacaatatagagaattcggagcatgatggcgaaagcagaatactgtttatgccttattctaaggaataccatgaggctgtgccgttcctttttgatgttgacgctcaatataaagggagtagctgtgctatgttctataattacagctggggcaatccgcagtttgcgattacaacaagcgatggtgttataaatatcggttatttaaaggattgcgactttttaagttccgatacattttcagaggatgtgtattataaagaggccacaataacattttcagagattacttatatatccacagaaagaggcggtatgagcggattaatcggtactgttgtatcggtggataatatatgtgagcttgggaaaaagaaagaggtataatatgatgataatcaaaaacataataaaagcaactatagcaacaacagctgtaatttcatcggcatttgctatggtgttaccaggaaacgcattatcacctgtcacttacaaagcagcatcaaactacaagttggttcctatgggaccaacatcatgcgtagtcatgtcatacactattaatcgaagtcaacaaacagcaactgcaaaatatgaattcaacggtgggacggaggttcccaacggcgaaaaaagcgtttcagtggtttgtgaattaataattcctacaaaaaatggagaaactgtcataaagaataagagtaacggtaacggcgaatattccagacttgataaaatgacaaaaacagtagcattgactgctgctgaaaaagcagcaggatataaaatacagtttgtagatatatctataaattgcacttctggtacatacaaaccattctgggcagtcagctacacatattaacttttgtttagcgactgcacgtacggtggcacaacatgacgtgttataaatgtatctataagacaaaaaaggaaataaaacaaaagatgctcctgcgtgtgaaatataattactgcttatattttttgacacagaaaataaaataaaaacataaatacaacttatgaaagggcaatattatgaacaggaaattaaagcttataggcactgcaatactgattgctacatttgcgtccactttttccgcctgctcggatacaaaaacagatgatcaggcgagatatatgcgagtatacggaacaatatataatgacggcgagttgatagttaccgaaaacgcagtactaagctttttacagtattctgatatgagtacaattgcgctatgcggtcagtcaaactgtgaccactcaaatgctgttacagaggacggacttccgtgccttgcttacggcaaacaaaccttgccttttttgtataacgaaaagctttactggttcgaggatagatacgaaaccaaagacggaaaagcagtagaatccgcggtacttcactcatcagacccgcttggtacttccgaaaaggaagtatgcaaaatagaaggcttttcctgcgactggataagcacaagcgtacttaaaaacaacaccctgctgtttttcccttatcagtctgcttatgacgaaaaaggagcgattacaggcgataataccaatcatttcggagtgcttgacatagaaaccggaaaatttaccgattttggtgcaacggaaaacaataaaacaaagattttaggtgtctatgacaacaaattttatttcaacagctcggtgtacgacattaagacaggaaagtatagtgaaaacactatgccgtccgagccgcctgctgtcagacttagcgatgattactatgcatataacaatgacagcaatattgaagtgttaactccgaagacctctgaaccgattgttattcataacgacaagatattgtctgaaaccgtcattttgggcgattatctgttccaatgcgataatgcacagtggtattattataatttaaaggatgaagctcccgcaaggcatgatataagctatggcgaagggctttatgcacaggtattgtccgagtacgaggacagctatattatcagcgtctataacgccgaagaacaaacagtaacaaaagaaaaggtagcaaaatcggatattctgggggagtaagatatggcaaaaggattaagtagaatagctttaatagtggcgaccattgcggtggttatgttaatctcaagttgttcagatgtaacagaaagctctcaaagtagtaacaaagagaaaagtgttacaagtcttgtcggagaaatatatcatggcgacggatattttattcttgacgaaaacggtctgcaaatagtcaaggaaggtgctgcctatgacgagaataaaaagctatggaacgcaccatttgccgctgtgcgtaaaattaatgatactttttactgtgacagttttacttctcctgataaattcgatgataatatgaattacaaaggtgaagtgccgcaggacagcaaaaaaatgataaaattgctgaaatcgggtgatgttacagaaagtgggcttaccgtcacctctgcagtttcgtccgttaaagaaacactcgaatacaatcgggaaacaaattctaccgagccgggaatatcgcaaacagtatacacagaaatcacattaagcggagaggttactcttgaaggcgtattgtatgtagttcttgatgaagatctgtacatatcagaagaaaacagcatattgtttttcccttatcccgaaagcttaaaaaatgcacttggtttttcaccgaggttttccggtgatatagagagtagttatcttacctccaatgcttctaaaacaagtgtattgctatatggcgattgtgtatatttttatgcaggcaacacagataacagcgagtggctcacaaaggatttcagaaataaaccgtttggtacagcaaaattaacggtcagcgatataaagcttatatggcaaagcgatagtctggacaggttttcctttacggtaaaaaatgcggaaaatgttcaggctaaaaagtagaggtgtaaaaaatgcttcaaattaaaaatcttaataaacattacggtaaaaaacaggctctttttgattttgagatgacctttaaaaacggggtttacggacttttaggccccaacggcgcaggaaaatcaacgcttatgaacattatttcagataaccttgcaccagacttaggctcgcagctttgctggaacggcacagacataactaagcttggcagtaaatttcgccgtaaggtcggatatatgccgcaacagcaggcgctttatgacaactttaccgcaagacggtttatgatgtatatatcagctctcaaaggaatttctacagcagtagcaagagagcaaaccgagtatctgttaagtgaagttgaactgcatgacgtaatggataaagctatcggaggcttttcgggcggcatgaagcaaagagttttagttgcacagtccctactcggaagccccgagcttgttctgcttgatgagccgacggcaggtcttgacccaaagcaaagagttatcatacgggatatgatacataaaacagcaaaggacaaaattgtccttgtaagcacacatatagtatctgatgttgaaactattgcagatgaaataataattatgaagcagggcagaattgccgcaaacggaactgttgaacagcttgtcagtgttctcccgcacgaacgccggacactcgaaaacgcatatatgttgcactttcccgagaaaaacacggcaggaggtgctatagatgaaaatagctctgtatgagctttacaaagcgttaaaaagcaaagtgctgttaatattgtttgtagcactgtttttgctgaatttagctctttcggcaacatatacgcctgtccctggcgtacccgatgaatgtattcgtgaaattaacaaggtatatttatctacatcggaagaggaaaagctgtctgtcgcagagagtattgcaaacaaatatataaaagacaatgtgctacagaatatatttccggacaagaaatatgaggataaattaaatcgggtaaaaaactacaataccacaatcaggaatatcaaaagcgaagccgaacagcgttcaaaaccatcggttttttctaaggaaaacagctttacacagcttagcttcaaggatattttcacagcatacaacaatgtaattgaaaataaaccgtccttttatcccgactacggaacagaacgctatataaacagcgcagataccgatttaatgatgcttgtttttgtgcttatgctgacggttattgtatgctgtcgcgacaaaatgacaggcatggcggcggttataagacaaactcccaaagggcgtattcacagtgcaggagcaaagctgatagcctgctttttgcttaccgttacttcggctgtgttgttatacggtacggtattgcttacaggtactattcgcttcgggcttggcgatttatcaagatgtattcagtcaatcccgcagtttacgctatgcaatataaatatgaccgtgggagagtatcttgttatccactttttattcaaaacatcagccttttttatagtcgttgttgtaatgatgattatatgtactttccttaaaaatgttgcggcggcgtttgctgttatctctgtttgtagtggtgtttcgatatggctttatacttctataagtgatatatcggcatacaacatattaaaatacataaatttctgctgttttataagtccacatcagttattttacagatattatcatttaaacatttttggaaagcccgtatcggctcttaccgtctgtgtaattacaacagtaataattcttatcatggctttgcttatttattttgcggtttattgctcaagacgcgctatatcggcttcaggtaaaatatcggaaatcttttcatatattacagtaaaacgcaagctctcggcaaattttgttgtaaacgaggtatataaaacggcaatagcgggaaaagcattgcttgttcttgttgttgtcgctgttattgggttctgcaattatcagaatatgagtgcaggctacgattccgagcaaaaacgctacgacagctatgtagcacagataggcggggaagtgacggatgaaactctgttgtttttggaaaatgaaaagctggaatttgaaaatataaagctacgctatgaagaattattgacgcagacacccgctgaatcggattatgaaagctacaataaggaattgaacgatattacaaaaaagcttgactatgagaatgcatttaataagatatgtgaccgtgtgtcggttattaagtctgataaaaatagcaacctacagctcgtttttgaagaagggtttaaccgtcttttgtcggtaaacggctataaggacgacttccttatgtgtatactcgctactatagcccttgtgctgtgtatatcgcctatgatagcatttgataatcagagaggactgacaaagctcctacgtactacagaaaagggcagaatcaagcgctttgccatagacggcgtaataactcttgttatctctgcaatagtatttgtagcggtatggctacccgaatttgttttcgtaatgaacaattacaagctctcattcttagacgcacccttacagagtattacggcactttacggtatgcaaacaaacgaaacaatattgcaatacataattcgggtatacctgatacggtttttctctatgctcgcctgcggcttttttatgctgtgtgtatcaaagctatcggctaatcttataaccgccttttcggtaaatattctgttatttgttctacccttggggctttgcgttgtcagcgaaagctttgtcgtgatatggatatgtccgtacctttcaggcaccgcagagagaagcgcgtcacctgctaatctcattatcaccgtgataattttcataggcttgatattggttgcgggaggtgaaggcgtaaagaaagcggtagagaagataggtaaacggttttaatatgatattgtagagctgagcaaaacacaaagtaaaaagtcagcagctacaaatgagcaaaatgaagataacaggcagaaaaaccgcacttcaaagcacagctgttaaatgacatatctttaggtgaaattattcctatgccgatttttctgtaaatatcatactgatatttttcagctataataatcatatcctctttttgtaaatttgtcaagagttcataatcatcagctgtattaatatttgcaatgaaaagcaaattattgtttttataagcagctgaaagtttgttttctaaagttttgaatttatcaatattcatgacgaaactcctttaattaaaatggtcaaaaatatcttaaaattaaccttcagaaataaaaaagctataaatccattatacaagcggtataacaacgataaatactgcaagtccgataccgaaaaattcagaaaacttaatccggaaggacaaacaaaatctgaaaaagtcccgcatatatctttaatatagcagtatcatattcgtatataaaagatattctgtctttctgaaggtagtataactgggtattgtatagaccttaaatttcgggggctacccctgttttttaaaaaaataacgctataatcgccctgtcccacttgacaaatgctgccgatagcgttattataattacgcaggctgtttaattctgtgattgtgggattatcagtgtgcttaagaatgtttttaaatgagataagcccggagtgcaagccgggcttatttcttttcttgataagtttaataaccttcaggctgtaagaattatccgcataaacttttctgttgtcgtaacgcattttacgttgtttacggacaaggtgcagattgacaagattactgactattttcatagcggtgtcacgcttgatgttcagctcatcggcgagatcgttgaaacttttgaaacaatatccgagcttgctgtctattgatttcataatgagaatataaaggcgcagttcgggtgcggaaagtttcttattgaacacatttctgtctatacgggtataatcagattttactttgttcttttcgggattcagaacgtatgtgtatgtacctttgcgattgcctttacgataagccgcaattatatgtgtgatgtaaccttttctcatcaggctttcaattatacgagatactgtctgtgtagactttataccgcagtgtgctgctatagtctgctgtctgacacgcttatattcgtgtcctgctctgcttcgtatatttgaatagattgaaagcaaataggtatacacggcaaactcattgtgtgtaagttctcttgcggtaataaccgagttagatatcagaaagtaactcttcattttcacacatccttgtattttgttgtattttaacgtctgagcggcttagtagtagtctgaatggtacttttctcttctaacgctctgaacgcttttaaatcgtcgttaaagtccttatttaagggtatatcattcgatattgtatatcctttaagtgcatacttgtcactgagctgtgccgaggcgtgtctgcctgcttcatcgttatccaggcagagtgtaatttcggtaatgggattattttgtaaaaactcatcaagagcaacatcagatttgccaccaagggaaatcatagtcagctcttgccaggaatcctgaccgtttcttatagcataaaatgacgcataagacagcatatcaattacagactcgaaaacatacagcttgttcttatttgtgccgattaaagaaaacgaatatttcttatcgcttccgggcaaatctacacggtatgtagatttatccgatacagaacggcaaaacgcatagcgtgacataacgccatcaccgtttacagcaatcatatttacgtattttttagtaataccacgttcgataagctcaggtatatgttcactgctgaacccttcgcagatatacttttcacctttttgcttctgtgcctgaagctcaacggtaacatattccggtgcattttcaggcacatcatttttgaagcgataaaacggtgtgttcgagctgtcatacccgacaagctgaagcccgctgtatccgacaccctgatatagtttacgatcgtaaatcagctgatttacgatactgtattccaatccacgggttttacataagtaggcgattacattactgtaattgcgctgtccgttttctttgtgatcctgttcgggcaaaataagccgatttgattccttatctttagaaacgctcggctttgacgttatcttatttggagtatactcaatttgaatatctccacaaagcgactttacagcttcagtaaaactttgtccgtaaatcttcatacagaacgcaatggcattgttgccaccttcgtcacggctgttccagtaccaccctctgcggtcattcgtgataaaaaggctgtcgtgcttatcacagcgataaccgttaccgcttttctttacgctgaagccttctgttcgttcaagaaattccaccatatcaacatttcttgcacgctctatctgttctttcgtaacatagttactcggtttagatttagaaaaactcataaaaagctccttaaaaaagaaagcaacgatttcctctttttcagaggttgtcgttgcttgttatttttatcttctatccagtaccattgcctactgaattcatcggcagtatctcgcttgataatttcttttttcagacggcgaatgcggaatgcctgtgttataattacagctaataaaattgttataagaacgctcatagtaaaacctacttactgcgtttttgtgattgtgcgggaaaatcaaagtcgatttttccgtctttaacgataagtgccgctgagaatgctttgcccgactttgaagtaaatccgtttattattcttgttcgcttattagcgcataacatagtcgcaatcgtgtctgtaatacattttccgcatatagttccggctataaaaaaattacacccgtttttatacccggtgcagacccatcctttagaactttttatcatttcttttccgcaaacaggacatttaagacgttcgggaaattcaaaaccgatcgtattatctgctttgattgttagcttcgcatcaaatgtttttccgctctgagatgtaaagcccttgatgatagatgtcgaacgtttcaatgtaagctctttggcgattacatctgatatttttttaccgcagatttcatttgcaatataaaatctgcaactatccgggttatccttggaataacctgtacagcaccaacctacttttttcttaattaaaggtttactgcataacggacaaataagggtgttacctgccattgcagaagtatcactgttttttattaactctacccatttagctacaagctttttgtaattattcaagaaatcatttccgtcagactttccacgggcaattttatcaagttccatttccatatcgctggtcatatcaacagacagcatatcgggtaccgtcttttcaagtgcatcgattatatacattcctttttctgttggcataatgcctttgatcatattgccgttttttttggttctacgagcaatatagcctttttcatacagctctttaatgataccttgacgtgttgcggcagttcccagtccacgcttttcaagtttaattaagttgcgagtttgttcatcttctatattatcacctgcaagctccattgccgtaagcagtgtagcatcggtataatacttcggtggctcattttgtccctctttgacatcgaaaccgataactttataatcgttatccttaacgatttcgggcaacccgattaccttcggcgttgcatcaacagcaaaccaaccgggactgattatattcgttccggttgctgtaaacagctgattatcaatctgaaaaacagctttgacattttctgtaacagctttcggataaacagtacggataattgataacgcaagcaaagtatatgccttgcgctcattttctgacataccgcttaaatcattcggcacaagagcggtcggtgtaatagcggtgtgcgaatcgactttgctgtcatcataatgccgacgtgtacagggtgcaaaattgtcgacaggaatagcatatttagcaaattcgggcatttcaaacagtagctttattatctttaccgtttcatctttcattgcatctgttagatgctccgagcttgtgcgtggatatgttatcaatctgttttcgtacaagctctgaacgagctttgtaagcatatcaattgtgagatccgtacactttgataaatcagcaagcaaatgtgtagtgttatataaaagcggagcggctgtctgcttttgcaacacctcgactttaatcgcttttgccgtatttaatttaatttcatctataacagcctttgccgccgtttcggtatcgtacttatctgccgcttcggcagtaaactttgcgccgtcagttgcttcgatattggcaactattttataaaacggctttttaacataattccttatttcccgttcacgcttaacaatcattgcgagtgtcggcatttttacacgtccgcaggcgaatacattatccgtaccaccgaatttcaatgtagccgcaacagacgtgttaataccaacgagccagtctgttgcagaccgtatacgtcctgcattttcaagcggcttcatatcttttgccgggcgtaactctgcaaatgcctttctgatcttaaaaggcgtcaaatctgttatccaaacacgtttataaggtactgtacaatgcaacacttcatataagtacgcaaaaatcaattcgccttcacggtctgcatcagtggcattgattatcagatccgccttatcaaagaactgcttaacataatcataagcaagcctggaataattattatcttttactcttgtaataaaatgttcgggtataatcgggtaattatcgaagctccagaatttataactttcgttataatcttcagccggagctaaaccgcataagtgaccggcaccgtgacaaagtatagcttcctcgccgtttaaatttaagctccagtgagctatcgagggttctttaggattcactgtttttttgtatgcgcctaaagcctcggcaattgtccgaccgaggctgtatttttcggcatagattacaatcataatcttctcctttcaagttgtgctacaggtagcacatcttaataaacgatatatgctttaagaatgttgctgtatacgttattgttgtttgcgtttgttgccatccagttgtcggaaggctcaagcatatacgcattaaatccggactttataagctgtttgtttattgcaacaaacttatttacggtaacagggaaaaagcacagatttacatccatcttattcggaataattacgttgttaatgtaatcagtaagcattggcatatcccaatcagccgccgaacacagcaaaaggtgtatatacgcattatgattaagcgtaatgccgtcatcgcaaacgatgtaatcgaacgtatcactgattttatcgaaacacgaatatataataacatcatctatgttgaagccgttctcgtttacggtagtttcgtctacgttaaaatatttgcataacccggctgttacagctgtaacaatgcaaacctttgctctttcgtacttgtgtaagtaaaatgcaatgtcaaaagcagtgtatgtactgccgcaacgggaattatatccgaataccgaaataatcacattacctcgctgtattcgttcataattttcagttaaacgtacagtttgcattgaatatgaattgtcactgacatctttataattgatcccgacaaagttgccgggatattcgtgcacttttctgtcgggataactcagttctttattttcatccgatgaatcttccgtaaccggaatatcgggcgtttctgtttttggatttaagatcgcataatctattgcggcaggatcatagcccacaacaatatcataaacgcctatagaatataaagccgacgcatacttgttgaaactgctatcgttactgcacataaaaattatacgcatatagccgtaacgcatttttataatgctgagaaaatctatcagtgatacgcatttagtgacggtatcgtccccgactaatataccatggggacgatacttttcgtatatttcagtagctgtattgggtctgacagaagtgtacttacctaccgttacagcttgctcggattttttaagcactgtatcaaggttacgcatactgcgtttaccggtaatcaatacaatattcatttaatcaccgctttctggtttataagtgtaatttttaatttctcgagtatcgaggagatgattttcaggttatcctccttgaaagtttcataagcaaaagaatcaagtataatcatcaggtaactgtctgccgaaaggtaaattctgcaaacaagccttgaacgtaacatcggatttgaaagaataccgtcagccgccgtaataacggtaactgacggtaaagaaaaacagcgtaaaagtacggctctgtcgtttattctgcttccgtaacaatgagtaaaatcgctgtcatatacggaaaatgcacatatcggtatatgagcatttttaaaatcggcaaaggtttttgcaaacaaagctgaatctgtcaactgaatgctgttttcctctgattgttctgcattagtcaagattttatttgttatactcattgtgctacaggtagcacaattttttatgtttgagctattatccttgttttcacacagctttttgacagagttcaatttaattttaggcgtagagtattttaattgcagttttttcatatttctctcctaaaatcagtctgacagagcttgtatattgcactatcctttggaacgcgtctgtcaaacggtattatctttctgccgcttacgataagccctgtgcctttttcaccggtctgtaagtagctcgactgcgaaggcgacaagttaaataactctatgagcttatcaaggtcggttttcttctgctgaagaagaactacaaattcagagtttgaaagcataacctttgcctgccccgaatcaaggacttccgttatgttctgtgttatgccggtaggtataccgccgtattttctgattcgtttaaataccttctgaaaaaagtcggcagagcgaactgtttctttaccgttaccgtcgttgaacataacggagaactcatcgacccacacccaagtttgaatgcccttatttctgttgtcacgaacacgctgccagatgtactcgagtataacctgtaatcctaccggacggagctgttcgcccatatcggatatatcaatggacaacagcttgttatccgtatgaatgtttgttttgcccgaaaaagtattgaaactgccgttaacataaagctcgatgtccagtgctatctgatctgcttcaggtagttttttgtttataagcgcattgtaaaaatcaacaaaagtcggtgtgaattccggattaccgttattaagtacataatcggcataaacttctttgacacaactgtcgataatagatttgtcggcggcagataacggcagccctcgtgccgtttctatgatcgacataatcagctcggatttcatagcaacggcagatgtgccattttcactgatatttatatcggtgtcaaatatgttgatctttgtttcggaatcagctgataatttcagcgtatcgccgccaaatcgcttgatgagaggatagtattctccatcgggatctataattatcttttccgatttagggtaacgtatgattgtatctataatttcggatttgcaatacatcgattttcccgaacccgatgtaccgagatagaaaccgttagcgttcatctcttcagctcgatcaagtacaataatagcgttggtgtgcttgttcataccgtagcaaagaccggtgtcggaaaaataagatcgtgctgaaaacggtattagaataccggcggcatcggacagaacataagtatttacattgttgccattggcattatcaaaatggttaataccaaacggaaggacggaatcaagtgctttttcctgttgtctgacaaggcaatcgataacgacctgatgcttttttccttttgaacgtatagcttctgtcagctcttcaagctcctcttttgtagaagcggataatgatataaaaacgccgattttgaaaagttcacaatttgtatcagacaagcgttcttgaagatcttccagttcacgctcacgctccgtccagtgataaggaacaaaattcagtccttttttgtggtttttttcaagccttgcttgtattttgccttgatgagcatatatattgtctttcaccctgtcctgtgcttcggacttgtcaatatgtttgatgtgcttagatacaacaatcttgcagttgttatcaagaatatcacgaataaactcatcgtctaaagttctgtcatatcgagccatatacaatattcgtgtatacgaattaccgatttcaacttcctttgggcggaatgcaaacattgacggcgctatataatccttgatcgatccgccacgtgaatatatatcggatggcaacagaaattcggtattatcaaacggatgataatattcgtaaagaattgtgaaaacttcttcgggcataagctggcgagtttcactgccgatagcagcgtaaaaattctgcatttccctgtaataacgaaacattatattaacattatccacggtttcgttcggagtatatgacatggcgacgagtgttattttttcgctcgttgcgtcttcggattttgcaatatacgtttcgagatttttgttgtaatcatcgagtatatcacgaggtatttccttgttgttgcttatgagaatatttctgagctttgctgtattaacagaagagttcataataaactcctgaaaatttatttcgaccggaagtgcgttaagcaaacgctgataacgttgataggtttcttcctgctctctgtcacgtagcagagaatagtcgatattcgaaaatgcaaatatcaacgtaaacgtgttaactcctgtaagaaacaatccgttatcgtacacttcataaaacggtattgtatcctgtgccgatttcggcataacaatacgtttgtcatagccgaaaggcacatttttccttgcagaaccgccattaaagaatttatctattatcgacattgttgaatacccccttgctattgtatggtcgcttttgtgtagaattagaagtgatgaactttaatactgacataccttgaattcgcactacaccaaatccgatgaacagcactaattcaagaaatactatccacattaccgcatctataccgactttaagtaccagccatagtaacagcaatgatcctatagttacgatacagccgattattaaagtcacgatttgaatgattgataatcccattatcgttccggattcttgcattatttttttggttactttgcactttatcatttttatgaacctcctgtatcctgagcggtataatcacctgtccacgcatcctttgaggactgaatacaatacgctacctgtcctgttgagctaccaacattgagcttgattatctgtccgtatgtgcttgtgttcagtctgccgttgaagttatatgaataaccgtaccagtcaacatataacttctgatttgagccgtttgcgatattcattcttgtagccgcaagcgtatttacacttattgccgacatagcaataacgacagctaaaactaagctcaacatttttctgagtttgtttttcatactgatttcctttcttgatttgtatttgtatatataaaaaagcagtcctacgggtgcggactgctttgaatttttgctttcagaaaaagaaaaagagctttgaattttatactctcaaagctcttacatatttaattgttcacaaatacgaaatgcgtttaaatttatgaataaactacatcagcagtttaacctcttaaaaagtatatagcatatgcttttgtcagctttccgttttcatctcgtacatccaaatcttcagatatgtcctgaatgtacactttgaaatagtcgccttttttcataaacccttttatgttgtcctttgcaaagctctcaacatctcttttaattacattggggtgcaaatcgtaagagataacaagaggtgtaaaccacgtgctaccttcgggagtccaggttggatcttcaaggttttttaatccgtaattgtttacagcgtcatttactataacctgtttaattgcttcaaggtcaaacggatattcgtatattgacttcggcttgctttcctgtttcttcgttgtggtggtcgcaggctttggcgtttccgctttctttgtggttgttgtagtctgtataacaatcttgctgtcgctcagatagtcaccgtgtataaagctaccgtcagaaagtttgaagtagcctgtatcggtcttggctgtcactgtcaccttgtcgttcacgctgtacagcttaactgtgtcagcgccgagtacggctttcttacggctgtagcagtcggtgttgacatactttgtaccgcttgccttgctctccgtccattcgggtgtgggcttagtcgttgctactgttgttgtcgttgccggctttggctttgccgtggtgactgctgtagctgctgctgtcgtttccaacttttttgtttcctgcggctttgtagtggtctgagcggtagttactgctgtagtcgcttcggctttcggctcgtcaatcctatccatcactgttcccgttactgccggagcggtagttgtcactgccgtttcgggtgcagaggacgttgtgctgcttgcattgcctgccgtgcaagcactggtcagtattacgctgataagggttattgttgcgagtatggtgtgggtacgtttcattttgtcctcctttgtgggattggtagattgcccttaactgtttaagatggcttttatctgttcttctgaaagtccgctttttctcatttttgagatcatttctgcttcttttcttttttcgcctttcttaagtccgactgcttcgccctcggctcttgcgtgtgccttttcggttgcttcgatatgcagagccttttcacgcatttccgcaagctctcttgtcttttcgtccgcactcatcttatgcagtacaactactgcgtcctgtatctgctttacgcctgtctgctgtaacatatcaagttcatcctccgtttccgcattgataagtctgagccatagctcctgcttgttgttcttgtcgatattcttgcctattttcttcagctcgaagtaatgagccgtgaatttatccgtaagctgttcgtttctgctgtcctctctcattgagaacgatgaatgatatttttcgcagtcaaagagattgaagttgatgatatttatcgaaatgcactggttcagcgagccgtacacctctccgcttttaagctgtccgctgtacagcttagacaggtagtagagcgaacggtccttgtaatcgccctcgtcctttatctgcatttcaacgtttatcagtcttccattggctttcatacgaatatccatacggctgtatttctcggttatgctgtccggcattatctcggaattgagtacaacgaggttttctatcgaatcatacggtataccgagcgtatccgataagtaagcctgtagtaaatgctgatttccctcgtccgtaaacaacttcttgaatattatatccagctttgcctttactatatttcttgccatttgtgcatctcctttcgattcggtactatttcctcaagtatattgtaacataaaaacggacaaaagtccagcgaaacacagcaaaaatatatacaaaatatagtattgttttttgttcgtttcgccgatttttacaaacttgttacattgtgctacaggtagcacaaaaaagaaatgctgattaactttcagaaaagaaaaaagcggctgatttcagtcgctcatatccatattcaattaaagtgtcgggtacatatcatctttctgagaattgcttttcgtatcaggatagagtttagcattcagttcatctatctgccgagcttgcttccgaactacttttttaagttcaagatttgcttcttttaactcatatttttcttgatataaatcggcaatcagttgagtcttttctttcaatatattcttacacgaggctaagtcatcaatggcttgcgcccatcttttatcattattgtccagcagttgttctctttgctttttcatattgaactcattcgtaatgaaagcgtatgtaccttttgtgctatcagcaacgctattaatgcttttcttgatttcttcatttaagatttttttaatatctgcgtgaccttccataagagttttatgttgtgtagttagatttgttccttctccgttggttacaccgagtcggtttgctatagaaagttcaccgtcttttactcctatttgacaattaatatacaaactaatcaaaaatacagagcttgagattccatttttattagccagtcaatgtggattgcgtccttcggaaatatgtgcattgacaaaggattgcattaccgctgacggattagaaattcgcaaagcagttgtaataaatgagcatggcagagaagtatataagccgcctaagtcatacgccggatataggacaataccaatatcgcccttactgcgagataaactcatgaatactccggataaaaaacggatttgcgttatatcttcaaataaaataagccgtgattggaattcatttcttcgtaaacacgggctacatatatttagattctattctttgcgacattattacgccagtcaagcattattgcttggaataccacagaaatatattgcggaattaatggggccattcatcgactgacatgattgaaaaggtctatcagcacacctttccatctgcgatggaagaatttaaggttcgtattgctgataacatagaaaaacttttggggtaataagggttcgaatccctcttggcgtgccaaccgctttgataatcattatcaaagcggtttttcttttgcatattatatacagaaaaggcggaacggtttttatgctgttccgccttatattattccgttttaacaaattcagatacccattggatcccccagaacaccgtaagatgaatagccgggtcagacagcataagtaccgcacgctccgttttacttgaatcatcgtcctgcactctgagtatctgataagcaatacccgcaattccgatgaacacggcaggaagcatacttgtggcgaagctcattgcaacgccgtataaaacaaccagtccgcatgtgcctataagcctttttaaaaagtaacgtgacgtatcgacctttccgcagagtgttataattattgcaattacactgcatattatagctccgaagcaaacataccgccacaaagcgtcaagccgtgtaaacgccgaaattccgcctgcataaagaaagtcggtaacagtgcgtgcaatgccccatataataattaacacaggaaaaagcaatgattgcaaaagtgccgacttgtcgtttgtgaacatggtacacccccatttatggaaatcgcattgaagctgttatggtatttatttgtgataccttttccccgcaataatactatacgccctgtaaatctgctccagaagcatcacccttgcaagctgatgcggaaacgtcatcttcgacatcgacagctttatatcagccatcgcctttatctttggcgcaagcccgaacgagcttccgattatgaagttcaccgccgactttccctgcaccgccgtatcactcagcttagcggcaagctcctcgcttgaaagctgctttccctcaatgcacatagcaaccgtcaaagcgttctttgcgagcttcttttctatcatttcagcttctttttcgagtgcgtcctctatctgcctgtcagacggctcattcggcagtgcgacaggctcaagctcatatattttcagcacacaggagccgccgagccgcttttcatattccttgcaggcatctctcagatagatttccttcagtctgccgaggcagattatattaacaccttgcatcagcgtcttttagcgtagctttcaaagcggcgcttctcctttgatgccagctttctgcgcttggagttttctatcgttcttgtaactataaagcagataagcagtacaactattccgacagccgaaaccttgaaccacggcttgtcgaactcgtcctttgctttttctatataatattccacgtccgatctggcaacattgttgtttgcaacaaggttcatcgtggtgatagtttcgcccttgaatttaacgtccattacgccgagtatatcgccctttttcacgggagcctgtacgctttcatatgccttaaagaccttctgcactcccgattcctttaccgatttcggcatgagcgccgtgtagtcgctttcgggtgtcagtataacgtgcgttgcgctctctcccatttcgaccttgacttcggttatctgctcgtccttgtttactacagtagccatttcaaagtttgtgaatgcccacttgtagaggttgagtgcgtcgatcatcgaataccagtcgtcatagtattctccgttcttgtcctttaccggtgcgccgagcgtcacaaggatatagttgtactgattcttagcggctgaaacaaggcatcttccggcttcgtccgtagtaccagtctttgtgccgtatgcgtattcatattcgtaaacactgccgggacgaagaagtgagatagtgctgtatatagagtaaccgctggggttagcgtcatttttcggcatctcatattcataggtgcttgttattttcttgaacagcggaaatttgtcgtaggcgtattttgtcattttatacaggtcttccgcagttgtgtagttgttgtcgttatgcagaccgtgagcgttcacaaagtttgttccggtacagccaagctccttcgctttttcgttcatcattccgataaactttgtgatgcttcccccgcctatattataggcaagaatgtttgccgcttcacaggcagacgggagcataagcgcatacagacagtccttgtatgtcaggttgtcctgcagcggttctatcgccgcatttgacgggtcactgtagttcgggtcctcgtagaaatcgttgaagcagtcataaggcacttccaccttctttgacaaagcgccctcggacagatgctcaagcgcaattatgcaggtcattatttttgtggttgaagcagggtacattttcttgctctcgttcttcttgtacaccacatctcccgtatcggtgttgaccatatacacagcctcgctgtatatcttgtcggtgttcgggtcaaaatcatatacctcgtcgtcgttttccgcaaaagcggtaacggaaagcgagcataacagcatagccccgcaaagcagagcagacgcaaagcgtaatatcttcttcataatttattccgttccttttcatcggagattttttaatatgttccctattattgtatcacatatctccgaaaaagaaaagacttttttgcttgttaatattttattttgcgtattctccttgtcggctttccttttttgtgttaaaatagaataagaattttcttacaattcggcaagaaagccgtatctgccgaaaaagcggagtaaaatacaagggggtgagagtatgaacggaaatgtgcggagaaatgccaaaacagcttttgtatgcgtattgtttataataattgtttctttgtttttctatcttcttaccgcaggcacaatgccggaatctgtcgatataccgtctgcggacaaaatagcggatgtcgatttgtcaaaggaaggcgtcggtatagatatatcctccggcgaatattacaaaggacggctgtatactccggacaattttgcaaaaggcgatatatcgcagggtaatcccgatgataaatatgccacattccgcatagtactgccccttgaaaaaggtgtcacctacggactttccggagaaacggcgacctatgcacaacaggtttatattgacggaaaactgctcagcgaggtcggtaaggtgtccgacaatgccgaagaatttgtccctgcgacagacagatacacgctatatttcaccgcacaggcggatactgcggagataataatccgtcacgcatggtttaatcacaggacaggcacgatacaaaagctgtgccttgcaaaagctccgcttatatccgcaaatgaaagggcacagaccgtttgtgacggacttattgcgggaactctgcttgctatggcaatattctttttcggaatgttccttctcggaaacagaaaacgcagtatgatgtggttttcgctgtcctgtcttactgcggctctgcattatctcatatatgaaagcaagcagataggcgtactgttcccctatcttgactggtacactgagcataagctcgaatacatcacgaatatactttacttcgtgtttatactgctctatgcctttgccgcactcggattaagaccgcataagcgttttgttgtgacctctatatgctcggcaggtgcgatattgctgttctacatctttacgccgtcaaccgtttatacgcattttaccgttgttgcaggcgctgttatggcggtatatctgattctttcttctgtatatatctgtgttacggcggtaaaacacaggcttatgggctacatcgacagcattatagtatgctcaaccgttgtgcttaccacagtcgtttatttgatagaagggcttacctatttcacgaagatattctatatccgctcctatgcgactatattgttcgtgttctgtaatgcggtcatgcttactataaatctgtccagaacagagcgccgccttgacgaatcgaaacagcgtgaatcgcaggtcacccatatgaatgaaacgcttgaaaagctcgacaggctgaaaaccgattttatgcacaatatcgcccacgaaatgaaaactccgctcacagtaatgagcggatacgcacagcttaccgaaaaacagatagaaaagaatgtcgtaaacgatgaaacattgtcaaatcttgaaacgatttcaagcgaggctcagcgtctgtctgatatggtgacaaagctgctctcggtatctcataacgaggtcacagcaatggagctgagcaggtttgccgcaagggacgttctttccgatgcggcggcggtttgcagacctatacttgcaaagcacggcaaccggcttgtcacaagggcggataactgccccgatataatagcaaaccgtgaaatgctgcttcaggtgcttataaatctggctgtaaattcgggcaagcataccgagaacggaacagtgctattttcggcagaaaaatccgccgacggtgataatttcgccgtgttcacagtatccgataccggaacgggaatatcccgtgaggcacttgcacatctgtttgacaaaggctacagcacggacggcggaaacgggctgggactttatatctgccgtgatattatagaatcgacaggcggcaaaataaccgcagacagcagtgaaaacggagcggtgttccgctttaccgtaccgtgtggaaaggaagatgcaaagtgagtacgattctgcttgtagaggacaatccgcatataatgaagataaacagctcgtgtctttctatggaggattacagcgttcttgaggcggcagatgcggcgcagtgccgttatatgctgtcgaataacgatgtcgatcttgtgatactcgatataatgctccctgacggcgacggaatatcgctttgccgtgagataaaggcaaaatacgatattccgatactgttcctgtccgcactcagcgaaaacgatgatattataacggcgctgagagcaggcggtgacgattatctgccgaagccctacgatatacaggtgctgatagcaagggtagaggcaaggcttcgctcagtacggaaagataagcgttatatctcgttcggaaggctcagacttgatacggtttcaatggcggcatattttgccgacaacgacctgctcactacccagaaagagttctcgatactgcttatgcttgcccgtaatatcggcagtacagtgccgaaagccgaactgtacgaaaacgtgtggggtctgccgtattccgacaacgcaaatgcactgttcacggcggtttcacggcttaataaaaaactcgatgataacaaagcagatgtgactatcacctacgaaagaggcaaaggctacgcacttgaaagcatataggctaaacaaaaaccggtttctgcttgtttcgcatccgcactgccacactcgccttgagccaacacccttgcctcccttgtcaaaggtgaggtgctgtcgcccgaaaaaattcgggcgactaccggagggattgctccccatccgcaccaaccctcccaaaaccgcaccgtccctcgaaaatcgccaccatccctttgcctcgcactaaacttgcctcccctcgaaaaaggggaggtggcttgacggcattgcaaaaccgttattctatatcatcttcattttgtaatttaccggactgtttccaaaattgctatactttttgccgtcaagacggtggggattgtgtttgcttagaagatttgaagatagtactcctatcaatttcaatccccaccgtcacggctcggaatagtttcagaattgtaaaggcaggactatctgaatactgtacagcaagccagaaaaaattatcagccgtgccacctcccctttttcgaggggaggcaagaaaggattgcgatttatgccactttctgcataatttatatactttttggtatgatatattctttcgttgtcattttggtagagtagtaaagccttagcctcgcaccatattcttgcctcccttgtcaaaggtgaggtgctgtcgcccaaaagaattcgggcgactaccggagggattgctccccatccgcaccaacctcccaaaccctcactattcctcgaaaatcgccattgccatcgcctccttaaaagcatacagactaaactaaaaaccgctcccgtaacactccgggagcggttttgtattattcttatattatcagtttgcaacaatgtttacgagcttgccgggaacaactatctccttgcggatcgtcttgccctcaagcgactgtgcaatagcttcctttgccatcttcagcagttcgtccttgtcggcggctgtaggcacgtttatacgagcctttatcttaccgcacagctgaactactatctcaacggtgctgtcaacgcagagcgcctcgtcgtatgttacccactgcgcttcgttcagtatgccgtagccgagcgaattgtacatttcttcggtgatgtggggagcaaagggatttaggagtatcagcagcgatttcatctcggcatcgttaatcttgccgtttgcggtaatctcgttgataagcgacatcatagcggcaatagccgtgttgaatctcatcttctcaatatcttcgctgaccttctttatcgtcttgtgcattgatgttctcagctcgtctgagtattcatcgccacggacaagcatattctgaagattccatacacggtcaaggaaacgcttacagcccttcatactgctgtcgttccacggagccgcctgctcatagtcgcccatgaacagaacgtatacacgaagaacgtctgcgccgtatacgtcaacaacgtcattcgggtcgattacgttgcctcttgacttgctcatcttctcgccgtccggacctaagataagaccctgtgcagtacgctttgcataaggctcgggagtgggaacttcgcctatgtcgtaaaggaacttgtgccagaaacgtgagtagatcatatgacgggtaacgtgctccataccgccgttgtaccagtcaacaggaagccagtatttgagcgcttcctgcgaagcaaattccttgtcgttgttggggtcgcagtaacgcaggaagtaccagcttgagcctgcccactgaggcattgtatctgtttctctgcgtgcgtccttgccgcacttggggcacttgcagtgtacgaatgaatctatctttgcaagcgggctttcgccgtcctgaccgggctggaagttctcaacgggaggaagctccaaaggcagttcctcataaggtacgggaacaattccgcagtcggggcagtgtactatcgggataggctcgccccagtatctctgacggttgaacgcccagtccttcatcttgtactgtacacccttttcgccgcagccgagttttgtaagtacgccgagcatcttttcgatagcgtccttcttgttagtgatgccgttcagttcacccgaattcaccatctcgccgtcacccgtgtaggcttccttcgagatgtcgccgcccttgataacctcgattatatcaatgccgaacttcttcgcaaattcatagtcacgggtatcgtgagcaggaaccgccattatagcgcccgtgccgtatcccatcattacatagtcggaaatgtatatcggaatttccttgccggtaacggggtttacgccggtaagaccatctatctttacgcccgtcttgtccttgacaagctgtgtcctttcgaactcgctctttttgctgcactctgccttgtaagcgtctaggtcggcaatgttctttatggaatccctgtacttttctattatgggatgctcgggagcgataaccataaatgttacgccgtagagcgtgtcgggacgggtcgtgtagatgcggagcttctcgccgttttccttgatagagaagttgacgaaagcgcctgtagacttgcctatccagttctcctgctggagctttacgttaggcagataatcgaccgtttcaagtccctgtaacagcttgtcggcatattcggtgatacgcaggtaccatacttccttggtcttctgcactatctcgctgtggcagatgtcgcagtgaccgccctgtgagtcctcgtttgaaagtacgaccttacagctcgggcagtagtttacgagcgtcttatccctgaatacaaggccatgctcgaacatcttgaggaatatccactgagtccacttgtaataacgctcttcggtggtgtcgatgacccttgaccagtcgaatgagaagccgacacgcttgagttggctggtaaattttactatgttgttatcggtgaccttacggggatgaacgccggtcttgatggcggtgttctcggtgggcagaccgtaagcgtcaaagccaatcgggaacagtacgttgtagccctgaagccttctcttgcggctgactacctcaaggccggaataagccttgatatgacctacatgcatacctgcgccggaggggtaggggaactctacgagagcgtagaatttcggcttggtactgccgttttcagccttgaatgtctgatgctcgtcccagtatttctgccacttactttctatggcagaaaagtcatattttttctcttccattttgcgagttgtcctttcatacgcccgatatggcggtataattcaatttcaacctttattataatacaaaaactgctgttctgtcaagtaaagcggcaagtaaagcgacaacagtaaataagtgtaaaataaaggtgaaatatgtcattcgcagcgtgatgatttatgatgaaccggtttttacatcggaatgggtgtaaaccgttatgttatcgggggtgacggcgaatcgacgcaagaataaccgaatgatgatttttgatgattttagattttttcggcagagagagggttacatcacaaaaacttgaaaattatgggagctttggcggtggattacatcgggtggataatgcggttcggcttatcagtgataatgtcaaatatagataattacgttatatctgatagctaatagttgaattggaagtgtcacgaaatgaggggaagaaagggaaatcgcagagggcaggataacggaaataaaaggaagtcagagaatgatgttgcacttgcaatataatttgtacgaataattttaaaacacgatatagtttttgatataatgagttgtgaatatcgagcttgaatttaacgaacggaggggggaggaaagaaaatcgaagagggtcggacttatggttcaagatggaaaatcaagggaggggggacgataatataccatcaatatgataaacggtaaaattagaattagccgtaattagtatattgaataagaaagacagatgcgaaggtagcagtattcggtgcaacgggggcaagcaaggcaagtgataagtgttcttttgcaaagattagtggaaacaacaaggattggtgcaacgggaggagcgagctcctcacctacggaaagcgagagggatagtgcgggtttgggagggctggtgcggatagggagcaatccccaccgtcacggctcggaatagttccagaatcgtaaaagcaggactatctgaatactgtacagcaagtcgaaaaacctctacagccgtgccacctcccctttttcgaggggaggcaaggatatagtgctttttgagggatagtgcggttttgcaacggttgcggggatggagaggttggtgggtgtaaagcaatccctccggtagtcgcccgaattttttcgggcgacagcacctcacctttgacaagggaggcaaggacgtggtgctgagcgagggattattgttcttttgcaatggttgtgggggatggcggtattaggtgcaacgggaggggcaagcaaggcaaggatgccttagcgtgtgtgcccaagggctttgcaaggacgcaaagccaactaagcacacacagacgctcgccctacgaaaagcgagagggatagtgcggaaaatctcattgatggtggggatggtgtgacaatccctccggtagtcgcccgaattttttcgggcgacagcacctcacctttgacaagggacgggcatggatgcccgcggcggaaaattgtctgtatagctttcggcttcttttcttgtcataccacacctcagaagtcgagcaggctgtcaagatcaagctgtagcttgccgctgtcagcttctgtggatgttttgctgctgaatccgccgtcaccgagatcaagcgtcatagtgcattttatatccgcaccgggaaagtaaaacgctacagcacgcttgtatacttcgagatcttcgagacttgcgcctacacctttgaccgttgccttgaggcagtcggcaaaagacttgcctgactgctctatggcctgtttaaactctgcattctgctcgcagaatttgcagatagttttcatcacagcattctttactgctgtttcatacttgccgagctttgcgtctgtcagctcagctgtaagtttttctttgatactcatattgactttttctcctgccagtgttatactggtcttgtgtaaaatttgctttgctcccttcggggagctctttttttttactcttctttgatgttctcaacatcatatccgcactccgggcaacacggtaatgtttcccacgcaggtgcaccgtgacactcgccacgatactcagtgtagtgtccaagctctgatgccgagcctgtccagtcacaacgttcgcatttatacatcgtcttcgtcctcctcgtcaatcatctcgacctcatcgacaacaccgacaagagcattgacaagcgccattgcctcgtttattgcatcaaacgtagctgttaccttatacttcatttcttctttcctctctttcttcgtatctccgctacctgccgtgctctgcggaagttttgctgttgctcaattgtggctcttgcctgccaggcaacatactcgccgtagctcatgccgtgatcggtggcttccttggcaattcgctcaagatctgtcatcgtgtccgcctcctatcatatccttgcaccactcccgcataagccatcccagcccgtaccagaccgcaacagcaactattgcaacgggtaacatctcgccgcctacggctttatagcccctttctgcgtaagccagtgctgacataggtatgtacatcatcatggcggcagaggctgttatccacagccgcaggagctgtgagagtatgtaggcgattatcttagctattttcattcatctccatcctttctgcgagctctgacttgaaaaaccgccagagcttaggtcctaccttgtgagcaggaatatctccgttccttgcccatttacgcaaggtacccgtgtctattccgatgtaccttgccgcctgttccgtattcatcatctcagggaactgtgtctttttgtacataacgcacctcacttacaccgccatatatttgtttataaaatatgtctgaccttttccggttacctttgttgtacgatttattcttatcgaaccgtccggattgttcaccgtgctttccttgacttcaaacaatcccatttccattgctctctgtgtgggcatattgtgcgaattgccgccctttatcagataaccgtcctgccttaactgctcgaataaccttttctgtcctgtctgaacgccgttttgcttaaggattttcgcaaggtcgcctatcagtatggatgtgtgtgccgtttcgactgctcttgcaaataacactttaggcttgtcctgctcaacctgtgcttctaactctatacgctttgctttttcttctttgagctttgttgcaagctgtatcagaaagtccggagacgtcagagcatactcaagtgtatcgtctgtcatatatgcaccgtttctgcgtattgttggcaacacctcgtcaaacacccagctctcaaactgttcagccgcaggaagcttgctgtgcgttatcaggcggtagacattgccctcgttgataaattttgcatgctgttctctgcccatgttgtcgatgaggtcgtgaaacactaccccatcttctttacaatgtcttgcaagtgcgtcttttgtgtttgaatacccgagtgcctttgcaatgtccgagccacagaacagcactgtgccgttctcatcaattgtccttatctcgccaaactgggcgttgttgaaaatctgtaaattgttcatgtatgtcctcctttaatctttaaaaaatggtatgtactttttatcacagtaaactagttttactcctaattcatctgcaattttttcagcaacctttcgactgttatttgccccgcacataaaacatttaatcgtgctttctgtaaaaccaatcttcttcgcaagtttataatatgtcatccgcttactcttaagattttctttggcaaaatgcctaaattcatcgtacatattcctacctcctttcagcaaatcaacaaatttcgtttgatactattgacacaagttgataaaactgttactattaaatcaacaaagtttaaaaattgtaaactttcctttagtctgtcagctaaacttgaactaaagaaaagttggaatttcatcaaccgtatacgcatattatagttgatattattccaattgtcaaccctttaagttgttattttttcaactttgttaaatcccaacaaaaaggagggtgaaaatatggagataatagataaaatttcagaattgcttattaaaaaaaataaaacacaaaaagaactcaccgattatctagggttagataaaagtacttattcagcatggaaaaacggaaaaagcagatcatacaataaatacttaaaagaaattgcaacttttttgtgcgtctcagttagtgatttgataggtgacgatagtaatctaaacaatgaagtgaataatatttattttagtttcgcaaaaaaagcacaagacaatggaatagaccctaatgatattgaaatggcaattgcaatgattttgaaacttaaagataagggcaataaggaggaataattattagttactacactaaggaaaaactatataagttaatcgcagaaaaaagagtccagtttaatatttctagttcagattatcctcttgatatttttgaattatgtaagaaatttaagaatgttaagataaaaacacttcctttttcgacgtatgatttgcgaggaattgttagaattgctaaaaacagagatgagaatcatgttatactattaaacgaaaacaagtcgtttgtcgaacaaaactatcatggatttcatgaactaacacacattttgactgttgatgagcctggaactactttgaattgttttggaaatactagacctaatcaaaatagttatattgaatggcttgcaaatgagggtgcagctgaatttcttatgccatacaaagaaatacttccgataattagaaatgaaagtaaaacatttgacgagcactcaatgccaatttttgatttatcggaaaaactaagtaatatgtacaatgtgtctaccgttgtggtgcaaaatagaatatccagtttgtcatacgaaatatggcagtatcttagtggtactgatattgacaaaatacaattgatgtcacattctgaacagcaacgcaaaggtattaacgtagattcattactcgatatcgaaaacaaaatgtttgacgcttgttggaactacgagcagactaaagtaccgataaaacctttctttttttattcgaaggattacatatttgcagtaagcagtcgttgttattaagcgtttgaaataggaggtgcaacaatgaatatacaggaactgaacgactgctcgatagtagacatcgaaacaacaggcttatcgccggacaatgataatatcatcgaaatcggtgctttgcgtgttcgtgataacaaaatcgttgctgaattttctcagcttataaaagcgagcaagccgttgtcaaaaactatttctcagattaccggcataacagatgatatgttggcagatgcaaaagagcttgacgataccctatctgattttctgcgatttgttgataatgatacggtcgtaggacataacattgcatttgacgctaatttcatcagtaaaaaatgcgttgcttatgggcttgattttaaaaatgatacatacgatactttggctgcatgcaagcaagaataccccgatgtcagccacaagctcgaagatatgataatacagctcggaataaaagatagcggtatacatcacagagctcttgcagactgctaccatactcacagcttaatgacagcattgaaaaatcattccgctcttgtacttgaaataaagccgccgaaacaaagagtgctgaatcctattacaaaagggttacaaactttgcacggcatattgataggcataacctgcgatgacattctaacacaagaagaactgttaagacttgaagaatggatgaacaataacgaacagctcgcaggtaattacccatacgacattataaataacgcaatctggaaagtgattgaggacggaataatagagcaatccgagctcgattatctcctcgaattttttaaagcacaaatcaatccgcttaatgcagaaataggagccgttgatatagagcttagcaacaagtctatctgtctgaccggtgattttgattatgggagtaagcaagaagtacaagaaagattgtctgaaataggtgctacggtagttagtaacgttacaagaaaaaccgacattcttcttataggcgaaaaaggttctgacagctgggcttgcggaacttatggcactaaggcgaagaaagcaattgaactcagaagcaaaggctatccgattatgatactaaaagaaaaggatgtgcagttatgatagagcaggtagcattatttgaaaatgaacccgaagatttagattgtaaaactactttagaaaacataatagtcacagtttcagcaaaatggaaatgttcaaacgggcttttcagcatacaggaaaacaaaagcaaagacaaacttaccgggtattcgatctattttgaaaaatgtcttttcttcaaagtgaatacaaaattcacggtaatttcttgcaataaaagagtttatgatacgcttgaaatatctcctgcaggtacaaaattgctgaaaagccctcagaatttcatacaatgtacattccacacacaaaacgaagctgtaaaagctgctgaacttattactgatgagaatgtcagaatatttgagccaacagatcattttgggtgttgcggattatatttgaagtgttcagatgctaaaaagtgcttgcacccggatataatccgttctaaatcctgctattacaaaaagaacttagaaagcggcaagatattctacggtaaaaacgcaaatatatgaatatttccccgccgtaacaagcggggaaatattataggaggtgtaaatatgaaaaaacgtgcggacggccgttatcagcaatcggtttatatcggtaccgataacaacggcaagcagaaataccgtgttgtttacggaaacacaaagaaagaagtcgaagaaaagtccaactcgcttaaaatcaagcttggtaaaggtatagatcttgatgcttgccgtgaaaccttcgactactggggcaaaaagtggataaaatacaagcaacccgacgtttcggaacagtggtataagaatacgcagagctactacaagcaccttgaaccgttgtataatcttccgatagcaaaactgtcctcatcggatttgcgtgatattctcatagacatggctcaggaggactattccaagagaacaattaaagcggtgtatgaaatatcggtaagtgtcattgacctggctattgagaaccgagccacagactataacgttttccggaatgtaaaacttcctgcaaaggtaaagcctgcggaggagcgccgtgctctgaccgatgaagagcaggagtggataagaactacgccccacagagcccagactgccgcaatgatcatgatgtatgccgggttgcgaaagagcgagctcataccgcttcaatggaatgatattgacctaagcagtaaaactatcaagatagcacgatttgtagagttctcaggcaatcaggctaaagtcaaaaactacggcaagtccgaaagctcaaaacgaattgtctatattcccgatgtgctcgttgactatctgaaaggtgcggagcatgacggctttctcgtatgccggactgcaaatgacaagatgcacagcaacacgtcctggcgcagaatgtgggaaagttatatgtccgtcctgaactatgagcacggcaattttgataacacattatgcgacaaaccgacaagccgttttcagcccggtggtgttccgttcgtgattgaacctttcacagcccactgcttacggcatacatttataaccttgatgtatcttgcaggtgtggatattatgacagcaaaagagcaggcaggccacaaggatatatccacaaccctcaaaatttacacgcacttagacaagacttacaaggcaaaaaatatcgataaatttaacgaacatttgaatgcaaaattgcgacaagcaacgtaagagcatataaaaacactagtcaaacactagtcaaattgcaagtcaaacagcttataaagccagttgtatagccaatctacagactatagagcctaagcctccgacgctatgtgtcgtgcgttcgaatcgcatcaggcgtgccaaaaaactgcatcgcaatcaaccgtatttgattgcggtgcttgttttttgttgtcagccttgcgaggagaacgcacaggtgcgtctcgaatcgcatcaggcgtgccacgtcggaacgagttacgcttgttccgattttttatgctataaaaaatcagtcacccgctccactgttcctccttttcgcaaaaaagtaacgctcggcaaggctgctcgcttgtactgcactcgtcagccttgccatcgctgacaacttttttgcggtcaccggctttgcaccacagtaaaccgtatttgattgcggtgcttgtttttttgctgtcagccttgcgaggagaacgcaccaaggcaggatttgcaattttctgacggaaatgctataattaatatataagattcggaatcagcttttaaatacggaaatcaggtgaatttatgacatatcgtaaatacccggacgaaaaaacggtaaatgaatatattgctaaaaaagaaccgttgatatttgcaatatcctttgacggtgaaactgtacttatgtcacggcttgacgacagctttgagcatcatatactgcttgcaaacttcggcataagccagaatgacattgataaatatttcagagtaatagttgacgaccgctctgccgaatggacattcgtatgcccgcatgactactgcggaattaccgacaggaagaaacgtataacacgcttctataacgatggatttacggctatttcgcacgttctgtctgatataggatatttctcagacctcactatccctcgccgttacaggcgacactttgatgctatgggagatgattcgtcctatttgccgtattgaataaatttaacatactgaaagtcacagtaagcctatttgattgcggtgcttgttttttgctgtcagccttgcgaggagaacgcacaaaattataaatttacttaataaaataagggcaacgtcagcaacgccacccttacaaaaatatcattaatattatactcgttttatttgaaattgtcagcaacaaatacacagcgttattctaattttaagatatttgtcctttttattgtacactgtctatgctacaataacaacataaacaaagtccttgtgaaaggagcgatattatgtttgactggaacggaaacggtaagcacgatgcctttgatgattttttcaccttcgagctttttgaagatatgatgaacgaggaggatgaaatgccctctgtaagaaatcgcaacaggagaattcatcgtcgctatgacatctatcaggacactaacagtgcccgcaagaatgcaataacaaccttctggcttgttttaggattgattattcttattgtcggttttattctgataatctgcaatatcaaagatcaacttctgatagcactttctatattcggtttagtatttatcagctatattgtaatgtcacagggctttgacaaagacgattagcatacagcaacagcccgcaggagttttatcttcctgcgggctgatttttgttttagatttatacgcttgccgtttctgcggttacggctgtatttgatgtgtttgcggagcagagggggcagacgttttcggtttcgcctgcaatgaatttcatcgccttgtcggtactccagaagaaacgctcctcgccgtaggtttctataaggccgcagcggtggaacatttcgtcaacggcaggctgtacgcacgagaagtatatttctatcttccttgcggaaaggctgtcgcaaagctccttcatagcctgtacaccggaaatatccgctataggcacgccacgcattgagaatatcagctttccgccgtcatcgacctcaagatgtgacagcttctctgacagcttgtttgatgttccgaaataaagcggacctgtgacatatacgacctttgtgccgccaagctttccgtccttgtcggctatatctatcttagcagggtcaacatccgcaacattaaccgtcatatccgaaaccttaagcacgaacatgatgaccgagaaaagtataccgattataattgcgacagtgaggtcgaatataaccgttgccgccattgtgataagatactggaacattgcggtctttatctttctgccgaaaatgtcctttattaccgcaaactcgttcattctccacgcagttacgataagtacgcctgcaagcgccgccataggtatctttgacattacgccgccgagcaggaacattgacgctaaaagcaccagtgaatgtattacaccggctattcttgtctgtgcgccgctctttatggcaacgctcgttcttgcgattgccgctgtcgcaggcacaccgccgaaaaagggtatcagcatattgcctatgccctgtgctacaagctcctgatcgctgtcgagcttctcattcttcattctgccagcgctcgcaccgcacaaaaggctctcgataagtccgagtgccgcaatactgattgcagggaatataagattctttaccgtgtcaaaatctatcgccgtaatatcaagcctgtcgttaagcagaagcgtctgcggtatctcgcctacaatgccgacattgaaattgaatatgaagttcagcgccgttgctattataatagacataagcgacgacgggatgatagcattgagctttttgggataaataagcataaacactataacgcatacgccgattgctattgcctcaaaattcagtgtctgaggcgtgttgaagtagcttactatcttatctatagtagaagcaccctcgcatttaagtcccgtaaggttatttatctgaccgaatgcaatgattattgctatacccgatgtaaagcctgtgataacaggtgtgggtataaactgtaccagtccgccgagcttgaatattccgcacagcagaagtatagcacccgacataaagcaggcgatgaacacaccctgtatctgatatgtagccacaagcgagcaaaggatagccgccatagcgcccgtaggtcctgaaatctggtatgacgcacccgaaagcagtcctattacaacgcctgcgataagtgccgtgataagtcctgcggcggcagtcgcaccgctcgatataccgaatgcaagcgcaagcggaagtgccacagccgctactgtgataccggcaagcacatcttttccgaattttcctgcattatagcctttgaattctgcctttaaacgtttgaaataacgctttatcatttctctccctctttctgttcatttgtcctgcggacaaacagcaacctttatattctatacccgaaagagaaatttgtatatatcaaaactcaacaaagatttgttcacatcgggtaaattttaagtttatttttagttttgcataaagaaaagccttccgctgtcataatgacgggcggaaggcttcgcttttgatgttttgatgttttactgtgccgcttcaagcagcttgttgtttactcttgtctgcacttcgatgtagtaggctttttcggcatcgttcatatccgagctgttccacttttcaaagctctgtgaaagctcgttatatttgctgatatatgtcgcataatctgtgataaggctgagatcggtcgggtttgccttatacttcttcataaagtcaacgtaatcgttcataaagctctcatagttgtccatagcctctttgaaatcacttctcagaccacttgcattggcttctgccggcttgcttgtttcgggggcattagttgtttcgggctttgacgcatccgatgactgatcatcgtcatcggattttcggggaggatcaacccttataaacattacgttatttccttcgtacgacagatccaaatgccacccatcactgttataagcgtagaagtgggtatcggatttgctgtaatcaacagtaaatcccttgtctatacaagccgatacatacgcattataatccgctttgggcgttttgcccatatacaagcagaagttgttatcatattcaaaattgattttaccgaatgtcgatttcggcttcggaacgagttttccggcctgaccaataggaaaaatgatttcatccatttccataggcgcttcaagttcaacactcagactgtcgccgccgctgaaatgtgttaactccaatttatagccgtcaccgttgaatgcttcaaatttatatgaatctgattcttcttctaccgtaaagcctctgtccttgcaggctgtgatataatctttgaactgattatcgtctaccgatgaaaattttatccataattcttcttcggtattctcgtatgtatgatctaccgttccctttacctcggggataatattgctcagcactatttcatccgaccacgcttcataactgttgttactgccgctgctgtcggtactgctgtcggcagataccgagctattcacggtgttactgctttccgtctgagaagatgtgccgttgctgttgcacgctgtgagtgataatgtgcatataagtgccgccgctatcgctatgaagcgtgttcttgatttttttactgtgactttcataaatacctctcatttcgtattacttgttttgatgatccgccatattgaacgctcggagtagtcatatttcttagcgagttcaagaatattcttgccgttatattccctgataattgccctgtgcgtgtattcctttgaatacaggcggccggggaacgaaatctgagttccgtgaaacattttatgaattattctggcattttcaattccgatttcatttgctatttcacgatagacctcattcaatccgttaatctcgtttttcataagctccgtatcttgttccttcagcgttctttcatccattgacataataccacctcgcaacagacataacaaatgacattttcattgcatctggcagtacgctgtcagttaaaacagctctgatattgcttttcataataaaagctcctttccgaacaattcctgttcagaaaagagcgtgttatttttgcgagtttgtcacaaaaaaacgacctgcaggttttatcctgcaggtcgcatttttattcacttttgatgttgctatgctcgtgggtgctttccttagcaatctccctgagcttcattctgttctctttggctatcgtttcattgtgaagccacatctttataagcgctaccgaataaagaataccggaaagaagcattacgcctatacagataagaatgagtaaggatgatgcaggcgaaccctccgggaatactccggggaagaacagtaaagccagcactgcgatatagataatagccgtgcagaccttgccgtaccagcgtgcgccgtcgagctttgtctgctttgtctttaaaagcacaagtcccataatcgccataaagccgtccttcaaaagccatatagcaagcagtatccacatcagcggataatttatcgctatgcaaagaaacagcgttccctgcgtcagcttatcggcaagaggatcgagaaatttgccgaactcggttatcatattgcatcgccgtgctatctgtccgtcaaggaaatcggtaattcccgacgctacgacaactgcggcggcaagataatactctccgctcgtgcctgcggttacatataaccatacaaatatcgggataagcaatattcgcacaaagctcagtatgttcggaattgaaaatatatcttttttcatcggctcacccctcttgttacacttaaaaaacaaacataatgcgactgattcggcagattaatgctataattatactacagaaaaccgaaaaaatccatatttgcaagataattttgtaggattaaacgaaacttggtaataaattcacggttttgtgtgatttttgcttaaacaattacaactatttttcgtctgcaataattattgccccgaaataagcgagtaatacactttataaagctcctgcgttgaattctcaagaaaataatagtgtgctatgtacggaacaagaagtacaagcagaagaaccgacagtgcaagaaaataaacatttatcgacaccagtatcagcgacaacaggaagaatatcgcaaagctcatcgttactatgagatggataagcctttcgtgctgatagaagcctatccttacaagaagctgctctgcaagtgctttcttgtcaacgtcagggtctgccgcctgctgctttatatattccttatattctttgatttcatttttcataaaaacgccttcttttcggcttattataatgcgctgtagtaatcacgcatttttactgcgagcctgtcgcaacgttcattttcggggtgtcctgcgtggccttttatccagcggaattccacatcgtgcgtatcgagcaacgggagcagccgctcccacagatcgacattaagtgcaggggtattatcggattttttccagcctctgcgtttccagccgttgacccaaccctttgtgacagaatccacaacatacttgctgtcggtggtaagtatcaccttgcacggatatttcagtgccgtcagcgcctcgataactccggtgagctccatacggttattggtggtatgcttttcgccgccgctcagttccttttcttttccgttccaacggagaatcgcaccgtaacctccgggacccggattgccgctgcacgctccgtcgctgaatatctcaactgtcgtttcaggcatttttattttcctttccggcttttctttttgccgacattcttataaacacatctttccagtaccgctggaacgccagcagattatcggttatatgccgttcaaagaacgaggacagagcctctataagaacagttgcgcccataaggattcctgtcataactatcatttcaaagcacataggcttaaggtcgagcaggaaatcacgcaatatgaatatatcagccgtaaatccgcctatcaggaaaacaaacagacctattttccacggcttgaagggcatacataccttgaacagtatcacgaacgccgcaaatcctatgcatatggttgacattgtttcgatgctgtaatcgaaggtttctctgggaattatgtccatccagcttgaaatatagcgcataagcactattccgacaaaattgaacgttatcagcagtccgtgcattatggatctcggcaggacattttctataaattcgccctttacacgcttgaagttaggctccatagcaagtaagaatgagggtatgccgttcgtgaacatattaatctgcgtaagctgtattgcctgaaggggataacccataggcacaaagcagaacataagcgccgctaaaaacgagtatacggttttgtaaaggaacagcacgcttgaacgctcgatgttgtttatagagcgtctgccctcgcctactatcttcggcattgaagcaaaattgctgtcaagaaggacgatgttggatacgtttcgtgccgcatcgcttccggattgcatagctattgagcagtcggattccttcagtgcaaggacatcgtttacgccgtcgcccgtcatcgcaacggtatgacctttggctttaagcgcctttacaagctccagcttctgatacggcgttacacggccgaatatcttatatttgtcagccgcctcccacagttcttcgtcggttgttaatgtcgatgcgtctacgtaattttcataatgctcaagccctgcacgctgagctactccagaaacggtaacggggctgtcgcccgaaataattcttatgtcaacgtcctgctccgcaaaatatttcagcgttgcaggggcttcttttcttatgcagtcggtgattcttacaagcgccacaggagttatattttcgggcaatgcgccgccctcaacttctggaggcatattgtcgctgtgtgcaaacagcacaactctgtatccgccctcagacagcgtctttatctgttctctcagagcatctgtcatagcatcgcccagaataaattcagccgcaccgagaatatatgttcctttatcctcaaaagccgcaagactccactttttcgcacttgagaaatgtatcgccgtctttgccgaccattctctttcgggcaggaaaccgtcttttttgtatctgtccattacggcaagcgcagtggggttattatcgccaagcgcatatatcatctcgcaaagagctttttcgtgatcgttgccgtcaagagagataacgtcggatacctccattctgccctcggttatcgtacctgttttatcaaggcagagaacgtcaactcttgcaagggtttccacgcagtacaaatcctgcgcaagtgttttgttcgttgcaagtctgataacgcttaccgcaagcaccatacttgccataagcacaagaccctcgggtatcatgccgattatagccgacaccgtatttacaacggcatcggtgaacgtgctgtgtgcaagaagcatttccttgccgaacatcagaagtatcatcggtataatacatacggaaatcatcttcagtatatagtttatgcttgcgagcatctttgagttattcttcttgatatattttgcgccgcttgttatcttattggcataattgtctgcgcctatgcggataacctgcgcctttgcatttccgcttatcagaaacgagccggacaatatctcatcgcccttgtgctttacgatagggtcgctttcgcctgttacaaggctctcgtttacctcgcagtcgccctctaccgctatgcagtccgagcagacctgtctgcctgccgacaaaatcattatatcgtcaagaacaatatcctttacggctatagtctgtatttcgccgtttctcagcacatccgctttaggcgcagaaataagagccagcttgtcgatggctctttttgagcgtatttcctggaatatacctattgccgtgttgcatatgataacgcctaagaacaggcagttcttgaacgagcctaccgcaacgacaaaagccgccagtattatgttgataaggttgaagaatgtaaggcagttatccttgaatatctgctttaccgatttgcttggtatattgaaatctccgtttacttttccctgtgcgatgcggtcgcttacctctttcgaggtaagtcccgcgccgacatctgttgcattttcaagtgatatgcttttttcggcatttggcataatataggttatatccttccgttaaaataaaattattcggtgctgctgtctaggctgtcggtgatattgctttcgttatcgagagtgtctgtaccgttcagataatcgacataatccttaagctcttcgtctgggtccttgccggcataaacgtttttggtaacagttatcccgtattcccagaaccgagccgtctgaggcgtgttcggcatagcataggagaatgccagctgattcacaaatccgtccagcttttcatctatatccacgttagcggcaggcagggtttctgtcatctttactctgagcctctgcatatcctcgctgagaagatagcgtgcgaactcgtccgcctctttcggatgctcgctttttgagtacacatacataactctgacacctgcaatggaatatgtattgcttccgctttcaaaagacggaaggtttactatgccgtaatctatgccggaggcatcggccttgcttacaaaccacggtccgttcacaatgaaagccgcatcgccgttaagaaacagattgtcataatcgtcatattcaaaatccgtaacgttcggcggcaatatttctttcatctgtccgagaagatccataccgtattttgcggattcgttaagcaagccgtagtcattgccgctcatcagcttattcccgtccctgctcatcagcatagcaagataatataccgtatctgcgtggaaaataaagccgtatttgccgggatagagcgtattgaagcccttgctccagcctatcataccttcccacgttgacggaatatcattcagatctacgaatttcttattgtagaaaagggcgtacgtttcgcaggaaaccgggtagccgtacatagtatcgccgtacatcacggaatcccttgcagaagtcattgccactgtatttacaaacgatgtgtcgattgtcggaagtataagatcgttggcgataagctcccctgccatgtcgcagggagatgcaaacagatccggtctttttaccgtactgttcttatccttaagatttattatagcgtcgggtatctctacgttgacatattcaatcgttatgttagggtaaagcttgtgaaagctgtctcccgcttttctgataaattcatcggggccgtcctttgactcccataccgtaagcgttatatcgtcctttgtcagactgttgttggtggcatacggctttgaagatgccgtaccgtccggacgtgaggtgtgctgagttataatatggctctcttcggaacagcctgctgtcatcattgccggaatcagcgccaaaacagcaagaagaaccgatattaatcttttgtatttcatatgatcctcctttgcacaatgccttgtgaaaaagtcaaatcctgtattcacatccatattgtaattgtacaacaactgtacggttttgtcaaccgcaacagcacttgcaaaaacacggttcttatgatataattacatcaattgtaacgtttgtataggtattgccgtacataaaagcggagcttaccgtctgtacggtttatttgaaaggatataaaaatatggagcctgaaaagaagtacgaaacaagcagtatcgatgatataaaggcactgtttgaaaaaagaacggacgataatataattccgcttgacgagcttgacggcaaattcaagccaaagcctgccgcaacgcccgttaaagcgtcctcgtcgcaatatccgaaaaggaaaaccacagcgcagaaaaagcgtaaccgcctgatagcgaatattatgatatacagcggtattgccctgctcataataatgtgcgccgtgcttgtaacgctgattttcacgggcaataacggcgacagtataaaagggcttgagataacaaacagcggtgatattacactgcgtatcggtcattccgaaaaactcaaagtgaaaaccgagccgtcagacacggaatatgcgctgtcatatgtcagtgcggatacatccgttgcgaccgtttcgcttgacggaaaaatcacaggcgtatcggacggaaaaaccgaaattacggtaagcagcggagagctttccgacagtattatcgttattgtaaagaaggatataatcgaaaagctcgatgtatctcttgcggctctgtcgcttgacggcggagaggaacagaaggtcactgcaaagctgactccctctgacgcaaaggatgtatcgctcagctggaaaagcgccgacacggaagttgcgaccgttgacaaggacggaaatataaagggcgtgaacacaggcgaaaccatagtcacggtaaccgactccgtaacaggactttcaaaggatataagcgtcactgtaaacggacttgagctgcccgattcgatggaatttgacaaaaagagcgttactcttgaggtcggagaggtatataattccgttttaaaattctcgcctgaggatattacacacacaagcgccatatactataccagcgactcatcggtagcgtctgtcacaaacgagggtgttatcacagcaaaaagcgagggcagctgtaccattgaggcgtactacgaaaatgatttccgacttgttgctactatggaggtgattatcatagatccgtatgtaataacacagcccgaaactccgaagcccgaaacatcaaagccgtcagccccgtcatataacggctcgcacaaaatggaagttatagacggcattacttattttgacggcgttatgatagcgaacaagacatacactctgcccgcaagctataaccccggtgttcagcctgtcgctatggacgctttctacgatatgcaggctgccgccgccgctgacggcatttcgctgtggattttatccagcttccgttcctatgaggatcaggacgttatatacaaccgctatgtagcgcaggacggcagagatgccgcagatacatattcttcacgtccgggtcattccgatcaccagacaggatacacattcgatcttaattctctcgaacaggacttccagtacgatcccgcaggcaaatggcttgacaagaactgctacaagtacggctttatcatccgttatcctaagggcaaagaaagctcaacaggctatatgtatgagccgtggcatgtaagatacatcggcgtagaccttgccacaaaggtaacgcagagcggtctttcgcttgaagaatatttcgggataacgtcacagtatcaggactgacgtgaaaattcaatgccgtataaattgaggcggtcactgcgtaacagcaatgaccgccttgtttttttatttctgcctcttgtcgccctttttatcggtcagcagaggctttatcagcctgtatatctcgcctgcccgtgtagtgccgtattttttcacgatacggttatttattcccgacttggtagtaagctcattgatacacttctcgacaaactcaagctcatcgctgtttgttatcagcttttcaagctcggaatgaagcctgctgtgttctccggattctttagcctgttcaaggcaaacggctgagcaaacgtttacgttcttatcctgccagaaccttcccacaagctcgaaagccttatcgtttgaaataatgcaataatcttcctcaggagcttctcgtatcatatatccgagataggaaacgagctgaaaatcaagcgcatttttcattcccacctgtgcctcgacataaaatatatcggctttgctctcggttattcttttatgcatattgaatgtcagcacacctgcgtgttcactgtaaaagatatagcacttgtccttcttgccgagctgttctattcccttaagcccgtcagagtgaacattttcaaaatcaataagatatatcataaacgctcctgtcagtttacatctttatgttctgcatattggttacggtgcggatatatctgtcgtatttgtcgcacacggtattcacatcgccgaaagctatctgctttcccttgtcaagccacagcaccttattgcaaagtctgcgtacctgcggaagtgaatgtgaaacaaacagagtacagcaaccgctcttgataatgttcatcatagtcgcctcgctctttgccctgaaagccgcatcacctacggaaagtacctcgtcgagtatcagtatctcaggctccataaggcaggatatagaaaaagcaagacgtgacttcataccggaagataactgtttgaaggctctgttttcaaactcggtaagctccgcatattcaagtatatccttgtacttttcggtaacgaattcctttgtataaccgagcatcgctccacgcagaaaaatgttttcctttattgtaagatcagggtcaaagccagatccgagctccagcagtgccgctatctttccgtttacggtaacactgccctttgcaggcttcataatgccggatattactttcagaagggtcgattttcctgcaccgttcgtgccgattatcccaagaaaatcgccttcgtcaaggctgaacgaaacattgtctaccgcagtaaactgctcggtctttatgtccctctttatctttttgataagatattccttaagtccgatctctctgaaattgcttatcgtatactgaaccgtaacgttctttacatcaattaccatttatattcctcatcaataataatatacgaacttctgctctgtcttgctgtggataaaatatccgatgccgagcataccaagtgcaaacgacagacagataatatgctccgttaaactcggaacggacgcctgcataacaagctgacgcatatatgatatataatgatataccgggtttacattgaatatgaatctcagttcctcggggaagtgcttgacttcatagaagatagccgacatatacatcagaagcattgtgaatatctggtaaagatactgcatatccctgaagaacacgaaaagtgcggacaggatatagctcattcctatattgaaaataattaggcaaagtatcgggtaaattatcaataaaagatgcaagccgaaggttatcttgcagaatatcataaatgcaaaataaacaatcagtgtaagaaggaaattaaagattgccgcagagtttgacgacagcacaaaaaggcttttaggtactttgacttttgacaatatcgccccgtttgaatacatcgagaacataccgttagtagtcgcattggtgaagaagttgaacatcagagtacctgtgagcaggtagattacaaatcccgaatcaagacggtggaatatatatccgaacacaaaatactgaacaaggaacgtcagaaacggtgaaattatgctccacagcacgccgagaagcgttcttttatatttcttcttgaaatcacgctttgtcagctcttcaaaaaggaatctgtactgcttcaccttttgcctgaaggtcatattcgcacttgtattgatagatacgcttaccttttcggctttttccttaggcttttcatcagcgtttccgaatattgtctgcgacttattctcctgtttcccggcagcttttaccgcgggcttttcctttgacggttttgacggtgaaacgctgtcgtgcgacgcattcaatctatgctttacaggcttttcatcatcttcaaactccgaaaggcttttgtaatgtacatcactgtccggtttttttacttttggggactctgccgttttctgcgtctgatgtgcaggttctttcggccttctctgcccttcaccgacaacacccttcagatgctgaaggttctctgcggatatttcaatggtattttctttaccctgtgtttttttcttttcgtctatagaattaagtatcatggtcgcacccggctttgactgtgacggtgctttcttgtccgcaacgcctgagctttttgcggttttcttgcttacgtcattgtcactgccgatttcagccaatatatcgtcaatactgaatttatcgctcaatcgtaattcaactcccttaacagtagcttatcacatagtttttccaatcatcaaaataacaattaattttaccacatttccgtgtttattacaatgtgcaattgcaacaaagaaaaaaattgcagaaagtgcttcgttatacagattatattcccgcccgtttatactccggtagtcttttctttcagccttatcattgctttacggggtataaatccgagcaaaatcggtttcagcgcataaaagaatccgacgggcataaggccgagccttttgaaaccctctgttcttactttgaattcatcgcacctcatcgaaaacgaaacacaccttgttgacttatcataatgaaatctgtacagcttctcaggcagatttgcagacttgaagccgtctgcgcaaagtcgcataaataaatcgtaatcttcgtatttacggtttttgccgagcgttctgtaacgctctttatcgaaaacctcacgtctgaacatcatactgccgtgaataaacggcgaattgaacagaaaactcctcttgtcaacggctttaggcattatgcgctcgccgtatacaccctcacccgacgaataaagctcgcaatttgttccgatgaaatcaatatcactgtgattttcaaggtactcggtctgtttttcaaaccttcccggaaggctgatgtcgtcatcgtcctgccttgcgatatattttccgcttgcaacatcaatacaggcattcagagccgccgcaagtcctttgttttccttgaaggaaatcagcttcacacggctgtctttaatactgtcaagcgttttccctatgccgttttcagacccgtcatcacatattataagctcaatatcggataccgattgcgacaaaaccgagccgacagcacttaagagcatatcggtttcgctgttatgcactcccattattactgatattaacggcatagtttttttctctccctgagcagtcttagcctttcccattcacgcacgctgagcctgtaaacccacgcaggcttacaccctgtcagtacaatactgccgtacagccagtaaatatatttatcgggataaatgctttttccttttttctttctgataattctgacaggcagaagaatatttgaaatactgcctttacagtttcccgcaaggcgctgaatcttctcttcggtcacatcatcgctgaacgggaacgctcccagaatttccgcctcctgtttatcgggcttgtacataagagcctttagaagtcgggcggatatatctctcattttgcatatcgggatataattttcattttcacacgcatattccgtaaatcttacagctgttttcgtctgtatttcagccatttttaccatttctgcgtttgcgtcggacagcatgggaatgatttttccgtcgcattccctgtaccctgtagtcataccgtgcggcgcactgcaaaagcactcgaacagattattacagaaggtcggcacatatttatacgcatcggtcacgtcaaacaggaacgccttataattatcgtcctcacgtctgtaaagcccaaaataatatccgataatattttcgtccgttctgccgtttacaagcgctgtcagcgttttctgcacagtacccatccagccgctgtcaacaacggcaatttttcctttttcaaataaaccgctttgctcaaaatatttcattatattatgataattgttttcggaattattttttattttacaaagcaaagcaggatcgtttttaattttctcacaaaatgcggaatattcgctgtcgctgaggtctttattttcgtcatcagaaaagccgatttctttgtaaacctctacacgttgacaatcattcagctctgctctctttaaaaaattctttgcactctttaatgtatagcctgtaaataatcctgcgttttcgaaatcctccgctgtttcgcacttgtaataaagcgcattgcgaagcgaatagcgtgaaacataaagatagctcgtctgtattttgagtttttttctttcgattattatatccgctatctgctttaaaatatatccgtcacgggaaagaaaaaatattctgtttatattattcttttttacactgtcgagaatgtagcagacataacaaaacagcacaggtgcggtaacgtatgccgtgacctgtgccggaatattattctgtaaagcgccgttctcatcatttgccgtcttatctgccgcatcaagaagtgacggacagcaggataacagccttctgtatttatctgttttcacccgacaacacttccgtttcagtttttagcgttggtatatcaacgtattttccgtagatctctgccatttcggcaagcgaattttcaattgcgtatttatcggcacaggaatatccgtttctgccgagctttttgcataactcatcgtccgagcttaacaaatgcactgccttaataaactgtgacacattgttgcactcacacacaatggaattctcgccgtttaccgcatattctctcgttcctctgttatccgaaacgatgagcggaagacccgcccccatagcctctatagccgcaagtccgagtccctcacggtagcttgggaaaataaacgcatccgccccgtgcagaagctcctttgcgtcataacggtagcctgcaaatataatcctgtcggtgcagccaagctcctttacaagctccctgcacttctccatactttttcccgaaccgcagataagcatatatacacccttgttggcggcgaccgcagttatcgagcattcaacattcttgttctcatttatctcggaatttgacattaccagaaaagcgtcgtgcggtattccgaattcatcccttatatcttctcttgtacgggtagaatttctgacacggcttaaatcaatgccgataccggaaattttataggcatcacattttttgttacggcacattttctttgccgcaagatagtcttcttcatttatcgtgataattccgtcggtgtaacgaatcatagccttttctacgctatagtataagcggcttatcttaggtgcgcccttgtagaaatgaaagccgtgagcggtataaagcacctttgtgttgtgctttttccttgcggttctgaaagcataacgtgcaatagccgcagccacaggcgtgtggcaatgcacaagctcgtactcgttttcttctatcagcttgcgtaattccttatatgagcggaaattctgcgtttcaaacggcgaacggtaaaacggaactatgtaatattcgtcacagtatggtatatgtcttgcttcttccggctcaaaatcatcgcctgcacatacatggaccttgtatccgtgatccttgaaccacttcatatacggcagatggaactgtatgatatgctttttggtaacagacgcaacaaataacacggtcttactcataaatacagccccctatcagaaaaataaataaaaaccgaaatacaactattcaatcgtatacactgctttaattttactatatcatcggaaaaaagtcaatattatttgggagaaatgcactatgtgagcaaaatttgagaatatggcgtaaaaagcaggtgattattgggtctgctgtcatttgacagacgaaatccccgacagccgtactgtcggggacacaaattattcataatacaaatttatcaagaccgggtttaagctcctcgataatatcctgtgaagtttcgggatatttatcaaacgggaactcgatgcccatatcgtcgtatttcgtcttacacagctttctgaacgggagaagctccgcaaaagtgacattttcgtgcttattcgctatatcattaagccttttgatattcgtatcatcatcgtttacgccgcataccgtcacctgtcttatccacgtttcaacgttcatttcggtcagcttgtcaagaaatttcagcggtgcgtcaagggagcagccgatatacttcctgtagtcctcgtcatttgtcatctttatgtcaagcatacaaaggtcggtgaccttgagaagctccgtaacgtcatcgttcattatacagcccgatgtgtcaaggcaggtgtttatcccctgccttttgcattccttaaaaagctcggttacgaattttgcctgcataagcggctctccgccggataccgtgataccgccgttcttgccgaaataattacggcatctcagcaccttttccataatgtctttgacggtagctgttttaccgccgcttgcatctcttgtttcgggattgtgacagtatccgcaacggagcggacacccctgcaggaacaatacaaaccgcactcccggaccgtcaagcgtgccgagcgtctgtattgcgctgtatctgcactccatgttacatcaccgtgtggaacgttctgctgatgacctctctctgctgttcctttgtcagcttgtggaagttgacagcgtagcctgatacacggatggtaagattgggataagcctcaggattttcatatgcctcaataagcatctccttgttgagaacatttacattgaggtgatgtgcataatttgagaagtaaccgtcaagcacggcaacaaggttttccactctctgctcgtccgtctttccgagcgcatcgggaacaatagagaatgtatttgaaataccgtcacggcagtaatcgtactggagctttgaaacggaattcagcgatgctatagcaccgtttgtttcacggttgtgcatcggatttgcaccgggtgcgaaaggctcgcccttctttcttccgtcgggagttgagcctgtcttcttgccgtatactacgtttgatgtgattgtaagtgccgaaagggtatgacgtgcgtttctgtaggtcggattcttacgaagctctgttgacactctctgaataatgttctgagctattttatcaactctgttgtcgtcattgccgaacttcgggaagtcgccctttgtatcaaagtcaattatataaccgttttcgtcacggataggctttacatcggcatattttatagcactgagcgagtcagccattacagaaagtcctgcaattccgaatgccatcattctgtcaacgtctgtatcgtgcagagccatctgcgtcttttcgtaagcgtacttgtcgtgcatatagtggataacgttcattgtattcacatacagcttgcacagccactcacggtaaatatcaagtctgcctcttacctcgtaataatcgagcttgtcgccctgtaaaggctccatctgaggacctatcttcattcccgtaacattatcatagccgccgtttatggcgaggagcaggagcttgggcaggttgaatcttgcaccgaagaactgcatctgcttaccgaccttcatagccgatacacagcaggcaatagcgtaatcatcgccgtattccatacgcataaggtcatcattctcgtactgtatcgaatctgtgtcaacggacagctttgcacagaacttcttgaacggttcgggaagtctttcagaccacagtatagtaaggttaggctcgggtgaagaaccgaggttataaagggtgttcagcattctgtagctaccctttgtgaccagaggaacaccgctgttgttcacaccgccgacgctttcagttatccacatcgggtcgccgccgaaaagctcgttatattcgggagtacgcagatgtcttgcactgcgcagcttcattacgaaatcatctataagctcctgcgcctgctcttctgtaagaatgcctcttttcatatcacgctcaacgtaaatatcaaagaaggtcgatgttctgccgagcgacattgccgcaccgttctgctccttgattgacgcaagataagcaaagtatgtccactggatagcctctcttgtgtttcttgcgggcatactgatgtcatagccgtacatagccgccatttccttcatcttcttcaggaagtttatctgctggaaaagctcctcggaaagacggatcgtatctacgtccattatgttttctccgacctttttcttgtcaagctgtttctgctctataagatagtcaacaccgtaaagcgctaccctgcggtagtcgccgattattcttcctctgccgtatgcgtcgggcagacctgtgattatgcctatatgacgtgcgagcttcatctcgtctgtatatactctgaatacgccgtcattatgtgttgtacggtactcgaagtgttcttcaacgctctgcgacagcttgtagccgtaagcctcgcacgcacctctcgccattctgataccgccgaaaggatttactcctctgcgaagcggagcgtctgtctgatagcctacgataagctcgttttccttatcaagatatgccgcaggataattgcagagagatgataccacctctgtgtttatatccagtacaccgccgttttcacgctcttttttgaaaagctcaccgagctttgcgttaagcgcttttgtgcgctcggtaggaccgcataagaactccggtccgcctgagtaaggcgtgaagtttgtcattataaagtcacgggtattaataccctcctgccattcaccgggcttgaatccgtcccagtaatccttgaagcgaacgctgaggtcagttgtgtttcccataattttacctttccttcctgcgaataatcgcaatacacgtttgctgcttttcagcggaatatttttccgcatacaaaacaaaaagcagccctattcggactgcccagacggtcggcataaggtgtccgcttgattcggcgggcaggcagttacagcacccgtgttgattcacggttatccgtcagcggtaactgccgtttcctatggtttgagtatagcacagctatatacttttgtcaatagcggaaatgtaaaatttatataacagtttttgccgtaacgcaatgcataattgcctgctgtatacaaaaaatccgccccgggcaatacgcaccggagcggaaaatatcctgcttatcgtttacttgcagaggtctttcttttcgataagagttacaccgttgtcgataagcaccttagatgccttctcaacatcttcgacacggataacaatatccgctctgcctgcaaccttacccattacggagtacatatactcaacgtttattccgcaggcatttatcttgcccataacgttatataatgctcccgaaacatcggggatagtgaatgcgatgacctttgtaacagccgctgtacagccgtcagccttcagtgcctcaagcgccttgtcggtatcatctactatcatacgcagtatgccgaagtccgccgtatccgcaatagtcattgctcttatgtcgatgcctgccttgttcagtacctccataatacctgcaagtctgccttttttgttttcaacgaaaaccgaaatctgatcaatatacatactgtacctcctccaaattatttcttttcaaacttgttctttatagccctgttatcctgaactcttacagccttgcccattgagcgtgcaagggtcttgggttcaagcagctttacattgattcctacgccgatagcggaatctatcgccgtttttaccctttttgtgtagttttcaagcgtctttacgccgtcgccgaacatatccggacgggtttcaagctgaatttcaagggtatcaagattattcactctgtcaacgaccagcaggtagttcgtagccttttcgtcaaccgacagcagtgccgattcgatctgtgacgggaatacgtttacgcctctgataataagcatatcgtctgttctgccctggggcttcagcattctgatatgcgtccttccgcactcgcacttatcatagataagagtagctatatctcttgtcctgtatctgataagaggcagtgcctcctttgttatacaggtaaatacaagctcgccctgctgacctgcgggtaatacctcaagcgtatcggggtcgatgacctctgctatgaagtgatcctcgcagatgtgcataccgcatttatactgacattcggcagacacgctgggacccattacttccgacagtccatagatgtcgtaggcattgattccgagtccgtcctcaatctgctttctcatctcgtctgtccacggctctgcgccgaacagacctgccttaagattgaaatcctcttttttgaagcccttttcgtgcataagctctataaggcttatagcgtatgaaggggtcatacagattatagaagtgccgaaatccctgaacatttcaagctgacgcaggctgtttcctgccgatgcgggaataacggtagcaccgagcttttctgttccgtagtgcataccaagaccgcctgtgaataatccgtaaccgtagcagacctgaacataatcgtcctttgttccgccgatattggtaagcgctcttgcggcgcattcagcccacacgtcaatatcatgagccgtatagccgacaactgtctgcttgcctgttgtacccgatgatgcgtgtattcttacgacctctgagcttggtacggcaaacataccgtaggggtaattgtttctgaggtcctgctttgtcgtaaaaggcagctttgacaaatctgcgatagattttatatcctcgggtcttactcctgcctcgtccatcttcttacgataaggtgcaacattttcatatacacgtcttattgtgcgtgaaagtctgtaggattgtaacgcctctatttcgcttctcggcgcacattcgatttctttgttccagtaattcatttgtctgctcctgttttatgtaatatgcaattttaagacagcaaaacgttattctgctgtttatactattgattttatcacaattgcatatcaaagtcaattaaatatcgtgctttttgtgcacagttcatcaaaacgcagtttatacctatgcactttgacaagtatcagagcaaggcagggcttaggtttgtttaaggttgtggatgtatcatattaaaaacggagatgctgctattgcaaacctgcgtttcaaagaatataataaatatgacggaagaacagaaacggagaatatacattgtacagaaaaagacgatacaggcgcaaaagctcgaagccgcaaaagctcgcccttataggatttgcggcggcggtcacaatcggtgcgtttttgaccttattgaatatcaaaaagcaaattgacgcagacagtgcttcatcggcgcaggaaagcgaaaccaccgtcactgctgccgatgccgtgcctgtgaatgacattgtcgagcctgaaaagattgctcttataagcggaaatgtcacaacagccgacagcgtaaagctccccgatgagataaaacaactgttgctcgactacacctcagataaatacgaatacgcaggtgagctgaaatacagctcgctgtcgcagtatttcaataccgacagtacatacggcaggctgtacgcaggtttctgcaatacctcgctgcaatatctgatatatgcaaggcagtgccgctctgccgatcttcgctatgacgaggcatcgtttgtgataaacgtagaaagcgcaaccgtgaaaaagggcgtttacacaataaactataccataagcgaaaaggttgcgttcgcaatatgcgatacccctgccgagtcctgcggtatggaggtcgaggcgcagatttccaaaggcacagacgggaaatacaggtttgacattctggcggaggataccgatgtaaacctgctcatagaaaaacgtgtaatgagttatctcgggtatgattatgaagaatattatctcaaggatatgaaaatacccgacaaccttgattacgataaaatgtattcgggcattctcaaaaagctcaaggcggaagcagagagcaacgtaaatgagcaagagcagatgcttgcgaactataacgccgatcccgacagcttcaaaacctcaaagaccgcaaagcacagctacgaccgtgacaaagccgttgcttattcatacaaatgggtaaacggcgaaagcgtagtcagaaaccctgcttacagtgactatgccatatacggcggaaattgccagaactacgtttcgcagtcattgtttgcttcggggatacctatggactggagcggcagtgagcagtggaaatggtttgacgatgaaagcgacctttctgagcttcctacgggaaggtcagggtcgtggtcgggaacgcaatatttttacgaatactgcaacaagaatacgggcaagggcattgtagccgaaacagacggtaatattttctccgcacagcccggcgatattatccagtatgtagttgacggctgggcgcaccacagcgtgatagtaacaaaattaatatatgacgatgacggcaacgttgtcgatcttctcattaacagcaatacaaccgacagagttgattatcctatgagtgcatacggatatacggacataaggctgataaagataatcggatataatgataaatgataaaagctgtatactgcggacgcccgtagtatacagcttatttttctgctctttcgatattcccgataatatattcatactcggggtatgattttcttatcctttccctgcaccgctcgcagaacttgtcaagctgtgccttgtcatcacgcattttctgttttgcgccccacagatgcgtatatctgctttgaggcagaaatagcctgtccttgtcaagaagcgtggtgtatccgatgccgcacctttttgcaagcatagggagcaatctctgttcggcgaaaaccatataggtaagataatctccgccgtacaccgccgacttcataaacgctatggagcgtgatgtgtaatactgcttaaaatcctcatcgggaatatacaaaaacgccgtatttagcggtaacgttgtgtaatcaagtccctcgtcaagcaccttgcctttcagcctgaacgatgaaacatcggggtagacggacggcataagatcctcctcatgtgccgcaattatcttatcctcaaacggcggatcctcccacacgataaaatccgtatctatcattgcgcacggtgcaggaaactgctgtaaagcaatcagctttcctcccgcccagaacataacagggtctatcccgtcaagatcatcgggaatgacaacctttatatcgttccatatatcgtttatgccgagagcggaaaaaagctctgctcctgcgctgtcggtaagcatagttatgctgttgccgttcttgcgccattgcaaagccgaaatcactgtgcagtatatgtcgggtaggctcataatgagcttcctgcccgggtttttggcgaaaaaagccgccgatgaaaatgaatgaaatccgttcatataagatgtatcccgtatccgtagcggttaagcggttcggacgaaaagaaaagcataagtgccttaggcgtaaagctgccgcccacgcacagctcgtcatacgaaaaactgcccgaaagaaagctcgttatatcaaaactgccgatattgaacgagccgaagctcgttttacccgagccgtattcatattcgtattcatattgatgcttataagaaccgaacgaacctgcaaacgaagatgccgtgaaagaaccggcaaacgaaccgcttcccgtcataacaggaaatctgaacgaaccgtccgccgataaaacaactgttcctgcttcacgctttaaaaacggaggtgtcaccgtcttgaaataataaccgccgtattcgctgtctttattattgctgtcggattcttccgcagagcctgtaaatatatcctcaagagccttgtccacgtcgccgtttctgtcgatgttatcaattcttgccgcttcgttatcataacctccgagccttaaccagtcagcaagtctgccgccgagataatagcctttaacatcggttatattgaaattgtccctgataccgtcaaggtcggatacctttactccgcctatccagaggcaacagttctgcataacatcaatcctttcgtaagcgtacatttttcagcggcgcacgctttttctcaccatatcaagcagtatcggagcaacgttcagcgacggctcggccagcaccgcttcatacagcgactctataacagctctcgcctgtgccttgtttgcgacaaggcgatgcgtgataagatcgttttcttttatggcaagctgtgatatactgtagcattcgcccgacgcaattatatcatcaagcattgtcaatgtcctgcggtacattgctataacgccctcatgcaccgtaggcttcgccgtatcatcggctatacggagttttatcagctttttaagttcctcgtgcgaatactcgcaaagcagccttttaacagccgtcctgtcctccgtgatgcttatatcgtgcgattctatcagcatatctgtgtcactgcggagtttaagctccgccctgtacttttcgaagaaattcgccgctcttatcctgccgtactccccgtgaccgtaaaagaatgtgttgccgtgcgaatcacggcatttacaatcgggaatgccgacattgtggaacagcatagcataccgtatatcagcctgcggaggcgcaaactcaacgcttttggaaatatgctcccacagcgtgctgtcataatatctttccttatatctctgcgctttcagcagttcaggctctattgcagaaaatacctccggaaaccgagccatcacgcccgaaatatttcttgtaagaagaatccttgtaaagcgtcttgacaactcgtgcttatccgcttcacgcagaagcggtgcgtccgcctttattgcgtcggctgtaacgctgtcgatctcataattctctgcgccgagcagttcaagtgctgtcagcatattgaacgggtttgtaacaaggctcgacttgggttcgagtttaagcgtcagctcgttttcgtcaaggtcgttttcgtgccacatcacaacgggatattcgcctattgctttcagcgttatcactccgtcctttatgcacggcataccgtcaaacggatctctgaatccttttcttggatggtatgcgatcgcaaatgcggaaaaatcacggtgaacaagatcgaaaatataattgtcggtatagactgcttttccgtcctttatttcgccgcaatagcttgacacctgtattacaagtcccagcgacgataccataacactgctcatatcctcgttttgcgaaactatccgcatatcacggaacacatacagcatttcgccaaagtccgccgtagttataatatcataatccataggcgagccgcctctcagcagttcagctacacactgtccgacaaaatacgccttgttacctgcacgctcaagcattttcagcacctgcaatgcctgctcgggaatattcagcgtctgtcttttaacagccaagtacggtcacctcttgttgtttatttatcggggtatccccagccgtccacgccgctctttctgagtgccgtgaacattctgagcttgaagcccttgtccttatgctccatatcccttaaaaactctttcgttttctgcctcgtcgttgtcttgtccgcagggcagaccgactttatgatttcaaacccattgcggttgcaggcggataacacctgtgactcaggtgcaagcacaagcggtcggataaccgttatatccttgcggtcaaggtgggtcttaggcgaaaaacatcctatcctgccctcgttgaacaggttcattataaatgtttcgataacatcgtcattgttatgtccgagcgcaagcttgttacagcctgccgcctttgccgcatcgtgaagcgcacctctcctcatattcgcacacagcgaacaggggttaggttcttttcttatgtcgaatactatctcgcctatctgcgtatgaacaaggctgaaaggcacgtccagcttttcacaaagccttgccaccgcctcatagttattcggcacaccgttgaaaccggggtcaatcgtgacagctgttatgtcataatcaaactccgcaaaccttctcatttgcgcaagtccggcgagcagaacaaggctgtccttgccgccggatactcccactgctatcctgtcgcccttttgtataagatcaaaatcctgtacggcttttcttatatatcccagtatcttctgcattatttcttatcctttttgttcttgccgaatctgaaataattctctcggtactttatagggatattcagctttctgctcagcaccattacagttgcgtccgaagcgatggtcagcgcaatgaagattatgcagataacataagccgtattattatttgtaactattgctacacctgccgctcctgcggcgatcagtgcaaacaaaaaacgtgttttcttgaatattcccagagcaagctccaaaaacactcctcctttataccggcattaatcctcgccgagcttcagcgccttgttgatatttatctttctgataatagcaccgagtattgcaaatcctccgagaagcattatcgcaataagtatatacatcttaatgtagtctgcctgcattgccgctactctgtacggcggtatctgctcgtttacgttatacatatactggaacagcggtacaaacaggtcgcttgtaactccgcctatgataaatgcgcagattatcgaaacgcccgataccagaagctgttcatatcccagtattcctattatctcaccgaatgaaacgcccatagcccttaaaataccgaactgcagtgtcctgccctttatggacagtatccagtaaataaggaagccgattatagtcattaccattatgattataaatccgagcgtcagcgcaccgttcataccctgcagtgaaggatccgtcttttcgcttatcagcatctgtgagctgtccttcacgctttcaagcggcagcatagactcttctatactcttgtaaagggcctcgcttgttgcgccgtctttcatcttcagccatatctgataaggctcaagctctgttctcgcccttacataattataattcattaccgcaaagtcgcactcgttggggttaagtccgggccagtaatcaactatagccataacagtggtatcaaggctgtcgtttccgccccacttgaacgagataacatcgccctgcgaaacattcgacttttccgcaagtcctcttgagattataacgccggaacggctctctacaagagcgttgcagtagttccaccagtggataggcagaagatcgtttctgaaccacgctgtctgtgcgaatttatcaggttctattgccataagagtaagatctgcaacattcttgtttgcaactctcagctttacattatcgtttacaagaactcttgtggcgatctccacaccgtcaagcgcctcataacgtgaaaagtcggtttctacataggtgcttgagccgccttcctccgaggtcgaaagcgagtattccttcattacgacatctgcgccgttctcataataaatcctgtcgcttatattgttgtttatggctctcgccgtattcgcagagaacagaccgaatgagaaggtcattacaaggaacagcataaggaaacgttccttgccgccctgtgaacggcacacggtggttatagccatatactgtgagggtgtccagaacggacgcagtacataatacacaagccttaaaagatacggatagatacggataaacagcagaccgaagcccagtatcataagcgttgagaatatgaacagaagcgggtcaagctcgcctgtcgcttcaaaagtaccctcagctatagaatttgtgatattggttgtgtagaagtaaaggaagccgaatgacaccgcaagaagtacaatatcaacaccgcacttttcccacagcgacatctttacaacctttgtcctgctctgcttatactgtacgatagtcagctttgacgcagggataatcggtatcattgtggtgaggaagaataccactaccgcaagcagtgcgtaaataacgcttattccggttatctttgcggcaattcccgtgcggtttacgaactctaaaaatccgtttgatactccgagaaactgacacagcacaagtccgatgaacggtgcgaccacaagcgttacaataccgagtatgcccgactctgcggcatacataccgaatatctgccacgagcttgcgccacggctcttgaatacggcaatctcgttgcgctctctgtcaacattcagctgagataccatgaacagatagaacgccagcattaccattgcgggtatctgaagtatccacagtatacgggtgagcttttccgcacgctcggtatagttgccgattatatccgcaacgttgaattcgtgtgcatatcctgcctctttatagaacgcatcgtccttttcaagctccgcagtaacagcggatattctgttcatatcaagcgtatgatagtcaagagaatatcttcttgcaatgtttaccgcattgaatctgcctgcgggcataaggtcgtttcttaccatatcgtaatcaacgaatatggcattaagatagctgtcgagcgtttctgcccagtagctgtcgttgtcggtcttctgctcatatacgccggtgattttcacatagtacggctcaacacctgccgcaagcgaaattatcttatatgtattgcccatatttatgccgagcgttttgagtgcgtcctctgaagcaagtccctcgtacacgccgtcaacagaggtctttgagggcagctcgcctctgacgagcttcatatgatcaaggctgtcggtcattcctataagcttcagccttgtagacagctccgaaccgttacgctcaccgtttacgatataaaggcaatcgtcaataagcgttgtcttgctgttctccgaggcgattcctatagcatttatccttgaatccgttttagatacaacatcgtctatcgttgcctgctgggtattcgtatcggcagttatctgaagcgtctttgtaacggaatacagaccgggatatttgttgttgtcaatctggtactgctccatatcctttatcagcatacgctgtaaggatgcgtccatatatatcggaatagtgctcatcatacctgcggcaagcaggaagccgatgaaaagacacagcaccatccattttgtgttgcgcattttgcgccataataaagtaaacatcttgtattattccttccgaaagtaaagcctgttcagtttgccgtcttacttgacaacaacctcgtcaccctcggaaagtcccgatactatctggatctccgtagcattgcttatgccggtttcgacatccgtttccttcttgactccgtccttgtagacctgtacatagttcttgccggacagcgtctttacaagatacttcggtatgacgattgcgttctccgcctgctccttgatatagcttatatccgcaaccgttcccaccttgccaaagccgggcaggctgcccttgaactcggcatatatcgagcttgtatcctcgtcgccctgttcctttgcctcaacaggtgtttttactatagtacccttgtactcctgttcgtcgatagttattgtaacttcctgaccttttttaaattttttatcatcgttgacggccgcctttacatatatcttatcgggatctattattgtagcgataaccttgtacgcctgcaccttcgagccggcgttcatacgctccgcaaagctgacaagtccgtcacacggagcatacagcttggaggtatcgtattcgttctgaagctgtgccagtgtattcttctcaatctcaagctgtaaacggtcattctcagcaccgcttgagccgtatgtattctgtgcctgctgaaccttaagctcctgagtgcgtatcttgtattcaagatctcccgtgttgtattcagcgataaggtcgcccttttttaccgtatctcctgctctgacatatatcgttttaagagtaccgtcacgctctgtaaacgaacagtcctgctgcagctcggatacgcagtagccggtcgcactcgccttgtttattatagtcttctttaccgccttataggtagaatatgtaacatcctccaccttaagcacaggcggatcgagcaatttttcttcctccgggaaaaaatagcatccggaagcagagcctgccatagcaagcactgcggctattgcggcggcacgcaaaacagtctttttcatttttactttcctttcctttgaacaaagggattttcgcatctttttccttttatagaaaatcaaggattttgctgaacttatatgtacaaaatttaaaaaacactatagagatgcttattttaattttagcatttttcacataaattttctacactttttcaaaattaaacgatatgcacaaataccaaaaaggttatttgtttattttgtacaccgtaaagcaactttaaataatcgaaaagcacttgaaaaagccgaacggatttagtataatagtgagtagtgtttatttttcaaattgacatataaaatcaatacgacgggcaggaaaagctcaagggaaggaacaaaataatggctacaaagtatgtattcgtcaccggcggcgttgtgtcgggactcggaaaaggtatcacggcggcttcactcggaagactgctcaagatgagaggttacaaggtaactatccagaagttcgacccctatataaacgttgaccccggtacgatgagtccttatcagcacggtgaagttttcgtaacagatgacggtgccgaaaccgacctcgacctcggtcactatgaacgttttatagacgaaaacctttcaaagtacagcaatgtaacaacaggtaagatttactggacagttcttaacaaggaacgtcgtggagattatctcggcggcacggttcaggtaatcccccacataacaaacgaaatcaaatcaagaatatacagagttgcaaactcagccgaaaccactgcagatgttgttataaccgaaatcggcggtacggtcggagatattgaaagcactcccttccttgaggctatccgtcaggtagtttcggatgtaggcagagaaaacgttgtttatatccacgtcactctcctccccttcatcacaggcagcaacgagatgaagacaaagcccacacagcacagtgtaaaggagcttctctcactcggcattcagcccgacattctcgtttgcagaagcgagatggagattcctcaggatatgagagataagattgccagcttctgtaacgttcgcaagcaggacgttatccagaaccttaccgctccttctctttacgaagtacctcttatgcttgaaaaggaaggtcttgcaaaggtagtatgcgatcatctcggacttgatccccgtgttcccgatctcaaggaatgggaggatatggttcagcgtcagtacaacgccacaaagaataccgtaatcggtcttgtaggcaagtacgttgcactccccgacgcttatatttccgttatggaatccctgcgtcacgcaggctttgagaacgaatcgcacgttgaaataaagctcatcaactcagaagaggttactcccgaaacggcagacgagcttctgcatgattgcgacggcattctcgttcccggcggcttcggtgacagaggcatcgagggcaagattgaggctgtccgctacgcaagagagcataagaagccctatctcggtctttgtcttggtatgcacatggctacaatcgaatttgcacgtcatgtggcgggtcttacagacgcaaattcaagcgaattccacgaaggcgagcagaacgttatcgaccttatgcccgaccagaaggatgttgatatgggcggtacaatgcgtcttggcttatacccctgcaagctcgaagcaggtactatttcccgtgaggtttacggcgatgagcttatttatgaaagacaccgccaccgctatgagttcaacaacgtattccgcaagcagctgacagagagcggtcttgttatcgcaggtcagtcgcccgacggaaagctcgttgaaatagttgagcttccgagaagtgttcacccctggttcgtggctgttcagttccaccccgaattcaagtcacgtcccaacagatcacaccccttattcaaggactttataagagcgtcgcttgaacaggcaaacaagtaaagaacgaacaataactgctcgtgaaagcgggcggttatattcatattacgggatattttacattccatttacatcttcagaccgtatttaatccattaaaagaggtaatttatgacagacagcaacgtttacgataaccgtgaattatcgtggctgaaattcaatcagcgtgtacttgaagaagcgcaggacataaatgttccgctctttgagagaatgaggtttatatcaatattcacaagcaacctggacgaattctttatggtccgtgtcggctcgctgtacgatcaggatctggtagacccccaaaagtgcgagaacaagacaggtatgaacgccgcaagacagcttaaggaaatcgcacgcagggtaaaggatctgctctatataaaggactgcgccttttcagaggtttcggcaaagctcagcgagtatgccgagcttaaaaagcccgccgaccttaagggtgacgataagctgttcttaaggctgtatttcgaaagagaaattctccctttgctttctccgagcattatagacaagaaccacccgttcccgttcttaaagaacagagcaatatatatcggcactctactcaaaagcaaaaacgaggaaaagaaaaagcagcttgtgggaatattgagtgcggaatgcgacagggatttcccccgtgttattttcctgcccggacagaatctgagatatgttctggcggaagatgtaatactgcattacattgatacccttttcccgaatttcttcgttgaaaaccgctgtatcatgcgtgtcacgagaaacgccgacattgacgtgaacgaggctctttacgatcacgatatggacttcagaaacgtaatggaggagctgtgccgcaagagaaagaagctgatgccggtaagagccgagttttcatatgacgcttcaccggagcttgtaaagcgtatgcttgattaccttgagctgtcagacagcttctcgtttatgcagagctgtcctcttgatttcggctttatgtccgcacttgaggataagctcgaaaacaggagcgagcttttctacaatcaggtttcaccgcagaattcaataatggtaaacccgtacgagagtatgttctcacagctttcacagcacgatatacttctgtcgtacccctacaacaagttcaagaacttcctgcgtctgcttgatgaggcggctgacgatccttacgtttcttccataaagataacgctttaccgtgtcgcaagaaacagcgagatcgtaagcgctctcataagagccgcagaaaacggcaaacaggtaatggcgcttgttgagcttcgtgccagatttgacgaggaaaacaacatcggctggagcaagaagatggaggaggcaggtgttaagataatatacggtcttgacgctctgaaggtacactcaaagctgctgctgataacacgcaagcagggaagcaacatcagatattatacccagataggcacaggtaactataacgagaaaacctcacgactttacaccgaccttacgctgatgacatcggataaggacataggtgcggacgcaagcaccgtgttcaacgctctgtcgctcggtacgacagttgagagcagtacaacactgcttgtagcgccgaaatgtctcaagtcacgcattgtggaaatgatcgacaacgagataacctacggtactgacggctatatcggccttaaaatgaactcgctcaccgacaaggatattatagacaagctgatagaagcaagctgtcagggagtaaagatagagctgataataagaggtatctgctgtcttattgcaggagtgccgggttacaccgaaaatatatcggtcatttcgatagtcggacgtttccttgagcacagccgtatctatatttttggcaagggcgaacgcaggaaggtatatatttcttccgcagactttatgaccagaaataccgaacgacgtgtggaggttgccgtaccgcttaaggataagataattgccgataaggcggttgatatattcaacacgatgctcaaggataacgtcaaggctcgtgtgcagggaagcgacggaatctaccgtcataaaaaagctatgccgggcgaggaacgcacagaggtacacaagctgttctatgaacgtgcatatcaggaagccgagcaggcgcaaaagctctataaagagccgagaaagtcactatttgcaagaatccgtgcaaggctgcaaagtaaataaacgataaacaaaagcggagcagattcccatctgctccgcttatattgtatctttttgtcctgcttactgcacaagatctccgtaaacaatgccaagtccgactgtgctcatataaactctgccgtatttgttcatatcgcccacaacaaaaaatccgttgccggggccgccgaactgatgctgatcatcgtttaccctgctccatgtcttaccctcgtcctcagaccagtaaagacctataggatcatcgtttgtgggcttgccccatacgaatatggtataaggatcgctgtccgtcttgcccttaccaagacctaccgccatacaagcggctaaagaatccattcttgtgaacgttttgccgttatctgttgatacctgaagtcccattgaaggatagtacacaacgccctccttgccgggtgcaaccacaggtcttgccgcagcgaatacagaaagtgtcatattctgagtaaatgtctttccgccgtcctcgctgtagaagaacgcactgccgcttgcggcatatacataattggggtttacggggtcgcagataatcttctttgaacctactccgccctcgctctttgtccaggtcttgccctgatcgtcagaaaagtaaatgctgctgtcgtttccgggtgcccagaagaatctctttccgtcagcagaaactgccacatagccgccgtatgccacatttccgctctcaagaggcgaaacggtaacattcacccatttcttgcctgcgtcaagagtataccagaagcccggcttttcttcactgccgccgcactttacccatatatcagttgcctttgccgctatcgcaagaccggtcattgagcctgcaacgctgttgtgtaccataccgtattcttcggcactatcctgtacaaagccgtcatagtcggctataacgcttaccagcttaccaccgggtatgctgattatatcatacggaacagtttcttctatgccctttgagaagaagtagaattcggggctttcatcccatatattatcgcaggtgaacacgccgttacccgataccaccattatcttatttgtgttattgggatcaatggccattgagctgcaccagtgcatagacgctgttgttatccactcaactccgccgctgctcatcttcatcttatcgttgagaagcgtccagttcttaccgccgtccgtagttacatagaattcatcgccgtactgaccgttaggctgagggacatatatattctccgtgcaggcaaccattctgtcggggtttgaaggatctatcaccacatcaccgaaagacttctttgcaggattgatctctgtaaaggtatcatcggcaatgttgagagttcttacgccgccgtcaattctgttattgttccacggaccttcggcgcttgcataggtaattactattttcccgtcaccgttatacttcattctctgcgtataaagttccttgggtgcgtctgcaacgggtttccatgtagcaccgccgtcggtcgatttataaaggttctcctcctttgttctcgaaacagccgcatatatagttgtgcaggcactgtcatcgcccgatttcgggtcgattatgatactgcatataccgttgccgtttgacgttgtcgtctttgttcccatatcaagtgcagtgaatgtctttccgccgtcggtcgactttattataccgcctgttcttccgccgacatatactatatcactgttcttggggtcaaccgcaatacgctcgccgtttcctctgcccataccgtttccgtgcgccgttatcatatcggtaagttcggtacggttccacgttttgccgtaatcatcggagtataagaggcaggttttgccgttgctgaaatactccgtgcctgcaagcatatataccttgttaggatctttttctccgaatgcaagaccgtctataccaagcagaccattgtcttcttcgctgatatcgtacgacatggattcccacttctgagtatccttattataacggtatgcgccgccgacgtctgtacgggcataatataagccctgctcgcttgttgcaaatacgccgcttacgaatccgccgccgcccatagctacctggctgaacgtaaactgcgcctgcgctgttcccgaattgccgcccgatgttgtagtcatactgctgtcaccactgcccgatgaggtcacatcaccgcttgacgatgttcccgaattatcgtttccgttacagcctgcggcgcatattgctgttgctaccgcaagtatgaccgctgttatttttctgtacttcatttcttattcctttcttattaaagcagacttgcttaatttttatgtaaacctttacacaagtattatgcaccatttaagttaaatttgcaagacttgttttgctgttttgtgaatatgtgacaaatcctcgtagccactattggtgataatcacggattttgcaccaagaaaaatatgggcgtgacttttgcgtgcttatatagtataatcatattgcaatcgaatacaagccctgtcttatcacgtttacggcagggaaacggaaatggaaatggaaaagataaatgaaaaaacgcatcatctcccttatcttatgtgcggcaataataatatctgcctgcggctgcagtgccgataacggcacattgtcagccgacagttcatcatcagcagcttcggcagcgtcttctgccgaaaccgcatcgcaggatacctcgtcagacgcttctgataaaacaagctccgataagcagaacagttcgtcatctgacagttcagacaagcagaacagttcatcggctgacagttcagacaaacaaaacagttcatcggctgacagttcagacaagcaaaacaactcgtccgatgcttcttccgaaacgtcaaagccttcgacaaacaagcaggaaagcagttcttctgccgttacagcaagcaagcctgcaaacagcacaggttcagcaacaaacaagcctgcgtctgcaaccgccgccgataccaccaaaaagccttccgcaacgactacaacgaaaaagccttccgcaacgactaccacaacaacagtaaagcagactgacgacaagccgctgaacttttcgaaaacctatgaagcagaaaacggaaagctgtcaaacgatatgtccgtcatatccaacggcaatgcatccggcggaaagtcggtaggtaaatttgaaaatgaccgctcctactgccagattaaaataaatgttccgtcagacggtatttatgatattgtaatacgctcaatgggcatcggcggttccaaagaaaacgacatttataccgatggtaagaaggtaggcactttcaccagtgagaacaatatattctcggattacaccgtaagtgcggtaagccttacaaaaggcgaccacaatatccgtataatcacgtcatggggctggatagagcttgataaaataacagtaaagacgggtgcaaaaataagcagcagcacctataatgtcacatcttcgcttgtaaaccgaaatgccaccgcaaacacaaagaagctgtacagtttccttaaggacagctacggaaaatatgtaatcacaggtcagcagtgtgacggcggaataaacggcaacgaattcaaagcgataaaaaatcttaccggcgactaccccgccctgctcggacttgatctgatggactacactccgtcaagaacagcattcggcgcatcatcctccactgttgaaaaggcaatagaatttgccaacaagggcggtatcgtaacattgtgctggcactggaacgctccgaccgaatacctttacagcaccgccaacaattctgacggctggtggggcggattctacaccaagagcaacaaatttgacattgcaaaggttatgaacggtcaggacgcaaaaggaaagaaactgcttgaccgtgacatcaaggaaatagctaagcagttaaagcgtcttgaaaaagcaggcgtaccgattatatggcgacccctgcacgaagcgtcaggcggctggttctggtggggcgcacaaggtcccgacgcttacaaaaagctgtggaaatacctttataacgagcttacgaatacatacggctgtaacaatcttatctgagtctataacggtcagagtgccgactggtatccgggtgacgaatatgttgatattgtaggcgaggacatctatcccggaaatcacgtttacgatcctcaggtaagccgtttcaaacaggcgataaactacggcagtaaaacaaagataacggctctcacagaaaacggctgtatctttgatatagattccgccgtgagcataaacgcactgtggtgctggttcatgacatggggaaacgagtttaccgttaacggcagtaattacagtgaaaaatacaccgaaaaatcggttataaagaaaatgtacgcaagcaaatactccttaactctcggatcgcttccgaaaatctattgacataagctgaaaacgctccgacaggcgaacacctgtcggagcgtttttgttaccgtttttagcttacgatatttttggtataattatcataccataagcgagcatatcttgttgctgtactcaacggggtcttctataggcataccctcaacaagaagcgcctgatcgtacagaatctcactgtatgttttcagcttgtccttatccgtttcatacagctttttcagcgtttcatagataggatgctccgcattgatctccagcaccttttcagcctttgcatcatgctctgcgggcatctggctgagcaccttctccatctctatagaaagcagaccgtcacttgtcaggcatactgcgtgggacttcagtatctttgacagtcttacgtcctttaccttaccgccgagtgattccttcatgaaagcaaacatatccttgctttcctcagccttagccttcatttcttccttttcttcgggagtttcaaggtcaaggtcgcctgcggatactgacttgaactgcttttcattatagtcgaccatcatctgtaaagcaaactcgtcaacgctgtcgataagataaagtatctcatagcccttatcctttacaagctcggtctgagggagcttgtctatcttgtcgaccgtttcaccgcttgcaaagtagatgtatttctgatcttccttcattcttgaaacatattcttcaagagttacgagcttcttttcgtatgaagaatagaacagtagcagatccttaagcaattccttgcctgcgccgaagccgttatatacgccgaactttatctgaaggccgaataccttccagaacttttcgtatctctcacggtcgttgcggagcatctttgtaagctcgttcttgatagaacgctcaaggctcttttcgattatcttaagctgtctgtcgtgctgcagcatctcacgggagatattgagcgacagatccgcagagtcaacaagaccttttacaaagctgaaataatcggggagcagatcggggcatttatccattataagaacgccgttcgaataaagctgtaagcccttttcatagtcctttgaatagtagtcgaagggagcttttgacggaatgtacatcagtgcgttatatgttgcggtaccctctgcctttgtgtggatatgtgcgataggatcgtcgtagtcgaagaacttttccttgtaaaactgattatagtcctcgtctttaagctccgacttgctcttgttccagataggcaccatactgttgagagtttctatctcggtatgtgtttcatactcgttctcggtaccttccttgaggtgctgatgacttacttccatcctgataggataacggatatagtcggaatacttctttactatcatacggagcttgtagtcctgcagatactcgtcgtactcctcttcttcggtattttcctttatcttaagggttatctttgtaccgacatcttccttgtcagagtctgtgatagtataaccgtctacgccctgcgaataccacttgtaagcctgctcactgccgtaagccttagactcgacagtaacctcagacgctaccataaacgcagagtagaagcctacaccgaactgaccgataacgtttatatcgtccttttctgtatcggtattgtcgttcttgaatttgaatgaaccgctgtttgcgataacaccgagattattttcaagctcgtcctttgtcataccgataccgttatcggtaattgttataagacggttttccttgtcaaccgcaaggtctataccgaggtcttttctctctatgccgagattctccgtcaatgacttgaaatacagcttgtcaagcgcatcgcttgcatttgaaataagctcacgcagaaatatctccttatgagtgtagatcgaattgatcatcatatcaagcaaacgctttgattctgccttgaatgccttttttgccataaaaatcatttcctttctatgcctgcgccttatatagcggcgataatactgaatttacaccgttcgtaaccggtttagcactctatcactctgagtgctaaaatatattataacactatttttatatttgtcaagaggtgttttaaaaatgtttgtatttaaaacaaatccgtgatttcaagcgaaattttaacatcggctattgacaattgttcatttttgaactataataatattgttcgaaaatgaacaatatcatctttcgacagaaaggacaggcatatgaccacaagcagcttctggaatttcatctctgccgcagaggacgaatacagcgtgtacagaaagcgcattatggcaaagttttctctctcggccgcagaaacggatataattatgttccttgcgaacaaccccggctatgacacggcggcggatatttcaaaggtccgccgtatactgaaatcgcaggtttcggtatcggtaaaatccctgtgcgaaaagggcttgctgacaggtacttataaggacggaaacaaaaaaagcgtgcatctttcactgacggcaaaggcaaagcctgttgtcacatacggcaaaaaggaacaaagcgattttgcggctgttctgtttgacggatttaccgatgaagaaatcgccgcatttgaaagataccatattaaaataatggacaatataaacagaaaaaggagcgacaaataatgcaatatcttataacgaccgccatttgtctgcttgcaggtattggcgctggtcttggaacagggtttgccggtatgagtgcggcggcggtaatcacacctatgcttgttacatttctcggtatagagccatataccgctgtcggaatcgcccttgcctcagatgttctggcaagtgccgtatcggcttacacatacggaaagaacaaaaaccttgatattaaaaacgggcttgtgatgatgataacagtgcttattttcacggttgtcggcagtttcgtttcaagccttgtgccgtctgtggcaatgggcaatttctcggtattcatgacgcttttgctcggcattaaattcatagtaaggcctgtaatgaccacaaaagccgatatgagcgcaagatccgcaaaatcggtattgataaagtcaatcatctgcggtattatagtcggcttcatctgcggcttcatcggtgcgggcggcggtatgatgatgctcctcctgctcacgagcgttatgggctatgagcttaagaccgcagtaggcacaagcgtatttattatgacattcacagcgcttacaggctctgtttcgcactttgcgataggcggtcttccggatatgctcccgttcatcctatgcataatcttcacacttatttttgcaagaattgccgcaaaaatagcgaataaggcaagtcccgaaacgcttaaccgtgtgaccggcattatccttgtaatactgggaattgtagttctcggtttttcactgattaaataaatccggcaaatgaatataactaaagccacgatgataaaaaatcgtggctttagactgtcgataaacctatatattttttgaaaatgggtgtttagcgttgcttgctatgttggttttgcatcgtgcaaaacttttggcaagcaaccaaagcgtccttgctttgggcgtagccccaagcggggtgagggcggcagccccacactcagccccggcacggatgccgggcgtgtatgcccaaaggctctgcacgatgcagagccaacaaagcatacacagcccttcaccgaggggaaggggtttggggttagggttagagagtttgctatatttctaaaaaataaactttttctacaagctaaagccacgatgataaaaaatcgtggctttaatattactgtacctctatctcaggcatttcttccatttcattcttctgtaaagctttcttctctctgaatataagtgagaaaacagctcttacaacaggacccgcaaagaataattgccagcacagagccataggaaaattggttatcgttgtctgaatccacaccgcaataacttcgcttcccgcatttttgaacagaagagttgcggcaaggctcataagcggacacataaagataactgaaataaccgagataccgagaactatgaaaaacggattatcacgttcaggattaattattttaaaagtcttgtactttgctatcatgccgactaaaaaaatatcaagcacaaaagcgataggtcccattatcacaagctccttgaaagcaagtaaaaagacctcgtttgtcataccgccgatattaagtgctatattatagcatatcatggcgtacaccataacaaacaccatcataacggtaaacacgatttcctgaaataagtttttgggcataaaaaattcctcctgataataacaatttgcactttattgtgttgttcgttatcatccgggggatgtgcgtttccaattagaccaatattctttttacgttatagattttaacatattccgcacccatagtcaattgtaaagtgaacgaaaaaagcaccgctttggcggtgcctttttgtatacatatcacttttcctttttacactttttcgcttctgaatcttccgacaacatttgcattcttatcaatgttgacctcaaatctcagagtgcacggcgaatagtgaacattttcgccctccgcaataacctcatagaagaatgccagagcgcctccgtcctccatacgtcttactgcgcacttgcagaagccttcggcgattgccctttttacataaggtatctcacggtcgtatgtacagaaattgtcctccgtaacgggaatattaacatccccgtcagaacagctgttttctctcagcatagtttcaagcggtgatactttcttacggctgaattccgcaaacggagctttcttagcaatttcgccctttcttgcagggtgtccgtttattttccagcacggccgtgtaacaacgaccgtttcacctatatggaaatcattgttgagatgctcgctctgtgccgaatagaaatcaagcgtatccttgtctatcacaacctcttttgccttatcacgcactattccgacaagctcaagcatagagagcagctcgcctgccttttccatgcacttttcatcgctccatatctcataattgcggaagttgtttctccagtacgtctttatcggcagatcgcctataagcgcctgtatcctcatttcccagtcgaacagtataccgctcttactgcgtatcttgttctccttgatggcattgagcggttcaagcagctgtgcaaacgatgcgatattatccgcaatatcctgcgctatgtactttcttgtatcgctggtcttctttttctcgctttcttcctcgatcttttcatcgctgtacttgtcgaaatcgtcctgtccgccgtcagccgtatcaaacagtgaaaatacctctgagggatcgttaaatgttttctttacctcaggctcatcgtccataagcagatttccgaacaaatcctctacctcggcaacattctcatcgtgcttttcttcggtaacctgtgcaggcgtatatgcttcgtccggcagatcgaagaaatccatagttctcggcttttcgtcagcgtcaatcggctcgtccggagtttcggacagctcatcggataatgtactttcctcaaaaataccgcttgtctgttcaagatcgtcgtccgaaatatctttgatgcttccggtgcttccggtgctaccggtgctgtcagcggtttcggatattcctataaagtcgccgaattctttcaatgcgtcctctacagactcagctgtacgaagggaagaaacaggctcgcttgcggtttcctccgccattatagtgtggaactgttcttcgagcgactcttcttcactgtcggcggtttcttcctgctcggcgatttcctcaaaagcctttactgcgtcctcgacaggctcgcttacagcttcttcggtggctgtgttattttgttcgctttcagcttcgctgtcggcggtttcttcctgctcagcgatttcctcaagagcctttactgcgtcctcgacaggctcgcttacggcttcttcggtagcagtgtcattttgttcatcttcaatttcagcttcactgtcggcggtttcctcctgcttggctatttcttcaaaagcctttaccgcatcctcgacaggctcgcttacggcttcttcggtggcaatatcattttgttcgctttcaatttcagcttcactgtcggcggtttcttcctgctcggcaatttcttcaaaagcctttaccgcatcctcgacaggctcgcttacggcttcttcggtagcagtgtcattttgttcatcgtcaatttcagttttgctgtctgcggtttcttcctgctctgctatttcttcaaaagcctttactgcgtcctcgacaggctcgcttacgggttcttcggtggcaatatcattttgttcatcgtcaattccagttttgctgtcggcggtttcttcctgctcggcgatttcctcaaaagcctttaccgcatcctcaacaggctcgcttgcataaagatcgaaaatgctctcatcaacaggcatatttacatcttcaatttcttcattatcctgtataacagacggcatttctgcaagctcctgaaccgcatttgctatcggagcggatgtcattatccccttttcaagcatcatctgcttcggcattccggcttgctcgtcaaaattctcctcaactgccgttactattgccgttactgcgggtaaggcttcttcggctgtatcctcagcttttttgccgctttcgcctgcgtcctcgccttcattaccgacggacgattcaagcctgttgaaatggtcgaatacacgctcaaagctgaccccgggatcgccgtcatcttcactctgagtaaatgtaaaattgacaggcgctatctcaggctcggtttcggtttcgccgttatccctttcggacataggcttataccggcgtacagcctcatcaatgcggctgtttatcgcatcggtctgttcttcctcgcttataggctttctgattatctccttatgagttaccccgccgtttttccatacggtcaggcttttctttctgagcggagtctgcgtttcctccagctttttcttggcgtatacagccgcacctacggcagccgccgcacctacagcggcaacaatcgccttacttatcttcatatattatcaacctcccggctaatgccgaaatattattcaacactcttgagtgcctcgaccatattgaccttcataagccgtctgtgcataaacagcattactatcacggcaaagcatatcgttataagacccgaaaatacaaagctcatcggatgcaccgttctgccgaacataaccatatcaatttcagccgtctttacaacaaagtcaacaaggaatcttccgaataccatgccagtcactgttcctataagggtaagtatcaccgtttccctgaacacatacattgatacttccttatcatagaagccaagcaccttgagcgatgcgatctcccttatacgctcgtttatattgatgttcgtaagattataaagcacaatgaacgcaagcgcacctgcactcactataagaaccactattacaaaaagcagtgatttgagcatagaactgaatgtgcccgcaacgcttgtcttgaagctcactcccataactccgtctatcttcataagctcctgtgcaagctcgtccctgtcactttcggtcatatcgtcgccgtcctcagagttgaagaagaagcagttatacggcagtccttcctcgccgctaagctccttgtacagcttttccgtgatatacacatagtgatgggcgtagttttcgcatatctcggttactgtagcagtaactcgcttcgtttccgacaaagctatcgttaccgtatcgcccttctttataccgccgagcaaagatgccagcttctcgtttattataacgccgtcgtcggttaccgtgtactgttcgcctgtccgtctgtcctttaccgtcacaaactgtgcgatggtttcgttgtctgctccgccgaatatatacgcttctgtgcttttcttaccgttatataccgttatctgcttttgatatatcctgttgccctcgcagtcataacgctcaagcatcttttctatcttagctgtctgttcatcggtcactgtattgtcataagcggtaataccggtataattgcttatctcgccgaactgcttttgcagaatatcgtttacgctgtcatacacgccgaatcccgtcagcacaagcgccgtacagcctgcaatgcccactatcgtcataagcattcttctcttgtaacggaatatattacgcatcgttaccttatagctgaacgaaagcctgttccatataaagcctatgcgttcaagcagtatcttcttaccgctctttggcgttttcggccgcataagcgccgcaggacagtcgtgaagtatgccgccgcacgagaaataaactgtaacagcagtaagcagtacagatacccctgcggtacatatcataagtatataatcatacggcaaaagaatatcggggataacgtacatcattccgtatgcggtaataatgattgccgggaatatcttcattcccacaagcatacccgataaagcgcccgccgttgccgctgtcagtgcataaagcagatatttgaatataatagcgccgtttttatagccaagcgccttgagcgttcctatctgggtacgctgttcctctaccattcgtgtcatcgtggtaagacatacaagcgccgccaccattacaaagaacagggggaacaccatagctatattgcctattctttcggcattctgaccatattcactgtatcccggattatcatcacgggtaaacagataccactcaggtctgctcgtcttttcgagcttttccctgccgtcgtctatcttcttctgagcatcggcaaactgcttgtccgcatcggtttttgccgtttcaagtgctgtcttgccctcgttatactccttcaggcccttttcataatcggcataattcttgtcatactccgctttaccgctgtcatactttgccttgcctgaagcgtactgagcataacctgcgtcatactgtgcctttcctgcgtcatactgtgcctttgcgctttcgtactgtgcaagtccgcttgtgtactgagaatatccgtcctcgtactgcttttttccgtcctcatatttggcataaccgatttcgtactgcagctttccgtcattatattgcttaagcccgtcattatactgctcaagtccgctttcatactgtttcttctgcttgtcaagttccgcctgcgagctgtcgagcagctttatgccggcattatacgcctctttggtgatattacccttcttgtatgaatcctccagcgtttcacggctcgtatttataatcgcctgctgacttgttatctttgtgtttgcatcgtcaagctgagccttgctcgacttcaactgtgagtctgcgttttcaagctgtattttagctgtaacaagctgtatatagctttcgtcaagcgttttctttccggcttcaagctgcagcttcgtttcgtccagcttcttctttgtgctgtcaagcacatcttttgtcgccgtcagagtagccccgttagtgtcaagctccttttttgcctcatcaagctgttttttcgattcatcaagcgttttcttgccgctttcaagctgaggctttgcttcgtcaagctgtttttttgcatcgttcagcttggtttcgtttttctctatttctgcgtatgcttcgctcttctttttatcaagctccttctgcccgtcgtcaagttccttctttgcatcgcctgctatttcgtcaaaacgctcttcttctcttacatccgctattttctgtatcttcttttcaagagcgtcacgggcatcctcatattcatcgctgtaacagctgtactgctttagctcgtccgagtttatcataacctgagtatatacctctgtcttgaaacagctttccggtatgtaacagatcatatagacagaaccgcttcctatggtcgtgtttccacgctccgcatcagatatatacataggtgatgcgaattttccgactatagtaaattccttgaccgacaaagttccgtctatatccgtgtcttcatcgccacacagcgtcagcttgtccccgactttataatgagcaagcagtttaccgctgtcgataacgcactcgttttctttttcgggaagtctgccgtcaactatctgcaaagagctgtacggattgttttcgcccgttttgtcaagagaatatacccttgcgaccttcttttcgcccgaatccgtgttgacgtatgcgtccgtgaaatatccgggataaacatcaacatccggaagcccttttttcaaagcgtctatatcgttatcgtcaaatccgtatgtagataccagcctgatatcagacagggaagtcctgtcgtaataatgatccgacgataccttcatcgcaggagcgctctgcagaagtcccgcaaaaaatcctgtgccgatagcgattataccgaatatcgaaagaaaacggctttttgttttcttcatctcggcaaacgcatttttcagcattgcatttttcatatccgttccctttccccgcttaccactctatttcttcaacgggtgtcggatgctcgtttactactatttcgctcaccttactgcttttcatgtgtataaccctgtcagccatagggcatatcgccgtattatgcgttacgagtattacagtcatattttcactgcggcaggtgtcctgaagtaatttcagtatcatcttgccggtgttgtaatcgagcgcacccgtaggttcgtcgcacagcaacagcttgggctttttcgcaagcgctctggctatagccactctctgctgttcaccgcccgaaagctgagccgggaagttgtttattctgtcggtaagtccgaccttttccagtatctctacagcagggatatagtcctccaccgtctgagtagacagctcaatattctcctttgccgtaaggttcgggatgagattatagaactggaatataaaacctatatcgtatcttctgtagtcgataagctcttttctgctgtaaccgcttatcttacttccgtctacataaaagcttcccgatgtagcggtatccataccgcccagtatattaagcaccgtagtcttgcccgaaccgctcggtcctacgattattgcaaattcgcccttttcaatgtcaaagctgaccttatcgtttgcgttgattattatatcgcccatacggtactgctttgtaatatcgctcagcgtaacaaaactcattgtaattccttgcaccctttcgtccgttgtttcctgaaatcgttactctattaaattataccatttttcacggtacaattcaacagccgttctatatttattttatatttatttatagtgtatcccgacatttttaactccctttaaatttcaatgccgttaaaataaaaattattctcattttacttgacaaacgcatttgcttatgctacaatatcaatcggaaaaatcccttatcaagagcggtttacattttctgcattaaaatgcagattgggagtcaggctccgtaaacccagcaaccgtttcgcttgagctttctttgcgaaaaatggtgctaattcctacggcacggcaagggctgtgaccgaaagatgaggagcaggcagtcagcaagctccgaatggggctttttttaatgcagttttacgcaggtatatgcgtatgggatacggtttaaaaccgctatatgaaaggaaaaatcaatggcaaaatacttattcacttccgaaagcgtaacagagggtcaccccgacaagatctgcgacaggatctcagacggtgtgcttgatgcgatattagcacaggacaagaacgcccgtgtagcctgcgaaacctgcgccacaacaggtatggttctgataatgggcgagatcacgacaacggcaaacgttgacattcctgcaatagcaagagatgtcataaaggaaacaggctacgataacagcgactacggctttgactacaagacctgcgctatcctcacgacccttgacaagcagagccccgatatagctatgggcgttgacaacgctcttgagggcagagataacaatgaatttgacacaggcgcaggcgatcagggtatgatgttcggctatgcgtgtgatgaaaccaaggagcttatgccccttacgatttcccttgctcacgcactttcaaagaagctcacagcggtaagaaagtcgggcgagataccctatcttctccccgatggaaagacgcaggtaacagtagaatataacgaggacggcactccctcaagaattgacactgtcgttgtttcctcacagcacaaggctgatgttacgcaggaacagctcagagccgatattatcgaaaaggttataaagactaccgttcccgcttcactgcttgacgagaacacaaagatgctgataaatcccacaggacgctttgtagtaggcggtcctcagggcgacagcggtcttacgggcagaaagataatagtagatacatacggcggtgtcggcagacacggcggcggcgcattctcaggaaaagatcccacaaaggttgaccgttcagccgcttacgccgcaagacacgttgcaaagaacattgtagccgcaggcatagcaaagcgttgcgaggttgagcttgcgtatgctatcggcgttgcacagcccgtatctgtctttgttgatacattcggcacaggcgtaaaacccgacagcgaaatttcagccgctgtaagcaaggtgttcgaccttcgccccagtgcgataatcagctcactgaatttaagaaatacaaagtacagacctcttgccgcttacggtcacatgggacgtacagaccttgacgttgcttgggaaaagacaaacaaggttgacgagcttaaatcagcacttgatataaagtaatcagcatatagcactaaagccgttacggaacaccgcaacggctttattttttgcaaaattccaacatattttaccgccgtcatcggaggttacgcaattctccgccattcagataagcaaatttgaagcgcaacattgccgcccgccgttttgctatcctgcggatagctcagacaattccaaaggcggagtttgaggcggcacattgccgcaggcggaatttgaggcggcacattgccgccacgctattcgctgaaatccgtaactatgtacttcggcgcaccgggagttgaatacacccaccggtcaatatgcccctctgtaatgaaatacggcgcttcaagcggaacacagccgtcatcacagcagtttactattatcagcttgattttcattttttcgggtataatcgccttgatatacacgcaggcgcaatctcccacctttattccgcttttaagctccgccagccctgcgagattcggtgcaagctctataaaaattccgtagtcctctatagaccttacaatgccgggaacggtttcacctaccgcaaaacgttctgcgttctgttgccacgttccgagcagttccttgtgtgtaaggcagatatgtccctgatcccgacctttcaccaccgcaaaaatatcgtcgcctaccgaaaatctgtttgcaggatgaactattcttgataccgagatagcgtcaatcggtatcattgacgcaatgccgcagcctatgtccacaaaacagccgaactgttcaagatgcgttaccctcgcccctataatatcaccgggagtcagctttgatacatattccttgtctgcctcctcctgtgccgccttccttgacaggattgccaacggttcgcttccggtttcgtctatcttcgttatcttgaagcagacaggctttcccactcttgatataagcgctatatcccgtgtcgcaccgctttctatgcctattgcgccctcactgcgaggtattatccccttcatacagccaagatcgacgtgcatattatgctccgcatcgcacaccgtacacgaagcctcaagtattgcccccgacaccgccgcctgcataagcgttttggatgattgcaatgccgccgtgttctctttgtatgcaagtcttcttccctccggtaaaaattccgtcatttgaaataccgttccttcctcgttgtgttttcttttttacaagtgtatgtcagattttccttgaatatgttaccatatctttacatttgatttttcacggaatatttagcggaattcttgtaattatcgttgattttgacaacgttttctgttacaatagaatctatacaggcttagcgccattaacccttggattctaaacggaggaatcatgtttattcacagcggaacattaaaacgtgcaggcattcttgccgcagtggttgctgtaggtacagccgccgcaataacctataacgcttttttatcgtcggatgacggacttcccgaagtattaagcccgcttcagccgataataaaggacgaggacggcggggtaaagcagaaaacagatattgccttctcccccgacggcagcttttttgataaagacatatcggttgagcttaaagcaaaagacaaaacggcaacaatctactataccacaaacggcgagacccccacgaaaaaatcaaacagatatacaaatcccataaaggtgcacagctcgggagaggtcactgcaaagacgataaaagccattgcggtaagcgagaacggcacttccgaagtattcacaaaaagctatgtcacaggtgagggcgtgtcggatcgttttgaaaaaggcacttatatattcgtgctttcgaccgacagtgaaaacctttacgattatgaaaaaggcatcgccgtagcaggaaagatccgtgacgagtggatagcaaacgagtatgacggaaaaagcgaaatcacgcccaacgaacctgcaaactggaatcaggaaggtatggcaggcgaaaggcctatgtatgtcgaggctttttcaagcagcggagagcttcttgtttcacagcaggcaggcgcaagagttgcaggtgcatattctgccgcagttgaccagaaatcgtggaagctaatcgcaagaacgatgtacaccggcgataaaggaaaattcagctacccgttcttcagtgacgctacagatgaaaacggtgcgattctcacaaagattgaccgcatagttttgcgtaacggtgcaaacgaccgtgaatttgcaggtgtgcgtgacgagctttcaatgtcgcttgcgaagcagtcgggctaccttgatgcacaatcgaccgcccctgcggcagtattccttaacggaaagtattacggctttgcgtggctccatcagaatttcagccgtgcatatctcgaagaacgctacggcggcacgaaggacaactatcaggtggtcggaaaagccgagggcgagatagtcgatgaaaacgcagaaggtgcggcagacgattataacaaggttcttgagcttgctgagagcggacttaccgacgacaagaaattcgagcagttctgctctatggttgacatagacaactatatgcactacctcgcaatgcagttatttatcgacaaccgtgactggcccggaaacaactataaagtgtggcggtatgttgcgtcagacggcgaagaggtcacaagcaagtaccaggacggcaagtggagatatttcttctacgatgcagaatttgcctggggactttattcggacggatacgcaaacaagacgttgaccaagattttaaacggcacacaccccgcaggcggctcagtgcttatttctgcacttatggaacgtgcggatatgcgtgaaaagctggcgaacaacctctgcgaccttataggcggcgcattcagctctgaaaatattctggcaacgcttgagcagaagctcgcagacagcgataaggaacagctttatgctctgaacaagggtatcacgtcaacgtgggcaaacgagggtacgtttgaaaacagcagaaacgagataagagaattcgccgacaagcgtgcaaatatcattctcagcgacatctgcaagaatttcggaattgacaaggacgatacatacaaggtaaagctgaacggtgcaaagggtcttaagctcactatgaacattcagaccgtcaaggactcaaatacggtaacatccgaatatttcacgccctacaaggtaaagctgacagccgaggatatgtcgggctacaccttcacaagctgggagataaacggcaagacctataccgaccgtgagataacgatagacagctcaatggctaaaaagggaaagataacaataaacgcacgcagtgaaaaaacatcgtctacaggcgaactgctgtatataagcgaagtgtacacgggcggagacgccgactggatagagctttacaaccccaatgacaacgacgtatcaacaaaaggtctttatcttacagataaggatgatatgcttaaccgctacaagatacccactgtcaacataaagcctcattcaacgcttacgatagtttgcaagaacaacaagtctgaaaatacgctgatgaaaatgcagacgaatttcagcctaaaaacaggcgaaacgctgatactcagcaacgaaagcggagaaattctcggcaaggtcgcaataatcgactgcagtaaggatgaatcgcttgtaagacagcgtgacggaagctacgcaaagggtacgccgacctttgaaaagaacagccaataacataaaagccgtgcatcaaggcgatgcacggctgtttttctttccctttcgcaacagccttactaaatactcccttcgcctttgaaagaatcaaatgcaggcatagcaaaaaacaagcacggctgtacaccgtgcttaaaacaaaaaggaccgtgaaaaccacgatcctcttttttcattacttgtcaagattgtacttcttcttgaacttgtcaacacgtccgcctgtgtcaaccaacttctgctttcctgtaaagaaagggtggcacttcgagcagatttcaacctttatatcctgcttggttgatcttgtttcgataacctcgccgcaagcacacttgatagtggtgggctggtagttagggtggataccttctttcatgctgtcacctcctgacctttagaattaatctaaattacagctttcgctatgatttcagaatactgcgctttcacgcttaggttactattatagcatatacaaaactgttttgcaatagttttttcaaatttcccgaaaaatttatatcacagacagtttcagcctacaatctttgtgaaatctgccgagagtttaacctgcttttcagccgcatcttcaacgcttgtgcctactgttgtgtagtagagcttgattttaggctcagtaccggagggtcttattactacgcttgcgttatcctcaaggtagaatgtgataacgtttgacttaggaagtgtgagttcttctgtcttgccgctttcgtagtctgtctttacgctgagcttgtagtcagccttgccgataaccttaagacctgcaacagcgtcaagcttttcgtttctgagagtatccatgatagcgttcatcttcttcatacctgtttcgccctcgaaagtgaatgtatcaagcttgttgcagtagaagccgtagtcgctgtacatctttgctcttgcctgtacaagagaaataccctgtgaacgatagaatgccgccatctcgcagataagcatagatgctacaacagcgtccttatctcttacataagagcctgcaaggtagccgtagctttcctcaaagccgaagatatatctgctttcctcgccctttgcctctaagaagccgatctgctcaccgatgaacttgaagcctgtgagaacttctctgagctctacgccgtacttagcggcgatagcctttacaagatcggtagtaactattgtctttactgcaacggggtttgcgggcattgtacctgcggcgatacgctccttgcagatatattcgagcagcattgcgcctacctcgttacctgtgaacagaacgtagttgtcaccgtcgggaactgcgatacctacacggtcgctgtcggggtcggtagcaagcagtaagtcgggcttttctgtcttgcaaagctcaaggcctaagtgcagagcttcctttatctcggggttgggatatgggcaggtagtgaagttgccgtcgggcatttcctgttcctttacaactacaacgttgtttataccgatttcctttaagatacggcggacgggcttgttgcctgcaccgttaagaggagtataaacaaccttcagtccgctctttgcacaaagctcggggtggatggactgctttttaacgtttgcgatatattcgtcaataacatcctgaccgatgtactttatttttccttcgtttacaaactgctcaaagtcgccgctctttacgtctgcgaagatattgagcttctcaatctcaccgagaatcttttcagcggcttcaagagtaacctgacagccgtcgcttccgtaaaccttataaccgttatactttgcagggttgtggcttgcggtaacaatgatacctgcgtcacagccgagcgctcttacagcccaagaaagcataggtgtgggcataagctctgtgtagatgtttgctgtaatgccgtttgcggcaaatatcgaagcggcgtgctttgcaaatacgtcagactttattctgctgtcgtatgcaacagcaaccttaagatcgctcttgcctgtgttcttgaggtagtttgcaagaccctgagtagccttgcctacggtataaacgttcattctgtttgtacctgcgccgataacgcctctcagaccgcctgtgccgaattcaagatcacggtagaaacgatcatttatttcttcgtccttgccctttacattctcaagctctgtctttaaatcgggatccttgaccgctttttcaagccattcgttataaagctctgtagtgtttgccataatagtctgtcctttctgtataaaacggtagcacagtttgctgtatttaaaaattaggtaaatatagctgtggctaacctaaaattccattcaacaaacagtataacatttttccgccgtaaatgcaaataaaatcgtaaaaatattattaaattttttgaaatcaaaaattcccgtttttgttgaaaatatacctaaaacgttgtataatcattacatagcaatcacttaaaatgatatgaaacgggtgtaaatatgtattctcaggtaaacggtatggggcttttcggtatgaatgcctttaaagtcaccgcggaaataatgtcctcaagaggtcagccgtccttcgatatagtaggactgggcgaccttgcggtgcaggaaagcaaaatgcgtatcaagggtgcgttatcgggtatcggaatctccgtcagcggtcagcgcctcacggtaaatcttgctcctgcggatgtacgcaaatgcggctcgctgtacgacttcacgataatcgccgccattcttgcggtaaacaatataataaccgatgatttgtcgggctgtgcctttatcggagaggtttcgctcggaggctcgcttgttttcacgggcggaattatcagcatggcgatagaggccaagaaatgcggtataaaacggctgttcctccctgccgaaaacgccaaggaagcgtccgttgttgagggtctgtccgtatacggcataagccatatttccgaccttataaaccatttcgctggaaagaagcgtatatcgcccgagcctccctacgttccgtccgcagagatgtttgaaacggaggacttatccgatgtaaagggtcaggcacttgcccgtcacgctctggaggtagccgccgcaggcttccacaacgtacttctcataggccctcccggcacaggaaaaagcatgatagcaaagcgtataccgtctatccttcctccgatgacctttgacgaaagcattgaaacaacaggaatacattcaatagcaggtatgctcgaccgtgaaaagccgatagtcacggttcgcccgttcagaagcgtatcacataccgcctcggcagtaggtcttatcggcggcggaagtataccacgcccgggagaaatatcccttgcacataacggagtattatttcttgacgaactgccggaatttgaccgcaggacgcttgaaacactcaggcaaccgcttgaggacggagttataaccatatcaagagcgcaagggtcggtgtcctacccgtgcgatattatgcttgttgccgcaatgaacccctgcccttgcggaaacttcggcaacccgaagggaaaatgcacctgctctcagaatatgatacagaactatctcggtaagataagccgccctgttcttgacaggatagatatacaggttgaaatgccacagttatcttatgaggaaataagcagtgcgaaaaagggcgagccgagcagtgccgtgcttgaacgtataatgaaagcaagagaaatacagcaaaagcgttttgctggtacggaaatacgctcaaactccaaaattccgccctcatatcttcacgaaatgtgtcctatggacgaaaacgcaaagcagatgctctccgactgctttgataaaatggggttgtcggcaagggcatacgacaggatacttaaggtcgcacgcacctgtgctgacctttcaggaagcgaggtaataaggcggcaggatatatcctcggcggtaaatttcagaagccttgacaggaaatactggggtgcggggaaataaccgtcattttaccgcttatcatatttattatttatagtgcggtaaaatatctgacaaatcggccttgtttttaccgccgcagagttataaaaacgccgaaatttttctgtcggcttgacaaaaacgaaatcaaaatgctaaaataaatacagtcgagtagcgaaagcgtaaatccggacacggatttacgctttatttttttgccaaaagaaaggaatataaatatggaacaggaaaaagtaaacaggctcgggacagagcctgtaaaaaatctgttgctcaaaacgggacttcccgtgatactctcaatggtattgcaggcggtctacaacatagttgacagcgcatttgtaacgaatatgcagacaggcggcgaggcggcgttcaacgcactgacgcttgcctttcctatgcagatgcttatggtggcggtaggtataggaacaggtgttggtgcaaacgctctgctttcaaaatctctcggacaaagcgataaggaaaaagcgagcctaacctccggcaatgcggaatttcttgcgcttataatatatgttgtttttctgcttgtcggactgttcggtgtagagccttatatccgcacgcagacgcaggacggggagatagcgggaatggcggtcgattaccttacgatatgctgtacaatgtcattcggcatcacattcttttcgatatatgaaaagctgctgcaggcaacgggcaggtcgcttttttcgacgatagcccagatagcaggcgctgtcaccaacataatcctcgacccgataatgatatacggacttctcggttttcccgaaatgaaagtaaaaggtgcggctctcgcaacggttataggtcagatagtttctcttgtcaccgctcttatctttcatatcaaattcaacacggaaatagtaaaaaaactgcgttacaaaaagcccgatatgaaaattatcaagggcatatactctataggacttccggctataatcgcacaggcgcttatgtctataatgacctacggtatgaacgtaatcttaggctcggtaagcgtggacgctgtcaccgcctacggactttactacaaggtacagcagttcttcctgtttgccgctttcggtatgcgtgacgcaataactcccgtcatatcctacgctcacggaatggcagacaaagcccgtatcaaaaacggcataaagtacggaatgctctatacgcttataataatggcgctcggcacaattcttatcgaaattttcgccgtgcctctcggcgagatgttctcgctttcgggcaactcactcaggctatgcacagacgcaatgcgcattatcacaataagctttgtatttgcaggaatgaatatcgcatttcagggcatatttcaagcgatcgacggcggtttgcaatcgctcatagtatcgctcttaagacagcttgtgcttgtactgccggtagcgtggggattttcgctccttgtcctcggcggtgcgcccgatatgcttatgtggtgggtgttcccgatagcagaagctatctctgctcttgtttccgttatctttatgatcagacttaacaaaacaaaaatcgccgtattatagcgattcaaacaatttaatatttctccgacagaaaattcacttttgatattgaaattttacctgcaaaagtgtaaaatatcattcggagaataaaaaacagcctccgcaaaagcgaaggctgtttaagcatatgtttacttttcaaatatcatcttgattctgccgataaggggaagatccttggccttgccgccgatagcgttgataaggccggttaccagtatgattatcggtacagccatgaatattatgtgtatcagccaagctaaaagaacacctacaaagcctgcggcaaattcgttgaatgtagcgtagaaaataccgtagtaaacagcgttgtacagaattcttgcaaagaagtattcaatagctcccactgccattacaccgagaataacaggaaatatcattgaaagatgatactgtaagaattttgacttgcccgctgtgatacagggagctacaagcatacctgcaagcacgatgattgcaataaagccgccgaatatccatcctgtaagtatgtatgcgagtaccgcacaataagcgagtattgacattgccttacctgtgtttatatcgttggcgtccattgtagaagttacattctttgtgtcaaatattttctgaaagaagcccggattttgatttatcggaacaggtgcaacagaaccgtcaaggtttgcaccgcactttgcgcagaactttgagccgtcctgatactctgttccgcatttaggacaaaatggcataattatttcctcctgtttgttatgtctatacctctgtattatatccgctgtatgcagataccagttaattatacacccctacggcatcaaagtcaataccgcaattgtaaagtttaattaagaaatatgaaagcattgattaattttgctattgcatttacactggtatatttatttttcgtgtattattaaattttcaaacaacataaggagaactatgaacaatacaaacccttttatatattccgatgacaacaagcgttatcacacgttgaattactataataaatcatcgttcaacagcaaagtgttcaaggcggtcattgacgcaggcttcacctgcccgaataaagacggcacaaaaggcacgggcggatgtatctactgtatgggcggaagcggctacttcaccgaaaaatcggacggtgaaatctacgacagcgtaaagcgtcagcttgccgctgaaaaggaacgtatatacaagaaacacccggacagcctcattacagcctactttcaggcaaataccaacacatacgcacctgtcgcaacgcttaaagaggcatacactgcggcgcttgattttggagtacacggaatttcaatcggcacaagggccgactgccttcccgatgatgttatcgccctgctctgtgacattaacagcaagacccaccttaccgttgagcttggcttgcagacaatacacgataaatcagcacaaatcatcaacagatgctacacctatgacgagtttctggagggctaccgtaaactgcaagaatccggcatacgcacctgccttcatctgattgacggcttgccggaagaaagcctatccgatatgctcgaaaccgcaaaggaggtcgcccgtctgcaccctgacgccgtgaagatacaccttcttcatataaatcacggcaccgctcttgaacggctcttcctgtcgggcggttacgttccgctcacccgtgacgagtacatagatatagtaatatcacagcttgaatatctccccgccgacattgtcatagagcggattaccggcgatgcggacaagcgttgtctggtagctcccctgtggagtgccgacaaaattgcggtacttggcggcatagaccgtcagatgaagctgagggatacttatcaggggataaaagctgatgttatgtgatttcatatctgaatgtaagtgaaaccgcagtatcgggtcagtttcgatactgcggtttgctgttgcctatccttaagctatatgctgaaacatttgctgaggaaaaccctgcttgttcggatctgtaatcttgatttttctgcacttatatattagatttaggagcaaaatggacggatattaacgctcgtgtgcatattgtcttaattcttctgcgatttttttaaattcaacatcatctctgataaagtcatatattttatcgtccatttcgtttatctggtgcattgaatcattcgcattaatattatgccaaacttcgccgtactcttttccgcgcgcaatcaggcaggtatatgtttctgtcggcttgtatactgctttatcattatcgatagattgatttttggcaagggtcagatattttatggtttcattgcgattgttgattttggcatagaaccaagcaatatcgagatatgtccatgcgattttttgcttaaaaaagccataattcttatcttcaaagattatgttcaatatgtcgatgacttttttattcaataaaatcagttcctcaggtgtatagggctttgtgttatcatccaaaggagcacagttgaaggttataccggaaagcattaactgcaagtgggttaaaattgcgtcctgctgatatctgtatcgtttggttttgtcggatacagatacaagcagatcttctctgcactgatgagcataaggcattgtatttgcaagactttccgctttttcgggcatatttaatttgggataagcataacaaagcaactgaatcgcactgtgccttaattctgtgtccttagagttttcaagcacattttcttcgagtgaaacaacttcctgtaacaatttttcgtaatgctcatcagatattgtatctgtttcttgcggtgaacaatacaaagcacttgcgagctcgtgcgacaacttatatgccgacggatattttctgatagcttttcgcaaaatttcaacacctttcgaccactgaccattggttgtatactctcttgcggcttctgacagtgactcaatttctttttctcttgacgaagcatcgacttccagcaagaagtcggtcgttacatcgaaaaagtttgccagtataggcagcagtgaaatatcaggtaaagcaatatttgtttcccaacgacttaccgcctgcgcagagatcgaaagcacttcggcaagttgttcttgcgtcatattcctatctgagcgcagttttttaataatatttccgaaactcatatttacaactccaattcaagtattcagccgatcgaactgtaattatattataatctatagatagtcagcagtccaccgcttaataattgagaaaaaatcaatttcaaattggattatcgataaagactttagcgcattgtcaagttcagacaagttgcattttccactatgatatgctaaaatattcacgaggggaaaccttggacgtcaggcggtcaattcatctcccgaaagtgcgaaagcactttgaaaggaggtggagctgtgtacataacactaagcgatttaacacagataggaatatttcttactgctttcacagttatgatattcacaatcatttctttttataaaaagaaataaccgccccagtcgcaaacggaaggcggttatttcttaactgatttaaacgggagcgaccgtctgtcgtttccctctttatttatattataacatattttcagctgttgtcaagttcgatccggttgcattgctgtcgcttttgtgctaaaatacgcttgtggaccttaaatccggattatcataaaggagaaacaatatggatatgaaacagcgtatgcacgcaaatcttccctataaagcctggcttgacgggctgagcgaagaacgtgcggaatgcaagcgtaagatatacgaattcaacaactgccacccggatgaccgagataaaatggacaaaatcctccgctcgcttctcggtaagacaggtgacactattcatatagaacagccgttccactgcgattacggcagtaatatcgaggtcggcaacaacttctttgcaaactataatctggtaatacttgatgtcggcaaggttaaaatcggcaataatgttatgcttgctccaaatgtagccatctacacagcaggtcatcccgtacattatattccccgtaacacaggctatgaatacggcatagatataacgataggcgataacgtatggataggcggaaacgttgtaatcacaccgggagtaaaggtcggaaacggcgttgttatcggtgccgggagcgttgtgacaaaggatattcccgacaactgcatagccgcaggaaatcctgcaagggttatccgtgaaataacggacgaggacaagcattattacttcaaaaaacgtcgctttgacgttgacgattacctgatacccgacacaatagactggagcaaaatatgaacacaccgacttttgatataaacaaggtagataccccgtgctatgtcacagaagaatgctatctcagacgcaactgtgagatactgaaaagcgtacaggatatgacaggctgtaagatacttcttgcacagaaagcgttttcgatgtacagcacctaccctctgataagcggctatctcagcggtactaccgcaagcggactttacgaggcacggctcggatatgaatatttcggcaatgaaacgcacgttttctctcctgcctatacagataaggaaataaacgagcttgcaaagtacgcaggacattttgtgttcaattcaataaggcagtttgccctgcaccgtgacgcagtaaaggacaagcactgccttatccgtgtaaatccgagattttccacacaggagggacacgagatatacgacccgtgcgctcccggctcaaggctcggacagacgcttgcttcatttgaggaggatataaagcgttacggcgaggaaatccttgacgaaatagacggacttcattttcacaccctctgcgagcagaacagcgacgacttaatgcgtaccgcaaaggaggtcgaggtgcagttcggcaagtatcttgataagatgagcgttataaatttcggcggcggacaccatataacaagggatgactacgatattgacacacttgttgaggtgataaaccatttcaagaatgaatacgggcttgaggtgtatcttgagccgggcgaggctgtcgctctgaatgcaggatttcttgtaacaactgtgcttgacgtgatagacggaaaaataaacggcgaggacgatatagcgatacttgacgcttcagccgcctgccatatgcctgatgtgcttgaaatgccgtaccgcccagttatcattcagccaaacggcaatattgccggagaaaagggcgaaagggctgtcactgtgcggcttggcggcaacacctgccttgcaggcgatgtgataggagattattcattcgacgagccgcttaaaccgggcgaccgccttgtgctgtgcgatatgtcgatatactcaatggtaaagaacaacacgttcaacggtatggctctgccgtcaatatactataatacctcgctcggtatgcggaaaataagagagttctcttatgatgatttcaggtgcaggctgtgatttcggctttaagcagaactatcagagaagccttgttttcagcgacagccatttccatatggacaaagcatttcaaagggtaaaacagccaaaataagcaaaacggttgaaaactaatgtatatgttgaatactttgttgaaagttttttgtgcatatcacacaaactatcgtgaaatgtttaaggactattgaacaaaagtgaaaaataatcgcagaaaaattgacaaattgaaaaatctttgttgacgaacaaagaacatttggatatactataggtacagagcggagataccgcataacatctcaatgcggacagctcgacggaaagataatacgattttacggaggtaaccaatcatgtttgttaaagaagtaagcgttaagaatcaggtaggtttacacgcaagacccgcaacattcttcatccagaaggctaacgagtacaagtcatcaatctgggttgagaaggaagaaagaagagtaaacgcaaagagccttctcggtatcctttcactcggcattgtaggcggtacaactatcagaatcattgctgacggctctgatgagcagcttgctgttgacggccttgtaaagctcgttgaaagcggttttgcagaataattcacactcccgaccaagtagtgtatatcgggtaataacccgatgtgtagacgtgtagaaaagtgtagacggacagaattacatttataaagaaacagcggggattttgcgtaaagcaggtcacccgctgtatttttatttaacagtctttaccgtttagatttcaaaggagcattatattgaaaagaacaggaaaaatcgcagccgcatttatcacggctttaacggctgtggcgtcaataacggcgtgcagtgccgattattcgcatattgacggctacagcgacatagaaaacgcacgaaagctgtattcctcgctgtattcagccgagatcacggttacggataagcaaaccggtacggttacgcaggaactgacattctgctacgataagagcgataccctatcgtacagctatttcggcacagacggcaaaacaaaatattatgaatatcacaacggctcggagtacaactattattccgacggcgaatggcatactcttgtgagcggcgataaggattatgtatgctacacacgcactaacaagatgtctatgaccgcagagggcatgatattcataaagcccgaaagcgtgacaagctcggaagtaaagaatacggcagacacaaaggtaatcactatgcagtacgatgtttcaaagctcaacagctcaatggcttctcagctcggtcttgtcggtgaccttgacagcttcagcgttgtgtatacaattgataaagacggatactgcacctcaatggagcagaccggcacagccacaaaggacggcgtacaaagcaaggtggattatcttatgaccgtcagccatatgaatgatattgcctcggtaagcaagccgcaggtacaggaaagtgcggataagtcagacgcagagtaaattataagcatcgcccgtaggcttaggctatgggctttgtttttagataaactgattattgataaaacctcattgtgaaatatatcgccaacaccgctgaaagaattttccgtactgacaagccatcaatattttcgtgagtgtatcagtgcaactgcactaacattgacctttcaaaaaaacgccgctaacctaagatatatgtactaatatgcggacgtgtagcgttaagcgtccctgcattaacaggtcatacaatgttcaggtggttattcgagttcagccaacaccccgacggggtgggggtgtgagtaaggaaagagggagccacgagggagagaacctaagagatagggagaggggctgtcaagtcccttgccctagtctctttggttctttccctcgttaatattgacaggtgtacccactcgaatagcgaacccgagaagtgctgtccgacaaaaagaactatcggtagcttgctatcgtaggcaaagctgaataatataacagaagcacatctaatacaagactttttcaacaatctgcgcccgtaggcttagcctacgggcttttttgacgttttttcccgaatataatcaaaaaataaaacgaaaatgttgtgaaaatttacaaaatagcttgatttgtgttcttttttatggtaaaattaaataaaatcataatggcggtattgcgtatatctgtaatgcaatcatatttcactgcctttgatttcagctatttaattgcgttgccccactttaacagtttatcacattgaactattacatacatattagcccaaggaggcgaataaggtgcagttaaacaccaacggtcagaagtttataaatataataatcggcttttcacgggattttccctttaccgtaaacccgggcgaacattccgagaaaacctacccttctcttttagagctgataaatcccgatgatattcctccgataaccgaaatgttcaccgatgtatcacaggacgaggaaaagcgttttgaagcgcattgtcgttttatggtgaacgatgaatatcactggtttttcctttcgtgcaaggcggtatatgcagagtacggcaggcctgtgcgtttcgagggaacgatgtgcgatgtatcgacctaccttgaaacagcgggcgatgaccttgtatataacgaattccgcaaaaagcacaacataaagctgtccgaacttaaaaaaggcgctccgcgtcttgccgatgtgcttgatgtcgactaccttacaagcatacagcgtccttttgccgtgccacagctttattccgccatatttgacgaaaaaggaaagctgatatgtgcgccgaaaacacagcataaatccctttctcccaatgattttgcctatcagaagaaaaagaatatccgcataaatcaccttatcagcggaacgtggatactgggagcgaaaacgcaggaattactcgatgacaacattcagctgtgggaaacgctcgtacagaccgtttcccgtatggcaaacgcatttgttgtagttctttcggagatggacaattcgcagaacgccaacaagctgctcggtcagaatgtcgaggagcagatactgctgaataatatctacgctatcataatgcagagcaaaagcgcagatattgcgttaaactccgtcacagagcttataggcgattattttcaccttgacaggataaccataatcgaccgtgatgattttactcaggagctgtgctggtgcaaggattacaagtaccgccacctccctcttgaaatagacggcgataccgcacttgactgcgcctcgatccgtgatgatctgagccttacgtcatcggctttttcggatacggacaccaacgaccttacaaagttcggtatcaagtcgtatgctatcttcaagctgataaattcgggtacttttgacagccttataatgttccagacgattgaaaaggagcataactggacacagcgtgagcgcaaacagctccgcaacatttcacagataatctcctcacttatgatgcgtaaggaaacgcaggataagctggagcaatcgcagaagcttatgcgtcagcttgccttttatgacgctatctacaatattccgaaccgtgcaaggctgaacaaggaccttgacaagataattaagcgtaatacaaaaggctcgcttatcgctttcaaggtcaccaacacacgcactctgtccgcagtttacggtcacacctattcggatatgctgctgcgcagtatcgctcagtatcttaaggacctgcccgtaaaggacattggtgtatattatttcacaaatgcgatttttatgcttaatcttccggattgtaccgacaatgaagctaaaaatcttgtcgaaatgctgatacaccgtttttcaaagccgtggaaattcggtgaggatgagcattccatccattgcagtcttggcatagcgttctatcccgaaaacggcgaggatgccgaggagctttgcaaggcggcaagcacggcaatgtaccgtgcaagagaattcaagcagaacagctacgccttctattcaggctcgcttgagcgtacaagaatgtttgcggcaagccttgaacagcatataagagaatgtataaacgacggtatgagaggcttttcactgcgttttcagccgtccttcagtgcggttgacggcagtataatcggctgtgagagctttgtacgctggcacgacgagcagtacggcaatattcctaactcaactttgttccctatggctgaaaatctcggcttatcccacgtcatagacggctgggtaatggagcgttcgtgcgaattctgcaaggagatacaggacgcaggctttgagaattttaccgtcagcgtaaatcttaccgcaggcgaaccgcaatctgccgaaatcgtaacgcaggtacgtcacgctcttgaagaaagcgcactccctccgtcctctctgatactcgaaattcctgtaaaagccaacattttctacagcgacagcacccatatcctgcacgatctgcgtaatctcggtgtaaatattgccatagataaatacggcacggggaatatttcgttaaaggtcctcaaaaactcatacgtcaaccttgtgaatcttccggcaaagctgtttatgaatcacgaggacgaatttgacactgagcttgtaagctcggtcatccatcttgcaaaatgccgtgagcttaccgtatgcgtaaagggcattgaggacaaggaacagctcgataccgtgcagaagttcgatattgacaggatacagggctactactgttcacgtccgctgtcgctgacggaagcaaagacagtatttaccgaaagtataagaataaagggatgctgagcgtatcctcagactgtcgataaacccacgcaccgcaaaaatgcagaaaagtaaaccggcgcaaactaaaaatccgataaataaaaagaatttcgcacagccgtaaaaaaacggctgtgcgaaagcatttttgcttactgcgtcaaccgcccctcaacgtacctttgtacgcctgtcggggcggttcccttgtctgcgtgtgtttctcaacgtctgctgcgtgccgtaagaccgcaggatgtattttaatgtcacttgttgaaaaagtcgaagaattgttgataattcttcggctttttgtatttaatttgaaaaattgatgtaaaggacgcttttatttgcaattcgcttgaaaagagcgcatttttcgagtataatatacttatctgtaattgtaaaatcgactgcggctgaaaccgcatttatattaaaaggaacacagctttatgaaacttattctaagcaaaattaagacctatttcggaaaacttgataagctgctgctgttcatgtgtatgggcattgcttgctttgccgtatttatccagtataccctttatgaaaacgatataagctcggcagttaccgcaagccagtataaaacgcagattatagcctttattgcaggaattgtaatagcgatggcactggcggcaatcaactataaatatctggcaaagctctggtttatatacgttccgttggcaatggggctgacattactgctgttcacccctctcggaatacagcgtgaaggcgcagatgatataggctggctcgatctcggtataatgacgatacagccgtctgagatactgaagctcgcttttatactctcgcttgccgttcatctgtcaaaggtcgaggacagaatgaacgagccgatacactttatcctgctgtgcattcacggggcgatacctacactgcttataaggcagacgggtgacgacggctcggctttggtattcctgttcatcttcatatgcatgatgtttgcggcaggtctttcgtggaaatatcttgtaatgatagcggtggctatccctccggctgtctacgttttatggaattaccttatgcagccgcaccagcagaagcgttttcaggtgctctgggacgcacagatgcaagaggacgaggcactgggaatatatatgcagcagcgtgtgggaaaaatagccttaggctcgggcggacttacggggcttgggctttcgggaggagattatacctatgttcccgaaattcacaacgacttcattttttcatatatcggaatgactatgggactgctcggctgtcttctggtagtagggcttatagcggctctgtcgcttaagattctgtcaaatgcaagcggtgcaaaggacactctcggcagacttatctgtataggcgtatttgctcttatagtattccacacaacagtaaatatcggaatggtactcggcatcgctcccgttatcggcataccgctcccgtttttcagtgcaggcggcacatcgggaatgtgtctgtttgcggcaatagggcttgtgctgagcgtaagctatcataattcgaccaagtacagaatgttctatacggaaaaggattaaactccctacggggacagactatcgaaaagcctctattattatcaaaaaatggggttgaggggcgtagcccccaacagggtctaggggcggtagccccacattcagccccggcacggatgccgggcgtgtatgcacaagggctttgcacgatgcaaagccaaccaagcatacacagcctttcaccgtcaagcagaagacggcatacgagatttcgcggagtgactggagttcagacgtgtgctcttccgatctgagtcgctttatgcgaaaggaatatacgaaaaactcatttcggcgggctacagtgccgatatgttcgtgatacccgaaggagaaaagtcgaaaaccagagcaatgaaagagtttgtcgaggactctatgcttgaaaagggctatcgccgtgactgctgtgtaattgcggtcggaggcggtgtcgtaagcgaccttgcaggctttgttgcaggtacattcggcagaggcgtaccttttatcaattacgccactactctgcttgccgccgcagacgcatcggtcggaggaaagacagcggtcgatactcctctggctactaacctgataggtctgttcaaccagcccgaaaaggtatatcttgatattgaaacgtggaaaacactccccgaaagacagctttcaagcggacttgccgaaacaataaaacacgcctgccttgcagacggcgaaatgttcgattatcttgaaaagaacattgaaaagatacttgtgaacgataaggacgcctgcgaatatatagcggagcataactgtgctgtgaagtataaagtcgtaatgaaggacgagcgtgaatcgggactgcgtgaggtgcttaacctcggtcacactgtcggcagagcgatagaaacggtcagcgactacaagctgctgcacggcgaggctgtatcaatagggcttgtcgcacaggcgaagctcggtgagaagtacggttatatttctcccgaaaatgtctgccgtgtaataaagctgtgtgaacgtgcaaagctccccgttgcgattcccgattacattgacaaagccgcacttgtcagaaagctgtatacggataagaaggtccgtgacggcaagctcagaatggtattccaaaaggaaatcggcgatgttatgtgctttggcgataatgattacgctaagcagatcaccgagccggagattgcggaagttatagacgaaatgtgaaaaaaagcctgcacagattgaaatgtgcaggctttgattttaacttttggtactaatttttaatatataattttatattattttgataattaacgttgactttttaattttttatgttacaatttagaagaccgtgcagaacgacatatcccagtgacgatggaagattggagcaaacgcccggatttattcctgatggcggatgacagagaagttttgcaggatgccggaaaaatcacagcggagattgccaagtccaaagctgaaacagaatttgagaagtatcgtgttattcaagacagattgttcatggcggactatgacaggtatctgcttgaattagaggaaaaggcgaagaagtaataaaaaagcaaatgtaaaagcattttgacacgtattttctgcgatgtcaaagccgtttggtagactacaagcggtggttatcctataataaaagtgcaagggaggtgtcatggcatggagcatgatattggaagtaaaatcaaggcagccagacttgaaaagaagctgacacaggaacaggttgccgaaatattgggagtgagtcgtcagaccatctcaaattgggaaaatgaaaaatcctatccggatatcataagtgtcattaaaatgagcgattgctacgaagtctctcttgactatttattgaagggagagcaaaaaatgaagacctattatgattatctcgaagaaagtacaaatgttgtaaaaagcaacgctaacagaaacaaaattattaccatcctatcttatatgcttgtatgggcgattgccatgattgtgttctggttctttacaagcggaagtgatgctatgggttatagtttgatgttcctttggattattcttcctgtaactacattcgttgtgtccattgttatcggcaaaaatgacttttggaaaaaaggaaaatgggcattcacccttttcttcggagtgatgtatatgctggctgaatacggaacatttaaaatggcaaacaacattgcttttgacaagctgaatgcaccggattggggaatgattgtagccggtgcaataatttctgcaatcggtatgctcttaggttcgttgtgtaacaagaagcgtaacaagcagaagaatcaggatatttaatgtagggcgaatatgaacaagtttagaacagttgtatctattttgtgtggagttgcaggattgttccttggagcctcgcttaacaatgctattggtggatgtatccttggcgttttgatttctgcgttaccccaagatcaaaaaaggaaattgccgaatatctcggaatggcatctgtatcttattgtataaaacgttatgtagaccctctggtcgaagacggtgcacttgccctgacagaaccgaaatccaaacggagccacacgcagaaatattttaccgtgaaataaatcgtataaaacacaagcctgcacgaacaaaaatcattccgtgcaggctttaatattcgtttcaatacggctttttaagcaatgtttctttaagcgagcaatacttatccgcccagcataccagccacgcttccttacttctcggaagtctggtcaatgtcagcggccacatatgatttattattatcccacgctctttaaccgtcagagaaaacgtgttccttgcattacgttcggcggtcacgggatgtgagaatccgtgcagaccgtcccttgtgaatgcgcccttgtgccagtcataaaggaaaaaatcgtgcagaagcgcaccttttacaagcgcctcgatatttatcttcagcttaagcttctttgcatacatataagcatacaggcagaccataaggcaatgctcataggtggaaacatcgccgtgctgaacatactgcttcatctgctgtaccttttcgtttgcaagtatctttcttgctgtttttataaatctgcggtcatcgtctgtaagcacaaacgtgttcttatctgtcatcattctcatcatcgccgttatactcggcagaatcctcttcttttttttcaccggttcttgcttttatgcccggaatgcgtgacgcaatcacatcaaagcgcataatatgagtgcttatgttgcttatactgaatgtgcttctcagcttatcgacatcaatctgctttcttgccgtgccgagaaaatcaatcgccataaccagcgatatgaccgtacctgcaatacatataaactgatacggcagattgttaagcacatacaatgtaatgtccgaaacaacgtatgtaacgaacaatcccattacgccccagaaaagcgaggacaccagcgatattctgtttttataggttatcctgaacatactgtaatcccagaactgcttaccgaacatagtttccataagccagcctgtgaagtattcaagcgccgtgcaggcaataagagccacaaagaaaacctgaaatccgttatctctgaacggatgacagataaacagcaggagcagtccgccgacaccgtatataggaatatatgggcctctgaggaagcctctgtttatcggccgtctgtgatacagcgactcgatagtcgattcctgcacccagcctgccatacaatatatacagaacgtaaataaccaatattcaattccgaaatgttccatattattctccgatttataatcaatattatgatgctgttctgtttaaaattctgtcttgggatattgcattttccgccacaatatcctatactccgattttattatataatatctgttaattaaagtcaattaaataaattgccgtttgccgaagtgaatagattttttgtgaaaactgtcgaatgcggataaccctcaggaacaaaaaatcagtaaagttaacattcagttaataaacgaaaccccgacctttcaaaagtcggggttttacgttcaattcagatgtgcgtcaatcgatctcaaccataaccttctggttgtatcttactgctcctgcacgcataatggtacggatagccttagctattcttccctgcttgcctattacacgtcccatatcatcgggagcaacgtgcagatgataaacaacagttccgtcctctttaggctcgtcaactgttacccggatggcggacttgtcatctacaaggtcttccaccatagcgataagcaatttttccattttattttcctttcagaaacagcgattacttttcagcagcgatcttaaggagcttcttaactgtatctgtgggctgagcgccgttagcgagccacttgtcagccttttccttgtcgatagatacaacagagggttcctttgtaggatcgtagtagccgatttcctcaatgaaacgtccgtctctggggtaacgtgaatctgcaactacaactctgtagaaaggagccttcttagcgcccatacgtcttaatctgatctttaccattttgttcacctcataaaaaatttaaagttttagtttttataatcaaagtgtattgtcaagcattaattgtcaaccactatgaattacctgtaatcctgaacggcttacatcgggaaaccgcccatgccgttcattccgcccattccgcccatggggaacttcgggaacttgcgttttttgccgcccttaagtcccatctgcttcatcatcttctgcataccgtcaaactgcttgagaagctgatttacatcttcgacctttgtgccgctgcccgccgcaattctgcgcttacgctttgcgtcaatgatagagggcttttcacgctctttttttgtcattgatgagataatagccttagtgcgatacattctgcgctcgtctatatcttcttccttgacctttcccgcaacaccgggaatcatctttataagagatgagatgctacccatcttctcaatctgttcaaactgtgcgtacaggtcattcatatcgaacttgttttcctgcagacgctttgccagcttttcctgctccttctcatcaacatttatctttgccttttcgatgagtgaaagcacatcgcccataccgagtattctgtcagccatacggttggggtggaactgctcaaggtcgtctgtcttctcaccgacacctgcaaactttatcggcttgcctgtaaccgagagaaccgacagagccgcaccgcctcgtgtatcgccgtccagctttgtaaggataacgcctgtaatgtcaagcatatcgttgaacgattttgcaacgtttacagcgtcctgaccggtcatagagtcaacaacgagcaatatctcattcggctgaacctcagcctttatgtccttaagctctttcatcaggtcttcatctatatgcagacggcctgcggtatcaaggataacaacgtcaaagccgttgtcctttgcgtattttatcgactctttcgctatcttcacgggatttgtctgtcccatctcaaatacatgagcgtcaaccgaagcaccgaccaccttcaactgatcgatagcggcgggacggtaaatatcgcaggctacgagaagcggtcttctgttctgctttttaagatactttgcaagctttgcggtatgagttgttttacctgcaccctgcagaccgcacatcataataacgcacggaggcttcgaggggaaatcaatccttgccgtatccgtacccataagctttatcagctcatcgtgtactatatctattacctgctgtgcgggagtaaggctgttcattacctcactgcctacagcacgttcacttacctttgcaacgaagtcctttactacagggaagctgacatccgcttcaagcaatgccatcttgacctcacgcatagcttcctttacatctttttcattcagcttaccgtgatttttcagcttgctgaatacttttccgagcttgtccgaaagtccttcaaatgccatcagccaacctcctctttatatcgcattctttatatcttctataatagatttcattttctctttttcatcggcactgccgacattctcatctgtaagagctgtcagcttatcgcataaatcgcagacattgcggtacttttgtgcaaatccgagtgtttcctcaagctgagtgagatattcctccgctgtgcgtatgcacttgtgaacgccctgtcttgtgatacccatattctcggcaatctcggaaagtgacagatcctcgtcatagtaaaggctgagcgtatcatattgcttttcggtaagcatactgccgtaggtatcgagcagtattgcgttttcgatattctttgacattttgccgctccttcgtccgtctgtattcacgataacagtcatacagacttacccacgctccgattttcttgcgtccttcgtatgctcctttgtccgtattcacggtaacagtcatactgacttaagcgattcactgccgacttacaagccgtaaatcccgcaaacctttttgttgtgccgtttcaagcagtgtaatgctattttggtttacagccacctgatatattatacacaaagagagccgctttgtcaagtaaaatctgaaaatttcttataaatacttgactgcaaaccgatttagcggtattatatactcataaccgacaaggagcgatcattatgataataacaactcttacctgtatgtgcgtcgacatattcgacaaaacgataatgcccggaggcgaatcgcttaattttgccgcaacaatatcacggcttacagatgcgaaggtctatataatcggcgctgtgggaaatgacagctacggtaaaaccgtccttgacagcataaaagatttcaacatcgataaaactcatatcagaacggaaaacggagatactgcctcgaaccgcacctaccttacccctgacggcgaccgttattataaagacgattcgtggaacggcggagtgttctcaagctttgccctatctgcgtctgacagggaattattgcattcgtcggatatggtgcataccaccttttccggaccgaatttcaacgatgtaatagactgctgccgtgaaaagcgttttccgctgagcgttgattttgatatttgcagggattttgacacgatagaaaaataccttgactgcatatcgcttttgtttataagcggagatgaacctacgcttgaaaaagcgaaacagctttcctcaaaatatcccaatacggtctttatcgtaacgctcggagaaaacggaagtaccgccttttcaaaaggcacggcttatcattgtgccgccgctgaggtatccgaagtaacagataccaccggctgcggcgacagctatcaggcaggctttatagcaagctatcttgctgacgggaacatagaaacggctatgagtaaaggctcgcagacagccgcacaaacgctttcgttcatcggaggattcagatattgaaatacggcggaaaagcaaaagcttttccgccgtcattattttatatgcttatttcgaccgatacgcaccttccgccgtacagcttctcgcttagctgtgtcggctgtgtgaagcctgcgtacaacgtatatctgccgcttcttaccgctcttacgccgttatcgtcaaccgtttcaaacgcaccttcgggaatattgatgcttatcgtcctgctttccccgtcaaacagcgaaacacgctcaaatgcgcaaaggctgtgatttttcaccccgttttcgctccttatatagacctgcagaacgtcctccgcacttctgcttcccgtattggtaacattaacggcaagcgtattgtccttgtacgaaatatcgccgcattcaaagtgcgaataagtaagtccgtagccgaaaggataaagcacgttgctttcatcgtcacagaagcgatatgtcctgttcttcattgaatagtcggtgaaatcgggtaacatatccgccgatttatagaaagtgaccgggagcttaccggacggtgaaacctccccgaaaagtatctccgcaagtgcctttccgccgtactgaccgggataccacgcatttataagggcgttcccctcgcattcggtattcacactgcttcctgccgcaagaactattataagcggctttcccgtgtctttcagcttctgcagaagcactcgctgaacctcaggcaatctgagatccggcttatcccccgacttgttttctgtgtcgccctcctcgccctcaagagtagagtcaagtcccacacatacaacagtgacatctgccgcctcgcacgccgcaaccgcctcggcatatctgtcgccgggcagtgcaagaccctgcgttctgtcacggaaaagctgacagccctccgcatagtataccctgccgtcaaatgcgtcctgtattccctcaaggaatgtaacgcttctgtcgggcgtaccttcatagtttccgagcaatgccgcacggctgtccgcattcggtcctattacggctatcgagcttatcctgcttttgtcaagcggaagtatgccgtcattatgcaaaagcaccattgatttctccgccgcttcaagcgataacgctttattgccgtcacaggcgataatatcaaacggcaggtcgtcaaactcgttatcgtcgagctgtccgagccttattcttgtccgtaatgcgtgaatacaggcagtgcgtatatcctgctttgttataagcccttcttcaagcgccgccagaatatgcagatatgtatttccgcagttaacgtcacaaccggccttcagcgccattgccgcagactgcggtgctgtgtcggtgattttgtggttagtatgaaaatcccttatagccccgcaatccgacacaaaatagccgtcgaagccccattcacgcagttttcccatcagcttttcagacgcacacgaaggctcgccgttcaccctgttatatgcacccataacaccttcgaccctgccctcttttacaagcgctttaaatgcaggcagataggtttcttccagatccttctcgcttacccttgcgtcaaactcgtggcgaagcgactcgggaccgctgtgtacagcaaaatgctttgcgcaggcggcggctctgaggtatttttcttctccctgtatgccctttacgaagttcacgccgagccttgaggtcaggtacggatcctcgccgtaggtttcatgccctctgccccagcgtgggtcacggaatatatttatattcggcgcccataatgtaaggcctttatatatgtcggtatcgccgtgttttgcggcgctgttatacattgccctcgcttctgtggaaaccacctcgccgacacgacacatcatatccttatcgaaagccgccgcaagtgcaatagcctgtggaaaaaccgtagccgttcctgctcttgccacgccgtgaagcccctcgttccaccagttataagacggaagccctgccttttctatggcaggtgcgtcatatttcagctgctgtgcctgttcctccgtactcagcgtatcggcaagtgccgccgctctctcgtaagccgataattgtttatccttatatctttccataaattactccttgaaatccggtttgccgtactgttaagttaattttatcatatcttacggcaaatttcaagatgattttaatgcaaaatgcacgggtaaaaataattgccccgccgtaaaggcggagcttcatttccggcagcatcgcaactgctcctatttgttataagtttgttataagctgtaagaaaaatatcttcttccgtgttcctcttctgcaccgattttattataaaaattgattgcaggctcgttccagtcaaggcagctccactctatatatgaaaatccgtcctgctttacaaatttctctacttcagaaaagaactttgttccgagtccgctcctgcgtttttcaggctttaaaaacagatcttcaagatgcactcccgcctttgccgcaaatgaggcgaatacggggtaataaacagcatatccgaccggctcgccgttgagttctgcgataagcgcagcagctatgttcctttcaaagagaagataacgcaaatcctcctgtgcggcagtcatatcctgcggtcttttttcgtatgcggcaagaccttttatcagattttctataaggcttatgtcgttttcggtcgcttttctgacagtaaatttatcgtccattggaagtcctcctgcttgtatagatttattatagcgggtttttgaggggaagtcaatcggatgtcgcaggataaacataaagcaacgaaacagaacaatcaggaaaatgtactcgacaaacggtaagattgcgctataaagctgaattttacaggtaaaattctttcaggtcatcaagtcgcaaaaggcatggattatttccataaggcacacctacatcaacatctatccaggtatcggttttaagaattttgccattgtatttttcaccgtagctttttgtcggtgtatggccgaaaacagttatacaatcatcaaaatagcggtcggtcagttcaggccaagcccagataagttcatcagcggtatagtccgccgggcttctttcgggcgaaaaattatcgagtccggaatggcaaagcagaaaattctttcctccggcggtcacgatttcgtaaagcggcgcttctttcagataaccgataatattgcaaagcgtttccggtgattcgttttggagttttcttaatgcttttaaggtaacgtcgcctccgcttaacatatagttattcagaagttccgtttgctctttgtcaaaatgcttgatactttcctccgtaatttcgttaaatacaaaatcacaggataaaagcatcgcttcgtgatttcctaaaatcagctgtgcattcggttgttccgataaccatattaaaattgcaacgccgccgtcattttggcggtcgatgacatcgcccaaaacaaataacctatcgttttcgttaaaacacgcttttttaagaagtgcttttaactttgtgatttcaagtccgtgtaaatcggaagttacatatatcatttaagcctcacttattgaatgccgtattacagagttttttcgattaagactgccgcttaatctgtgtaattattccgaaaccgtataaattgtcagcataaagcaagacctataaccgtactttagtcttgccgtgataaaagtttttatggaaaaatccaatcgtttgttttccgcagtctttaacattatacatgaacaaaatcaaaataacaaagaaataaatcaagaacaaataatcattaaactacccatattccgtataaattattcagttgaatcttaccatcggaaaatgcttaaagctccacctcaaatgttgcggagtgattgattaaatcaagcgcaagctgtgcgtcggataattcatctgttacggcaagcaggtcttttgttacttcgtcgatgtcataatttacatagcgatagtcgataatattacttgctctgccgtattcttgctcttcacgggctttcggtaatcttgacgccatttcagatagcttttgctttttagccgatagctgagggagaaatacaagcatttcgtcaatagtgatgtcgtatccgggaataacagttgtcgtgttgaaaagattgatagcatgttttaattttcggattttaagagctaagctgtcaagttcggcttttgattccttataatcgtatttcggtctgaccgattcaggattttctccgacacttgctaaaaatgtgcttgaaatactttcttttgatttgagcgcatcgtattcggatttaagcttcttaagcagctttgcaccttcggcagatgataatttcattaaaatcttcctctctttatttttcattataattataatcttatctatgtaccttatttggtgcgtttctttttcgccggatttaacggtttccggtcaggtcaaaaaagcgtaaacatcgaacattactactttattataacacatcaaagtttgggatcataccgttttttcgtgcaatacatcgtcatttgattttcaagcaatcaggaggtaaaacaatcttaagactccttcatactactattcgtgcaatttttccccaagggggatccacgtttttattattcagcaaccataagaccggaatttccatcgctgcttcttctggtgggaagctatcatacccgtcagttatgataattatttgagaaggcaactcatttaacatatgatttttcatatatctaaaaatatctgaaaaatcgtttcctccgccaccaactggttttatactcataagttcatcaacacttgaaaacggtactggatctgtaacatagctttcagtaaaacttagtattccgcttagtttcccgttgaattgatcaattgcactgcatatctccgaatatgcagcttttattgcatcatcgctaattgacccagatgtatcaataacgaaccagatattaccgattgattcttccttttcattatagtccggcaaaaagaacggactatcatcgaacctgcgatctggtggagtaaatgaatagtcagtaatctcttcttgaacaaaattgtttagtatctctctccaatcaatctgcccctttctgatctgttttagtattctttgagcaagaacaggtcctccgccgaatgattttgttgaatctcttattgaaatcacttcgcatacatcaatcagccatttttcccattgttctcgcaaatactcattttctccaccaaatcctccattgttttcttcacttgaaccagaccaacgggtatgatcatcccaactagctccaagagaaggtttcggtgttttgccttttggcatagggggaagcatcgcatagatctgttctgcagtgtactcatatccctctttcccatcgggagctatgtgcatggattctccgtattttctcagcttgattgagtttctgttcatgttatttgacaacagaatatttgaattgacaacgatatcacaggcaatgttgaattgttcgctatcataatccccctggcgcatacaatgttgcaaaacgacatgaagtatctcgtgcatcataatgaaatcaagttccgaatcactgagttcgtccagaaacttcggtccgaagaatatccggtgcccgtctgtggctgctgtttcacagttttcatcaatcgaataaatcatgtgcattaacagcaagccgtagaagccattgtttatgagcaggcgcatacgagacattacaagtcgcttcacatattcttttttcttttcatttgacagaaccattcatcagacctccttttgtctgcagccatttactgaattccggaatggtcaaaagtgtttgcttgaaatctttttcaatgtgcatataatctttcaggagaactgcgctgaaatccggaggcattttatccgcataacgaattgagttggcaattcggctcagttcgtttttatgagtacgggcataacagctcatagaggcggttaaagcatacattgcatctgtgtttttcggcatggaaggcattttaccgtcgaagatttcttcaatcgacggcaaatccttatacacctttgcccatgtcctgaattcaaccgcaacaccggagccgacgattcccgctattaacgaatacatatcgtcaatgttgtcactgatgccgttaagaatgttgctgaccatctcccaggcacgtggcgtgggaaacgcaaggtcttcacttcccgaatcgaatcccataagatagtttggtctgaaagaaaggaatccgatcactttgtcattgatgccggatgttacagcccattctttccacgacttgaagctgccctcaacttcgatgtgcatcaaacggtttgcaagtgctttaggcattttgaacgccactgatttatctgtcgttctgttaccggcggcgataacgatacagttttcaggaagcttgtgttctcctacaacacggtcgagtgttatctgataggccgccgcctgaacagactgaggagctgcggagatttcatcaagaaacagaatattgacaatatcatcactggcgtccatctgaaatatctgcggcttcagccatatcgcaagtgttttatccgcatttgctgtgggtattcctcgtaaatcaatcggattgaaaagaagcagtcttacatcggtcacattgacacttttgccggttctcgcgccaatttcatttgcaatctcacgaactgcctgcgatttaccaacaccgggaggtccccaaagcataacggaaggcattgttctgattggaagcccgttgttgataacagtgctgtatgcctcgctcagctgattcaccattttacctaccgccatagaagggatatttgtcattttaatatcgttcatttcttatctactcctaattttttatcaagttttttgactttattcttgtatgtttcgatttggtcggtataactttcgtcttttgacagttcaaatcgaatatctttctctttttcccggagcttttcgagattcagcatcagtttactgagatgatcttcgagagagtcgagataattatcaatcctgataaggtttcctatatccgtatccccgagttcaacgtagtatttcccactctttttcaaccacacataaggcttttcaagcgtcatattggcgggaagtacaatgtcgaatccacgatatgacgtaagtgttttctctttggtctccagaacgtgttcccttatcgcagtaccgataaactcacgaagcgttttacgcttttccgcttcttcttttttcagcttgctatcctcaaccggaggattaatctttctccattctgtatagaaagcaagatcctgtttgcagtattctatcaagtcgatttgattgtgtatctgccccagcatttcaagaagctctttttcaagtcttatccttgattcaaccagtttgctctgcagagccatatatcttgtcagttcattggcggcttcgacacgctgtttaaccaaaggattaccaacagcaagagctttgacctctgcgtaatccaagacggtatctgcaatatccgtgccgcttcgttctgttaaagagccggacagcagctcggatataaagcgttgtttcgtttcgagaagctgccatgagtatgcatcaaaactaccctctgtgatgtaacgatagatatatactttgctgtttgtattgccttgacgaagaatccttccttcacgctgtgtcatatctgccggtctccacggaacatcaatatggtgaagagcaatcagtctttcctgaacgttcacaccaagaccgagcttgtaggttgaaccgataaggattcggatatccccgctcctgacttttgcaaacaacagagatctcttcgtctcggtttctgcatcgtgaacgaaagcgattttgctctccggaactccatgtaataccagtctgtccttgagttcggtataaatgttaaaaccggctttcggagttgaagtatcacagaaaataatctgtgtgctcttatcagccgaagttttgaaatagatatccgcaacgttttcggaacagcgagccaccttcgactgatatgtgaatgacgccataggatcgacaagtcttaaatccagagccgcctttcgtccgtctgtcgtgattttcaacatattatcgtctttcctgcttatacgtccgttcctgacgtcatccgctcttgtagagatatctgcaagatatgcggcgaacgcaggagtttttgacacgagtgcatcgttgtatccgtcaaacgccggtatgtctgcagattcatcaacctgatgaaaatcggcaacggacgagagaagagacgttaattctgggaggttatggaatttggcgaaacgtgttgcaagtctgtacgtactcgtatcaacgtcaacctcaaattccgtaactctctcggcaaacattcctatccagctgtcaaagctttgaagatcgagcatactgagttcaccgctctgaaggtatcgctgcatgatatacgcatcggtaattgaattggtaataggtgtgccggttgcaagtacaacgccttttccgtcgttctttttctgaatcatgtgtactttgtccatcatatcctgacatcttttagatccggtgctgttaataccgagaacgttgttcgtctttgtttcaagcgggacgtttttgaaattgtgtgcctcatctacaaagagtcttgttattcccaaatcatctaaatacacgccgttatacaaatcatccattgcaacggaaagttcggataaagcttttgaaaccgcctcttgctttttcttcaaacgagaagtggctttgttctttttgcccgctatttctgcgatatgtttctgctcatcaataagcaggttttgataatatccttttgacaacggaatctgctcaaagcaactgtacgctataataataccatcgaagtcattgtctcgtattctttcgagaacactttctctttttgagggtgcaaaacttttcgggtcaacacaaagaatatcagcacttggatacatttcatggaaaatgtttttccattgaccgactatgttattaggaacgacaaacatattcttttcagacaaccccatacggcgcatttccattgcagcagcgatcataacgtaggtttttccggcaccgacgtcgtgagcaagaagcgtgttcggcgtaaagatgatgcgtgccaccgcatccttttggtaaggataaaggtttatctgcgcagacatatcaggaaaccgcaaaaacgatccgtcaaaaattcttctgcgaatacaactgaaattgttctcaaaaatcctttcaagtctttcttttcttgcgtcatcctcccaaacccacttctggaacgctttaatcattttattttgcttttcaatggcgagaatggtttcagactggttaataactcttttcttgcctgatgaatttgtattacatacaacctcatcggtaacagctaccgacttcatatttaatgtcctttcgagaatatgaagggcgtttattctgtcagtaccatacgttcgtgttaccttaacgtcgtgattacatctgcttttgaatggtatttcccaagtgccggtcaattcatcgtgtttagtatggaaatctttttcatcattgatgctataccagtgtctgcgccaatcgccaagaagatactctataaaatcgtcaattacatcagcaggaacccatggagaaccaagcgtaatataaatatcatttgtcgctacggtcgggggaatgactttttcaattgcctttatattttcagcaaaatatccgttgtattctttatcggcttctttagctgccttccattttcttatcatgttgccggacagatattcctcagaggtttcccagcctttatagaagcactcgccccaagtttccgggttctgataaatagagcctttcagcgcacagataattgtcttgtagtcctctcctgttattgaagaaatatattcaatatcaacccgtccgagattagacagactgtacataaggccatcggaaatgctatcagcgtgaactccctgagtccttacatcctgattgaacacattttcccagtcgagcggaaggtccatgcttgtaacttctctgatatgggcttccttacgttcctttgcttcatgagcttctctttcccttttctcacgctcttcttgccgtctcttcttagcttcgatagattctctttttcgttttgcatctgatatctcatgatccaaaccaagtttgtagattttgagattgcatgcatacgattgtgaacgattccaggaattcattgtgaagtatctgaaatgatcctccagataatctatcattgctttgcgtgatcttaggtcaactggttgaaaaaatcttttcatcgaaacatccccgcattcttcatatgagttaccggggactcccagcttaaaacatagtggtcacggtttagatgaacaagagatttgttcccattatgctgagttgccagtttttgaaccatcaaatagagactttcctcaaaggtgtaaataggcatattcaatgttatggcatgaagtatttcttctcgcataccgttgctgatatgattgccacacactaaaatcaaatcgctttcctccaaaaggtgaagtccaaactgaagtgcaatagcacgttctgaagggacgcggtcacacagaagcataggaagatacgcatggggtgctcgtgcagcatatcccattttctccatagcataatacatatacgctctggcactatgcatatttcgaagcatttcttcctctgtcggtgcgcttagaggagaacagatatatgcttttttacaacacctgttgttttttagaaactgcaaagcaagcttgtcttcccaattctcgataaaaatattttgttccataatgaactcctttctaaaattcagccgggagaaatcctcccggctcagatgattacgccgtttgaacagagacttttagttttcggctttcagtagttttctgcacatctttgaagacggtaggatatttttctttcaaagcctttgtgtccgttctgcggctggttttcgtggcaaaatcaattaggaatttatcggtagttgtttctaaaatacctctttcatgttccttcatcaattctgcaattcgcacactatgtgcctcgatctcctttgcataagattttatttccgcattgcattcatcaattttgccttgtagaagcgcaatgcgacgaacttgtttttcataactttttggcaactcaatggttggtaaaccaggttgactgctgccataaattctggccaatgattctaaagccagtttgggctttacatctgtcatcttagggggtttatcatgcactaagctccaaatccactcctcaaggcgttcgaaaatcatatcttctttcgcctgatctcgttcaatatctggaatagctaagtccgtttccggattgttaccccaaagagcagagaaagcgcctattcgcacatctgcaactgatagataaaatcgtaattgcagctcatagtaaatggggattgcatcgtccgcccagtcttcagccttgtgataagtgcagctcttgcactctaaaattccgggttcaccatctgatgaacgagtgaacctgcggtcaaagttggccaaggcatatgggtgatcagcatgttgatataaaccagtatcctcataaacggtatttccgctttttttcgcataccagtgggcagcaatgggttctaaaagatgtcccatttccagctgactcgcatttgccttttcaacaggtttcattcttccttttttgattaaccacaattctaatggtgttgtccacggactcaaaccaaaaattgtagctacatcacttccaccgacggtataaggaatcgtccctgtaggaccatgcattctgcattccagccagcgctcattgctcattcctttggtgtcgcatagcaaaatgggctgtgccatcaatagctcaccgcctttgcaaggtcataatcactccatttcagtgtcaatgctcttgccatattttcttctataacaagcattttgctctccggagtattctgacttttaaggataaaaggaatttcctgcagtgccatgaaaacatcatgtgctgttgctgaccctccgccataagacatctcaaacattgcgattgcttccaccgctgcctttttaggaagactcagctttttacagatgcgtgtcattgcattgactgggtactcaagttcgatatccaacagcttttccagttttgctactgaatcaccaaactgagcaaataactgatccaacgcattttcaaaatcattcacttttttctgatggcgatgatctactgcaatacatccgccaatatggattggatactgcagaccggttagaagcgctgaaacttttgcagaggcaacgcctgtgtctgaggtcataaagcgaatgcctggcatcagttttgcagccatagcacttttaccttgctctttcagcactttagcataggcacctaagagatcatctttctgaccgggaagtgtccaagtagcactggaacacgaatgatcggtatatccagactcaaaaacagcgcctggaaaacgctcatccagctttcttgtgagggtactgagcaattcattgattggaaggacagaatagtctgatggatctccggaatgaactgctgcaattttttcatcacgaatcagaagtaatgcctcggctgaatacagatgcaggcaggcattcaaggtttccgccaatacatcacgtccaagttttgggagcgcagtacctccgattttcgccctgtcaagaaggcttttgtaggctgtcatgcgcaatggatagcattcgccatctacacgcatagctaaacctaagttttttgccgtatcctctacagcatcttgagagattcctgaggcaaaagcacttaaattaccatagaggggagaggattcattcagcggttcaacctgcagggtgttgaccttgcatctgtgccacttgctttctctctccagctgttcgtggtaatctaacatcaccacaggggaactgaaggttgtgaaatagttgtcttcgcatttttttagcatatagatgctcctttctttttttgacggttaaccgccttgatatataacaaaagccagcaaccccgaaggactgctggcttatgcccaatatgaaatttggccggaaaacaaaaaagtgccatctgcaaaaacgcaaatgacactttgattacttgataactatgatttttcttacgaaaatcttgaaactgttatatatattatagcagagatttgttctccagtcaatctatataagaaagaagcctgtaaatgataccttctattgctatgtttgaatgggaattttagaaattcagcatctcggcaatctcatcgacaatatctaaaattacatggaactccagaccctcagcatatttgttttccgcaacataatttctccagagtgtgtacagctgcggttcctctctaatttctttgagaatatctttccaatcgtacagttcttcaagtgaaccacgttttttagccgtatgttgtactgcatcatgcaatacttcaaaacggatctcatcccagtgctgccgacaaagcatatataaatcataaaaatctcttgctcttgtggttccaatgtttctacgaataatagtctcatatttttctgctaatattgtttctaatgagtatgccaaaatgctcaccgttttttcactgagtattagagggtaatcataccgaattgctgctggcgtgataacatcgcctgtagtaacatccatcttcattggattatttattttaccgtattttgcgataaggtgaattctaaagttgttatatgcatcatcttcacgaatcggttcaattctttgaaactcaaattgaatcccatcatccacatctattgcaatgatttttttgactatctctacaatctcatcctcttccatttgaatgccgcgaacagtagtatccatatccattgttgttctttcactgatcccgatcatggatgaaataagtaagcctcccttcaaaataaagttacttttatattcagaagcggaaaggcgttccaatactctctcaaataaaaacatctgcagaacctcttgtgggcgcagatcttttttctctgcgatgttcttaatccgtcctttaatttgttccggtgttaacatgacaaaacctccatgtaagtccttattttatcatcaattccaaattgtttaccgtatcgcagtaatttacgattgttaggcttggatttaaagtagtccctgagagcctgcgaatacaactgcatttctattttctctttatcccgtatcaaatcacaaatacatctttctttatcatacaagcgcactgtacctccctgaggagacatcaattctgtaatacccaactcatacaaatcatttacgatgtaatgacaacggatattcggattgtttttccgcagcacagtagcattcaatccttgaggcagcgtcacatctaaaatatgcggcgttctgtctgacaacccccagaaaaaaagtgccgttccatatgaaaagatagcttttgtgttttgagcctgcagaagaacatattcgtctgcgacttctccacttaaaatatatagaccctttctaatgcgctccaattttcctaaatccatatatttttttagcataggacgactgataccagccgcttcaacttggcttgttcggataactccatcattatcctctgctattctaacgaatttttcccagattttatccatacaccatcacctctcagtgattatttacattcttgctttaaattatacaccgttaaagtaaaaatgtaaataatcactttaagatatgatatgcgtttgttagaaaaaattcaaaagaaaaagggatgtctaaatagacatcccttcagtgtggcaattattaaattttatgcttgatacttatttaccatttccgatttacactgcacgcctttgacgaaggccccaaagtcctcgtccagcatgaaaaaagtgatccggatggtattgaagagtctggcgaactttttccttccaccattgatttttttgagcctttttgtatagctccacctccttgtaaatttcttctaaggatacagcctcctttttctcagtcaatacagctgcgactacatcacgccaagtagctcctggcatatcacggatgtccagtttcttctctgttgtaaaaagaatgggatagataagggcattatcttttctcacaaccagtacatactcatgaagaattggaataaattttccactgtactgtatttgatcagaaaagcaattgtgctgcgctttgattataatgttttccagcgttcctggctttataatctctgcaagcatactgtatagctttccgcgctttttgatatctcccataagaacagccatacgaccgcctttttccagagcacaaaactgtttcatcattgcatagttcatcgcttcaacaaacctgtcccaatctgggatacgggataaatccgccttacaaggatcgtatccatatttctcttttacttccgacgctttgtacataacatcagagtatttgattatatcccagtatggaggatgccagaaaatgaattctggacgttctggaatttcgcaattcattagatcgaatccactatgtagatcgtacagatgactgcggattcccagtttatcagcagcggcttttgttgtgccactaccacacatatagtcgcagatttccatcggcttgaaaaagccaagtaaatcctcaataagttttggagaacaatttccgcgatatttattgtttccaccttcaccgcgttccggataagaaacaatgctggtcaaaatatggcgtgattcatgtttatcaaacatttgcttcacctccttcatgatacttttttgttaaatccccgatgacctcagatatcgaatgccagtagctatcccaataagaatcgttctttcccaaagtcttttcaattctttctggaatactgggatcctcaattaggctgtggtactggtcttctgtaaggtctgtagttatttcggactgtactaactgagattcaaagtcttcgattctgcattgttttagatattcacgacctatttctcccaattttcccgaactaagcagcaattctttttgtatcaaattcagacaataatgattttcaatgtattcaccatcgatccagcactcatatgagtgctcgtcagattcagatatgaaactgccggcattgcgaaatatctggatgcaaccagtattctgctctttttggagcatttcgcatagtgctatcttagcatattgataatctccaaaaagtgatgtggtatgccctgattctccatgggatactgaggcaaggcctgaatttttttggcttttttggtacgtttctgatgatgtaattttccagcttgctgctgaaaaacctttccatcctgaataatgtagttcgtgtaatatggaggacgatccaattgaacaattttgccttctggcagtttaatacagtcagttgtactgttgtaatcttctcttaattctgctgtcatatcaaagaactcaagatagtcaggatttcttgtatcctgaaaatagggttccatgacttcagagaccatgtcgtctacagcgcttgagaagccagtaactttgctacgcaagcggctgatttgccattccagcatgtggttaactttttcagacctggaatccgaaagtttttggatcatatccctgatttcctgatttcttttctcatcctccactatgggagcaatatttacagctaccattgtcttaaaatgcataatgattttcctttcttaaagacagatgggcaactgtaattcagctgcccatcattgttatagtgatgttgtttatacccctatgtgacgctttactacagccgtcaattttatgggcagttgatttagatcagtgatatccatgaaggaatcaccatagattctttcgatgttctgcttgtcatcgccgattgccgctgcgatgaaaagcaatccttttcgacgatattcctgcttaatacctctcagatcttcttctgcagctgcaccgtaataaccactgtcagctggttgtccatctgagattagcattaaaatacggatctcctcgggtcgtttcaccattttctcggctacaaatcgaagagccgcgccgtcacgattgcttcctctagcggaaatatccataaggcggtacttgtcgtcttgatcaatgtcttgaaattcagcatatgagaacaattctacgctgtcgtatcccgttgtgtgaccataaattgttactggtatacccaagctatgacaaaaatcgtataagataatcgctgcagctctggcataagtacaacggtcgcaggaagacatagaaccagactcgtccagcaataaaccaacagatatctgggggacctcatttggcaaggcgtttttgtaaaaaaccttgccatcatttcggcataatgcgtgcgcatccaatctgcgtcccattaccaagcctgtttgttttccacctctttgtctgtcttttaactgctgaacgatacttttttgcagctgcttagaaatgcggatcagcggtgccgaaatttgatcatattgctctataagctcattatcgacatcggcaatacggttgacgcgtatttgtacacccgcatgaatatccccataagagatattctgtgcagcttcatttagttccctgagtcgctcgttttcaagttgttcgcatgcagctttttccgccattttatctaaaagacgttcgatatcagaagctgcattttcgtaatgttcacgctgatagtcatcattgtaggatgtttcaccaccagtcggctcagagacactttcagtctgttgataagggattcttccttcttcttcagaggaaacattcttcttgccgtttccacttagtgcgccactttctacaccgtcatcccctattgatgactgcgatgcagtggtactattctcggaattatctgacgcatcatcttctttttcgtcactgacagcattttccgattctgatgaggaagaattatcttcctcatcgctgccttcagcaattgcttttgtggcttttctctttccggcattgcatgctgggcaagagcttgtacgtggttccgggacagggatggtatcaccttcgcctgcacaagaacctcctaccacagaaccaaaggcttttgcaagtgtttctgacactgatgtttcttcgcctgcagcttttgcatcatcctgacgctgtttgcatacctcaataaagctttcgatataatcccagcaacgaactaagactaaatttaccgttttcagcctttcttttccggatgtaaccataattgcattatccagatctgatatcaggctaaaaaccaactgaatcctttcgtcctttttggaagcctcgccgtacttaatttctccatactttacataggagagcagcagttgagcgatactctgaaaaatatgagttggacgttcttcatcttcctcagactcaatcagttgagtcacagttcgcatatcctcaaacatttgatctcgcagagttgcaagattttgtccaaggactcctggaaaccgtgaaagcatacgactttcaacataaccatcctcaatgatgttacaaacataatgagaaactgattgaagcatttcgagatttctgggttctttttttgcatattcccaaagtgctttttctctctttgcatcatcgggaaaaagtagactcggcggttctggataccatttatacattcccataaaattattgtgggtctgttgtatggggaaatccgtaaacagcacatgcccaagctcgtgcgcaaacatgccagtaacaatttcgtatcgatcctcacgagttcgatttttctttgttaccaatggatgtcctgcatttatcaaaatatgcctgttattagttactgcggtttcatcgcttctgggtttccatataagtttcatgtgaatgcgccgattatacttgtatctcctggtttgcgcaatcgccatgtcttcataatgtcctgctaaaatacgcgaagtaaagaactgacggtctgtaattttactgcgattttggtcaagcatctgcttgacttttttgtgattcacccttgccatatgtagggtaacctccttccttaaaattttatactgctttctttgagcgtcttggcgcaaatatcggttccaatacggtattgattagagcttgtcggtcatcctcatcagcagttgccttgctgataatggtatataatgccgacgcatatggatcaccggtaatttcggtactgataatccagtcgattaagcttctcatgccacaagaaccgtctgtgatactgtttttcctcatatagtcagacatatcgttgacaacctgcaccatctgggataccagataatcatctgcacatcctgttacactcatggcacgctgtaccatgatttcaggtgccggaagctcaacatctctgacaagactcatacggtcaataacagactgattgagtccacggcaaccctcatagctgatatttgtggtaacaaccactacagcatctggatgcctatttatgatttctccggttggcagtgtaatagatccagattgctcaagcattgagttaaggcccaccaaaacgccaggctgcataattgtgcttggctcctggatttcaatcacatacccatttttcagagcctttataaagtcggtctccacatatgtgtatgactgtccactgctctgatggttctctgcacgtttgctgagctgctgtactttttccgtaaccttatccaagacaatactcatacagtcttgagcggaggcgtcatcattgtcaatccccgtaagagccttatatacacctgctggatcataatccatatcatccaagtcaggcaagtgcattaaggcagcaacattagcataattgattccgcccattgccttcaaagcttctcgttcgcgatccagttcagcatctcccgtagaaacagaatcggtttccgggaaaatcatgccaacgaaatcaaaaatttctgtgcctgccgaacaggtgtatttcatgtatggtaaattaagccccgccgcaattgctttggcgcccattgttttacctgtacctgcaggaccacgcagcagaaaattacgcatcggcatcgcttttccggttgtagcatttgcgtgtttgcagatgtctaccacttcatccggtatgatataccatgcgggaagctgtggaaccagcgatttttccagcggagataaggatcgtccgggattaaactgatacttgctaataaagtcgctgtgttctactgtgttagtagagcgtttgatgactactggtccagtctgagcaaatacagtgaactctccggctataacatcgtttggtgtatacgcaccggaatccagttgtgtttgagaaatacgcatcagatttccggacttatccaaaacaaccttaacatgcgccgcacacgtttcgtcttttacacggcggtacatattgtcgcaaaggattgccatatcatctgttgctgcagataaatccgaaaaaccgtcattcatatgattgtgatagctttccagatgtttgctgaattcctcatcttccataaaagctggcatcatagccataaggactgctgcaccgtctctaccgctgttgttcagtgtataaacctccatcacttcggtgcttttgtcatatacactggcaagcagatttccggcctttgtatcatacacaacgagatgataggaatctggtccaatagaagatttgtactccgcaactgttctgttatcaatggtaccaactgcgccttccgaagacccatccatacaacggcacaaagcatgaattgctttaattgccgaagagcaaagagtagattccattcctgatccatacttcgatgaaacctttacttttttgtttctgagggtatcaaaaggggctgggagggagcgtgaaaagttaaataaatttgttacactcatagtgcttgatttcctttctgcagttttactgcgcaaatttgatttctataccgttttcttgacagactgcaagctcaatatctgaacgcattagctcgtcgcaaatgtttttccagctctgttttgcaggaagctcttcctcggaaatcaatattgattgctttccttgtccgatagcctcattacatcgctcattcagatccatcatatgagattcagtccattcaaaagctaacagttcatagttttcagggatttcttcacaggtggaatcatcactggtttcatcagtaaatccctcatcatggttttctgtagattccatattttcttcatattcattttgaggacatggcccttcggcagtacaaaactgtatgccgactatctgaagattttggacttccactttagcacgacgatagccaccggctcgattgagcaagatatagacggattcaccactttcaatgctttttctggcgttcggattttcccagatccatcgagcttgtggaaattctgccaataccagttctgtgactcgacgctgaatcacgccgtaggcaagatcccgtacatccttttcggtgggaattggcgtaggttcttgaacagttgtttgcacttcaatgggttctaccgtttttgaagagagaaacaagagccggatgactgctacaaaaatgcccagaataatcaaaagcaaaattggccaaagccggcagataaatgtcagaagcgcaagcattcctaataggatcagcgcttcataagccatatgccgtttgtgttcttttcgattcattggcatatttcctttcttgtactcatttttgggcacaaaaaaacgcacatgagcagtttatctgtaactcatgtgcgtttcaatgcgcctgattcaattgttctgtatcctccttattcatcaaagaaagaatttccgccgccaaatgcttcaaatcctgtaaaattttcaggtgtagaagtattttgcggtgcagcggcgggagaggagacaggcggtgtttcgtgattgccattattatcggcttttttgttcccaccactgaaacagtattcaatatctgtcagaatgataacgggaacactcttcttttcgccggttgtagcatcttcccatgtatcctcatccaaacggccgagaatcgtgacaagagagccttccttgagcttcatatttttgattcgctcgcagagaggaccaaacgctttcacagagaagttaacccagcgcgagttgttttccgcacgagtatcgtacactttgtatccgactctgaatcgtacagaatcgttattttccgaatacttgagtgcgggggtgtcgttatatccttttgatataacaaccggggtaccaaatgtcattaacatagttaagactcctttcttgcaggggttacctgctatcaaatatatttatttcaacctgttttccaggcagaaaccgagagaaacaaaaaaagtgccaatcagcacaattgtgctaactgacactttgtaaaccttgatactatggattttcaactgaaaaccttgaaactgttatttttattatagcatactttattctctcagtcaatccgtctgaaaaagttcttagttatgatgactgagtttggagcagttctttttttgccagctctaatgcaagatagactttttgtgtgtcacagtccatatgtccgtctttatcagaatgctcatgaatcagattcctgatttcgtccagcagcaccagtaaattctcggctgtcataattgttgttcccctttctcattttttccaatgcaaggtaactgcataacactttacattgatcatgctcatagacaggtgtatgtttagagatatatactcggatattatcccctttttccatctgttttatacattgcctgatcacaatctttacagtccctgcctccgtttcaaggtaaatgtttttcacacgtttacgcagcggtgttttatcaactgaactgcatagtccttctaatatgatatacctgttttcagtaacagtgtgccaaacgtaaatgccattcacgtaaaaaaatgccgcaaacaccaaacagggtattaaaagataaacatctttatacaaaacaaggattagaatggtgagaattaaaaacactgaccctgctccgaaacgtattatcagctgtttttgtaatgcttctggcaaagccataaacttctctttcattatatcacctcacaataacagtatccgttttttcttgagcaaactcagaatgtttttaatggtttcatctcgtgttgctgccttttccatctgtacttctaaaatattgtcctgaatgttattttgaaaatagatggtttccgtcaatttctgcctgttataggaatatagcagttcagacgaaggacgaatacctttctcattcaggtaaacaagttctgctacagatagatgtagacccgcatgacagatccattctaaaagttctttttcttttgtgctgagtctggaaaaacgcatcttaggttttgtttgacataggacgcactgagtcaagatctgatactgagctaattcactcgtttcctctctatactcaaccaaattcattcgtgccaaatgctgcaaatgctttttctgttcttctgttttctcgtaggcaaaagaaaatctaccgtctaaccacaagtcggcttctataccagtcaagcgaaattcgaccccacaccgtgttacaaatagcaattcttctgtagacggtcttgcaaccatacctttcgaaatatacattagtgttcacctcgttttgagctttaccttattacacggtatcgctctcgaaagtgtaacattacaacagatacatagcagcaacacataaagaaatgatcaataacactccgattgcaactaagccaacccgtttcatcatcacccaatcgatgccttcacggtgttttccaatgtcacttggtacgatgtcatcataatacccatcgtaagaaggatcgttcttttctgtttcatttggtaatgtttcggtattttcttgcggaggacgtttcttttttttggtcaatttctgagcaggaatactcttttgggctttgggttctttttcctcgttaacctcttttgagtttgaatgaggtaattcctttccgcattccgagcaaaaagaaacgacgtcatccacaagggatgcgccgcaatatgggcagtatttcatatcaacacactcctttgtataaaatttcggttttaaaaccgttctcatcaaagcctaagtgtggatattaaaagtataccacataacaatttgcatgtcatcggcatcaaccttgccatttatcttgccattttatatgccattttgttttcacacaaaaaaatatagaaatgagatcagtaagaataaggtttacagttttacaaacaaattaaaaccactctgttgcgatatagcattatacaaagtataatagtattgagaggaaatattattatataaattggattgtttaggcggaggaataactatgaaatgtccattttgtaatgttgaaatgatacatggttatctaaattgtggaatgaccttatggagcacaaagaagcataaaatcagtttgttaactgatgatgatgaaacattttctcttcagcttggtaagccagcactgtctcctcatcacatagagagtgactgctgtcccaaatgcaaaagaatcattattgatagctccggctataaaaacaatattgattgaacccgcactatctaattatcattttttatttcaacgattcaaattactcataattcaaggatgtgctaactatgaagaggacactttgcatattccgaaggtttattttgtttttctgcttatcttttctgatgctaaatttaatcccaccacatgcatccgcgaattcagcacagacccattggaccggaacaaccgctacaggagctattatcacaaatgatgagtgtccgattgtcgttgagaatgaaaatttgacatttgatattaacgaatttccaaagcagtactacaatgagtccgaagattatttgagctataatggaaaagtgactgcagagtacactttttataatccagcggattacactgtaaacgctgtacttgcgttcccttttggaacagtccctgattatgggataattcgcaattcgaaaacagatgaaacaatctggaccgcagatacagaaaggtacaatgtatcaattgacgggacaccgattgataaacaactacgccacacattttcattgaatggatcccagtttgaactgaacagagatgtttccatgttgcatagctcatatatggatgatgagttttacgatccggatttacctgtaactcaatatacctttgttgcgagcaatgtggatactgaaacatatcgggctgcaaatgcggcatttatcttctctgcagatcaaaacaaaacaaaaattctgctagaaaatcaaagtggtgccaaaactcaagataatggaatccaagtcgaaacttgggttcaagatgaaccgtttgttttaaatgtaattggaaatccattgactcaaatgccagagtggaaattttatgaagatgggtcctgtgaaaaagaaattgatggtaccatgaccctggtaaacacaaatgtcataacatttaaggaactggctctatctgaatatgaagcagattccggcattttagaatacgactggtataatgcgattgtagaatcaatgaaatacttcgagtgggaatatggcgttgttcctggttcagaatttcaatttgacatctcgaaccagttaatgcgctggtatgagtatgagatagtattggaacccggtgagaaaatagttaataccgtgactgctcctgtatatccatctatcaacaccaattatgagccccctatttacgaatacacatacctactgtctcctgcacaaagttggaaagactttggcactttaaatattatggtgaatacaccattttacatgacagaaagcggaccagaggggtttgaacaatcaaatagtggttacatatgcaagttttcaaatctgccagaaggtgaactcacatttactctctgttccgatcctaagccgaccgcacctatctttaataattatttgtcaccgatccttttaatttttctcggaatagtccttatatttgcaatcgtgattattgtcgttgttgttctaataagaaagcgtagaacctaattttccatatataaaaaagtggcggtacagtatagactgtaccgccacaaaaatagttatcctacatcatccattaaaggggatgattttatgatactttggaacatcgattctccggagtcccccgtttgatatgtgctattatgagatgtaatcggttctttctttccagactgaaatttaacaagataccaagctgataaccaggcttcgtaatgtgtttttgttataagcagtaattcgctaaagctttcaaaggtcatgctaatcgccacatgattttcaggtttatttccgaatttcgggactatcaatcctttatcattggcttgtccaggaccactgtcagctacaaataggaaatcagatttactgccacagagtagttgagctgttcttgattggctcattccatcttttcgagcgcggccttgctttgccaacttttctgcagaagtacctccaaggcactgataaagtggagttttatctccactttttttcttattctgcagcatatagcgaagctcaccgcattcagtctttctgcacagctcaagaaattcatctgctgtaatgtagatagatatataatttgtttgacgctgacccgccggacggttaagatcatatgtagcaaaaacaaaatggatcctgcatatttcaaatgcatcgcttaggctttcaacaaaacatccacgggcatccttgcgaataatttggttttggttgcgaatatcatccatgttgtttaccccctttcggaataggcataagctgcatcactacaagaagttcttcagaacttttctcgaactgaggtaaaaattctttctccatatcatagtccaaataaagcttaacaaaagtaagagcccatatattttccattagctcatcttttatttttccttcagccttgcggaagatggagcccagcttcatgatggtattgttccacttggaaaagaacggatcatcaatggaaattccaaattcattcaaccattcacggacagtgtgcgtttcagaatcgtcgccacatccaggatttgtgaaaatgtattcggttccatacattgcaaccggattttttacatttttattttcaaacctaatacagcgaccaataggaaacattgcacatacagctggttttgctttatgtactgaacattttcggtcttttagtaaaggacaccttttaatggagcctcttggttttagccttacgattggcattctggaatcgctgcctatataattctcgcaataagcgataaaaaagtcacgaggattcaaaccaagctctttcgacatattatatatatctcttggcgtcaaaagtatgtcttctcgatctatgcagcatttaccgcacatagtacagtggaatttaaacggctcatccaaaccaattttcatctgatcaaagttatccacgatttctttcaatctgttatccataattttgtacctccaaaatatttaaaggcgccgaaataattcgacgcctttttgtgattttacatcctgatcagttccaggtatctctgcctggaacaaattcaacctcaaggttttcgctgattggcatatcaggttcgccgtaaaagtcgttgtcacatttcgtatggatatctgctttgccttccttatacggactgacatcaacatatacttggccattcgactcataaacaggtctttcccaatcatctctacctttgtagtttagtataagttttttcatcatgatttcctttctgcctttattggctttaacgttttccggcaagtcttctcaaagcagcaatcaagcaactgttattgtgattatattggttgataaaggacttgtctaaatcaaagtttgaatacttatagtgaatgaaaagcatcattgctctcggcttatcacattccggcactttttcaagtagccttgcaatctcttgcaccgtactgtactcttcttcccagaatgcaaaatcctgattcgagcaccgcttctgtatccactttttgaccgacatttgcgggccagtattgtgatgcggttgttccatgctgataaattgttcataaccgccttttgcatcaggtcctaccgaaataggatatgtacggcaagctcgcggatttacgctgtgaatcgtgcatttattctctttcaaaaatatacaagcatcatcttcacctactgttttaagcataaataccaaataaccggattcatgcaacagtaccggctcagcataagcagccagaacatcatcaatagaacgcaccttttctccggagtctctaaagaattttgctaaccgaaatgcatcgagactttccagtggtacgctttcccgcactcttctgcagcaggcgccacattgactgcaccgaaatgaaaatcggtctgttgtttttatgggaaccatttttgttatgaaagctttcatatgatcttcctttctgaacaaaattcgatatctcatgagagatgttctaaacctgccatgagcagatcttctgtttgcaacatctgcaggcgatagaccggcatacaatgctcgtcctccgggaagatattgtttccatccggaataataaccctaagcactttacgaccggtttcctcgaattcatccaaacggatatcacaatcctcgtaaattccagaaacatagtcaccggcatgaaatacttctcctgactgtacccgcagtccaagagtgttcagaatgcgtgctatctcctcatcttttatgcgcaacacaagctggaaatccatatgaccgtatctaatcattccatgtgtatgcgcattacatgcatagggcaaaaaacctgtttcgatattgttgcaatcatcacatgctccatttgccacacagtgtattacccagtctattttgagcgacatattgatcctcctgatttttcaaatattttttcattgcgtacattgcctgatggagatcttcgtcaaacagattccacgattcaatgaattcctgcatagaatttgaatcaaacaatcttacttcactcaaacagaaaatctcaccattctcttcgtccgcaatgtcataaggcaggctaagaactccttctttaaccaaaaccaaaaaagttccgagatgtctaccatccgatataggataaggccagcacaactcattgtgatatttctcgcgatattcttcgcaaaagtccatcaatgcagagtgtgtggacccattattttggaggtatataagaagctgactcatgcttctgagctgcttcagatcaacacccagattttctaattggatgtgactcatatcatctgaatctttttctttcacatcaattaaataaagaaattctcggtctatgtactcttttatccaatctaatcctaagctgcgtttcagtaaaagatctgataatcccattccgagtgcattaaaagagacatctccatcatcacaataggtgtcttctctcactcggtcttcagcttctaccgtatcaaaaacgaagtccagttcagctaagtcaactctgtcattctgtatcgatatgccccagtaatcatgatcatccattgaggcgatacagtaaaaacaacgaccaagcagcttctgaagttcagatgatacagccttggctacatcaacccaggataactgtattgatttaatttgaatcattcacattccctttctgccatatatggcttgtaatatgttgtatcttcaagatgggactggtagacccctatgcaaagcctgtgttgagagtctcgctcaggattaaattctgcaaaacatatttcttcttgcggatcgtccgtattcctatcccaataaagattgattgccggaaagttttcatcatcaatggcaacggcttttaaacgagtgccatctggtaaaggtaattcaatgcttggataatcctccagactcatttcataacctcctgcccaactaattccggtatggtagagatatgaagcaaataatttgtgttctgcgtttcaaactgaatctcggtctgagaaatgttatccattcccagaacaggtgatgttctgcgcaaaaactctccttcacaaataagagcagatgctccaatttaaattgggcaaattaagctgcctgtaatctcaatacattttttttgctgattcataattgtgctcctttcaaataaatctgatttctaaagcgacgatttcattgtctgatttttgagcataaacgccatagcaaccatcgccatagcccgaaaagctataaaaaccttcctctgtaagccatacgctcccttttgctatgctgtcgcaaaatcttgaccattcatcatcactataatctggtttgttatgaaaaaaaccagccagtcctgcatctacaccgatggatcctatttcctccatgcttttttgaggtggaataataccatttagatatatgccaagaatcccaacatgcttttccgtgtaagattgctcgttcaccgaaaacttttcggtatgataccaagcaatacaggtatacaggccttttttgattgagatgttattcatccgacaccaaacattcctgctataacatggatccgtaacatctactgctccttgaaaatcctttgtaccaataatttttcgtctcataatcagcctccaaaaaaagcggaacagtttcctgttccgccatagtttgttccagcttattctgccagcatgttttcaaattcctgttcagtcagtgtaggaatcccgagttgctgagcttttgtcagcttgcttcctgccttttctccaacaatcagataatctgtattttttgtaacagaattcgtaggctttgcacctaattctaacagctttgtctgaatgccatcgcgggtgtaattcactaacttaccagtggccacaacagtttttccgaaaaacggattgttcgtatttgtattcataaaatgattctcctttataaactcaactttactcaataacggacgccagagtttggcttcctgctcatctgcataccatgcatagatgttatcgttcatgatctgtccgaaatcagggagggttgtaaaatcaaaaccggattgaattgcagcttcaaaatcttcccatgaaccatgaaaatgacgatccagatctcgaccagcgtgcctgccaaccatgggaattcccagaccggcaatgaacttggccaatgtacagctgcgacttttctcaatggctgcgtgaagacgttcataggatttttcaccaaacccatcggtattgataatctcttcacgatggaggtccaaatcatacaaatctccaaagttctgaatccaaccatgcccgataaacttctccaaagtgactgcagaaagaccttcgatattcattcgagtcttctcacagaagtggctaaacttctgtaccagttttgcagcacagcgcggattttcacagaatagctggcgagttccaccgctggttttctttacacttaatggttgtccgcagcagggacactccataggtaaagagtaggtgttgctcatcgtagcattttctgcaatttggggaatgatcatgttggctttgtaaaccttaattttgtcgcccactccaaactggaattcatcaaaaatgtccatgttatgcagataagctcgactgacgacagctccatccatattaaccggcttaaacagtccagtaatacttaccatacctgttcttgttgttgccaactccacaccggaaaactcagtttcatacaattcatcctgccattttagcgcgattaacctgttttcatgatgaccggtcgcaccaagactgcgcccataggagatatcatcatactccataatgaggccgtctacaggatatgcatatttctttggctggaaactgttaatggcttcacgcaccgatttatcatccacacctgcatccagatgaatgtaaggcactacggaaaatccattgtgctccaggaagtgctgctgctctaacttgctaccagactccatttcatcactgaccaaatcaaatgcccaaaactccagcattctctttttggcttcgccggcatccagtttacgaacactaccagctgccagatttcttggatgggtgtagtctcctcccagactgagattgactttctcgaaattttcccacgaaatgacgccttcaccacgaacctcaaaggatttctgagtgggtatggtaagaggtacattcagaaaagtgcgtactgtatgggtaacatcttctccgataattccttcacgacctcttgtaattgcttgatgcaatttgccattttcgtagcgcagcaccaaggtgagcccatccattttccaactgagtaagacaggttgaccagctgcaaatttaaccaagtcatcaattgacttggtcttatctgccgaaagcattggtctggtatggcgtactggtgtaagctccttcagaatgtctccgctaaccttttgggttggggaattggaaagaatcaaaccagtatcatgttccagtcctttcagttcgtccagtatgaggtcgtattcccggtctgtcataataggtctgtcatcacggtaataggcgatatctgcttcattgattatcgctattaactcaagcattctttcgtgatttgttttgtagttattcgcactcatgtgcaagctcctttcttataatatctggtcgatactttagattgaatggaatgtaatctcgccatttgggattatcaaaaattctgtctgcatgcaattctaaagcatattgctcaatttcgtgctttccatgcagccagagtgcagtttcctttatccactggcaaagatgcgcatataattcctcttcttgatttctactgatcaactcatgaacaagtcgttcccattgtgaaacctctatgtcaccaatattggtcatcactccggttcgataacctgtcacacggtttttaccgctgccagaaatcgtataggacctgccggttccatatcgcttccgaagatcttcaaattttaagccatctgaagaaatttctttctctctcatgccgggatctcctctttctgttgagcagcagaaggatttttgtcctgggacagggacagaagagcatatggtgtgacccattcggaccattcttccatcgtgatggtgttcccatgaacgacaatcccaggaatttgatacaagaacatctgaatataggccatccacacacatcggatgtcaatatccctgccaataaataggcatttcttttgataatctattccttttcgtttcatagcccatgcagaagcaagaaacatcgcaccagagccacaagcaggatcattgacagtaaatggcttttcgtcaggcaattcgtcaaccggatcaacgaacatggccatcatacggcaaatatggtcatccgtaaaaaattgtccattccattcattgttcagaccgagcctgtgataaatacttccaagaatatcgctgggttcctccgaatgctctttgacagccatatacatcaacgcaaacattcttgcatatgtagacagcatttcctgagacattccggagaccatttgttgatatcgtttttctctttcttccgcatatcttggatctacctgagcattaagagagacagcaagcatttcgagaaatgtggtaaacacattgtttaagccttgcgtttgtcctaatgtctggatttcttcgatgagttgttctgatgcggatttttgtacttttttagccatttgcatccctctctttcacttcgaaaacagggcctgcaattagcaattcgtcttctccgtctgtaaacaccatctcgtcaataatcaaactggctgtagactcagactcagaatataaacccagatctacgacctgcatccccctgagttcatctaatctgccatttgcgtattccccattaagatagatgcctttatactttgcatcgaatccttcaggagttcgatcaataccgctttcgtcccagtttaatgagacagtctttccacttgataattgaacttcaatataatcaattatcaggtccttggtttttgttgttccttgtaagataagagtcataaaacctacctccatttaatgattttatatataaacggggtaggcctgtaggctctccccggaatcaaggttgggggagcctcgtcagctccgatctatataaaaaaagcgctcaaagaaacgaaattctctgagcgcttttgtgacttagttagtcaagatgtaaagttgtgaaaaatggacggaagtccatactcccgttttttactgttctgtgcttctataacagaagcagaagacataaaaaaacgcctgaaatcataatgatccagacgttgtgttacctgataaactctaatttctcagttgaaaggaattccaaaaaagcaggcagaccaagaaatcagaattcttcttcaaaagaccaatctctctgatgtttgtcataaacagatgaccagtctctccggtggcatgaaacaacgtgtgctgttgattcaggctcttttgggaaatcctaaagtggtgctcttagacgaaccaacagcgggacttgatccaaaagaacgtatccggatccgaaatctgatttcggaattttctcaaggacggattatattgcttgccactcatatcgtgagcgacattgagtttatttctgataaaatcctgcttatgaaaaatggagagcttgttcggatgggcagtacggaagagctgctgatgagcgttgcggataaggtgcgggaattgccctgtgacccagggcaactaccggaactggaaagtcgttataaggtgggcaatgtgtcgagacgtcagggacatacggtagctcgactggtaggagatgacctgccgccggaaagcaaaaacgtggcagatcggcttacattggaagatgtgtacctctactacttggaggaatcacaatgatggaatggaaacgaacgattttttcaggccgttttctttgcctgctgctctgtgttatcctgctaaatggaattttctttttgaaagttcagtttgaccgcagtctgggtctggatttgtccggccccgagtctcaactttcacatagtgtggtagtgacggaggaaggaatttctcagtcagaggaattgccacaaattccattaaatgaacttaacaaggaatacattaccgttcttgatgaattaaaaagtctatcgttacaagaaatcgtctccaccctaacagaaagaatggagcgactatccttgttatgggatggctgtatactctatatgagacaaagagatagtgattttgacagagcacaatgggaggactatgcaaaacagcacctggaagtgtcggaaaacattatagacggatcaaccacccaagaagatgtttatcgagaatatgtggctgttcataccctctttttacgttcggaatcgctgatgaactttccagaatatttgcagtcaattgaaaagaacaaggattatatgctgacattccccatttttagagatgaaaacagcttttcttcacgaaacatactaaaaacggcagatgactttcagagtttacagaatgtgcctctctctttagagaatacaggggcaatagagggtattcttctttacagcggcagcgatctgtttctgattcttctgctaatagtggttgcactatgctttttggcagagcgaaaacgtgagctttggggacttgtctacagtttacagatgggcagaagctccttggcactgcatcgcttgggaatacttttgtttctttctgttacgggaacacttttgctttacggaagcaatgttcttcttggatcaattctttacggaggtatcggaaatcttcatatcagtgtccagtctatccccattttacaggagtatcccgttccaatttccattggtggttttttgatccaatatatagttctccgaattggatctgctttcctgttggggcttatactttggcttttattaggagcactttccgatgcacgctacggagtggttattggtattgcgtttctattgatcgaatacggacttcatcactttcttccggaacaaagtgcctacaacattttgaaatatttaaacctctgcacatattttcacatagctcccctctatactcattatctcaatgtggatattcttggatttcccgtaggaatacgccgagtatcagaattagctgctttacccttgatctttgtgatgagcagtggttgtatcgcacagcagtgttttcgtcgtccagctcagggaacatcatggatagatatatttacacgccgtttgggaaactgtttagatcgatgcctgaaacatcttcctctttggggtcgggaagtatataaaatcttgttttctcaaagaggaatcgtcatcttacttttgtttgtttatcttgcgttgggaattgaacacagtgttcccctgcggtctggaagtgaacaggttgcctatgaacggcagtatcttgttcaattacaaggagaaatcacaagcaaaaccttttcggaaattgatcgattgcaggaggaacagaaaaaaactattgagactatggaacaggcaaaggaagcttattctaacggtgaaattccgcgtggtgaatatatgtcaatcagtttcgaagggaatatcgcacagataaaactcgcagctttggatgaagttgaaagtcgagcagaaactctaaaacaacaaagtgaaatacaggggtttacaccctttttgctggatgaaacaccataccaaagtgtttatggggaaccagcaaaaatcgttcgacttaaatctcttcttttgattttgggggcattattattgcttttgggcgcgaatagtgcatatgagcgaaaatctaaaatgatacccttactccgttctgcaaaaaaaggtcgaaaaggagttctgtgtgagaaggtgttggctgcagtttgtatcacacttcttctctgggctgtgatgtacggaaaagaattctgggatttttatagaatttttcctcaggaattgtggaatatagcaccacaaaatctttccatattgtcccgtttccccgtttcttgtactctgacacaattttttataatgtattatttggcaggtggattttgcacgatgatcacttctattctgctgatcctctccggtatatatttgtacaacagaaaatagtctaaattatcttaacaaacatgatgtttttccccgatccaaaaaatagagcattatatctcaaacaaaaaagacaacagcagataactgcgttgtcttttttgctttttcggtaattataaatgagtaataaatttaagtataaacttataatagggtgattggtggatcttattcaattggcgttaaaacccctgttaatacatatcgtgcattatcgaactcataactgcaggtggataacgtaataattttatcagtggctgcggggatgacagggctattaaaagtggatttttcaatcgttcgctctatccatacagcgcggtcttcttcactatcaaagatgagctgccaagcttcatcttctacattagccacatatccggaaaaaagctcaattttaaaattttgttccggtgtcattagcagtaattccggatgttcatcataatacgcctgctgcttatatttcgtgatgctggaaaacatagagttgtttttcatgtggtgcccatatattatgttgttctcatccgtaaaatctgaagagtttctgcaatcaaggaagatacagccagcactattataactgccatcgaacatgtgctttaggtaataagtattatccttataatgcacaactggataattgattgcagttccttcgcaatatatccaggcaacaaaatcgttatttatgcttttcagtttctcaaactcgacaacaggtaatatcgtcttgttttcagactcagatgattccgtttggtgatctgtatttttttcttcagtcggcggggaaacatactcctcaagctctaaatacactttttctccagactgatattcggacatgattttataaacctgccatccagagaatgccaccacgccggtacatagcaatgtcagtatggtgcctattagttttttcttcatttttgatcctcctgcatctttgctaatttataaaatgtgctgcgcttcatattgagttcattcatagcagcaactgctgtcagttctcctctcttccatgcatgatagatctcattccagtctggtggaaactctgcttttggtcggccaaggtgttttcctttttcttttgcgacggcaattccttctgcttgcctttgcttaatagtaagtctctcctgctctgcaatacttgccaacacttcaatcagaatattattgatcatttcaaaaatccattcttgtccctccggtaattcaattaaggtcgtcgggaggtcgataaccattacacggatatggtgattcttaaaatattccagttcctgtttgatatgagttttgtttcgactcaatcgatctaatgatttgatcaccaatacatctccatctcgcagcattctggacttcagcatttgataaccttcgcgctccaaagatttgccgctggctttgtcagttacaatatctctttcatcgactcctctttcaagaagcgcttttatctgtctatcgagattttgttcgcgggttgacactctcgcatatccatatatctttttcataggatctcctttcagaaatctgtccgtaaaggctattttatttatagatatatccgaatacttaaaatagacttttatggacgcttatcgatgtcattttatttttgttttttcatttccacaaaggtacacctttatagataccttattacaccgattgaattattgaattgtaacattatataaactaatttctaaaatttattgtaaacagcttgatattgttcgccataatgaatataatataagtagtgattgaaaggagggcatttccatgggatttatgacatcagttgaagctggagaaaagtggaatttatcaaaacgccgtgttgctatactgtgcgccgaaggtcgcgttccaggagcagagaaaaaagcaaatgtatggctgattcctgatgacgctgaaaaacctgtggatgctcgtattaaaagcggaaaatacattaaaaatgtgaaacccaataaatagaaaacactggcaagtcaatatacaatagactggaggtgactgattatgccataccgctttcgtgacgcaagaatccagtctggaaaaaatttagcggaagctgcagaagaattatttgtctctaaaaccacactcagcaattgggagtcaggtcgaagagttccttctgtcgaggctatagaaaagctggcggatctatatggcgtttctgttgactacctccttggacgaacggatcaactaaatcctttatatgaagtatctgaatctgtcgatccacatatgttgcaattcctacacgaatgtccggtttatgtgaatcagtcacgatggggactagttgacgctgtgaatcataagatttgttttactgatggtagtgaattagcattttctgatgttatgcaaatctctatgctactccctgctttccagtcaggaagttatcctctggaaaagcctttgactcgttcggaaactgaaaattgttcacgcatttggttagaaccaatttcaaaagacgaaacgctgcgccaagagcttcgaggatggtacaatgtaaaaaatcgttttgtagaaaacgattttggtcaaaggttttattttgatacttacgggaataaatggttggcatttcacaccaatttataattgaacaaagtctttatctgcaaaggttttttaagaagcggtgtgagatctatcgtctcattgttttcgtaaattaaagtgataaagtagttgaaccaggaagcattttatgttaatacaacatgctaaatgtaaccttaaactatatacaatttaataatgatagaaagaagattaaaaagatgagaaaggaaactctataacaatggttaagagttagtagcttcctatgatagaaaaaagaatacacccagatttttcagtatacaaatttgtttactttaggaatcacatgaaaagatgtgattccttgtctccgtgctttttagcgccttgcgtcagcctgtccatttggcaggatgatacaaggcgcctttttatttttggttgaaaggaacgaaaagtatgaaattgaagtaccagtgtccaatttgcggaacaccattacgatatgaaggtttatgctggaaatgtcagtctgagcaaaaccgaaaagaaatcatggaatggacaacagaacaaatcaaagaaaagcaaaacggattgattaagaatatccaaaagctgaatgatatggaggatccggaactcacagacttctggcagctgctcagttaccgtgatgccatcaccccggagattcagcgggcggcactggccgctgaggtgttctggccctgtgagatttattaccgtgccccggcagatgttcgggatggtctgatttctgctttattggaaacagataattcccatgaagctgggatcctcatgtcctgccttgctatgcaaggagacgataaagctttggaaacactgttagagttagaacgaaatcctcggccatggcgcaaaggattatatgtggatccatccaactatgcacagatcggtggatggacctttgacaaagaaggtcatcggacacaactcaatttcgatacctgttatcccatggtcaagggggatcctgacgaagcaactcctgttcgcatcggtcgagcacgagaagacacctgccctcactgtggctgccaaatggtggatatgcttgtgttggatggtcgggatgaacggcttaaatttctggggctggatggtatattaactgccacctgctgtcccaactgtgtcggatttttaaaaggtcccgcatttaacagctttactctggacggcggcgcaaaggtattcccctcagaactctttgacggtgcggaaaagacagattgctatgtgcgatcggaggactacaaagccctcactgaaaatccctttgtactggggaaagcaccagtacccctgttctacggtgccggctgcgaggatgtgaatacggtaggaggctttgccaactgggtacaggatgcggaatataccacttgcccgcactgcggaaagccgatgaaataccttgcccaaattcaatgggataccgtgatggacggcacggaaggaactctttatatcgagttctgcccagagtgccaaattgtttctatgcagcatcaacagacctgagaggtgatttaaaatgagtttaccgaaacgtgatggcgtacatggccgttattacctgattcataaaccagatacgaatccagaagtgctggaacacgccgatcagtgcattcaggatgtgttggatggaaccgcaaaagaaaatcattccggctacccgatggtagttcggaaccaaagcggaacgccctttcttcccagccaactgctggatcggtatctgtccaagctgcctttgaaggggtttccctacgaggaggcggttgtattctgcgatgcactgcggcggttggtgggctggaaagagattgattacacactggagcaatacatcaaacaccaagttcaggagaggtattttgaggttggagaaaaagaggatgattttacgccttacccgccttgtaccgtgtggtcagaactgcagccggaagatgtggacgagaacctgctgcgctttacctgttatgtcgcggtctgttatacggtgtatggagccagctataataccattacaaccgaacactacctcaatctggtttcccagattcgcccgaatatggtaaaacagctaaaaacaggcggcagcggcaaattgccaaaggacattcagcagcgtaaaacggagcatttcgccgcatcggccaatgatgcttttgccgccatccgcatcaccgccagggactccactgaggagtgctatgctgaaatcctggactacctgtgcgcggtgctggagcaggaggaatttccccgcagttactcggtggagttccgtggaaaggaaaaactctacctgcccattcccggcttgcccaagaagggagtcaatcagctctttgcctgcgctgtgcaatacccaaatttgcatccggctatggagcgatacgctcgtctggctatgcgggagtatgaatactaccaaaacctcgcggatgaattctgtgcaatgcccggcacatttgctgtgtttgctctggggctggagggaccacagtggtgttcgctggtgtgcgactatctggatctgtgtgatgatgaacattcctctttacaggagaagtttgttcatgttttcatcaagaagttcggatttacgaaacagactgtgtctgtattggtccacggcgtccagtctatgcaaggtatgaaaccagccaaggagttccgtactctgattgctaatgaggaaagtctgaatgctctgatggaagtcaagggtcatttagaggactacctgccggaagaaaatcgccaggataaaagatcccaggactttctctggcaagatgtgctttggggcatttgggggcaagctgcgcaaaatggtggacgcaaggtcatcaaggcagctcctgcacagctgcgggagcggtatgaacagatatttcactgaggtggaacattatgaaaaagagaacagttaaggactttattgccctttataactcagatgatgaggaaaaattggcgctgatccaaagcggcaccagtgctgataaaacatttctggataacttctggtcagctcatacctgtgcccttgctatggcagatgtacagactggacaagtgatctctgaccgctgttacctgaactggccattgacagataaagaaagagaagccggcgaatattccaatcgatttgcgaaaggaaaggtctatcgtatcaaagttcgaggctggaaaggtactgcgctcaacgaaccccagtggtatgttaccgaagtgctggaggaggatgtttcctgcccggctctggacgatatctgggcggagtacataaagcccattgttattgaagatgaagcgctgggaaccatcacgctggatcgtgagatgagcacattcgatgggacctgtaagtggatgggaaaagaagtccagatctcgttggatgtggagattgaaaagaaagcgtcctggacccgcgtgaccaatgtgatgaagaaactgctggcagatcaggaagtctgggataagtctctgcgaactatggctgcccagaagctcacggctcaggccaacgaatggctggccgacaatgaccagactgaccgagacccggagaaagaccccatcaccgaggatgagttcgcccggcgcatcctgctcaccgagtttacagtatctcctggcggacgatttaccgcctggtatgaggatgatgatatgttctggggccatgtagtcatggtagatgggacactgaaaaaaggccccattggtgcagatatgcagggataaggagaggagaaaacctaaatgaacagcgagcaaatcacggcttttttacaggaacattggaactgggtaaccctgattattggtgttgtcctgctgatcggggcgatcatgaactggaactggctctgcgaccccaccggcaaaccggactctcaccgctatggtcgtggttctcggcgggtgatcttctttctactggggattgtgctgattgtaaccagcatcatggcctgggtgttataaggaggcaacaaaatgtcattcaaatttacattccgagagatcacctcggaagatacggaaattttgcgtatgctcaaactacggaacgcaaggccggaggatcatatttgctgcgagatcctaagaggcgacggtatcaccatgaagacttggtacagcaaggcagatattgctctattgggagaggactacatcaaggccaattccaaaatgaaatatattgacggcgactggacggtcagcttagacatggagccgtggaaccgcacacacggtgtatctccaaaggaagtcatactcacatcctctccccgatatccttcctggttggaaggccatgtgaaagagtgggcgcagaaacgcctgcccaccgtgacactttcttctaccactggcaatgaactgctggaggtttggtattacggagatttgctcacggtgaaaggagagccccaattctatattatagatagcgatgaagcccccggactggtggcagctcgcgacccagagagcggcgaggagtttgtcatctttgatggtggacggcatggctacgacaatatgttctgcgatgaacatgatccagccgaactgaagaatcgtcctctcaagaggtatgagattcccgcctccaagctggtgttggagctggggtacagcgtagactacgaggacgaaaaagaggacttcgaaccggatgaagcggataccgtggaactgatcaacggcgagcgtatgccctgggatcaggtcaagcgggatggtattgactatatcgccctttactatgtgaacgagaaaggaaagcaggttcagattttgaacgcagagttggcatgagtatgccatttcatctttcgacaatccgaggaggtaccccatgactcaagaacaacagctccgtctctaccggctcatggaaaagctcaactggtttttccatcaggagatgcactatttggataaagagattgcggaacagactgcacgggagtgctatccggagattcgggagtttacatatgatattttatggaatgacctgcccaaagaggtacaggagcagatcatggacgaggaggaatccctgtgagtacgctgatttgctcttttgatggcctgcacgacaacagagtcctgcgctactgcgctgactttgaagcccataccctgcacatggagacccagactgagaccggagagaaagtatccgttcgcttcaccggtctgctggcccactggtttgaaaatgtgatccaggacaacatcctcttcggcatggatgagatcaccgtggacggtttttttgaacagtacaaagacctgctgggcgggaccatctcttacggctttcccgcctgttgcagcatcgaggagctgcgggagcgcatggaccgggagcacatccgggtatttgtcatcgactcttcccttgggctgtgcggatttgtactggctcaggaggtggaactgcaatgtctataactgcctataaagtagaagccgtcggtcatgaccgaactggcgaagactatggctatgtgaatatcatgtaccgctatggcaacaagcagtcctgtcctcggccagatcaatgtgaaaagatagaggtcatgtgggcggatgagagcgtctacggaccgcctgctcctggcagcaaggtgggcgactttataaagacatggctgatgggctcctgggactgcggagtatttacccaccgggaaattgcccagcggctcatggataccttcaccggtttgaagctcaaggaactggcgtggtttgagaaccccagagaaaagactctgaaaaacggcaaaccgcgtgcgcgtcgagctaaatggctgccagattgcgaagtggatctggtgtacctctattctgaccattatattgacgcaagaaaaccgattaccactgaaactgactttttcacggtcacaaggatggactcttggggaatgagcacctggttcatgtgtacctcggaggccgccgagaagctgatcgccatggattatgacaatctggccgtcaaggaaaccaccatcgtgggataggaggaatgtgatatgaaaaagctattactaatactattcgtcattctaacgattcttacattcgcaggtgcaatctatgtcttaacatcaaacggtacagcaaatgcaggatacgcagcagtaccattgttatttgatattgtgtgcattggcggttacaaaacatacaaaaacaaagagtaattgatatacaagataatcagaaaaaaggaaggggttaaatagagatgatgaggttagaacaactgccccccaagggcgtaaagcgagaacaagccattttggagctgggcaaggatgaagcaaacggcgaactgctgttccagcttgtgaatacagaaaagggcaagtgcaaaacagctgctcaaaaggctttggcacagctggagtatgcccctgctgccccactgtgggccaagctggtcaggggcaaatggatgggcagcaatatcatgtcgaattcctgttccgactgtgtatcggagcagatcgcgccggtcatcctgaagacactttcccaactactggacgatggagacacaaagccactggatatcgaacaactgaacttctgtttccatttgatgttggggaaagcctctccaaaaatgttggaggtctaccgttttttggcggaaaacacccatcggatcgcccagcttaaacgtgcgcctgtctattctcgtgatgattgcacctcttggtggattacggacgggcttcgcatttgggatgccacacccaaggaaaaagagaaaattcccgctgtggtgctgactgcctccctgatccgcaacccggatgagcgactgcaagcattggctgatgagctgaatgaacgctacggcggcagctggctgatgccggtctttatgaaggcgatcatcacccagcccaaggagcaggtgtatgagacctattcgccccttctggatacgccgcaaaaagcctatttgttcaatgcgctgggaatgctcctttaccgctgttatccggaagactgtacctatgaacgcctgggtccggatggaatgattgctctgattttctggggtgattatagctatggaacctatgacacaaggttcatgtttgaacggtatgtggatctggatgagcggtggctctttgatctggctaaagacacggaaggacgaaaacctacggtgacatggcagacttacaaccggggcggtgttctgtatggaagctacgacgaaatgttcatcagtctgctgccccgcaaggtggaaaactcggaactgaagcgtattctacgagattacttccgtattcgcagcgaaaaagtgagagtggaagaaagtattactgtttacaaagatgctgctgagcggttcggggatgaataagaattgaaacaacaacgaaagtaggtgccttatgtaccaaattgcatatattggccgctgggagaccctcccggaagcggctgccgccatctgtgaccatgacacttccaagcttgaagcaatgcttcaaggtgggttggagctgaatgctcccattcagctcagcgagtatatcaaactcacaccgctggagattgcggtttttcggaatgatgtgcccatgattcacttcctgttggagcatggagctgatcccggtctggcagaggaacagccccttctgctcaccgccacccgttgctgtgggccggaggtggtggcgctctttgctggacaagccgcacaactcagccctaagcagaaagagcgagcctttcaggaagtgcgctggggcaagcgcccggagaatatccaggtgctggagcaagccggaatcacagtggacaagtttggcggcgaggcattccgggccgctgtgtccgatggcaataccaaacttgcccgactgcttctggaaaaaggggcagacatcaattatcacaagccggacatggtgtttccgaacgcttccaccgctgtcaccgaagctgtccgacacaaaaatctccccatggtgcgctggctcattgagcaaggagccgacatcaccattgctgataaatatggtgaccggccttacaccgtggctgtgcagaacaaagatcaggagttggccgactacctgaaggctctggaaccggaggaatggcataacgaacaggaaaagattcggcagctcatgccctataagttgcccgccaagctggtgaaatacttgaaaactggcccgctgcgtctggagttcccggatcaggaatgggtgaagtgggcggaactctattcctttatggatgtacaggagatgacctggaaacggaagaagttgctctccctcatggttcagatggataactacagcgattacctgctgctgtggagccccagggacaagaaactgtggtacttggatatagagcatgaggaattccaccctctggccaaatgggatgacttcattgctgatcccggcaggtacttgaacggaatgatcgagggtgagtttgaggaataaggagaattattatgacatcgatagactttctgaacaaggtacataaaagcctggattcacaggaatacaacctttcctattctccggcgaagtcaaagaactatatgctatactgcaacggcaactttatcggcggtctgttcgatgaggagctgtgcttcgtctacgccgacagtgtgagtgaactgctggggaagccagaacctgtctatcggggatactccagtaccgcacagcacagaatgctggtaatcccggaggaacactggaagaaggcactgaaactgctctatgccgagaaatttgactggagccgtttggtgtacgacatcacatacaccagcattggcgcggctgtggtagaggaattttacgacgagaatgtggtattcttgcgcttctgctttgaaaaaggattactgaaaaagaacccgctggaccggcagggccgtatcctgcgtatggtctatatcaaccgggatctgaccgataccggtaagcatttgttccctgagttgctggacaagttccttgtttttacagatcgtaagggtaaaaccagtctggaaaccatgctgaaacggtggtacatcgcactggagaaggaataccagagtgtaataaagggataaggagaaaggcatgatgaaagaagaaaacaaagcatatattaccggtttagatgtccgtgatgttccgtggcaccggcttaccaccgcctatggcagagggacagattttcctgtatattttgaaaccctttccaagatggacgatttaaaagcggttaaaaacgctctttatgagcttaccacgaatatggagcatcaaagcaccttatggcatgcaacaccttttggaatgatattcatgagccgtattttagtagaggctttgaataaaagcaaagagaaccctattgccaatttccttgcagtcgagcttttagactttttcctctgtattctccagtgctatcacgatggagatgagatggaacacgctgctcctctcctctgcttttccgatatgctgaaggaagaatacctttggtcggaagaatacgacgaggaagaagatgaaatgcggtacgaggaagacgaagtattccccgatgacttgttctacagtttctattactattcttggcaggcggtgctggcttaccgaggtgtactggagcaggaagtctccacggagtttggccccaagatcgcagcagttctggaaatgctgtaaaggaggatgcgcaatgtttgaagaattctatgagatgtacgagcccgaggagcaggaagtggtcgctctgatcaatcgctgtattgggggcggatataactggaaaggcaagttttgggaaatgaccgttgtgacactggggatcatgttctgtgacaccggcaaggttaccaccaaagagacgcacttggattggccggtcaccgacgaggaacgcaatggcgacaagggctggggacgctttcaaaacgagcagatctgccgcctgaagattcgacggatgaaagaagaatgggcaaaagatctggtggcgtggccctggtgtatctccgaggtggtcaaaaccaatgaggactgtccggagcttcaggctgttctggatgagtatcataagcctgtagtgattcaggacgaggtgctgggtgagatcactctggataagaactacggtgtcttcgagggagaaatcaagtggtgcggaaaggatgtgctcctctctctggaagtcaatgccgaaagtaagccctcctggacccgtgcccgcagtgccgccaagaagatgttggctgattgcgaaaactgggacaaagccatgcgggagcttgcagcaaaggacctgaccgagttggccaacaactggctttctcaggacgaggaaaacgcccgcaacccggaaactgatcccatcacagaggaagaacttgcccgacgaatcagcatgacgagcctgtccgtcacctccggcggcagcttcaccgcctggtttgactgcgacgagatgttcaccgaccatgcagtaacggtctacggttccttgaaaaagggtctcaaagctgccaacattgaggggtaaggagacgcctatgaaactgtatgagtattggcttggtttgcatccccttgattgggaattttgttttatgtcagtgcaaacctataaaaacttcatcacagagcaatatcataaaaacaccgatttttacaacatttcagcgggttctattgagaaggtattggcacacattgacgccattttatctgcggccatggagaattggaataagaccacgaaccatgctgccctgcgttgccccccaatgatctttcctctcccaaagggccaggagagccatgcagcggaatttgctgtcattctcaagatggatcatgacggagacacagtagtctattcgccaattccattaccccatctggaaaaccaataaggaggcatttctgtgaaactgaactgtaaacgcattgattttacatatacaccaggcgaggagatcttcacctttcccgaagaatcgggactgtcctttctcttcgatgtagatgaggaactgaccgacaatcctgctgccatggatacggtgggggaaatgctggatgaggcagaaaaatttttttaatgatacggcgaccaccgagatctacacgtactgacacactctttccctacacgacgctcttccgatctggaacggtagtagatacggcggagcgtcattacaggaaattcctcctgcagattataacggtttaccacgcagaacttttttactgtatgtgcgggtgtgccgtcttcccaacggggtctgacctcgctgtttgtatcccatgagccgtgctcgattatgtcacggcagttttctataaaatatttatcggctaaactcattataatcccttaaattaattatttaaatcagctttagaaccgctgaaaatcaaaaattatttatattttcgataacagctttgttgtcgagaaatctatctggtcaatcgtgcggctctcgaacatattgaggctgtcgataccgctcatattgtagatagaaacacctgcgcttgaagcgtatgtctttacgtttttaagcagcgtctgcgcttcttcgggataatcgtacttcttctcgtcatttacaagagcctcgtcatagcttgttatctgagcgtcgtaaataccgtcaaagccgtagatgtatatttccgagaagccctcatacaaagcaagctgtaaagcaatatacagatcatcgacacgtcttaaagcctcgctgtgctgtgtagagccgaacgagggcagctgagggataaagccgttgcccattatattgaagtaggtaggcttcttttcaaacttatcctcaaatacggtcacattgcttgcaacaaagcagtccatagcttcgatatacttgccgtttccgagataatgctcggcatttgacagtatgtactgtgtgggacggagaggtgtcttgctgaagaacttgcatataccgttgtagcttatgcacttttcattgaacagcaggttcagctcatcgagctttacaccttccttatagccgataataaagcaacgctgaccgtggaacttatccttgcattcggcaagctgcggctcggtgcggcggacatccttttcgagcttgttctgtgttgatttgtcggagatgttgaactgtgaacgtttcatcttcatatatgtgccgagaaagctaacaggctgatttacaaggcagtagtcacgctctgtaaagccgtactgctgtaaacgcttttcgatagactgtgcgcttccgacacgtcctgtcatacccttgagatatacctcaagctcatcgtatgacgatgaaacaagaacgtaatatgcctttgacatacccttaagttcggtgatacttctgatagaattatcgccctttacaagcgtgcgctcatcgtttgtagcctcaaacgcaagctcgggaacacggacgcctttttttctgagctgaccgagaacctttttcagtatctcgccgttaacgccccgtccgtcaccaagtattaccagcttacgctgaccgataatctcgatattcttgattatctgctttttgtagtttcccgccttgaaaaactttgtcagctttgcattggtaagagaatcgtacgtcatcataattgttcacttctccttttcaaatatatatttctctgaatttccgcccgttaaaccgctcagcgattaatcctcgctgagtatgaatggaaagtctgatcttcaattttataaacctcaaactctcccgattgctgtgctttaagttaaacccgaaaacacaattcacaactcagcgattaatcttcgctgagtatgaacatatcataaataaccttgatagccttctcgaagtcagcctcgtggatacctactatgatattaagctcacttgaaccctggtcgatcatctttatattgatgtctgcgtgtgataaagccgcaaatattcttgtagcagtacccttcttggacttcatgccacgtcctactatagcgataagtgcaagatcgttctctatctcaatatggttggggtctgttacctcgcatatcttttcaacaatgtcgggggtcttgtcaacgtccttgccgtcaacaataatgctcatcgtatcaatgcctgtggggatatgctcaaagcacataccgttagcctcaagcactgtaagtattctgcgtaagaagcctatctcgctgttcatctcatccttttcgattgagataacgctgaagtgctttttacctgcaatacccgtgattatgtgctgaggaggctcgttgtcctctgcaactatcattgtaccctttgccgaggggtcgttggtgttgcggatatttatcggaatctttgcgcttcttacagggaagattgcggcctcgtgaagtaccgatgcacccatataagacagctcacgcagttctttatatgtgatagactcgatgaccttaggctcgtcaactattctggggtcagcgataaggaagccgtttacgtctgtccagttctcataaagctcagcgttgatagcctttgcaacgatagagccggtaacatcagaaccgcctcttgagaatgtgcgtaccgtgccgtcgggattagctccgtagaatccggggataacagcgtgtgaaagaccgtgcagcacagacgcaaggcaggtatctgtgagcgtatcgtcaaactttccgtcgggacggaagaatactacctttgcggcatctacgaattcatatcccagataatttgcaagaatgataccgttgaggtattcgccacggcttgcggcataatccttaccggctttcttgcggaaattgtctataattacctcatactcgtcatcaagtgaaagagtaagtcctaaatcgcttataattccgttgaaacgctctgcgataggcgcaaactgattgtatgcgttcttgccctcgtttgcaactgcgtcatagcacgcatagagcatatccgttacttttatatcgtccttgaaacgcttgccgggcgcactgggaactacatatctgcgttccttgtcgcttctgattatatcagctaccttgcggaactgatttgcatcggcgagtgagctgccgccgaacttgactaccttactcattttttaatttcctttcttgtataccgtttacgtccctttttatgttgatttttacggattttatagtatgggactatattctataatattttaccacagtaaaaaggaaaaatcaatatgtgaaggtgaattttaaagggtttgaggtaaaaaaaggcacattctgcaaaatgagcggaatgtgccgtagtttgtagaaaaagtcttttgcttgaagtgccttctgttatatcattcagctttggctacaaaggcaagctaccgatagttctttttgtcggacagcacttctcgggttcgctattcaaatcaatgcacctgtcaatatgaaagagggagacaaccaaagggatcaggtacaagtctgagccttgctcacgaaaggctcgtgcactccgctaaagctccgctggacttgacagcccctctccctgtcccttaggttttctcccaaatcagttattcctcttgagcgacgtgaggagcgggagcattgctaaagcaatgcttagcttggcatccctctttccttactcacacccccaccccgtcggggtgttggctaaactcgaataaccacctgaacattgtatgacctgttaatgcagggacgcttaacgctacacgtccgcatattagtacatatatctcaggttagtagcgtttttttgaaaggtcaatgtcagtgcagttgcactgatacactcacgaaaatattaactacttatcggtatggaagctgtttttggcggtattagcgatgagtttcaatgtacgatttaatgataaatcggtttttaaccggctgaggatttaccctcatcccatagcaagcgccggagtttcactctttctcagccttgcagtctgcttttgcgccataacaagctcgtaatatacgcccttgctttgtaaaagctcggtatgcgttccgatttcggctactctgccctttttcagcactataagcctgtcggcatttgcaagcgttgacagcctgtgagctatcgctattgtcgttctgccctttatcagcctgtcgagagcgtcctgtatctgcttttcggtctgcgtgtcaagcgatgcggtagcttcgtcaagtataagtatcttcgggtcgtgcagtatcgctcttgcaatagctattcgctgacgttcgccgcccgacagattgtagcctcgctctcccacaacggtattatagccgtcaggcatacgggtgatgaaatcgtggcagtttgccgtctttgcggcattgactatttcctcaaagctcgcatcgggctttgcatagcggatattgtcaagcaccgtaccgctgaaaagatacgtttcctgcaatacaactcccacctgcgaacgcaatgagttctgcgatatatcccgcacgtccgtgccgtctatcagcacctgacccgatgttgcgtcataaaggcgcataacaaggtttataagcgtggatttgccaacaccggaatgtccgactatgcctatcatctcgccttgctttatgctgaacgaaacgtctttcagcaccgggttatacgccttgtagccgaaatatacgtttttaaactcgatatcgccctttatatcaaggctgacagcgttctcggtgtcgcttatatcattatcctcttcaagtatctcgaatacctttcctgcgcttactcttgcctgtgcaagcactctgggcaggcttgtaagccactggataggaccgtagagcatagcgacataggttgtgaactgtatcagctcaccgagctgcatctctctgccgagtatcatactgccgccgaagaacagcgcacagaactcgcctatgctgaatatgtaacggataggcggctgtaccatataccagagtatatcggctttctttacagaatctgcccatttcgcagaggcatttctgtacgcttctatctctctgtcctcgttgccgtagttctttactacccttattccgtgcagaacatcgtgcagaagctcgcttgcacggcactggaagcgccacactctgccgtatcttacgcttatcgcattgaacgactttaccgaaaggaaagccgcaagcggtaaaggaacggtaattactatcgccagtttccagtttgtgatgaacataattatcagaagcgcaacaagtgcggtcgtctgaaaaatcatgtccttgccctgccttgtcataaagtcctgcaatgttgccgcatcgcccgatacacgattgataagctcgcccggagtacgttttgcaacattgctcatggatagctgctgggtcttgttgaaaatatcacggcgcagatccctgccgtatgccgttgatattttatagttgcacacctcctgcagcagcctgaatcccatagatgacaggttaagtacaagaatgcacagcgttatcttccagaaaagcccccagtcgctgttattcggcactataaggtcgtctaccagtatgcgctggaacagcggattgataacgtcaaaagcatacagcacgaatgttgcgaaaagcgacagaccaaactgcaccttgtacggcgcaagcctttttacgagctttaaaaacacgccctttttcgcatcacagaacatacatttactgctgcctcttagcgccgctccgcacttctgacagcttggctcgtctgcgtccgtatgctcggtaaattcgcccgtagcaatgtaatgctcatatatctttgcaagctccgcatagcgcatataatacttctgcgaaaactgacagacgcatatgtccctgccgtgcatatcccttacgcacagcatcgaacagccgataagctgttctaccgttatcttgcttatatccgatacggcaaactcccgtaccgctttatcgtcataatataccgtgagcttgtcctttgtggcagtaagatgcccgtttgcgtttttagcctttttgtctatgtcaaacggcagtgaaaagctcacgctgtcaatatccacgcctttcggtactgacagtttcaaattcatttatacccactcctttctgcaaaggcaataaatgcggtatcagatgaacagctggagctttttgatgcttgccttgtccagcctgtcaacatcaggtacgctgtagcggtttccgtctgcgtccgtcacggcaagcatctttccgtgtatcactctgaaattatgccaccagtcatacacggctattttcttttcacctgccgtagtatcggcttcaaggaaaagataccccatctgattatccgttatcctgtgaatcttctttatctcaggaatgtagtatttgagcttgagataatcatcggctgtctttttagtatcagccgccagatcttcaaggtcctttataacgcctatctctttccactcgtcttcctcattcttatagcttacgcttatatacctgttttcgtcgttgaacggtacgagccttgtaagatcgaccttttcataatccctgccgtcatacgaaaactcaagatagccgctttcggtttcggtaagcccgattttatcgggtgaaagaatgttaagcgtatccacatcataaattgcagttgtattctgtttcataagcgctcctttctgcgtcagtcaagtccgacagatctcagcgactcgctttgcagcttatacagctcgaagtattttccgtttgtgcgtatcagctcatcgtgagttccgctctcctttacctcgccgtgttcgataacatacagcttgtctgcgtcacggagcgttgagaggcggtgtgctatcgcaattatcgttctgccgctcttgagattatctatcgcactctgtatcttacgttctgttgctgtatccatagccgccgtagcctcgtcaagtataagtatattcggcttctgtatcagcgcacgggctattgatatacgctgtttttcgccgcccgacaggcttacgccgccgcttcccgtaacggtatcgtacccttcggggagcttcattataaaatcgtgagcgtttgcgctttttgccgcttgtatcacttcttccattgtcgcatcgggtcttgcgtatctgatattgtctgcgacagttcccataaacagatatgtttcctgtgacacaacgccgatattctttctgagaacgtcaaacggtatcttctttacgggtatcccgtctatcgttatctcgcccgatgttacatcgtacattcttgatatgagattgatgatagtcgatttacccgcacccgtcttaccgacaatgccggtaaatctgcctgcctcggtagcaaacgacatatttttaagcaccggtctgcctgcctcatattcaaacgttacatctctgaaacaaatatcgcccttcagaacaccgtccggtataacggcaggctcagcgggcggcttcactgtaggctcgctgtcgagtatttcaaacattctgcctgcggcatcggtacaccttgcccagtcgttgcccatatacataaagaagaatatcggatcccatataacgccgaaatagtttatgagcagtgtcagtccgccgagctgaaggttacccatcagcacaagagcaacgccaagacagtatataacaccgctgaaaacggcatatattccgtgctgtacagggaagaaatgagcgctcctcttatcccttgcgtattcagccgaataaagattattgttctttctgccaaaacgggatatttcctgttcctcacgggaaaacgcctttactaccctgtgtccgttcagtgcgtccgacaaggtagacgtaacacctcgtcttgcaatatcacggtttctccagtgccttctctgacctctcagccaaagcacctcgcacagcagtacaaagaacacagcaaggaacatcgacagcgatattatcgggttcaccataagcataagcacgacaagccctgctatctttatcatattcgcaataaactgcggaactatatcaacgaaaaatccgtacacgtcaaagctgtcacggtctaccctgcccataagcgagcctgtctgcttagtcgtgaagaatgacagcgacagcttctgcatagaagcgaaaatatccgtcctcagcttatgtattacctgcggtgttatcctgcttataataacaccgtagatcatcgaaaatcccgtagacagcagtgagaatgccgccataacgagtatcacgaacagtatctgcccgtgcagacttccgccttcactcagaacgtcatcgtacagcatttttgtgccaaaatagggagcaataagtcccagcgccaccgataccgctatcagagcaagtatcaccgctatctgctttttgtagtcgccgaacataccgagcagccgcttgaacacccatgtacgcttggtgcagtacgggcagaaggctctgttcgggtcgggatattttctgttgcacttcggacaatacagcgtcttgtcatcaagtgcggaatcgtcgggcgtttcgccctttttgatagtttcataacagcggcagaactgctcgaatttttcggaaaaccctcccgaaaacatcgcaagctgtttttccgtgccgtccgtcatcttcgccatcagccttgccgtaaactgatagcggtcaacatacagcttttcgatttcctccataggatattcgctgaaatccttgaaatcaaactgtgtgtcaaacgtctttttattctttacaagtctgtcatagcctgataacagataaagcgttttgttatcaaacgtgatgtaggtgtcataataacacccctcgccgtccatatctgcttttacacagtataacagcttatccgtatcgaccgccctgacagaaaaagctgcctgcacagcggcagacagcttatcaaaatacttcattcattcaccgtttctttccgaccgtaaatgcggtcttgcgaaacacaaaaagatacggcatcagagcgatttactttttgcctgccgtgcgtgtgcaatatctttttatgtatttcaaacgttacggcagccgcaataaaccggcagattgacagatgcagaccgtcctacaaggctcattacaggcttccgttctaagaattttcttctgacagcttatctgtaaaagagcatagcatccccttgttacagatttgcccatgtggatattatattaattccgttcctgttttccttgtatgtcggtcaatgcttattatctgtacattgtgcttgccacttcggcaagaatgtccacgcccttttcaatctgttcgtctgtgggagtggaatagttaagtctgaatgacagacaaggagcgttttcatcggttaagaatgcgttgccgggaacaacagctaccttgttctttactgccttcttgcagaagtaaggcatatcgccgtcgggaagcgtaccccagataaacagaccgccctcgggttctgtgaactttatggacttgggcatcttcatcttgaggtttgtaagcataagatccgacttgcgcttgtagatctctctcagcttttcaaggtgctgttcaaaatcgttttcggtaacgaacttataggtgatcatctgcggcaggatagaggtgtgaacggttgaaacctgcatacaaactacagccttagcgattacgttcttgggggcgcagaggtatcccacacgcagaccgggggcaagcgtctttgagaatgttcctgcataaagaacgttaccgttcttgtcgagcgactttatggtaggcacattttcgcctatataacgaagatcgccgtagggattgtcttcaaggatatatacgttgtacttctgagcgagcgcaagtacagccttacgcttttcaaggctcattgtcttgcctgtagggttctggaagttgggtatgagatagatgaaagccgttctgggattctctataagagccttttcgagcttgtcgatatttataccgtcatcttccatctcaacgcctacaagcttagcattataggaacggaatgcgttcagcgagccgatgaatgtaggagcttcgcagataatcgtgtcaccctcattgcatatctccttggtcactacctcaatcgcctgctgtgcgcccgatgtgataaccacatcttcatcattctcgttgaacataccttttttcttaaggtcgtcctttatccagttacgaaggggagtatagccctccgtgatagaatactgaagtgcgtcaatgggcgtggttgtaagtatttcatttgttatacgggcaatctcttccgtagggaaagcctcgggagcgggattgccagccgcaaagctgattacctcaggatctgccgtaaatttaagtatctctcttatcgcagagggctgcaatgtctgtactctgtatgaaaatgcgttcatatttatatgtcggtcttaccgccgcataaacggtatgacctttcctccttgcatttattttgtaatgggtgagtggcatattgggtctgccgctgttacaatagctatattttatcacatattcaagcggattgcaacaatttttacagcaaacagcttttaatcacggcagattgcggatgtatttcggattttcacggaacaatcgcttaattccaaacgaaaaatgttgacttttattaaaaaacgttttataatttaagtaacggtttttgccgtgtaattcaaaaaacggaatgtttaaatactattcggaggtaacaacaatggctttttgcaacaaatgcggaaaccagctccccgacggagctaataactgtcctaactgcggcgctcccgcaggaaacacacagcagaacacacaggactttgtaaacaacatgatgaacacaaatgatacaacatcacagtttgatccgcaggatataaacaataacaagggtatgtccgtacttgcttatatcggattcctgttccttgttcccctgcttgcttgccctaactcgaagtttgcacgctatcacacaaaccagggacttgtactgttcctgttagagtttgcattaggtgttgtaacaggtatattaggtattattcctatagcaggtcttataatcggcggacttttaagcgcagtaggcggtatcttcactcttgtacttatgatcatgggtatcatcaacgccgcacagggacaggctaaggagcttcctcttatcggcaagatcacactgctgaagtaatttgcataacatatcatataaacagcgttgcccccgtctttctgacgggggcttatctgtttttataagcatcgttaaaataggacacagcataaaaccgctccgccgtaaaaaatacggcggagcggtttttatcaattattctttgaaagccatatacttgccacatcaagagcctcataaagactgcctctttcgctcgtctttgtgattatctctgtagccggggttttcggatcggttgacataagctgtacccttgtcttgtcggctatctcaagatccttgaccttgtgggtggataatacagtcagcatggcaacgtatttgtctgacatattgccataatagatagtgttgtctttccttacaagaggaagacctttgtaggtgaaaaattcctgctctgtcataataacctccaccgttgcactaacggtcagtatgtgacggacagatcccgtgcaaaatttaagatccgccccctgtcgtcacatatcaattataatgccctgcggcatcagaactctgatactatctctccgccggagagaagcgcattcagattttcgagtagtcttgtcgcatatatctgccttaccttgtagcggacatcgccgtttacaacgataatgcaggtacggtcgctctcgctcgcatagaactcgacaacgtcgctttccttgccttcttcacgatgatcgtaggtgacacctgcgatgaacttgttgtcgcctgtaagatcgtcaaggtaaatctgctctgcgtatgccgaaagcagatactgatagaatgccttgaacttggctgaatctacctccttgccttcgtatgtgaagctcgacttgtcagcgtcgcccgtaatagtgaaatcatatgcctttctgtcgctgtcatagattgttacaccgtcaagataatagatataaggtgtaaggaacagcttataaagcatattttcgggtgttgcggtaagccacggcagagagtcgggagagaacacatatattgcgtccttgcctgagagcataccatagtagcccgttatcgtctttatttcttcgcctgtttcatcgttctttgtaacagtgtagacagcagagcctaaagtgagcttggtaacggtttccttgttgcttaccatagtaacggtgcagtacggatcgtcaagacccgcctgctttttctgctcgtctgtgggagatacggcaaacacatccgaagccgatattccgaacaggccgaaaatcactttcttgtcaagctcatcatctgcaaggatattgttgtggctggacatttcataagcaacgtatgttgacgaaaacttcttttcggtttgctcggggagcttgtcaagaactatatccttatccagatcctttcgctggatacgaaccctgtttactttatctttctcggaatcataagccgctgtaagcgttgacttgttgacgtatgacagctcgctgttcattgcaaagctgacgcctgcatttgctacaaggtataccgtatcgctcttatcggttttaacataccacgagttttcgccctcgtactttataccgataaggcaggttatgtcctcagccttgttatccttgaacgtcattttaaccgttgcggtcggcttgtcaaagccgtacttggcaagatctgtcgcattttcctcaacgatttgctttgcaccgatgccgccggcactgctcattgcggttgaatatgcactgctgtttgcaagtgcctcggggatcgaatctatgccccacttttccttacctaaacggtttatcgtatattcgccgctctcattgcttatcgtgagcgttgaaatatcatcggccgtataatcggtcacgctgacggttttgctgcttgacgtgccagagtctgcgttgtcgctcttcggctgtgtcagcaccagtgcgagcgttgccgcaccgagtaccacaatgccgattaccgagccgagtattattttagtatttttcttcattgccgacctttcgcttacttatgcagacgctttacccatattacaataccggatattatcagtaacagaggcagtacgataacgaagcctataacaagaccgttcttctgtgcatctgttatctcaaaggttgaggtgttgtaggacttgggagtgagcgtaatgccctcctccttgttacagcttacgttgaagatattcataataagctgtgagttgtttacggacgctgtctgcaggaacgatgtgttgaggaattccataccgccgattgctactatacggctggagaagggatttgtaccctcatatcttgtctttaccgcctgcattataacagaatactgctttctttccgcatcgctctcgggcgaccagttatcaccgctgtcctgcggctttataacagcacctgcataggtgttcagtatagactgtacggtaatgttgccgttgccgttctgatccgcccactttgatgtcacagggctcatattgtagccgtgaacgggcgagctgtttgtgaacttgctgaagtctgtatcgggtactgaaagcacctgatatgtgttcataccgctgtaggtgtagttttcgtctgtctggtaggtgatacccttttcgaccttcagaccccactggtcaagcagaccgtcaatgttaggtgaatcaccgagcttgggattgcctacatatacaaggttcttgccgaatttaccgctgttgtcaagccatgtgtcgagcttgtttatatcggcaacggaataatccttatcgggtccgaacataaatacaaaatcgtagtcctcgcttatcttgtcggtaagcgtaatgttcaccgattcgataacgtagctgtttgtcttgagcagattctgtaaaacagtattctccttttctccgtagcccgttaaaaccgcaacctttacaggatctgtatcggtaacgttcataatagcggatactacagcctgctctgcattggcttcaaccttttcgggccgcttcacgccgtaatagttgaggtactgttcattataggttatgctgaggaagtcctcgtaggtcagcacctttacacgctttgtagccttgctctcgaccataatttcattcgaggttatggtttcggtgtaatttgctataaagccggggtttgaaactacatcaatatactgtaattttatgttggaattcgccgctgcgatcttcttcagtatctcgtttgtctgatagtaataagagctgcctccggtaaaagccgcttcctcgcttgttaccgttatcgtaacctcatcggtcacggttttgagataatctaccgttgactgctcaatgctgtaaagtccggaatcggtaagatccgccgtcggcatgaatctgtcaccgagcagtgtgattattacgtttaccagaaccactgccactataaatatgaccgtgaacagtaccgacagaccgccgtacttgaacttcttgtttctgaacggattcttgcggggtttgccgttcctgctgttgctcttttctgcaggagcggtatctgttttattctcagccgctgtttcttttacttcagccgcttcgtttattttactcatgcgttttctcctttatccctttatcatagtcatcgcttatgcccagcggcgtttttcaagtacccttaccgtaaggaacaggaaaataaagataacgctcacaaagaatatcaggcttgacaggctgaatattccgcttgttatctcggagtatctcgaatataccgagatgcttgaaagcacgtcctgtaaaaatccgttggggagtgcgcttttcagcgtattcataagcagtatcataagattgataaagaaaccgcctattgccgctatcatctggttttccgtaagtgatgatatgaaaagacctatagaaacaaatataccgccgagaagtaaaagacctacggtgttgccccatatcggaagccacgaaaccgtcgcaaaggtcgacattacaaagccgtatacaggcataaccgcaacgcctatcgcaaatattgcataagccgcaaggaacttgcccattactatagacaaaaggcttacgggagcggtcagaataagctgatccgtcttctgcttcttgtcttcagacagcagtcgcatagtaagcagaggcacgaaaaccataagcactatgaacatcatcaggaatacgcttgatatatcggtcgagcctacagacagggagaagatataaaagaacaatcccgaaaatgcgtaaaaaatagcaaggaacacatagccgagcggcgatgtgaaatatgccttcagttctcttttaaatattgcaaacatttttattccgcctttccgcttactttgacagcttcagcttatcaacgctgtcgccgacattaccgtatatatcgcccgttgtgatcttgaggaacacttcttcaagagtaagctcactggacttcatcataagcagagtgtaatttcttgacgcaagacgctttgaaacttcacggcgaatgtccgtaccgggctttgcgtttaagaagtattcgctgacgccctcctcgacattctccctgttgacgaacacctcgtccataccgggaatagccgaaagtagcttcttcacgtctgcggggtttccctcacagcgtatcacaagcttgtgatctgcggacatattctttgcaagattgtctgcgctgtcgtttgctactaccttgcctctgttgatgataactatcttgtcgcataccgcctgtatctccgggagtatgtggcttgaaagtattacggtatggttcttgccaagcttctttataagcgctcttatctcgattatctgcttggggtcaagtccgaccgtaggctcgtcaagaataagcaccggcggatttcccacaagcgcctgtgcaagacccacacgctgtttgtaaccctttgaaagattcttgataacacgatccttgacatcggttatctttacaaggttgcatatctcctttaaatgcgagttgatcggcagcttgcactttttcagcccgtatacgaacttaaggtattccattaccgtcatatcaagatataacggaggctgttcgggaagataacctatcatttgcttagcttttacaggctcttcaagaatatctataccgtttatctttgcttcgccctccgttgaggaaagataacccgtaaggatattcattgtagttgattttcctgcaccgttgggaccgagaaaaccaagtatctcgctttcttctgcggtaaaggaaacattgctgactgctgttttagagccgtaacgcttagtcagattctttacttctatcattttttgctccttaaaacgaagtatccggcagaacattggtacatagccgtacctgccctgcgcacatctgttatattctatcctgcacaggtgaaacctgtgtgataaaacagtgtatttattgcttggcggcgattttatctttgtcaagctgagctttaagctcgcctacgctgtcaaaacgtctttcgggacgtataaaatcaagcagtgaaacacgcagtgtcctgccgtaaagatcaccgtcaaaatccattatatgcgtttccgcaagaggactgtccttatagtcaacagtaggctttacgcctatgtttgtaacagacggcatgaccctgccgtcaagatatgtcacgctcttatatactccaaagcgtggcataactatgctttcggggaaacgctggtttatagtcgggcttcctatggttctgcctatgcggttgccctctatcactctgccctctatcgaaaaatcatatccgagcagtttgttcgcctttgctatttcacccgattttatcagatttttgatggccgttgaatgtaccacacatccgtccagactaaacggcggtattataacgacctttatgccgtactcacggcatatacatttaagctcttcggcgtcgcttcctccgcctgctccgagcctgaaatcaaatccgcacacaacgacctttgcgttcattatcttcacgagaaccttttcgatgaaatcccttgccgtgtagtcgcacaccgaattgaaatccggagaataaatatattgtactccggcttctgcgagcttctccagcttcatatcgtttgtgagcaggttctctatcttttcccttttaggcaatgccgtattgctgtgaaacgtgaacattgcagggcaaagcccgccgtgtctgaagcattcctccacgaccttcatatgacctaaatgcaagccgtcaaaaaagccgagtgccgttgctgtcggcgggatgggtattatattttcggtaatgtcaatcaagaataaacctccgtgtcccgcattaaatgggaaaatcaagataatatattaaggtatacgcttttaagcccgttctccccattcacccttgccacgcctaaaaaatcaccatcgtgcttaagacgcaggcaggtgccttccgggtatgaaatatccattcttccgcagtcaagtatcatgccgttcatgaacagcttcttttgtgtaccgtccagagttatctcgtcatagcacgagaaaacacgctctgtcggcagtaccagccttgcggtatcctcaggcggcatattacgaagcgtttcaatatcgtggcagtccgacagcgtaaagcctgccgccatcgtgcggcaaagcgaggtcattatcgctcctgtgccgagcttttttcctatatcgcttatgatagtgcggatataggttccttttgagcaataaatatcaagcgtacctgtacgctttttctcgtcatagtcggacagctctatcgaatataccgtgaccggacgagcggcacgttcaacctcaacgccctgccttgcaaggtcataaagccgtttgccgtttatcttcaccgcagaatacatcggcggtgtctgcattatatcgccctgcatagtctttaccgcatcggtaatttccgcaagcgttacgggcttttcgctctctgtcagcaccttgccccatacgtcctcggtatcggtagtcacaccgagtctgaaggtcgcacggtatctcttgtcgctgacaggattcagatcggctgtctttgccgctctgccgatatatatcggcaaaacgcctgtcgccatagggtcgagcgtaccgccgtgaccgatttttctcgttcctgccgcccttcgcattatcgccacaacgtcaaacgaagtgaaatcctgcggcttattgatacagattacgccgtttatttcattcatttgctttcagcgccttttcaaatacaggcagcagctttgctttcacaaactctatactgccctctatggtacagcctgcggctctggcgtgaccgccgccgccgaacagggcgcacacgcttcctgcgtttataggctctgccgttctgacagagatcttgaacgtagcaggacccttctgctttacggtagcgccgataattacgccctctacctgacggggaaggcttgcaagaccgttgaagtcctcgctgtcaactctgcccataaagcgatccataagctccgttgtcagccatactaccgctaccctgtcgtcacagaagaattccattccctgcgttatcgcctgttcaagctccagcctgccctttgacttcatatcaaacagcttgtaattgatgccggaaacatcaaactcataagccatcagcttagcggctattatgtgcgttctgcttgtcgtgttggaatacttgaagcagcccgtgtcagttgcaagtcctgtgtaaaggcaggacgcaatctcaccgtcaagctgtgcattcatttcctccgctatctgaaaaataagctcgcaagccgcagccgcctcgggatcgacaagagtatattttgcaaactcctgtctgctctcgtggtggtctatcgcaaggaatatcctgccgccgtatactgcgtcaaggtcgccgagcagttttctgtcggcaacgtcaacgcttactatggtcttttcctcaaagctctgctgtatcaccgtatcacgcagaaactccatacggggcgctatctcgtccgcacacataacctttgcccgtttacccatcttctgaagcataccgcaaaggccgtaagcacagcccagtgtatctccgtcggggttggcgtgtgacaatatcagaaaatcatcgttgcttttcagtagctctgccgcttttttaacgtctgttatcattattgtttacctttcgtcatcgccgttatcatcgggttcggcaggtttcggcagtttgcttatcacctcgctgatatgctcgtaatagtccatcgaattatccggcacgaatatcagctgaggcagcttgcgcatcttcacacgctcgttgattcttcttttaaagaagccctctgccttcttgagatgctcggcgacattttttgtggtgtcgccgccctcaagcgttgtgatataaaccttgcagtaggacagatcgcttgtcagctcacagcgtgatacgccaaccatcgcctttactacagcgccgtcctttatatcacgcatagctgtggagatttcacgttttatatcctccgcaagtcttgctgtattgaaatttgccattaatctctgtactcctcggtaacaaacgcctcgaatatatcgccgtcctttatgtcagtgaacttttcaagcgtgataccgcactcgtagcctgcggctacttccttcacatcgtccttgaaacgacgtaagcctgctatcttgtcaacagcaacgattatgccgtcacggacaactcttacctcgccgtttctctgtaccttaccgtcaagtacataagagcctgctaccacgccgacgctcgacagcttcattacctgtcttacctcaacacgtcctgtatcaacttctctgtacttgggcgcaagcatacccttcatggctgtttcgatttcttctattgcgtcatatattactctgtagagtcttatatcgacaccgtcacgctttgcattgtctgcagccgcagggttaggtcttacgttaaagcctactatgatagcgcccgatgcctttgcaagcataacgtcgctttctgttacggcacctaccgcaccgtgaattacttctacctttacttcctcgtttgacagctttgacagtgactgtgaaacagcttctacagaaccctgtacgtctgcctttacgatgataggcagcttcttcatcgagccttcctcgatctgcgagaacagattatcaaggctgaccttcttatagagcttgaactgttcttccttagcgtcgaactttctcttttcaacaagctctcttgcgagcttttcatcttcaacagccgcaaaatcatcaccggcgctcggtacttccgcaagacccattatctcaacgggaacagaaggacctgcttcctttaccgctttgcccttgtcgtcacgcattacacgcacacggcctacagcagtacctgcgattatggtatcgcctgtgtggagagtacccgactgtacaagaacggttgcgataggacctctgcccttgtcgattcttgcctcgataacaacgccctttgcaagtctgtcggggtttgccttaagctcaaggacatctgccgtgaggtttaccatttcgagaagctcgtctataccctcacctgtctttgccgatacgggaacgcagattacatcgccgccccattcttcgcatacaaggccatgctctgtaagctcctgctttaccttgtcgggatttgccgtaggcttatccatcttgtttattgcaactattatcgaaaggtttgcagcctttgcgtgatttatcgcttctaccgtctgaggcataatgccgtcgtctgcggcaacaacgagtatcgctatatccgtagccagcgcacctcttgcacgcatagcggtgaacgcctcgtgtccgggagtgtcaaggaatgtaatatccctgccgcctgcctttaccctgtaagcgccgatatgctgtgtgataccgcctgcttcgccggacgtaacgttagcgtgtctgattctgtcgaggagcgatgtcttaccgtggtcaacgtgtcccataacaacaacaacgggtgaacggggctgtaagttctcctctgtatcctctacctcttcaaacagacgttcttcgatggaaactacaacttccttggtaacctttgcaccgaattcttccgctacgatacaagccgtatcataatcgaccgactggttgatagtaaccattacgcccaggctgaacagcttctttataacgtctgcggctgtaaccttaagacgtgacgcaagctccgatacgattatctcatcgggaacctgtatctcaagctgtttctttcttgccttttcaagctcaaggcgcttcagcttctgagcctctgtttccttcttcttgctgaactgctgcttgcccttctgcgacttctggcttatcttctgcttctttgtataagcgtcattctgacgtctgttgccgctctcggtcgaagctatggtttcatacttctcgttgtacttatcaaggtttacataactgccccttgtgtcaacgtgctttgtgacctgctcgcctctctgtacagcctcgcccttgacgtgctttgtgggaggtgcgtttgtcttgatatttgcaaggtcgataacaggctgtgccggagctgtctgctgtgcaggcttagtgtccctgcggtcatttctggtatcgcttcttctgtcgccgtagggctttctgtcaccctgctgtctgtcgccgtaaggctttctgtcaccctgctgtttgtcgccgtagggctttctgtcgccctgctgtctgtcgccgtaggactttctgtcaccctgctgtctgtcaccgtaggactttctgtcgccctgctgtctgtcgccgtagggctttctgtcgccctgctgtttgtcaccgtagggctttctgtcgttacggtcgcccataggctttttgtctgcagacttatcgctcttagcttcagacttagcttctgtctttatttcgtgctttgcttcagactttgtttctgtctttatttcaggctttgcttcgggcttagcctctgtttttgtttcgggctttgcctgtaccttttcagccttgtcggcttccttattggattcgggcttcttctcagccttctttgcaggcttttctacaggcttttcttccttcttctccgtcttgggcttgcttgccgaagcgaaatatgaattgaaattcttcacctggttgctctgagaatacttttcgagaacaacagacatctcatcctcagaaagcgaagcctgcgatttcttctgtactccgaaatactcctgtaccacatccgtaatttcacttacaggaatattaagatcctttgccaactcgtttacacgatattttttatccattcactgatccccttttttatgtcagatttagtattgtatatataaatcgggtgtaccgcttatttccctttatgctcgcccgtaaggcttgcgtataagccttcatcgagaacggcaagcactcccgtgcgttttccgaggaccgacttgatttcgtccatcgtacaatcgcactgcgacagcagggcactgtatttatcgcagaaaaaacgcatttccttctgtgttttctccgatacgtcgcttgcgagaataactcccgcaattttcgatttcgggtttttaagctcctcgcaaacaggatcgaacccgtgtatcagacgtccggactttctgcaaagaccgagcgtacttaaaaaattcattgccgttactcaccgtcgctttctccgatgcttttcagcagttcaagatatatctcctccggtaccgcacatttcagagagcgttcaagcccgcgttttttctgtgccgcctcaagacagctgcggctcttgcagacatacactccccgtccggatttcttacccgtgaagtcgagtacaaactctccctcgggagtacggacaactcttacaagctgttttttctctttcatttcctcacagcccgcacattttctcattggtatctttttaactgccaaagcgatccatcctttcgtaaagggtttttattcctcagcctgagcttcttcctcagccttttcctgcttgctctctattccttcatagaagccgctttcggggcgtatgtctatcttgaagcctgtgagctttgcggcgagctttgcattctgacccttgttgcctatagcaagtgaaagctggttatctggaacgatagccgtacaagcctttacctcggggtcgggtatctctactctgataacatcactgggcttgagtgcctgtgcgatgaattcctcaggcttttcgctgtagaatacaacgtccatcttctctccgccaagctcggcacataccttgctgatacgctgtctgccgggacctatgcacgcaccgagtgcgtcaacatcggggttgttgcttattaccgcaacctttgagcgtgagcctgcctcacggctgatagcctttatctcaacggtaccgtcatatatttcgggtacttcgctctcaaacagacgctttacaagctccttgttcactcttgaaatcttgagcataggtctgtggtctgttgcggaaacaccggaaacataaaccttgaccatatcgccgggccttagtacctcgccgggtatctgctcgcttctgaacagcggtacttcgtttccgttgaggtttacggtagcgttgcctgttctcggctctgtcttgagtacggtaacagttaccgcctcgtcctgaagaccgccccactgagcaacgagctgttcacgctctatctccttaagaccctgcttgatgacctgctttgccgtctgtgcggcaattctgccgaaatgctgtgtatccagctttatcgctacaatatcgccgtattccagctttctgcgggtgtgggtctttgcctcctccatcgagatctggtttgcatcatcctcgacctctgcggcaacttccttctggatagccacatcaaacttgccctttgcaatatcaatatcaaacttgatattctcacttctgggatattccttcttgatagcgataacaagtgctgtctgtatcttctctatcagcacagcggggtcaatccccttctcctttgcaagcaatgtcagagcctcaaaaagctccgttgtgttgctgttagccatttttaataattcctccgttaattattttttatgcgtcaagggcaattcttctgcacttagcggcattgaacttcatttcgccgttttctgtctgcacagtgaattcgcccgaattttcatcgtaatctccgagaacgcccgaataatacgccgtctttccgttttcgtcacgcacggtcacctttatcttttcgcccttcatcttcacaaagtggaaaggctttctgagctgtctgtcaagccccggcgagcctacctcgaaaacgtccacaaggtcaatgcacgacagcgtatcgacagccttgttcagcggttctgttatttcctcgcattcggcgtcgtctattcctccgtccgctttgtcgaaaagcaccttcagataccacatggcaccctctttttcaaagataacgtcccacagctcatagccgtatctctcgattatcggcagaaccttctgctcggtgattctctcgaccgtttccgcctgattcttcttgccgcctttttccttcggcactttgaaagcctcctttcagacaagagccgtaaaaagccctatatataagctaaagaccgagatgaactcagtctttagcctaccatattctactttaagtaagtatatcacatattatgcccgttgtcaagcaaaattacgttattttgccgtaaacaagccgtttttcaaagtttttggtaattttaaacgattttcttgcggcagatgcggtgttttccttcctttttagccctgtaaagctgttcgtcagcctcgtcgaaatactgcgcatagtcaacatcgcacgattcactccacgctatgcctacactgcactttatcgtatacctcttgccgcctatctcagcctttcccgacacctcaaggaaatcttcgaaatcgtccacaacggcggattcgctcgtgcctctggcgaacacgataaattcatctccgccgaaccttccgacaaccgcattcggaaactttctcgaaagcagttttcctaccgttctcagcacctcgtcaccgaagctgtgaccgtaggtatcgttgaacgccttgaaatcgtctatatcaagcatagcgaaaaagctctttgcattcgtcttttcgctgatgagccgctgaatgtggtttgttgttgccagcttgttcagcagtcccgttgtgctgtcaagctcgactagctgtatcattctctgctgctcacgcttttcatcgtctatatcctgtgttcttccgagaacttttattacctttccactggcatccgctacgcttgaataacacgtccttacccagcggtagctgttctgatctattatcgtggatctgtaatcgagcgtcatacagcttacaggctttctgcttgcctttttcagcgccgcatagaattttgcggcgtcatccggatatacaatctttgtacgttttgaaacctccgcatagttgcttatggagcggtttgccgaatccgccttacctacgctgtacaaaaacgtcattatatcatcgggaatatcatattcaaatgtgactgcattcgaagtcgcctcaagtatacggtaacgctcaagatttaccgcattctcatattccgccagttttctgttggtcatatcctgcacaattgcaagaaatacagggtgttcgctttctataaaatcaaccagctttgccttgacaagcacccatatatcattgccgtcatagcgtctgcctttgcattcggcatagaatgtttctccggtctttaccgaacgcctggctttttcaaagatcatctcagccgaatctccgtaaagcgacgaggtaacgctgtctgcatactgttcatactgctcttttgtgtagcccaccatttcgtaatatttcttgttgaaataaagcgaccttactctgtccgggcaaagctcatatatagcaactccgcacataagatgttcgagcattgtagagcatatcgtttcccagtcatatcccggcttgaagcggtttttaagctcgctcatatccctgctcgaaggctcaagtcttgcggcgcatttattttcagccatgttatcactccgttatagaaaagttttttatgttgtaaaaatagataatctgcgtttcacccaatatagaattgttgcatgaatctgacgcactgtacatattcgtttgcaagctgttgtgcgtcaacattgtattttttgacaaactcctccactttgtcccagtttgcgtgttcgtaatcgactaccagcctgaacacatctccgaaaagtccgtccgctcccagcagaccgttctttatttcgtccgttaccggaagctccttcataacgtttcctatatcacgttcatcggtcgtacctgccactaccgacataagtcccataagatacatttcttttctgtgtatgtactgccccggcattacctttgagatgctctcacagaatttcgccctgaacagcgcaagccttataagctcgtcgggggtatccttctgcagcctttgcaggcctacaagatatatccattccttcagcttttcaaagccgagcagaacaagtgcctgatgaatagtcgaaatcttgtttcccgtactgccgtacattacgtttataagcctcagcagtcttatcgtcagcacaacgtccgtcgaaatgaccgccgctatttcttcatagtcaggctcgggcgaatatacaagacccagtatatgaaggaacgtctttgccataggcgtatttgtcctgtgcgtcataagcagaggctttgcaaagaaatagccctgcatatatgtacagccgagccttttggcatattccacctcaagctgagtttccaccttttctgcaagcattatcttattatatgttatacacttttccgctgtgcgttccactgcctcacgggaggtgtggaagtcgagctttattatatcggcaagctcaaacagagcctttgtattctcgctgtattcataatcatcaagagcgattatatatcccagcttcttaagctctatacagcgccttattatttctgcgtctgccattacgctctcaagcagctcgactacgagtatatcgcttgaaatcatcttcggcactcctctttttatgaggttgcccgtaaaattgacgaatgcttttttaccgcctaaaacgcttgttatattatcgacaaaaaatgcgttgttgattacatctgctgtgcttacatctccgttgtttcctgtatatgcgtttactccgggctgatttctgtaaagcagttcatagccgtatgtattattattcacatccagtatcggttgacgtgcaaaaaatacgttctccacagagatctctccttcgctttaatccttatttagtaattttacattatttcacgcataaagtcaacaataatgcctaattttcgtctttaatacagagttttttgtaactttatacaaaaaaatatgaaatatttcacacgtttcagcttacagctttttccgctttttcattaaattgctttgcaaaaaataacagccgcaaatctgcggctgtccagtctctcgaaaaacagattgctaaagctgtacattaaaatgtatcgccaacactgcttataaccgtttccgtaccgataaggagttaatattttcgtgaccttatcaatgcaactgcactgacattgaccttttaaaaaaacgctactaacctgagatatatgtactaatatgcggacgtgtagtgttaagcgtccccgcattgacaggatatacaatgttcaggtggttattcgagtttatccaacaccccagcggggtatgggtgtgggtaaggaaagagggatgccacgctgagcattgctttagcaatgctcccgctcctcacgtcgctcaagaggaataactgatttgggagaaaacctaagggatagggttaggggctgcaagtccctcaccctagtccctttggttgtctcccgcatgaatagcagcaacgttattaaacggaatagcgaacccgagaagtgctacccgacaaaaagaactatcggtagcttgctatcatagcctgagctgaatgatataacagaagcatctcaaataacagactttttatacaaactataacagccgcaaatctgcggctgtcggaatatatttacttacgctgtcgttttactttgcttagtgttgatgagcctgtatccaagtatgcacactgcactcacccctgtggcaacaagcaggttgaacggcagagccgaagcgaaccattccatatgcgacgcaaaaccgccgacattcattacgttgtacgggtacttatatgcgtggaatatgcaaatagcggcattcacggcaactgtaacgccgataaaccgtccgaagctgtgctttataaatgtaaatatgccgaaagcgacagccaatgtaatcagtagcgatgagcagaccgaataaatatagaagtcaagtctgtcgagcgtagtgtcctgtgccacgcaaagccatactcctgcggcggcaactattgccgaaacgactgttctgagaattttcatagcggtacctcctgcaatattgtggaaaataatttttgttcacatcttgataatttgacaaagcatagttaccttatctattataagtatatcaacactcggctatatccgcaattgacatattccacaaaaaaacaataacggtttggtaatattcacagtgcagaaaagcggcacaccttctcaaaggcataccgcttgataataattgcgttatcagcttttaaggcaataccgcataattattgtcgtgcgattgcgcagtcagatttttcgtcagattgtataaattgagtgcaggcaggcttgcgcctgtcaagcgaaatttgtgcaagatgacgggaaatatgcaagcaagcgtgcggcaaaggcgatagccgttaattgtgcggtgttgccttaaagtagctgtacagcctgcacataagcataccgttatacagctttctgttcttgtccgctttctttccgaacagctcctcaaactcaccatccggagtgattacaaataatctcctgctgtctgtcgggagcaatctcttgcccataactttatacagctcgtgcgcctgttcttcgtcaagcattctctcgccatacggcggattgcaaagtacaacggtacagccctccggatatgtaaaatccgcaatatcacgctgcttaacctcaatatattcacccacacccgcctttactgcgttgtcacgggtaagtcttacggcttcggggtctatatcaaagccgtacagcttaaagttttccggctttctgatattcgctctgagcgcttctctttcctcgtcccacatttccttgggcaaaaattcccactgcatagcggtaaattccctgtcaagacacggcggtatgttaagcgccttgagtgcgctctcgataagcagtgttccgcttccgcagaacgggtcgcagacaatatcgttgtcccttatccttgcaaggtcggcaattcccgccgcaagcgtttcctttataggtgcggcattggaaaaacggcggtagcctctcttgtgaagtccctcgcccgatgtatcgagcgtcattgtgacgttatccttcattattgaaaagcggaactggaacaacgcttcggtttcctgaaaatagccgattttataaacgcttttcattcgctcgaccatagccttcttgattatcttctggcaggcaggaacgcttgtcagctttgaattaaggctgaagcccttgatagggaatctgtcgaactttccgacatatttttcaatagggattgcctttaccccctgaaaaagctcctcaaatgttcttgccttgaactccgagagaagtattcccacacgctctgcggtcgacaagcacatattcgcccttataagcacacgctcgtcaccggtaaacgttacccgtccgtccgacacggctatatcctctccgccaatcctgcgtacctcgaaggaaagcgtcttttcaagtccgaaatgacaaggtgctgtaagtctgaatgtcatatatcaatgatcctttcacgaaaacagcggctgatgtaagccgctgtcattgttgaattttctcagttcgagcttgtactgctcgtatcttcttccgctttctgcgtaccccagttgggtacaagcaatgtttcaccgccgtgcttctttacatactcgccgtctttatgcgtggaatcgcacgtctttggcagattatccgccttgtaatagcccacagcggtattcttgcattttgacgttgcaagaagtcctgtttcggtacagtatttcttttcgactacgtttgaatcctttgcaaaggtctttgtggaatcctcgttcacaacattcaccataaagttgtgccatacctgtgcaagataaatatagtttgttgtgccgatgttcttgttatcgtcaaaaccgagtcttataacaccgcagtaatccgcagtaagtcccgcaaacgcaagaacacgctcatcgtttgaagtacctgtcttgccgactacctctataccgtcgattttcgcatatctgcccgagccgtttgtagtatccgtaaccgccttgagcagtctgtttgttatatatgcgctgtcgctttccattactctgtcaccgagaggctcctgctcgataaccgtcttatcgttatagtcagtgataaggttgtacagcttaggctcgtaatatacaccgcctgagccgaatatctgatatgcaccggcaagctccataagcgtcataccctgcgtaagctgacccagagcaatgggcgaatatgccttgtcataggtgtagtcaagcgttgtcacgttcagcttatccgtaaggaagttgaagcaggtgtctattccgagtacctgtgccatacggacagcggtagtgttctttgactgctgtaccgcataccacgccggtatatatccgcccgagccgtaatcgccctcaaagttactcggccagcttgtgccgtcgggaagcgtgatacatttatccagtatcatcgaagaatagttgattatatccttatctacagcctgaccgtaaaccgagataggcttcattgtcgaaccgataggcagtatagcctgtgtagctctgttgaagcagccgtcaccgggcttatcgccgataccgcctgcaagagccactacattacctctgtaatcggtaagaacaaatgccgcctgagcgcagttttcttctattgcagtcttatcatagctgtagaagaagttgttcggatccttgaagaaggtttccagcttctcctgtatatccatatccatattgagatatatcttgtagccgcccttataaagatccgcctttgcctctgcataggtcatgccttttgccttactcagatcctcgataacctgctgtatggcagcgtctacataccagttctgagttatttcatactcgttccagcgatatgcctcataagtatcctcatcgtcatatccgtcgctgttctcgtccttgtttgcgttgtttccgtaatactcatcatatctgggatccttatagccgtaagcgtcgccctcaacgataagtctgaatttgaccttctctgtctttgcagcctcatattcgtctgtcgtaataagaccctgctcatacatacacttcagtgcgtaaagctgtctttccttcgagcgctcaagattcgcataagggttaagcacgctcggagaacgtgtcatacctgcaagtatcgcactttcggcaattgtcagctgatcgaccgtctttccgaaataatagtaagccgccgagcctactccgtaaaccgtacctccgagaggaacacggttgagatacgcttcaagtatatctatcttggtatactgcttttcaaggttcagcgctctgaatatctctcgtatcttacgttcgggagttactctgtcatcgcccgtgatattctttacaagctgctgtgttatggtcgagccgccctcgccgtagccgttgaacagggtcgatattgttacacggaccgttcttttccagtcaacgccgtcatgctcgtagaaacgcttgtcctcgaccgctgtgaatgcgtcctgagtgtgcttcggtatctgctccatatttacccagatacgattctcgtcacctgacagacgctttacctccacctgctctcctgcgctgttcttagcataaataaagctggtatagctaagatcgacattcttgagatcaacgtcaaacgcactgtcggcaaactgcattatatatacggtaagcgttactgctactatacaacaggttataattactatcatgaacaggctgagaaacgttgttccgataactcctaaaacgtgctttaccgtattcaatgtcttgttctgctttttctttgattttttctttaccgcaggcgtactttcctcaagctcaacgtctgcattaagataattggtttttttctgactcatatttacgtccttttaaggtgtgttgtttacaatattattgccgctgtcggcaaggatatattcttccgaagcagagtataccacgttgtaagtatagcacaaatcggcacaaatgttaagccttttacggcgaattttcagaaaatattcaaaatagccgttacaaccgctcgaataatgtaaattttcaccaagccgccacacagccgataacaaattatttatcgcactttccgtgctgtaattcaatcgtccgatgcttatgccttgtttttgccctcagagcaaaaaagaaggcatcggctttcaccgatgcccccatattcagcttgactttgctttacttctgtgttctcgccgtaacaactgcagaataagcgctgtactcatttacattgcctatcgtcttgtatgcacggattctgaacttataagctgtatttgcctttagtccggttgccgtgtaggttacgtttgcgtttgaagtgtatctcttgatctgtacccatttcgagccgttccacttttcgatgcaatagccgcttgcggagatattcttgttccactgaagcgttatggcgtttttcgttgccgacttcatcttgaagcccgttgtggtatacggtcttgtgttgacattaagataggtgaacgcactgtattccttggcactgccgaaattcttgtacgctctcagtctgaacttgaacgttgtgcttgccttaagacccgttacgttgaagctcgtattcgcattgcttgtaaatgtctttatcgtcacccactttttgccgtcatacttgtcaagtacataaccgtcagcggatctgttcttgttccactgtaagtttgcacttacgtttgtcttactgctgcacttcattcccgttgtggtgtacggtcttgtgttgacattaagataagtgaacgcactgtattccttgacactgccgaaattcttgtacgctctgagtctgaacttgaacgttgtgcttgccttaagacccgttacgttgaagctcgtatttgtgttgcttgtgaatgtctttattgtcacccactttttgccgtcatacttatcaagaacgtaaccgttagcagatatgttcttgttccaccgtaagtttgcacttacgttggtcttactgctgcacttcattcccgttgtggtatacggccttgtgttgacattaagataggtaaacgcactgtaaaccgtagttatatcatacatcttatatgctttgatgcggaacttgaaggttgtgcttgccttaagaccggttacgttgaagctcgtatttgcattgcttgtgaacgtctttatcgtcacccactttgagccgtcatacttgtcaagaacgtagccgtcagcggatatgttcttgttccactgtaagtttgcacttacgttggtctttgattttaccttgaagccggtcaccttagcaaatgcgggtaacttgtcaagaagcacataactaaatttcccgcttttagcataggcttccgcctgtgtgttactgtaacagtaaatttttaagccggttgtctttttattgccgttatcatcataacaatatcctaaagcactatcagcgatagttttaacaccggcgggtatcgtaattttcgtaagacttgtgcaattgctgaaagcgcccgaccttatacttgtcacactgtcgggtatcttcacaccggtaagacttgcacaatcgataaaagttgccatttcaattgctgtgatactgtcaggtattgtgatacttttaaggcttttgcaattactgaaagcatggtgctcaatatttgtaacgctgtcgggtatcgttatacctttaagatatatgcaatcacggaatgcggcaacgccaacaaccttaacactgaccggtatactgtaactcatattcttcttgtttgcgggataacatactattttcgttttatccttgctgaaaagaatcccgtttacatcggcgtagtttttattgcttgccgcaacatttattgcttcaagacttgtgcaaccaaagaaagaatatgtttctatatcctgcacgcttttcggtatcgttatgctattaaggcttaagcacttattaaaagcacgatcccggataacggtaacaccgtccggtatgctatagcctacatttttaattcctgccgggtaacagattaattctgatttatccttattaaaaagaactccgttcgcagaagaataatatttgttccctgctgtaacatctattttagtcagatttgcacagttaatgaatgcactatcccctattttcgttacattatccggtatctttacgctgacaagaccggcacattcagaaaaagcggcatagcctatttctttcacgccatccggtattgttatacttttaagcgaagtacagttataaaaagcactgcgacctatatacgccacactgtccggcatcgctatgcttgtaatctttgtacaatctttaaaagccaaattgcctattcttgttacgctctttttgttgattttctccggaacatcaactttttgctcactgcctttataaccggtgatctccaccgtaccatcgtcaagcacaccgtactcaaaattcccgtaggcttccgctccggcacatacagcgcacaacaccatcataaccgccataaccgcaaaagtcgctattgacaccgaccactttttgactttcatataattctctccttattactgataattcaatgcaaagacacaaccgccgtgagccgcctttatatcaatatatctcgctcagataacagctgtatctttatatttacagcattttcagtatatcaccgctatcagttattgtcaagtgtaatcctcccgttcagcctgtataatgacaccgtctgtacagatcgggatatatttacggcgaaattttcatacattgtagccatacaccgccacacaaaaacgccccgcataagcggggcgtcattatcgttattaagctgtcgtcaagaatagtccacaacgtcaagccatgtaaagagaagatccttctcctccttgcttgtaacaccctttgcgagcgttgatgccgccataatgggaagccattcctgaacatatgtctttgctgtatttgtcttcttgcagaacaggttgagatacttctcagctgtttctgtagatgtaagtgcgagcttcagatatgtcttggcaacatctgcactggcattaccggccgaagcgccaatccagtcaactatataaaccttgttgtcgtctgttacaactatgttctcaggaccgaagttgccgtggcacagcttaacgtgcttgggtgtgctgtcaagtctggtcagaagatcgtatctcttgatgtggtcgattacgtcaaggctctcgatctctgctctgaggttatccttcagctttgaaatgcctgtaaccttctttgagtgtatctcaagctgaagctcaaccatatcgtcaagatagccgtcgcagttctcaggctcttcctgcatgatctgtgcaagcgtcttgcccttgataagttctgtagcaattgcccacttgccgtcgataagctcaacttcctttatcttaggaacgttaagtcctgtttcttcaacctttgaatccatgaaagcctcatagaaaactactgttttgggtgcatcgggtttgaatacctttactgcaaggtcgccgctctcatatacgtcaacggttttaccttcggagatttttttacctaattttatttcattcatacttaagtcctttccgggagcgctgtgctttatgctgcggcgtttccttttaatgtgacttgattataacactttttcgcccgtttgtctatagtttgattggaaatttaacaaaaatgcaacaaaatatttttctcggttgtgcattttgacgaaaaatgtagtgggcgaatttacagtaattttcaccacttatacaatcggttcggctctgagcgtgccgttacatcagctcgttgctgtcaaggatgaccgtgaacggaccgtcgttcagaagctctaccttcatatccgcaccgaaccttcctgtctgcacgtcggctatgctttcacacttccggcattgctcaacgatatactcgtacagctcgtttgccatatcgggtgagccggctcttgtaaaggaggggcggtaacctttgcggcaatcagcgtacagcgtgaactgtgagataagaagcaggcttccgccgacatcggcaggtgcaaggtttgtctttccgttctcatcgtcaaagatgcggagccccgtcatcttgcgtatcagcttgtcggcaatttcctttgtatcggtctgcgagatgcctatcagcaccagaaatccctttccgatcttgccgattatttcgttatctacggtcacactcgcacctgtcactctttgaataacaaatttcattaaaaaatcctttcagaagcgcataaataatgccgccgtgtaaactggcggcattgtaacatcacttgatgatttatgctgattaataagctccgatatatctcttgagatcgtcggggttctggcaacggcttcttgcaacttcttccgtaattttacctgtgcggacaagtcttgcaagatcctggtcgagcgagaacataccgagagccttagaggtctggatggagttcggaatctggaatatcttaccttcacggataagcgagctgatagcgtctgtgcagctcataagctcaagagcggcgatacgacccttgccgtcagccgtaggaacgagcgtctgtgaaataacggctacgagggagtttgcaagctgcgctctgatctgaccctgtgagtgaggcggataaacgtctatgatacggtcgatggtttctgcggcacctgtcgtatgcagggtcgaaagcacaaggtgacctgtttctgcggcggttactgcggcattgatagtttcaaagtcacgcatttctccgacgaggataacatcggggtcctcacggagtgcggcacgcagtgagcctgcgaagctgtctacatcggcgccgatctcacgctggtttaccattgactgcttatgtgtgtgaagatattcgatagggtcttcgactgtaataatatgacagttcttgttgcggttgatatggtctatcatagcagcaagagtcgttgacttacctgaacctgtagggcctgttaccagcacaagacctctcggacggagcgcaaactcgcccataagtcccggcagcataagatcctgaagcgtaggaatatcgttacgcagaagtcgcattgctattgcgtgatagcccctctgtctgtacacgtttactctgtgtctgtgtccggatgcggatacatacgagaagtcggtgtcaagacctttctggatagaagccttgtgcttcattgaggttatctgatttatgatattgactatgataggctctgtacagtcgggataaccgctgagctttttgatactgccgtgcagacgtacaacgggaggaagtcccgcagtaaagtgtaagtccgaacatccgagccttcttgcttcgtcaagtattttgttaatatccacctttttattctccttttaaaaagatatattgctaacaccgcatccgtattatacggagtaggtggcttttaccagttcgtcaagcgttgtagtgcctgcaagcaccatatcggtaacgttgcttctcagcagctttgttccgttcttttcagcctgtgcgcctatctgctcggctgttgcgccgcttgagataagctcctttatatcgttcgagcttactattatctcgtggatagcggttctgcccttatagcctgtattatggcatgagcggcatccgccgtaatgagccttgcatatttcgaccggctctgtctttccgacaagtcttaagtcggcaggatcggtaagcattaccttctccttgcactccgggcaaagcagctttacaagtcgctgagcgataactccgacaagagatgatgcaaccatgtaaggcgcaacacccatatcaacaagacggaggatagtacctgcggcgtcgtttgtatggagggtcgaaagaaccaagtgacctgtgatagcggcacggatagcgatgtctgccgtttcaccgtcacgaatctcaccgaccattactatatccgggtcctgacggagaatagaacgcagagccgccgcaaatgtaagacctgcttttgcgtttatctgtacctggtttacaccgtctatcttcttttcgcaagggtcctcaacagtaactatgttaacgttgggttttgaaagctcaccgagcgttgcgtacagtgttgtagatttacccgaacctgtaggtcccgtaaccagcataactccgtgcgggcaacgtataatctgcttgaacatttcgtagttgtacagcgtcataccgaggtcggttatctttcttgtcttttcatctgccgttgaaagcagacggataacgcacttctcaccgtaaacggtaggtatggtagatacacggacgtcaaggtttacgccgtcgatggtcataccgaaacggccgtcaagaggtattctcttttcggcaatgttcataccgccgagtatctttatacgggtgataagcgagttatgtgcggcaggctttaccttcatctgctcgataagctcgccgtctactctgagccttattcttgttctgtccttgaaaggctctatatgaatatccgacgcattcattctgaatgaggtttcaactattgtatttaccagcttaacgataggtgcattatcaacacgctcgcctgattcggggtcgtcctggataacattgtccgtagcattgttgtactctttattgaggttatccataacattgcttacggtctgctgtgaatatgccttgctgatagtttcgttgatagctgtacgggtagctatcattgcgtgtatctccataccggagataaccttcagctcctcgaatatgtagaagttgataggatcgtctgtagcaacagtaagacgtgaatcgttcatctggaacgctacacagcagttcttctttgctatagcctcaggtatcttcttgactgcctctatatcgatctttgtggttgtgaggtcgatgaacggcactttaagacggatagacagtgcctgcgcaagctgtgtttctgaaacatagcccagctcgagcaatacgtcgccgagctttttacccggctcactgcgctgtttttcaagggcttcttcaagctgatcctctttcagaaatccgttctcaacaagaatctgtcctatcggtatgttcttcattaaactgttccccctgtgattagtggtatacttgccgcctgtacttgaaaaaggcggcgatatgtggtaaaatatccatacgctgttttacagcgttcagattgaaacaaaagctaattttatagcgcagagcggatttaatatccctatcccctttaggacactttgatggctttgcatcatgcaaagctttgtgtgtccttatttcggcatccttgccgaactgccccctttcccccggaaagggggagaatacgggggctgtcgcccctgcgaccctactcttggggcgttgccccaaaccccatttgttaaaatctgtaccgttgttacagcgttccaaaaaggaaaggatggttatatatatgacaggtatactatggtatgataccgtaatttgcgtgcttgtgtttatcttcggctcagtcattggcagttttctgaatgtggtaatctaccgcactcccctgcacatgtcaattgtgaacggcccttctcactgcttttcgtgcggtgaacggataaagccgtatgaccttgtgccgatattcagctggatattcttaggcggcaagtgccgcaagtgtaaggctcctatctcggcacgttacactgttgtcgaggctctgacgggaataatgttcctgctcgcctacataagattttcggcaagtctgccgatggtggtcgcaatcgtattcttctcactgctgatagtcctcagctgtatcgacattgaccatatggaaatcccgtactggtgtacgatttcgatagccgtactcggtatcgccacgttcttcaccgagcctaatatgccctggtgggagcattttgcaggtgcggctgttatcgcagttccgtttgctatactcgctttattcggcggtatgggcggcggcgatgttcagcttatggcggcatcgggttttgtgcttggctggaagatagttccctcagccgttataggtgttgtggtgggcgctgtctacgggcttatcgtgctttgcgtatcgtcacggttcactaaggagcaatccgcaaaaatcagcgaaaaactcacagagtggtgcgagggcaaggctgccgacagctcgaaggatgttatcataggcgaatttgaacacggcaagtgcaagatcgaccctgagctttttgaagaaaaagcgtggaatctttcgggcgatgagcttaaagccgcaacagagtcactcggcaatgagctgaatgaagtaatgggcgaccttcccgacagcaaggaatatgtattccgtgcgaacgtggaaaacggcaagataacaaagataaagctgcgccgccgcattgccttcggccctgcactgagcgtaggacttgcagtcggtatgctttgcggtgaaaccattatcaaggcttatctttcgatgctgtaaaataagcgttatatttcccccgccgattaaggcgggggatttttattatgctccgggtgtgtacttcgtgtaatctataatgttatagaaaatcacaatgttcttgtctgttcctacagctgtataatccttgagaacaggattgctttcaggtgtcgatgttatattcaccagcttgaacatatcagttctggtttcgaccacaacgttgcctgtttccctctcaagcgaggtgatgccaattttgcaccagcccgatttcgtttcaaaggtgaaacggaaatctacatcattataatactcgttgttgaaaagcgcatatttctcaatgtcatttactcttgcagtgaactgtgccacgcttgtaatctttccgaagtcgtataactggaaagtatcatccttcctgcgaagcaccatacaatacgaagactcggctgtcggattctttatcgagctgagcatcaacttgcatcttttcgccgcactttcgtcagcagacgcatcggcagtaagcgatgtgttatcgtaaatgtcaatgttgtacgtcgagcaggtgttcacctttgaatgtatgtaggtcgtcatactgtcggcaatagcgtttgtcactacatcctcgtcaatggattttataatgctgctgacgggattgaacatcgacatagccgcaacgataagtatcatcattatcgccattgcgattataagctctaccagtgtgaaggccttctttttcagtaatctcgctaacttcataagccctcccgttatctctggttataaacgccgggatcttttgaatccttgaacgtcgccgagcgcaatgtagcctcatcacttccgtcatactcgtgatcgatgaaatattttgcaaacgatttatattcacttgcataatcatcattggataattcgaacttgatcgtgaaagaatatgacgttgccttgcttagcgctgtgaatctgtaattggtgcttgacagcggctcatatttcatattgcttccgtttattgtgaccttaggatttgcgtttttatcgggaattactaccttcagtgaattgctctccgctttcataagaacatttttgctgtccgttaccgtaacgctgagagtgattgtctttgtagaatcgtccttttccgctgttgtttcggtgaccattacgcttgtaatgccctttgtaccgtaaatatggtcatgctcggataccatacctgcgttatctttgttgtcatcgtcgcctgttgtgtccttgtcgatattcgcctttatggtattaagctcaagtctgccgtcaccgcttgcttcggcggcgttatttctcataatatccgctccggttatgtcgatagaagcgactttgttgcttccagttcttacgaagttgatcgccatatctgccgtttcacgtttgaccatattgctgttatactcaacaatatcctgaacctgcttatccatatccttttcgctgttgacattattcttgtgctgatttatcgctatagctaatatctgcattacgatagccgtcattatagcaaatatcatcatagctaccagaacttcggatattgtgaagccctttttcctaagcaaacgttttaattgcttcatagctatcgctcctttcattaattataaccataaactcgccacgtcttagcgacagatgagcctattgttgtcgtacagccggattcagccatcagcttctccatgtacttcagacgttcttcttctttctgtgcctcgtttgcaccgggtgttacaaatctgtcgtagtaatcatagggtatggtacacatatatgtgtttgacgtttccttcattgtatagtcggaaactatcataccgccgagcatacctgcctgaccgccctccgagcttgcctcaaacgtcatatacggcgcatagataaatcctgcgaacatattctgctgaggctggaagttcattgcagcgttcttatcaatagttacaaggaacacattgttatgtacatatgtctttgttccgctgtcgcctgtttcatttatgaactcatctgtaaagcaagcgttcttcttgctggtcttgtcattgataagaatatcgtttatcttgcccttgatgccgccgaatgcaccgatagcatcaagactgtttgctgctgtaaccgtcttgccggttatcttttcgtaaatagctatatgtccgacatagctctgccagtttgctacatacttaacgccgtccggcagtaccagtatcagcgagcccttaccctttacaaatacatggaacgggttgttgttcttctcgccgacatagcttgagcccttgggaggattccacataaagcagttgtacttcgtaggatcttccgcacggtatttttccacgccgttttcttcgtaatactcgcagttgggcttgagatatacatatatatccttatatgttccgccgcctgcgtctgtatcaaatattattccgaagttgtcatagcttatcgggaattttatatttcccattacatattcggtcttatcctttgccgaaaacgttacaacgtgttcagccttgtaatcaacaaatttatattcaatgtttgttgcttccttgagagtttcgccgtttttgaacttgctctcaatgttccagttgatgtacttggggtcacctatctttctgttgatctctgccttgacatcgtcaatgttgtcgcacagcttttcctgtgagggccatacataagtatagccgccattgccgtttacagcctttatgtcgtctatgctttccttaaggtcggtgatagtggccttttcgtcaagcgtaagagtgatagccgaagcacactcgaccactctgcccgaagcctttgcatcggtcagattactgtaggtatgcttgcttccgtcgctgtcaacgaatgtgatatgcttcacatagttttccatattgccgaagccgggcgagaaatagatatttccgcctacatacatctgatttgagataagtccctgattgtgcgatttatcaacgtaaacgttgccgttaacgtataacttaccgctgtatttcatattgccgaatacaacaaaatcaccgtcaacgcatatcatatcggtgagatcggcttccgtacttgcacaagcgccgtaatagtcgcccatgatatagtacatattgccccttctgaacgggaagcagttgctgagctgagcaacactgccgcctactctcagtgtaccgccctgaaggttaagaccgtcgccggctgtctggctgagataaaggttgtttccgactgtcagatctatgggattattggattttccgctgttgataggtgcattgttgagcttcagagtacctgccgctattatttccgaatagaggtcgatgtgcgatccgccctgctcgccgcctatctggctgtactcgttgtcaaggtacatcgtcgaggtaatatccataccggacatataaacgtcattcggagcgtagcctgtcgatgtgaagaaacggtcaaagttatacgcttcttcctttaccttgaattcgccgactgttgatatggtggacttttcgccgtttacggtcacatcggtcgtaatacgaacgacctttgtgccttcctctgtgccgtcagctaccttggtaacggttatcttgtagtcgccaagacccggagcaagctcgctgaagccttcaataccatcggcacttgtacttactatcgtttcgccgtttgttttcattccggcgattgtctttacaaaatcactgttgggctttttggttatgtagtcggaaattatattgttcagcgcaatcgcactctgataggactgttcatcgccgtactcaatctcgacctgctttcgtgcggaaacagtggaatagtaaaccgcagatgcaagaactatcataaccgacattatagcgataatgaagaataaaacgcttcccttgccgcctttcagccgcagtaacgcccttttcatcattaacgcttttctgttatgtttgttcatagcgtttcatcctttcatttcttacttgtaagcagccgtttattcggctgtgctgttattagcagcaaagggatctgcaacaggctgtatgcagagcagatttacggagaactccattgtgtaatcgctctcggagctgttctcgccggactcggcttttgccgtttctcccattgcatagctgattgatccgatagagattgcttttgcctttccgttcttttcatactcgcccgagaaaagaagatccgcaaaatcgtggagattctggagcttgtttgagtgagcggtgaaagaaaccgttatcgagcctaccgttacaggatcgcttgcggcaagaagtgtcgcctggagcttctttgcgtacataacaagctctcttgtgctgagcttgctgaagtctgtttctttatcgggtgtttcaacaaccgtgtttgcaaaatccttaaggggatatgttacctctgtaggtgcaaataccgatacagaaagtgcctctgtcgagaagggggaaatcgaaaggccgtcgatggttatatccttgccctttgcgatgaacttacgcataatctcgtcagcctcgtattctgtgaggtcgttgaaaaaattgtcggcaaggttcttaccgtcttcatacgcctggctgatctcggtgtctattgttgactcatgctcgagctttgtcagtatctcctgatactgctgctttacagatgcgagctgcttattgttatcgcctatcttgttaaagttgggaagaataaatacaaatatgccaacgcctacaattgcggcaactaaaaatacaactattaggattcgttcctgtttactgatcttcatgttctgtatgtcctttccccattactgtgcagtagattctgtagatgaagtatcatctgtctgatcgccgtttgcttcattttcgatcatgctgttggcatcgtccttatttatggtaacatcgttacctgcctttaacagcatcgtaagaccgaatgtaatggtttccttcttgtcttcaccgacctcaaccgcatatccgttatatgtaatgttttcgaaatagccctgagctatcagcgctcttacatactgtgaaggctgtgcctgattcgtacagctgaaggtagcacttacagaatagccggagattgaaacgctatctacgagcttcataccgttcagattcttgcgtacagcatcgcttgtgacgctttcgattccgttctgctttgccgtgaacggttctttgagcatcttatataccgttgtagtgcccttaggcatataattgtacatcaattcggcatttgctattgagttcttatagctctggaagttttcgagaacgccttccttctgctgtaaggtcgtaagtcttgcctgaagctctgtatcatttatctgtgcctgcacctttgttatctcgccctttatgctgttgttgataacatctacaacaacatttgcgccgacaaccgcaagaacgcttatgagagccgccgcaccaagtccgatgaagaaggtgttaagacccttgctttcctttgccgctgtagtatcaagaaggttgatatgctcaagctccttgtttaccttatagagtgcgccgatagcgtttgcgtatacggtaaactcaaagtcagctcttgacgctatagtcgtgggggcgctcagaatgtgacacgaaacattgaagcccgatacggtgttcgtaagcgcaataaagtcgtctatctcgccatagaacatcatttccttgataggcttcatatccttccttgactggaagaactggaacattctgaacaggttatcatatatagcctggttaacatagtcctctgcgttattataatcagcggggtcgatcttgaaatatcttgagaacgaaagaacgttgtcttcgtaaaggttgatattcagaaactccttgtctatctgaacaagcaggagcggcatataagccgacatcttgggagtgttctggataagacgtgaaattgcgttgtttgaaatgtttacagccttgagcgaaagacccatatgagtgaacagctttacatagccgtcaacaagacgctgagggcaggctgtggcaagaaccttgataagagggttcttgttctcgtctacggtttcacctactatggtatatgaaatgttgtagtcgcccgatatacccatgttgcttcctatcatagcctcgatagcggctgtattggagagctttctgggcttggggagcataagctccttgtagagtatcgagcttgagctgattgatacgatggtatccttttccttgatggctcttgtgttgatcatatcgattatttcagccgcaaccagcggaacatccgctatgtagccgtttgaaacaagacccttttcgatctctctgaagtcaacctcatcaatcttgattttcgaaccctgtgaagtaccacgcacaagcttgatttgtctgtcggtaatatcaatagataacatatctcaataattccttcctgcttattaggtttaattttcgttgctttttaagtattgcccataccttccatacctgagtaaagaatcgggaatacacctgcaagcaagcaacctaccatgacacccataaggatgatcattacaggctccataaggcctacaagtcttgatattgctgagtcggcttcatcatcataataatctgacgatttagcaaggatggtatcaagagtacctgactcctcaccgacatagacaatcgatacgaacataccgtcgaatacgtttattctgcccatcgctaccgaaagcgactcgcctcgttttacgttttcgactacatcctcaaactgctttatgatatatgtattgccgagagtgcctaccgatttttcgatacagtctaccatctgaagaccggatgagaaaaggtttgacattgtacgggcaaaacgtgcagtgtaaattgtacgaagaagccctccgaccttaggtaatttcagaagcatttcgtcccacttgagctttgacgagggggtcttgataataagtcgcagtacaattataattgcgattaaaactataacaagaatatacccctggttaatcataaagtcacttattccgaaaattgcggctgaaagcggaggcatctctgtgtcgcccgcaaggtcacggaacataggcatgatcatcgtaaacatggctatcatgatacctaccagaagcacaagcagtacgataggatagatcatcgcacccttgatcttgttctgcgtcttgctgtcctttgcgtaatgctcggatacacggttcatgattgtatcaaggttaccggacgcttcacctgcgccgaccatgctgacgaaaagtgacggaaatacgccgggctttgtagctatagcctcagagaagctgcggcccttctgtacctcctcatatatatcgagaagcacctgcttttgttttttattttcagtctgcgcctgcaatatctgaagcgcctttacaagacttacgcccgatgtaagcatcgccgcaagctgacggcagaagaacgacagatccttcgtcttaaacttatattttacatccgccgccttgttctttgccgcatccttataggatgtacagaacaagcctttttgtcggagcttgtcaataagctcaacggaatcttccgccatttcggttccttttacctttttaccgtttacgtcggtagcaacgtaagcaaaagttgtcactggttatcccccattcatcataacagaataaacaacctccatattaaatggaaattattatataacaaaattataccataagtttctttgaatagcaagaaaactttgatagcatatcaaacaattttcaaagcgaaattttatgaaaaattgccgaaaagcattctcagttttcggcaatttaaggcattttttcgctatttttaagttcagacatatacccacagccatttgcggcatattctgccgatatggctgtatactatttaaatataaataaagaaaacagcggttacgcatcaagtgcgatagtgatcatatcggtaagggtcttttcacgttcttcgggtgtgatgtcctccgttcctgtcagagggttgtttgtaacggtacagatgcacagcgccttcttgcctgccgccgccgcattcatataaagtgccgccgcttccatttctacggcaagaacgcccattttcgaccacgccgaaaggctgttcgacgcatcgtaatatacctctcccgtcaacacgtttccgacgtgagccttgatatttttctctgtcgcaagctcatacgcccttttcacaagtccgaagtcggctatgggcgcatacgttccgggcaagccgtactgcctgtcaacattagtatcgtggcaggcgccctgcgctattatcacatctctcggctgaacctgtggtacaagcgcacctgctgttccgattcttataatcgtttcggcttcatagaaattgaacagctcgtagctgtatattcctatggatgaaacgcccattccgcttcccattaccgttaccttagagcctttgtaattgcccgtgaagccgagcatatttcttgtatcgttaacgcagactgcgtccgaaagataattttcggctatgaattttgctcttaacggatctcccggcataagaattttctctgcaatttctcccatttttgcctttatgtgtggtgtaggtacgtttgacatactatcattttcctttctgaaaccatttgaattatgctgattttacttcttttttcggcacacagcaagcattttaatccaaaacatacatattattacattttttgcattgtgaatcggataataatatccatattctgcatttatagttacagcagtgtaacaaattcggacctgtgtgtgtgctttgttcacatattatacaccataacgagaaaaatgtccagtttcatttaaacgtttacattcttttttgtcattctgaacgaaaataaagccgattaaacaaattaaggtaaaacccacttgaccgtaacgtaaaatttatgtataattcatttcagccaagcgaaagacttggtgttatagatcgatacaaacttactgtaaggagattaaagacatgaaaaagattttagctttagtagcagtagtagctatggtagcagctatggcaacagcttgcggcaacaacacaacatcatcaagcgttggtagctcaacaagcgtttctgagtctaagtaatcagaaaaaacgaagaaaaccggaagcccgtaaaacgagtttccggttttttcagtttgtagaaaaagtttatttaaaaacagaataaattctctatccctttaagaacgctttgtcggctttgcgtcctgcaaagcctttaggcgttctatctcggcatccttgcctaaccccaaaccccttccccgtggtgaagggctgtgtatgctttgttggctctgcatcgtgcatagccttgcggcatacacgcccggcatccgtgccggggctatattactggggctaccgcccctagtccaagcaaggatgcttgcagtcagccgcacaaagccactgcacgatgcagtggcacaaatggctgacgacctgtgcgggggcttcgcccctgcgaccccaatttaataattacgagatttatcgacaggctgattctgtacgtttgctaaaatgcgttgttgaattcctcacatatctgctgtgccgaccttccgctttctctgttatagcggtttatcactatcctgccgtttctgttcatactgcacggctgttcacagcaggtcataaacacgcttatgcccgcactgccgattatctccgcactcccctcgctcagcgacccgaagggatatgcgaaagcgacaggccttttccccgtgacccgctgtaatttgtccgacagccttgcaacatcctcatacagcaccgtgcggtactgctcgtcgctctcgttttcttttctcgcacagccgtttctttccacgttgttcgagtgcatattgtaggtgtgatttcctatttcgacataaccgctgtcagacagcttctttatctcattccatgtcaggtaagcataagacaagtgctttccctcttcgttgatacgggaatattcgtccgtataactgccgacaacatttatgaccgccttcatcccgtattttttcagcagcggaagcacataataaagtcccgtttcatacccatcgtcaaacgtgattacaaccgttttttcgggcagtctgccgccctgctcacgaattttcacaagctgagacggaagaacggaaacataaccgttttcggacagatacgcaagatcgctctccagctcgcccggtgtaattatatattttccggctctgctttcgtcctttaacacctgatgatacatcagccctataaagctgtcgccgctttcgttttcggcataaattgcggcgctcagtatcccgagcatcaccgcaatgcacaccacgcctgccgtgattgccgcaacgcatattcttacgcttttcaagctatcatctccgtttgttctttttgtttaattatcagcctttaagcatatgattattcgttaaactgccgtatttttttgttttacaaacttttacacgtttttccgattgactgctattttttttagttgtataatttgcgtagtaaaatttgtttatatccccgatataccatagtccgaattttctatccacagctattttctattcaggagaggtttatatgaacacagataatatgcgagagcgtgcggtcgccgtaagtgttgtcgttcccgtatacaacgttgaaaaatacattgaacgttgtcttgattcacttgtccgtcagaagttcggatacgaatacgaaataatcattgtgaatgacggaacaaaagataattccatgacgatagcggacaggtttgcaagcgagtatgatttcataagaataatcactcagcaaaacgcaggcctttcagccgcaagaaacacaggtcttgcaaacgcaagaggcgaatatatcgcctttgttgacagcgacgactttgtatcgcccttttacatttccgaaatgtatacgctcgccgtaaaaaacaacgcagacatagtgcagtgcagatactgcaattattttgaaaaatccgaccgcagtataaatgtgcttctttcccaccgtaacggtgtaatcggcggaaaaaaggcatttgaaaagctgatttccgatgtttcggtaagaaattacgcatggaacaagctgtacagacgttcgctcttcaccgataacaatatatcctaccctgtcggaaagtgctttgaggacgtaattacaacaccccgcctgtttgcctgtgcggaaaatgtcgcctttacacgaaaggtgctttacagctatgcccaccgccccgacagtataacgggtcttgcaggaagaaaaatggtagacagctatcttgaggcatatctcatcttgtcggaatatcttgcggaaaacggcatctattacatctgtcgcacaaggatttccgtaatgaccttaaaggtgcttataacgctgtacggaatgatagcaaggcagtatatggcaggcaaaggaaacggcggcagctatatctccgactgccgtgaggtgagaaacactgtaaaaaaacaactgcgtctgctttctcctgcgtatcttaaaagagcgcagaaaaaacagcattcaaaaacaaactgacatatttccccgaaaagcattttcgtttttcggggaattttctttgcctgtcagacttaaaatcgctgtatttcgcttaattttcacattttccctgttgcaatcggataaaaaccgtgttataattagtgtatatgtaaattggagaagaaaagatatgagtattgcagtagctatagacggccctgtaggagcgggcaaaagctccatcgccaaagaatgtgcaaagcgtttaggctttatatacgttgacacgggtgctatgtaccgttgcataggtcttttctgcgaccgcaacggcgttgatatggacgaccccgtgagagtaagtgcggcactttcgcatatttctcttgacgtaaagataaaggacggcacacagcacatatatcttaacggctatgacgtttccgatgagatacgcttaccagaaataagcatggcggcatccaaggtttccgctatcccggctgtaagagcattcctccttcagcttcagcgtgatatggcagaaagccgtgacgtgataatggacggcagggatataggaactgtcgtacttcctaacgcaaccgtgaagatatatcttacggcagatgccgaggtgcgtgcaaagcgccgttatgacgagcttatcgcaaagggtacggctgtatcttacgagagcgtgcttacggatcttaaacagcgtgaccgcaacgatatgacaagagaaattgcaccgctgaagcaagccgatgacgcagtgcttgcggatacgacagagcttgattttgaaggctcgtgcgacctgcttgtcagaataatcaaagaaaaggcagatatcagataatgtatgaatttttcaggaagatagtatgtctttcaatgcacataaaatacaggattaaggtaatcggcggtgacaacagaccgtataagaacggcataaagggcggctatataatcgcctgcaatcaccaggattacggcgatcctccgctgatagcggctgtgaacaaggcgcacttttcgtttatggcgaagattgagctgtttgaaaaaaataaattcttcgcctggcttattacaaagtgcggagcgttccccgttgtaagaggagcaggtgacggcagtgccattaaccacgccatagccgaccttgagaagaacagagctttcgtaatattccccgaaggcacacgttctaaggacggcaatatcggcagagcaaaatcgggtattgcggttatcgcgggcaagacaaatgcccccgttcttccgatgtgcataaagtacgggaaaaagggcttccgcagaaaagtatggatttcggtaggcgagatgattcctgcggagcatatcgcactgaacagcgatgacagaacagagctcagacgtgtttcaaatcttattatggataatataaagatgctgatggacggtatgagcgaatacggcgatccgctaccgaagcagtataacccgaagcccgaaaagcagacggaagaggaaagcaagtgagccgttacaatattgaaacggcaaagagcgcaggcttctgttttggtgttaagcgtgctgtagaaattgcggaaaaagccgcagaagaaaacggcagctgctatacgctcggagaactgatacacaacggcagtgagatagcaagacttcagaagctgggagtatatcccatagattcaccggacgatctgccgcagggcaggacgcttataatccgctctcacggcgttgcaaaatcggtaactgattatatacacgacaagggcataagctgtattgacgctacctgcccgtttgtcgcaaagatacacaacattgtttcaaagtcggaatgccccgttatcatagcgggcgaccccgatcaccctgaggtcatcgggatagtcgggcattgcagaaatccggatgaggtaacagtggtgcgtgactcggacgagctggaaaaaatggcagaattgcagaaatttcctcgtcaaaatgcactaatcatggttgctcagacgacgtttaattcgtcaaaatggcaatcttgcgttcaagttgcaaaaaaacactatacaaatatcacgatttttgatacaatatgtagtgcgacggctgaaagacaaaaggaaaccgaggagcttgcacggcgctcggcgcttatggtcacggtcggcggaaaaaattccagcaacaccgcaaagctggcacagataagtcaaaaacactgccctgtaatatttacgcaggacggcagtgatattgataaagccgcagtgcttagcctgctccctttgcagggtggtacggtcggtataacggcaggagcttcgacacctgcctatataataaaggaggttcatagaattatgagcgaaattctcaacaatgaagaaggattcgacttcatggcggaggttgacaagaccttcaaaaaagtatatatagggaacagggtcaaggctttagtagtagctgtaaacaagaacgaagctgttgtagacttaggcacaaagcactcgggctacattcctgcaagcgagctttcgcaggatcccaatgcagctccctcagatgttgtcaaggttggcgatgagatcgaagccatcgttacagctgtaaatgacgcagaaggtacagttacactttccaagaagaaggttgacagcgttctcggcgtagaaaagctcgcagccgctatggaaaacaatgaaacgctcgaaggtgaagtatcatcggtagttaagggcggcgttatcattatctccaacggtacaagagtattcatccctgcatcacagacaggcgttcccaaggacggcaagcttgaagagcttctcaagaagacagttcccttcaaggttatcgaagtaacagaggcaagaggcagagttgtcggttctatccgtcaggctaagaaggaagcaaacgatgccgctaaggctaagttctgggagaacattgaggtaggtcagaagttcacaggtgaagttaagtctatcgaaagctacggcgtattcgtagatctcggcggagttgacggtatggttcactcaagcgagcttacctggaacagaatcaagcaccccagagagatcgttaagatcggcgacaagcttgatgtatatgtaaagagcttcgaccccgagaagaagagagtatcactcggctgcaagaaggaagaggacaacccctggaacaagttcgttgctgaatatcacgaaggcgatgttgttgacgttactatcgtaagcatcacacccttcggcgcattcgcacagattatccccggcgttgacggtcttatccacatcagccagatttctacagagcgtatcaacaatgtagctcaggttctttccatcggcgatgaagttaaggcaaagatcatcgaaatcaacgaggaacagaacagagtaagcctctctatccgtgcactcaaggaagaaatgcctgaggacgaggaagaagaagctgaagacgctgaataatcgtcaatattttttttttgttttttttttttttttttttttttttttttcaagcagaagacggcatacgagatttcgcggagtgattggagttcagacgtgtgctcttccgatctgtcacatccataaaaacctcgtcaatggaatagacatggatatcctccggcgcaatatgtttcaaatagacattataaatctgcgtgctgatttccatgtattttgccatctgaggaggcgctacgatataatccactgccagttccggatgtgactgcagttcagcaaagtgataggaggatccggtgaattttcttccgggagctttgcgttggcgttcagcatttacattcttaatcttttgaacgacctcaaacaaccgaggacgcccgggtataccaaatgtctttaacgaaggagaaaccgcaagacagattgttttttcagttcggctctgatccgcaactacaaggttagtcgtcattgggtccaacccacgctccatgcactcaactgaagcataaaaagattttagatctattgcaagataggttttattttccatgcttcagtcagctcctctcactttttttagattaaaacaagtatcatagaatattgtctgcagaaattctgacattatgaagcagtcgattcatatcctgttgactgggatggtttttcgcaatcccgccaatctttccgaatggtccatatgtatcgtaacctctgcaatgaaaagcagaaatataattggcattgttttcacgcaggattttttctgaagatttagcgtaattcctatagggtatcccacaggtatacaccacaataacattctttccttcaaatgatgttgccttcatgtattccagaagaactttatggaatgaaccaaaataaattcccgaggccagtatgatcaattcatactgctcgatggatgggttcctgttttttaatagatcaattacatccgcatcaatagcagacgcaatatagttcacgaccttctctgtgttcttatgatgtaccgacgcataaaggatgacagcttttttcattgaacagggtctccttgttatttctcaaaattcgaacagcatttgcgcagcattcggtgataagacggatcctgcggtttagcattcgtgatcacttcaagctttccttctttgataaactgctctattcttaaagcaatcaaaccgtcgctgattccaagagaatactttccaagtactttcccaatcagcattgcttccataaactcatcttcttgggcttccaactcccgaagaataaatgcatcatagaatgtgtccggcacactaacaagttgacggttcacaaccgcccgcaaagttgcattttctcgtttcagctgttcccagcggaaagataatgcatgcatataattcgcaggtactttctcacctgatttcgccagattaccccactgatgaggcgatacctcaccccatccggaatagatgaccactgttttatccggcatcacatgaaaatccggaagttttacataggttatatccaaattattatagccaatgggcttcaactgatcgataagccaacaaaatccgcaggcctcatccgggagatcgcttgaccaaactcggatggcttctccttcctgagcacggattagcaaattatcgaggtttttacgggcagtttcctgcatttcctctgcagcttccttttcttcatcaggataaaagctgacaagattttgaagtgtttcttcccgttgttttccaatttcatcttctgtgatgcttcctatactcaaagcaagcggaaaactgagaatatctttacgttcaacatcaaggggaattgcattctcccagttgagtctttccctttcttcggattccctaagcattttttcaatttcatcctgatttggaatctcactgtctccctcagtattcatgataatggcagaactgactccaccaatatagctttttcctgcggcaacagaaagagatccagctgcactttcactgaatacaacttctatcatatttttctcctttacctcagtcggaaatagcttgataaagcatcagacggataagttcttttgcagataaaccatatccatcagttgcataccgtcttcatagatgggatgatcgtaatgatctataaaaaagtttttaatcctatgggaacggtggaacccacatgcttcataaaacaacactgtagacggaacatctcccgtccccacttgtaaaatagaatattgtgtgctgtaagtcttttctaaaaaggtaataagcgcttttccatatccatgcccctgatgctctgggtccgttgcaatatttttgatttccagtataccgtcgccttcatcggtgacgacgcattcgctttttataccatcatcctccagcacatacataatacctctatccagatagcgatcaatcatattttcctgttcatccgccaatagcagcagagataagtattcttttttgttgttttttacttctctgatttccacggaatgcacctacactcttctctcaatctctccattgtttataatctgcagatttgttttcaggcacttacagaagctctctaagtttatccagaaatgcttcttcgccaaatgtattgattttaaaaaacagagcttgacttccacctgctgtaattgcagagagatgaacagcgtcgtcaccacattggaacaaggtcacactaaggctgacacgattactgcctaaccagctataccgttcaaaaacacgcacactgcagcgcgccccgttgctataaaaatcgctggaatcttccaatgaagcagacatactgctattcactattcctgattcaatcctattaagaatttgattataatctccccgaattgtctgttctaattttgccattctatctcacctcacgtatccattttgatgaccagttaagtagaagatcggagaactggagtatctcctcaaacgaaagggaatttttctctttcagttctatactggtccgcaatatattctgatctttttcctgcagcagcggaagaagatctgtctttttctttttgtagctgccggtttgcaaaaaagcaatggcctgcagcgtaaaaacagctgacttatagagcccctttaagatatccgcgcttctctcgtgaaccaaattgtggacgcacatgtggtagacattacaggcaccaatccggatagcgcgttggacatcctccttatgtatgttattgattaaatcctgcaatgtacccagtatgggagtcgtatcgtaacagaactgaaacaaatcagacggctcccatgcaaggatttcttgctttcctgaaataaagccgcatattttctctcgctctggcaagtgatcaaggagcatagcatatgtctccaaatcgcttgcggatacagtgtccaaaataatcactacatcaatatcgctctgatctccagcttctcctcgaccatagctgccctggagtccaagaaaccagattctgtcatggaattcattctgcatgacattgatatattgatccatccatttatcaatcgaaaaaaccatttttacctcctcaaaaccacatagaggcttcatcctgaaaggttggagtatctccgttcttataagggtcatagcggttgcagttgcacccaaattctttaagagatacaattttatcatctaccgaccagtggattaaagacattccatcaaaagcttctatccgtccatcgtccatttggtttttgaaataccattctacaaccgtttgctcatttgtatgaataaattgcttaatgtcccatataagaacagttccacgctgattccattcatcaaaccagtgttttattttatttgcgccatgatattccggtccccagctttctatgtacactgcatcaaaagaaaacaaatccataattccatggtctgtttttttcagccacatatcaaaccacatccgaatcttttcttctctggtattcatatatatcctccaatcccgatgcagcaaacctcttcgtaatttacttcatctcagattttttgcttcttactttttcccattcctccaaagtaagcctggtaaaatgttcggttcgaatatcgcccaggggagattgctttcctgtttcggtatgatgatatagaaaaccgcatttctcctggacacgttttgatttatcattgccgtcatagtaaccacaccatacagcgctgcaatgaagttcatcaaaacatcgttcctgaagtctgtgcaccgcttccggaatcaatccctgaccccagtatggcacgccaatccagtagccaatttcagcttcttgttctttcatcggagcgcttccttttggggcaaacataattcccacactgcccacaggttttccggtgtctttcagaataactgcataagtttctggttcggacagaaccgtccggataatttcgaggctgttctcgacgctggtgtgcggcggccatccagcaattggcccgattctgtcgtcctgtgcgtagcgatataattcttctgcatcccgttcttcccatggacgcaaaatcaatcttctggtttctaattgcatttaatcacccacctcatctattgtaacttcctcaaaactatattccaacaaatcctccacattacatcccaatactctggataaggcagaaagcgtttccgctgctgctctgttgatatctttgcttctattttcatattgctggatcattcttaatgtgactccagatttttctgacaatagtttctgcgataactgtcgggattttcggagcgtctgaagtttagttggtagctttttccttcgtgcaatttcattcatagtattgacgaactttagttctgacgcttcatgcaatgtgtaatacattttcctgatttctcgcattgtacagatttgaagaatttctttgaaagagagtgcggtataccattgataaaatgctataatccacccgcaccaatactccggggaacaatcacgatcctcccttgggtctgacattttgatggaaactcccgctttactcaatacttcccaaaccaattccgttccggattttcctgaaacaattcccggaaccccattttcaaactgtgaggcaataccgccaacaataaacatttcaaaaaaatcatccatgtccaaatagcagctattgaccgcataatccagcatttctccaagattttgcatcgcgtcatctaaatatgtctcactgtaagcgtggatcatccttttttacctcctcccgaagtatgtctctcatatacagtccattgatatcctctttatccaattcggctcgaaaagcagctcttgcttcctcatctcgggattttcgtttagcataatattctgtattatccacaacagaataagataagaaccgaatctcttcaaatgcttttggactttttagaacgatttgttctccaagttttcctaacttcatagcatatgacaactgagttagagagatttcattgttaataaaagctcgggcaaacgagaagtaggaatcgtcggctcgatatcctataatcacatcatatccagtaatatcaattagaaaattgtctttcaaccactgaaatcccctacgcataaccggagtagaaatccggaatcttctgtttaccatcagcaaagcaagccaatggagaatcgagtactctgacaggtgtagcaccttcagatgcgttaaatccaactcatattcattaacaaatccatcaatatttttagtgcaggcccattccttggcaagttccagatgttctgtgcaatagaatccgattccataatcattatacggctttccttttccgtaaactggctgtttaacaatttcacttgaaccgtgatatataattatcttatccaattgctcatctccttaaactctatagatgatttacaactatattatatctccacagagttacaaagtcaacaaatctaaataagatgtgtctcaaatttattttaaaaaaacagacacacttttccgaagagaagttgtctgtacctttttttaattaagacaggtttatacacgaaataaatgtagcatatcaatgattacttctgcttttcactgcctctgtttatgaaggtagtgaataatcactcagtaagcatatgttcgttaatgaccgtcttaatgtgcatattattttataaatttgccaaattatagactatcttcttttttcgctttgcaagctccatatatttagcagctccgccaaagctatgacaaacatacgagataacgtaatccgactgttgaaccatccatttgttacgccaatctattgcaaaacgctttggaactttttccagaccatccggatacaaagtctctagcttttcatacccggtatcaaattcagacttaatgccgggcatataagctaatacggtacaacactctaaattaggatattgttttttcagatcaatcaacacactttgaaccattcggtcaaagtttccatttgacccgacataaaacgtggtgacacctttttgtaatattagatcgtcaattactttcttaatctctttttttatatttgtaggactgtccgcatgtccgaaaaatgtgcagactttttcttttttttgcatttccacagttctcgctctccattttcagattccagcaagaacatttctgatcaagactgatatccctgtctttttccatattcaacaggctatctaaagtcacactgaacaactccgccatcctcataagtaccgtaatagatggttctgttttaccattttcataataggaatatgtagagcgatccacattaagaaaatttgccacttgctgttgcgtcatttcacgataatctcttaatagccttaatctttgtccaaatgcttgacgatcaaattgaggcattcaagtcccgccttgtgaatttttctttgtttaaaatacatactataagcgttaaaaacaaagtaataatacttatagtctatcacacgttaaagataatatcaatagtctgtgtatttgagaaatgaatatttatagactatttacataggaaggaggatggtctatgggaatcgcacagactattggacagcgaattcgaaattaccgattgcaaaacaaacttagtcaagaagaattggcagagcgcgctgggtgtcatcacacctatattggacaaatagaacgtggagaaaagaatgccagcatagagagtatcgataagattgcatctgcacttggaatttcactttcaaaactgtttgaatttcttggcagcgaaacaccgaaagaggatgactatgcataccaagcttatgagcttattacagctcaatccccagaagaacaaaagaagctttatgagattctttattcgatcaaaaaatataaaaatatttgaaaacatcagccgattatactgtttaaagtatgagcggctatttttttggaagaatcagttttgctacaatatcatcttgatgtacaaaaggatcctcccaatatcttgaatcaaaagaattctgagtattgtctcccaacacataatagcagtcatttggcactatcaaaaatttactttctcggtctggcttttcataacctaccatatattcaatggcttctaaatctacgatatctccgggaacagctgcaattcgtttcactaacaatttcccgtcgtgcttaaagataacaatatcaccgtaatttaaggaaaaataaattcgattccccaaaataaagctatcttttgataaggtgggttccatggacgcagtcggaacatatccgaaaacaaaaacaaatctcattagtaagtaaataattactgctatagccaatggaaatataaatggcttcactttattcaatactgctttcataaaaattcctttctaaacagaaaaaaagggatgctttgaacaaaagtccaaaacatcccttcatcgttcttacattaacctatatcatatgtaccggcaagcctcacgatttccggctgtgatttcaagtattttctggcacgagacatccatacgcgtacctttccaggagaggtatgaagtacctcgccaatttcataactgttgtagccgtcggtagacattctaagtgcctgaatgcctttttggataatttcagttgcgcttgtttcagcattgctgatggcattttcgatttcaagactctcactaaaagatgaaaaatgtgcatcctcctgtgcttcatagttatatgttgacaggaggatctctctgtctcccaaacgattagcgcgaattagcgcatcggatatctcatgccaaatgagtcggtatgcataagtcgaaaagcagccacccttatctgtataggctgctttacatagtccaatatagccaatctgtacaatatcatcatatgaatagataccaagctggtttgtaccatgaactttatccttgatcaccttaccaaccagtcgcatattctgctctacttttttctgttgttcctgcgtgagtttcatgaagcagcacctccttgaatcacctcaaattttgggacttttttatttcctcttttttgaagcattttgcgactttcctcaatgactaccttacagtagtattctcccagatacccaatatgggcttttgacagcggggcggaaagcaaatctgcaagccattggtaggcgtcttgtttgctcatcattccactcaaatagagctgatcaaaatactgatgagcagttcttctaagtgtgcgcagctcatgatttgctaagctgccaacaggaatggtggttccagtatggacacgaacataagcatcacattccggataatttttacatacatacagcatcgtatttttattgttgtctcgatatattccatctgcactgcgtaaaatagcagggctgccacaataggggcaacggatctgagtgttgttaactccctttcttttcttcttatttttcattgtcacattcctccgtataaatacaaaaagccggaaggtctgcaaaaaaatgcagagctaaggtattggaaaaatgtccaaatcttaactctgcagtattcaagcagccttccggcttaatattcaaaaatggcttgcgtcattgtggatcgctctgtgcgctaatccgtaacgggttccatgcctctgtgcggcatgtatgacaccgggagctctccgatgtaccgaaagcctgggcgcaagcccctgccacgtttatataatagcacagagtttttatactgtcaagccattttgaaaactttaacgcattttttattaaaaagttttcaaatcttttgttagctcgcaaataaaagtcagtctgggatatctattcatcatcttcgtcgtcataatcctgttgggattccgctgcttcctggcgcttttttacaaaatacagtccaatcaatccaccaacagcaatcagcatacctccgccaaataggataagatgaaccactgggatgcctgcaatggtattgctttcgcctttttcggtttcagattctgtcttttcagagtttgtggcagaggcttgctcagattgtggaacaggagtgcttactgaagaattcatgcatgacagaacataagacttgcttcctccgatctcaagacgaagaacaccgtcttggtcaacggttatagttcctggataaagaccggcgtctgttttcaattgaaactcagtacctgcccaatctactcccaattggacttcgagcttttctggttccatgacctgcagttctgtaccgtcagtgccatccttggcgaataccgtctgcggaatgagtacagcgattattacgcagactaaacttagtatatattggagatatctttttttgaatttcataactgcctccgtttcttccttctttctgggtttgcgcgaatgtaaatataattcgctcaaagagccggtccttctaaaaactcagaaggaccggtttcttaatgagcgagggataattactggtcgtttttggttttgcggcgttttctcaagcatacaatggtggtacctgcaatgccggtaaggccacagatcataagaccaatccacagaccgagatttgtttcatcacctgttttaggtacatctactgtagtcttttcattgtacacattaaccgttaagacctcatctgctacgatttctacggttactggatccgcaattttataattggcgctgacgctatttttcagttcggttactacatattcgccgatgcgcaaattctcaatcagaatttctccagattcgtcggttacaaaggtttgatcataaccatttggtccggtcacacggaattcaaagcctttcttcgtaccatcggaagaggtcttgatgattttcagcgaacccttttgtgcctggttaataaagcccttgccagcttcattttcgacctcgtaggtttttccatctgtatcaatcatgatatagtatacgttttcgtccaaaacgaacccttccggagccgttttttctcgcacgagaacgccgccataacgaatgtcgttcatctcatagattcccttcagggtttcttccatggtgccaagaagttcatcttcgtcatccaattccttatttccgttactgtctcggaaaacttcgaaaacagcgcctgacaatttgttttccggaaaatctgcatcatattttgttaaatgcaggttaccggtaataaacgcgttttcgatttcaatttcaattacttgtttatcttcggtgatagaaaccgggaagctttcatcactgagaacaaatcctgtcggctgcgaaatttcacgaattacccaatctccaagagggatgttcttaaatgaaaagctgccgtcatctgcagaggttgttgtcatgagtgcattctcttccgtaaattctgtgcaatccggacggaataacccaatgattgctccaccaagagcattgccgtcttcatcgacttttttgccttggatttcgccgcgcttcagagtgttatcgactgctgcaccatcatttgcagcgatttcgatcagcggaacatcttgaccgccatactcaaatacaaatgggtatttctcatcgctaatgatgtaatggccatcaacagacagctcctgcaaataatagctgcctattggcaagtctgatgtgcaaacagcaattccgtcttctgatacagatacaacttcaatctgaccatctgcggggataatgcttccatcagctgctgtaatgtcttctgcagcaaacaagccgaaggtaacagaagtgatttcgccgttcattccaagtccgaacagttcatcctgttccaaagccttctgaatgctcacttttactttttgacgttcattatagaatcccgtctctgcttcagtaatttcaacatcctgacctgcatatacaagttctacttcatggatctcatcattgagcaccatcggatatggagcttgtatctctttcacattgaattttccgaggtacaactctttactggtagcgataccgcttttatcggtttctatggtatccacaacttctcctgcggagtagcggagagtaccatccaaagtataaatatcttcagctgctgtaatctcataaacagcaccagggagaccctgcacagagtagacaggctgatagattccgtcagactcagttacactggagaacacttcaccggtctttttaatatgaatgacgcctttttgtgcgacattggacttttctacttcaatgatggttacaccatcttcttctgtggaaccttcctctgtcacatcaaagtaaaccggatccgagtttacaacataaccatatggagcatatacctcaactaaagaatacccggacccgtattccaaaggctccggagtaatcagatagcctttatcatttgtgtagaaagtatcaattgtggtaacttccggataggtgattgtttgagtgatctgagttccatccggtttgaaaagttggaatccggcaccggcatacggaatagtcttgccagtctccgcatctactttaataattttgatatgggattcaaacaccctgttgttcaggatatagtgataagtttggccatctttggcgatgaacacatcgaaatcatcaatgagatctcggccttcccatccagatacttgatgcactgtataaatgccataagggaggtctttggtttttgcatatccattttcatcacaggtgagaaaatctcgttctgaatcagctgctgcatcgtaagaaccagaagatttcagataaacctggaactctgcaccgctttctggtgtttcaattccagtttcgccgtcatcagtgtgcttaatcaatgcaatgttacctttttgtacctgttcttttacatcattggctgttgtattcagttctactgtataaagctccggatctgctccaaccggatagattgtaggatccaacagataaccttcacttggattgatctcacgaatggtccagtccgtatcacatacataatacccagttgtgaaagatccattgctgtcagtagtaaagctgtctacaagtgtttctcccttataaagcccataggtagcaccggcaagcgatgcatctccctgtgcttcaccagtttccgcatcgcttttagtaaccgttacgcggaactttttgagaacattgtgtacagattggtttgttacttcattccattgaacagtagtgttctgtgcttcgggaattacatagcggatcgccgtatctacctcttccagaatatacggtgtgctgccagaaatcaggacattgtcaaaagtcgcaataccggaactgtcggttactgcatactcgtcaacaggaattcccgccaaagaagtgccatacaaatgaaatttcataccttctgtaagcccatcttctgatgtctttgtaacttttaggctacctcttttcagagtgttattaaatgtaacagtggatgtttttccgctgacaatcgttactctctggacttcctgcggctcatacttatcaataacctgttctgtcacagtatagacgccaggattcaaatcactgatatcgatgacaccatcttcattggttgttttgacttcgtgatagccttcaccagaaatcgtaaaactgattccacttacttttccatcttcggaagttttcagcaaatgcatatttccaaccatgatctcaagtttcaaataaccggttacagggtcagaaacagtggcgccataggttgtaaaatcctgctttcctccaccaatgttgccatcggaccaaattacgacgcctttgcgttcaccattctttttctctgccatgatgctgactgcatctttgggtgcttcattacagcggattgtgagcttatttccgtttacctcaaatttcatgccgcttgtactgctggaaaaagaatagtttcctaatacgccgtttgtatccgttaaagtaacagaataatctgtgccgttccatttcaattcgtaggtatcagcacttccggagcttctggtaaaaaagctgggcagcattgtgtgctgctgtacctttttctccatatccgtgtaatactggaaaatcaaatcgcgaaggggatgactgtctttgatagtgtctttaatgttggctttgccttgtgcatgcgcatcaaccttattaaactgactatcacgttcccccacgactgtttcccaaattagaagctgcgttgcaatataatgtgcgacttctttggtatgagttgggttggacatatcccagcttgtttctccgttaccttgccatccatactgcataatgcgcccgatataagctttgataatagtcggtgcaatcgtaggattcaacccggaaggatagttgttccagaatgtttcatcaaatccatcgtactgatcgccggtgtggacaccaacgcctggctcaatacaatacatggctttgccttcaaatgaatcttggaagtacatagaataacgtgatttcttctctggagtactccaattccccataaaatcaaacgccggatgtccccagtcgctgggatttgttgagttatctccgcttcttggtacatcaagaatataagccgtcatttgttttgtgtctgcaaatactgtcgatgtcattccggagaagactcccagactcataacaatcgacatcaaaaacgatatgattcgttttcctttactcatcataagttcctccttaaaatttgcaaaagaaaaagacccatcatttgatgagtctttttagcatagtgttaaatttaagcgtatccaataaaaatgttgtattcgttgtttcccaaatcctccgtccaaatccagaaagcagtaaagccactttctacataccaatttaaacgatcacacaaatctctctccaaaaacttgctgtcggcattcgcaaagatgggatcatcattgcaagctgttgctgtagaatccaatttcaaacctatgtactggccatattctatcgcatcagttaaatatggactgatgtcaaacggtttttcttcaggtacagacggctcaggtgttgattccgatggctctgttggtttcgatgttggaggagatgtttcctcgggattggatggttgaggcttttgttcaggcttttccgccggttgtgattgtttcggtggttctttatcattagacggtacttgcgtatgggaagatgcaggtggtttttggtttcctgaaccttcagaattttcagtggcgacgctttgactgtctgatgtatcagactgggtttgtatatcttcacctgagtctggttgttccgattctaaactggaactactttgttcttcagatgagctatcttcttctggcatagatacagactgagctgaactgcccgagttttccttattcggcagatagccggaacagctgcacaaaagcaagaatatacaaacgagtattggcaaaatgaatttcttcatactgtgaccctccttgtgtctttaccttattacaccagagtatcacaaaaaatgcaacatcagcttgccaaaacttgatatgcccgatctgcttcatcaacacagcgatttaacatttcgaaatatctctgtggtgatatctccgtatccagccactgagtcgcccgataggaataacatcctaccgattcattgatcgcatgactcccaagtacactcttcagattcagttcattgaccatctttttctttttggcagaactaacatgctgaatagatcgtgcaaggcagattaccatcaatggatgaagcgcagaaaaggatatctgcagataatagtctcggtaaccaagcataatggatgtatcatcttggtcatcggcggacatttgatttagaatcatactgcgtgtatgctctgcgatggtctttctacgctcctgttcttctttgctcagctcacaatactccatacttttatcacctcccatactaaagttcggttggaaaattatcttggtgcagcaatatgggtaatcgcaccccagatacgattgctctccatattgagaccgagaattctaacagtgacgcgggctcctctcggaggacgaccgcgtttcggatagctgcagaggcaatctacacctccatcaagtgcgacaaacacacctgttgtatctaccatactgaccgttccaacatagcgatttccaacagaaaatcttctcaaagctttttcataaggattttctcctgcctgtttgaccgatgcactggctttgatatgatttcggtcactgcggtcaatgcttagaatcttaacgaggacacgctgtccaggctgaaactgcgaagaagcatccagtagtctttgataactcaattctctgagaggaatgtaaatttcaaggccaaacaaatctacaaaaatgccggcgcgaattacagaaacgattctcgcttctgcacacactccttcataaagaatgttatttccgtctctatcagtaccgaaataatattccttgcgtttggcggccattgcctccagcctgctggcaaccgcaacacctgactgaggatcaatgcccttaacgatataatccacctctgcaccgaggcgttttgtcagcgtatagtgcatgacatcttcttgagatcgtccacgattatcctcaggtggaagaacagcttcttctgccggaatgatgaccttgaagtcgccgtgataaatgactgcgagagaacgggagggattatcctcaggctgttcaacgccttgaatcgtgccggtcaggatcttctgcgttttcatagactcaatcaaatccaacaaatcgttcctggctttgtcagcttccgtttcgaccgtacgatgctcatcaattgaaagaacatttacagcggttctggtatttgcgcgtttccgtctggtagttgttttgacctccttttcctctgtatcagactcagattttggagtcctggtcctccgggaccttcgtggtttctcttctgcttctgtttcagtttgggaaacagtgcctaattcttcgccttcgacgccgtcttccggcattcttgcttcagaattctccgattccaagtcagtctgggaatcagaagaattttcctgaggcaactgttccagctctgtttcgtttcttttggtttccatctaagagttcctccttgtaaattaaaattcagtcggcggttttgccgaactgtataggctttttttgcgttccggttttttctccggttcaggtgttgatataggctcactttgaattggtggcgaacaaacataagtcggtcgataattcataatagaagttttctgaatctgtttaaccatcgggtgttttgtgtagtccattttcttcagttttaggacatttcgaccgcgaataatgcatagcagctcttcgtttggtaatcgaagcacttcatcaggagtaagtaagcgccgttttccttgcccttccgtatggcgatattgcggtattacttgagcaactgcgatagttcttcttaccgtcatagtagaattgacttctatgctcatatctccgctgcgagcggaaaaatattctgcgctaacatcatcggtacatccaagcataagttggatgtcacagtttccgacgatttctgaccaaaggttgttgggatatcgattttgtaactggcctagactttgtacagccagcatcactcggatatttcttgagcgaatggtactgagagaacggcagaagtcagatccatctggcgctgctccaagtttgcctatgttattaaactcatccagtattaaattaacgggaacgtcacagctgccatttggtctggagtcggcatatctcgtcagcttaataaacatacatgagaaaaatagagatgataaaaatgccattgttgcatcttgatcacttaaaacaatgtaataggcacattttctcttagccggtaaagtcagatcgatgtctgaacggcttgtaattttctgaacggcctcgttttgaagcacctgcaatcgcgtaccaagtcccagtatgatgccggagcgaaccgtgtcactggactgagaaaaaagattataaggtgcccgtgccggatggtcgagtggaagcttctcaaaaattgcagtgagttgtctttcactgtgttgtgtcaatgcctgatacaccgccggaagatgcttcatatctacattacgactccgatcctgatcaacaagtaggatcaaagcttttagcagatttccttcaccattatcccaaaagtgatctccttttccggaactggtatttccgataatgacattcgtcagaacctgtgccatcaaagtatcaccgtttaagtctgacatacagttccaagaatcactgtgctctggggttaccagattaaacaccttgacttcgtagccgttgttgcggtacatttctgctgtatctgcataaagctctgccttgctgtctgtaataattacagattcaccacgtttcattgcctggaacaaagcattacgaataacagctcttgatttcatggttccggatgcaccaaaaatagcaatatgacgattgagtctggtatcctttggcatacagacaattttgcctttgtattcgcccaaaatagtaccctctgctttttcaggtgtggttacttccagctcctcttgcatttctttctcgctcatccatgtggcggttccatatgtgccgttttttaccaccttgaaacctcgttcatcatagtctttgcttccaaatttatcgtggaactttacataagcaaaaattgctgctccaacaaccagaataaataggatccctttcatcccgtttaaggtaaatgcctgcgggaaacagaatagtggattaaagttcacaggacgcattgtgttctgtccgccaagcccgccgctgtccatccaaatggaatagtttgtgagcaattgtccaatcagtccacccaaataaaaaagtgccgccaaacccagtatggtggcagcaacaatagcggcttttctatatttatctttcaaccataaattcctccttttgccccattgctttttccactaatctcatactgataaatttcaaatagacctgtggaccaagatatttacggaggagaggtccctgttcaggaaaacataggatttcaaatgatttcatatcagtctggagtgcttcgcgcaatcggattaagcgtgcaatatcattatccagataggaatacacatacttgttatcaataaaggcatcatattccaccataccttgtcctccagactgagtttccttgtcaaacaacaaatccaggagtttagttttccatccaggtatggaaagaagacgaagtagttttatgccaaagtcattcataggtacaaagtagatgttctgatagatgctgtcgaatctaaactccaaacgcctgttcttttcagtttccatcaaggttttgaatgcaatctcctcagactcacctaaaagaattgccgactgaatgttttgaacacctgcattcatacggctaatctcgattagattgtgtaaagccttgaactcacccataccattccatttcataagagcgttgcgggtgttgtataccgcataagcttcgctttgagaaaatatagcgcccgccatccgggtaaacaccgtcttgctcatttctgagtctccgagtttcttgagatccttagccaggtaatatgcagaatattccggtactgtcagactgatttgcatattctgaagagaaggtaaagaatatggccggcattcaatgccagctgccatacacatcataaccgattcggcaactcgatgatttctttcgatatgagctgcatcacccggaaacttatgatcccaaaaagaatgcatatagtaatcatacgcatccggatgaatccattccagtatgggaagagcagcttttgaaaaccggatggatttgcttgaacctttaccggatacatttaggagcttacaggttattctttcttcagtctgggtatgggggaggcgataatcttgtggtgttgtcatcttgtgaaccaatgccttcagcacccgttcatttccaagaagtttcaatgagcgcattggaaattcacctgtcacggatagcaaggtgatgatgttgagcgcgtgactgcccgtccgaagtgtaatcatcccgacctccttagaatgaggcgttttaagacagtatgactgctctctttgtcggattttccatcgcaaaaatgcctccaaacagctgatatttcagggctttttcggttaagcaaatatatgtaattttttctgctcgattttctcccttttttacatatgtttttgaggcggtttttggcattcttcatagagtttcactccttcttcagggatggttttttcaagaatcagccattgtgcaaactcatcacgcggaacaacataaacctctgttcggtcgctctctccggcagcgctgcaataataatggcaacatttcaaaggggcatcatcctgcataacataaagagcaacaatgtctgtcaccatattaacctcgatattatcgtgatcgcgatactgacgctccgggcgatctctgctgtaaacgtgcctgaatatcaaaacacaatccgtatagcgtactgggggtacataggtgaagaaatgctgcatcaccggatagagataagagcggatgtatgaagctgatccatcttcttttttagggagaagtgccggtattcgcaaacagaaccacccttcaatggtgaagcctattttaacggataccgattcagaaataatcagttcaacatcatgctttgcgcaaggcgatccggtataagcaggaagtgtccttgtaaccagtgttgctctttctgcacttgaggctgcctttaaagccatttcataggctgccggcaattctcctgactgaaccaaatgttctacacattgaagctcaacagatagccgttttactatactttcggctttttgcagaactttctcaaatgcagttttagacatctgcattttttaacacctcctctgaataaaaagtaacattaggttcttcctgaccgtcaaaatccacagtggcatataaacatgggaccttaggcagataaagtgattggaccatggaaatatgcggaacaacaatgatatattttaattcttcctgtggctgaagcagtctggttaaatgttgttctccctcatacaatacgacaatctcgtagcccatattttcttttaagaaaaagagttgtgatgggtaaactgccgggtaatgggctaaaggatccacatgatcaataaagtacagtaaaacccaaacagcaagaatcaggcgctgatcaggtttgcacatttcatctaacgcgagataatatcctccgacatcagtaatcctcatctgtcttttaagactgcggattattttttctgctgtttccggagttttgtctcttaataagcgtatcacctgagcttttggcagaggcccgtattgagacagccatttgataatgtattgctcatcttttaaaagcattttttgttcacctccttgtgcgcattttttataaaatacgcattttagccgaaatgcgtttgattttgtttccgtttcagcaaggcttccagctcagctcggtcagtcgttatcatttcctgttctgtttttgaggcttttacgactacggggatcttgctgttgttactgtaaatcaaagcttctcctcgttcaaactgagtaatggatcgaatttctgtttttgtaagcttcaatgtctctcgtacatattcagcttcatccggctccagattcaagataattttgtttttgctgttgtttataatggctcttccatatttgccatcatccagactaaagaaatctgataagtcttgtgtcgctgcaattgcagcgcctccaaagcctcggattgttttaaagattgtcaaacagaattcagccgcctgacgattggaagaagctccgattaactgccaaatctcatcaatcatgattgctttcttcttggttctgtctgctttgatattgtcccaaacataatccagtgcaatcatcatcccaaccgggagcaattttccttttagttcagacaagtccaacacaatatatttattactcaaatccacattggtctggcgattgaaactttgtgctgatccggttacaaatctgctcacaatcgttgctatacggcttgtcatagggttttcttgaaggtgcttatgtaaatccccaagtatgggcattttcttcataatcggcggatttacagtcatatcttcatacaatgaactgttatcgtgagttattccaaattcgttgtaggtctttattaacgcctcatccaacatctgttcttcttcattcgtcatgtccgggataagaagcgtaaagaaaatcatcagctgctgaatttttttggcaagcatagaatccatgtcgttgtagtccacatcatcaatcagttccatttctggagatatcgtatggcgtatactcatgacgtttatacaatgaggggaaccaggtgcaatttttataaaggttcctccaactttatcacatgcccttttgaactcgtgccctttaataggagccacaatataacactgaataccacgcattctcattctgagtgcgagcagctgcatagtgaaggttttaccagcaccactggtgccacacatagtcaagtttgcatttttgtttttcttcgtattaaaaagatcgacaatgcaaagcgaattgttatgcctattgattccaagtaaaacgcccgtatcatccgacatctcaaagcttgtaaacatataggaagcggcagcaccgcttgtcaaaacattcctctttgttttcttttgcaatctgggatctatctgtaaaaatggcatgactgacctgagagctgcttcctgttgaaaacggcaatcactggtatagatatccatagatttcagcatatccaccatctgccttttgcgccacatcagttcttcatagctcttgccggatactgtgataaaaacagagatgtaaaacaaatcctcattctgattggcgattccgttttttatgtagtatccggcagaaatggaattagccagttcttcataatccgtactggtatcctgaaggctcttgagtttagtgcggttaaggcggatgcgctgagcaactttatcaatagttttacttcgattttcacgctgtaaatgcaaatctacatcaataccttcacccgcgttaataagagcggacatccatccaccacgcacggtattcggaaaaccatcctttttgatataaaggaaggaataatagagaccgtccatgatgatgtaattgtaatgtgtcaggtcaataccgcgtggcgttataaagtgtgagatcttaattgggggaactgggtctacaccaatcactttcttttttgcggccattgtgtctacaactacacgattgacacgagaagaaaagggttcatccacacatgagcgcctgttaaaatacatatacaaaatttctgcagttgcttcatcgggatctttaggctgaataatggaatttccgcactgcataaaataagctcttgcgttttgttcagccgtttgcagcatgctataaattttcccgtaatcattctcctcatttcggtgcagctcttcgtattggaagattaaaaagaagcgcctggtcagcgcttcacgattcccgatatctttaatcagtcgaatatagtcttcgctgagttccttgcatttttcattatcttcctctttcagatcttgccgtaccatagcaatgtgtttgtctgagtcggcttttcttgtgatagacttgaactgcaacctcataggagatattttaagccagcttgcaaaggaagaaattatattggcttgctcctcatcagagcggagcaaaaaattgattggctcgatttcgaggattttaatatagcgcccgtcaacagtttcaataataccgttgctcaaattttttatagggagaaagtcctgaacaaactcaagcttttcgactttttgcttttttccgcttctttgtttttttgagctgtgctttgtcatatttgtatcccacccttctcatatgaagttttcgtctgtgaattccaaacctgcatatatgacccaagaactgaaataaggaatctccgtcgatacccataacggacaggactgcaagaggcatgagtgttactaccattacaacaattcgaatggtgccgggcatcggaatcagcatcaattctggataccccaccaaaagaagaagaaaaacggtttccactgcatttcttggttcaaccatgccgccgagtatttttcctgaatcggtatagttggctgggattgcatatacatttcgaatttctttttcgtccatataatcatacctttctgctgtatcaaagaagtactccgatacagcacgggtctattgtcttaaagaatcaagtgttataaagccctttcagcatattatctacttcctcataggacgcaaaagaaacatttcgcttcaaaagataagaaaccgcatcactccattcccacagagaataattttgtttgtttggaaaaagatacagttctctgactacacagtcgtttatcctatgattcaggcgaagatcagaaagatatgctgcatgatatttttgggccaactcatccagaagtcctttcatttttcctcctatcacaaactatctgcccaatctgtagatttttgctgttgttttatatctgccaagtcttagtgcttcctgatgatccggaacatagatatctacacgatggatatcattttctataccggagccgccccgatcttccactgtatacatagtgccgttaatcatgatttgtgttccaaacggataatggctggacattgcaaccattccttgtgccactggctttccacttgcagtaatgccactggcgttttcaccacagcatttactgcatgcacagtaatgtgtaacatccacttcgatggtggaaatggggtctccagtagtaccgttcggcacaggagcatcaaaatctacatctttggggcgtctaagtgagagcgttgattcataactcggtgtgttaaagatgacaccttcaccgccggaggaatgaacccacattcgctcaccgttatcacctacaccggcataaatcaatacatggttccacccttgaccatcttcattcattaaaaatccaagatcaccgggtaaaagctcatcttctgtaatagcataggagttatcccattggctccaagtgccttcgtagaggctaactccaacagccgttttgtaggtccaatcagtaaaaccggaacagtcaagaccaaatgggcgaatggttccagttgtactggatccagctgctgtaaccagtttcggtgtattccattcatcattccatcccggaggagattttccaccccagaaataaggaacctttccaacaagagaaagtgctgtttctaaaatatgttttctgactgcactgcaattttggcggctcacaaatgcaatcagctcctcatctgtcaaaggaacactttgtccatttcctactgaaccgtacagtgtcatttttaaggcatttgccatgcttttaattacctgatcataggtttgacttgttcctccatactttgctgacaaatccaatccaaatgctttggcaataatggattcatcaaaagaatgaatggtacattccagataggttactgtctttttcgtaggggaaagtgtttcttcaccattttgagtgtaataagtttctgtacgggttccagttatagtattaccggaataaaccggaacggaaacgcttacctcctcatatttaggaacggttacagatacatcggaagtttttgactgatccggcacatagtatgttttcgtcgcagtctcataccgatattgcgggactccattgattgtaccggtcgtcacagtttttgttacaactgtaactgaaacggatttataggtgtaatagttaaccggtaccacgatttctttcgttttctctactgaagttaccggaaacatgtcttctttgtatgtactcaattttgagcgcatatctgattcactggtgtttttttggtccatagatatcgaataagctgcaaggatataactgacatcatacccagcagagctttgtccgtgattgatcagagcttccattgataaatcatagtcataaccgccatcagtgataagcttctcaacctcatctaaagaatagttgtatccttcatctacgatctcagaaaccgctgtagataaagtttggtaggtccctgttagagttgcattagaatcgactgtagacccatctaatccaaaaatgctgttcgttataatagttggaagagaagcaaccataacaactaaaaaaagcaggcatagacagataaaaattaaaatcttatatagtgtatgtcgaagagaccaagctgctgaaaggacagcaccccaaggacctccggcagctgtaccagttgcaatttcagcaactgcttttccgccttcaacgcttgcttgaaccgtagctgctgcggcatttgcagttgcttcaacacctttggcggctgcctgttttgcggcttcctgaccgagctgtttagcggctttcgccatttgtgcagcggcttgaccataattatcaccgccatctcccatttgtgttttgtttggctcggccatctttccacctcccttatattggataaatgaaaacagccatagtttttggaatttccataactatggctgttttacttcgttaattttttcttcggggcggtttggatgaagtatcgctccgcctttccggattttcaaaacggcttggtgtagatttgtatcgaacagtttcaactgaaaccgactttacattttctccatcataaacaggttttccgttctcatagactggtcggcgctccactgcagaatcgccatgaatagcaaaccattgatggccgtctttgtcttcatatacctgatagtctcctctcggagtatcataaacagccgtatcgtagaaggcggtgccgctgccatcatcatgacgcacttcaaagtgtccatctcgctggcttccatctacagacatgatctgctgctcatatccaggcataaagtctctaaatacgctttggttataaatggttgcttcatcaccgttttcgaattcaggcacggtgccatgttgagccatcgcataccattccacgccattggcatctgtcataatggaatgaggtgcttcaggctcttgatagaaggcgctgttgtaccatgtagtatttccagtatctgaagacgcttccagaacaccttcacccacagtacgcaaagatgttccttctgctgctcctggaaatacagaggcaacctgagcagcttctgctgcgtttccggtaaattccggtgtactgtagaatgcatttctgccttcgccgcttgccatttgataccattgtgtaccatctgatgcggtaaccactgagtgcggtccttgtggtttttcaaattgagatgcattatacagttccacatttgagctttttccatcagcgccggttgcagttgtgctgatatgtcctccagtaatctgtgttccactcagtttgtgattgccaagctgcggcatataatttccaaggcttcggtcagcaatttcaccggctatgcttccggaaacatttggtgttcttgaagcgacagaggaaattgattctccagttaatgtagcgccatttcttgcagcaatgccaccaaaagcacgacccacaaagccaaatccacctccggcgcccattcttgttccgccatttactacagcatcgcgtacataggaatttcccttaaacttacttgcaaacccagcagcgaatgacgaagcagcagttcctccagctgcactcgaacctccgttgaatacatttccggcacttttggctgcacctcctacaccagaaagtacacgggctgccatcagaatctccattcccatgcttgatcctgtttgagcgacatttaaacccatggccgctaaatagctgtcaaatttctgggcggttttaagaaatgccagagcgcagaacatccaaaggaagatatttccctgaccgtttgacagtgcgccggcattcgcgataaattgtcccacagaagtgctgaagcctcttaaaaaccatacattcatgaccaacagcagcagttgcgatccaaccatgcgacaccaggatttaaaaacctgttcagttgctttggagccacccatgcaatatgccaagggggaagtatagcacagtactccaacaacaatatagcgttctactgtctctagtaatagtttgaaatagttccaaccaagagagatttcaagaatgagcatcagtataagaccaacaaccgttatcacagaaaccagcgttgttattccgcttttcagcacattttcaaccccggcaaatgtaaaatcttctgccgtcatctgaatatccattaaagctgtgtaaggagcccttgcaatatccagcgtcaactcgaaaattggctttgcaaatgcaattaacactgcaaaaatagaacttctggcaattaactgaagagggtgttcactttccgttattggtcctccaaatgccttgaacaactgccacactgttattaaaaacagcatagcccatgcagtgtactgcataacatcaaatgcttttgagagaaacggaaagtattcctccattgctgtcatatcggttccaagagcagaaagaaatattccggacaccgcatccattagctggctgacgatactggcaacccaattagcaataccctcaaaaatccaatctaatatagcgcatcacctccaatccgcaacactgattatttggatttggagggattaagtgcctgtgtattgtccgccactgacaagcggctgcaggtaggcaacgataaagcctaaactgttcagaacaatccacgtcacaacaatgcgcttcagccaacttgtagcttcgtcaactgcacgctggtttcttgaaatcatacgaaccagaagtgcgactgccgcagcagtgacagctacgattgtactgataccggccagctgcccatagacatcgcgcattattttcgagaaacgatcccagatcgtgtcagccatgattggctgcaaagagatcagtaacgctgaagcggtgctgaccaatgtccaatacccatttaccaggtatcgtttcccttttttgatctgacttgtcatgctgtatacctcctttttgattgtgcaaaaaaacgctgtttccatagacttttctcagtctcagaaacagcgttttatcgccagtcccattttgggatgatataattataactcttttccttttgcatgtcatcggcatataccttgccaatttatttacatttttgtgccatccaataggacattttgttttcagcataaatcttcaagcaatgtcagcacttcaaaccacgaatccatctcggtagaaggaactgaccaaagtcgtaaagaaatgatgccaattgcctgcgttcgaagtctgtaataatgccgtgaggaaatgttgagtcggtataacagttcgttgtgagaaagtttttcgggtgcaagatatgtcatgtagattacttcatacattttttcgccgtgttccggttttctcttcagaacggttagtgcctcattcactcgatccaagagaagtctggatttttttatgctttcgattctactttccaactttttgttatccaagctaagttctacatcgatgtaacgcagtatagcatccaaatcattcaaagggcgatccagttcatcaacaatagtcgttggaaaacactccagtgcccaaacaatacttcggtaattttgcaaaagcatctcagtattgtgatatgtacgacgctttttatctttttgcacctgtctgatcttatcatcgtcaatatcagcatcgccaaggattccacgctgtgtcagaagcttaataaatgctgctgactgcgcagaaaggcggctttcctgctgttcatatgcagattgttctgcttttttattctcgctcatagtaactctcctttgattttttgaattctggaaaatgaacacaaggtcctcgtatattctcaaaattctctaaaggtgagatatatactacttccttgcagtcataattacaattcttacaattccaacaatgcagagaaaaatacgcgcgtattatagggctcgaaagtgcaacgcgattttcagctttgctgttttctcccggcttttcgatacgttcagcagatgtttttacactaaaccatgcgatcatgcgggataaacgttcatggtctgtaccttcaatatgtacattggctgctgaaatgcgtatttcttcgataatgcgtacaacattcgcctgtgtaggcagtgaaacctctgtaccggtttgatacaattgattaaaaatgagacatccataggagccgggaagacgatacagcgcgaagacatccttatacttttgaaagaaacgccatacttttgtcttttcccatttccatctctgtcccatggtttccaaggttaataaagctttgcgtcgttcaaattgaacggttggtgccaataaagagaaaatatttcctgaatcctgccagacagtatgacaccaaagatctaaccatgcatccgattcactgaatttacggttactatctgccagcctctgagtaatatctctcggaagacaaataaagccatatccgtcactcgcataaacagtaccttcagaacattcagctccagaacattttacaacccagtcattgatttgataggttaactttttcgtttttggatccaaagagtagctgatatatcctaaagcggataattcattcattatttctaaggcctgtgctcggctcttcaaaccaagaatgcttttaagtccaacaattccaccagaccacattcccggaattacctcatttttgtatccacaataaagggcatgtccctttcgaaacgctgcacgagatgccagctttgcccagtaacccattagccccttgccctgaggtaaatatgcccgagacagttttacccactggtactttaacaagcatttcataacagcgttctcctttcttaaattttgatatgaaaatagggcagtccttatttaaagaaactgcccctaatgaatatttagattcttactctcaagcctataagattacctgttttaattccaaccagataccattgatcgtttatctctattctggtaggaacccatttattattcacaaatacctccatacttgttccgcaatgaagccctccataataatcatccaaatcaaaccgaatatccatccgatctgtatcatgatcataaatcaatacgccttgcctcatttaaagtatcctcctatgctttggtaaaattgaatacacatttgagccttgatataaattaaagccggattgattgttactcaatccggctttctgtggcagttattgaattatagagttttttggattctcatactgagatttggacaaaagcagtgaaaatccaaaatgaatggctaaaatttgcttgtattgcaatcctgcagtttgatattcttcctctatgtagcccccttccgattttacttattactgttttgttgcgttttttcttttcgatacaattgacgcaaatactcttcaaaaatactacgtcgtattaaaacctttttgccgatcttatatacagccccggcctctcgtgccatacgagtaaatacttttagcccgagaccataataatcagcgccttgataataggttataaaatcacgctttaacatttctatatcttcatcgtcaagcatatccgaaaacatccacaggtttccactcattcctcctcctccttaaaattcaaagtacttggttcacggaaccgttccaaatattcatcaaaaatatctctgttaatcaacactgtactatccattcgatagattgctcctgcctcactggcaagttccatcagttttttatgctgaatgctataaacaatttccgcatctttatagcggagaaactgtttacgaagtctcttagcactttcacgcacctcattgcgtttttttaggtcataatatgcctttgtctcgtcactaatcatgatttcattcctttctttctattcaaatcatttctgtcataacaaaagctaaccctaaacgaaaaaagagaacactcctgaaattactttcaaaaagtgttctcttagcagtaagtgctattttgcgtcttgagttgacaacaattcattttgcgctgtatttctccatatcgctatgaaaaattgttgtcaatttgttgtcaactgggatttgatgtgctgcaaacccgcataaacactgggtttatttgtccagaggcttcattgtcgggaacagcagtacatctcttatgcttgcactgtctgtaagcagcattacaaatctgtcaagacccataccaagaccgcccgttgggggtaatccgtattcgagtgctgttaagaagtcctcgtctatctgagcgtttgcgccctgctttctcttctccataacctgctttgtgaaacgctcacgctggtcgatggggtcgttaagctctgagaatgcgttgccgaattcgcacgcatttatgaagtattcaaaacgctctgtgaatgcggggtcggtgggctttctctttgcaagaggcgaattttctacaggataatcatagatgatagtaggctgaatcagcttttcctctacaaattcctcgaacagttcgataagcacttcgccctttgtggctgtgtcggcaatctctgcgtgctttgtcttagcctgagccactgcgtcggcatcacttgtccagctgtcatagtcaagacctgtgtattcctttacagcttccttcatagtcacacgcttccagggcttgccgatttcgatttcattaccctgataaggaactgtatcagtgccgcataccttgagcgctactgtacggtacatttcttctattaagtccatcataccgtagtagtctgtgtatgcctgatacatttcaatagatgtaaattcggggttgtgagttgcatccataccctcgtttctgaagatacggcctacttcatataccctgtcaaatccgcctacgataagacgctttaagtaaagctccgtttcgatacgcagatacatatcaatgtcaagagcgttgtggtgtgttacgaatggtcttgcagccgcaccgatctcaagcgtatgcagtacgggtgtgtcaacctcgagataacccttgctgtcaaggaagctgcgtatctcacgcagtatcattgaacgcttgacgaaagtatccttgatttccgggtttgcgataaggtcaagataacgctttctgtaacgttcttccttgtccttcagtccgtgccacttttcaggcaggggcaggagcgactttgaaaggagctttatcgaatttgcgtgtacgcttatctctcctcgtcttgtcttgaatacaaaaccgctcacgcctacaatatcaccgagatcccacttcttgaattccttgaagttatcctcgcctatatcgtcaatgcggacataaacctgcattcttccgctgtcgtcacggatatcaataaagttggccttacccatatcacgccagcttgtgatacggccggcaatcattacatccttttcttcaagctcctcaaagttatctcttatctgctgagccttgtgagtgaaatcaaactttgtgatttcataaggattcttgccgtttgcctttaaatcgttcagcttttctattcttatgcggtgctgttcgtcaagctgtgccagaagctcttcttcggtcagctcaacctgctctgcgttgttgttttccattattttttgtttcctctcagtttacttgtctatttctactatcttgtacttctttactcctgcgggagcttcaaccgatacttcctcgccgagttttttaccaatgcacgccttgccgataggtgactcgtcggaaatcttcatagccttcatatcaacttcctttgaacctactaagaagaacttgattttctttccgctctcgtcctcgataactaccgtattaccgatgttaacgtgctctgtagaaagctcgtcctcgtcaactacctttgcgtttttgagagtagcttcaatctctgcgatctcagcctcaacaataccctgttcgtttttagcttcatcgtactctgagttctcggataagtcaccgaatgaaagagctaccttgattttttcagctatttcttttcttgtgaccgattttaagtgttctagtctttcttcgagatccttaagaccttgcgatgttaaagttgtctgtgttgccattgtaaatgacctccataatttttttatatgatgcgggcggagttttccgccattaatatccttattctgtagctactatctcaagcgccttctgaagctgcacgtcgcttttcttgtctgcaaaccttatctgttctgcctgctgtgcggtaatatcaaccgtgtagtcgggctttattcctgtatcttcaaaatcatcggattcgacaggcactatatttgcggtagaaatcgaaaccgcacttccgtccttgaagctctgcgttgtctgaagctgtgactttcccgctgttgacgatccgactacagatgcctttgcgaagtcacgcagacctattgcaaatatctctgcaaggcaggcggtgtttccgtttgtaagcaccgttacgggtttgcttacaaattgatttccgtctgtttctataaagctcgtatccctgccgtttgcgtcaacctgaattgctatctgtgccttcggaagcacacggttcagcattgccctcacaggttctgtgataccgtcggacacatctctcacatcgaatacatatccgagaaccgactgtgcctcatactcgtctataagctgtatgaaacgttcgtctgtggtttcgttgaaggtgtatatcttgatataggcgtaaccgtctataagcgtaccctttaccgatgtcagctttatgctctgtcttacaagagttaccgtcttttcaacaccgtcgggggtgctgtaagtaaccgagagctttgtgccctcctcgccgtcaagctgagcctgcgcctgctcggcacctatctcaagtatgctctttccgccgaccgccgttatagtacagcccttggttatttcttcaacctcagccgatgagccttcataaacgttcgtgacctcaagataatcgccgtttacaacggtttcgattcccgttccgataatcacgccgctttgtagcttctgcagcttgtaatactcatctgccgtgtaatattttgcgtatttgtcgctcgttccgctgatatagccgtttgcgatacccgttatcagagtgttttcgttaggcttatatatcgacgaactgcggacaaatgtatctatttcctttatctttgcgttgatggtttcccgttcctgtatacccgctaccattgagttgtacatatttagcgataccgtcatagtcagtacaaatgtaatagcacacgctacggctataagacttatcataacgccaagcgatacttttttattcattcgggattcaccctttccttgttcgtttgtctgtaattcctttatgccgtttatgccatagtaacataattgaacggattttcgggttcgccgttaagtcttatctcaaagtggagatgaggacctgtcgaatatcccgtactgccgacagcaccgagcgattcaccctgcgctacctcctgaccgacatatacatacacatcgctgagatgtgcgtaggtcgtggtatatccgccgccgtgatcgacaacgacatacattccgtagctgtagccgggtatgtagcttgtttctgcaactattacagtgcccgcctttgaggcaagaacgctgtcgccgtaaataccgccatcgcctatatcaacgcctttatgccatctgccgaaatcagcatcccagccgaagttacaggatatgtacgagcgtcccggaacaggccagtaccactcgccctcctgatatgccttgtcgggattggtctgctgctttatgatttcttttatctgttcttcatacgcttcaatatcagcctcgcttacgtttatcagatactgcagattgctcttctgatcctcaagctcgcttactgccgccgaatacttgttgtaatcggactcgtatgtgctttttgcactttcggcatccgttacaagaccgtcaagctcctccttttcactgagcagctttgtcatttgcgtatcaagctcggtcttcttgccctcaagatccttcttgtcggtttcaagcagcttcttgtccgaatccagtttcttcatatctgcggtaagctcgttcatgaactgaagattctgctcgcttatctttccgacgacctcactgcttatcataaggtcgtagaaatcggcagagcctgccagtaccccgaacatatccgctgagccggtcgtgtacattgttctgactatctgcgcaaacttttcaaggttctgcttgttctccttgtcaagttcggcaatgtcggcctctgctttcgctatagccttgtccttttgcgctatctcatctgtgagcgtgtctatgttgccctgcagagtgcttatatcctgatttttgtaataaacaagattgtagtagtagtcaacaagctccttctgctcgttcagcagattggcggctttgtcgaggttttcctgcttatcggttatatcgccttcgatacggtctatttcatcacgcctttgagcgttgtcctgttttatctgctctattctgtcctttatatcatcgacagtaagattctccgcacctgccggagcatacgttatgattatacccgatgtcaatgcaaatattgtgacgaatgaggtcagagagtgcagaatttttttcagcttcatcctatatcctttcgccgttataccttaaggtatttgcctgtgctgagtaccgtgccgatagctccgagcagtgcgcccgcaccgcagcaagccgccagtacataccagccgatttccgagaactgcagtatgtcgcccattccgagcgcattccacattccgaggttctgcgtaaacagattgtacagattctcataaacgagctttgtcacaaaccacgaaagcagtcccgaaagaagtccgatgaacaatccctccacaaaaaacggtgtctttataaaggaatttgtcgctccgactattctcattatcgctatttccttacgtcttgagaaaacgctgagccttgttgtattcgagattattataacacttaccgtaccgagcgccactataagcactattccgataatggtaaacgtcgttctcaggtcctttataaatccggcgaaatccataggcgcattcaccttgtaaacgccgtctatcgccttgaactgctgaacggcagtgcttatcttatcaaggtcgtttatagttaccatataggtcgcaggaacgggattatacggaagattctcaaacagatccttctgctcgctgtactgctcgaccatcttcttgagtccttcttcggcggaaacgaaatccaccttctccgtcagcgtgttgcttttaagcacctcgcctatatgctttatatctgcgtcatcattaagataaacgcttatctcgttcttgtccgaaacgttgtcgagtattattccgcagtcaagcatcactatagccgacattccgactaaaataaggctgacagtcataatgcagaggctggcaaatgacatgaaacggttcttccataccgatcttatgccctgctttatcaagtagcttaaattattcatcctgcgcctcaccttccacatattcgtcgaaaataacttcgccgtttttcaggctgacgattcttccgccgaaatattcgacaaggctatgctcgtgagtaaccattattacggtagtaccgcacttgttgatttccttgagcagctttactatatcataggataaagcggggtcgatgtttgccgtaggctcgtctgctataatcagcttaggatcgctcgcaaaggctctggctatcgcaactctctgcttttcaccgcccgacagcttctcaggataggattttgccctgtctgccagcttgaccagattcagaacataaggcaccctatgtcttatcgtctttttggatttgtttgtaacacgcagtacaaaagccacattgtcataaacattcagatccggtatcagacggaaatcctgaaatatcattcctatggaacgtctgaaatacgggatcttcttattctttatcttggcaagattatatccgtttacgaataccctgcccgatgtcggcgctatctctcttgtcagcagtttgagcaatgtcgattttccggcaccgctgtcaccgactataaatacaaattcgccgtcctctattctgagattgacgccgttaagagcgtcaactccgcctccgtccttgaaatgaacgtcaacgttctttaattcaaccattttaccattccttcctgatacctgccgtgcaataacggcacacagcgatgcagtccggttatggcgtaaccgggggaatcacaatgctatccccttctgcacccacaatacttttcaaacacttatttttcaacaatcaaaagtatggtggagtaattcaacttttctctcctcatatccggccgatattgccgataatccgcagctttgcaacgacactcttacaccaaatattcagacaagcacaatcaagtatctgtctgaatagtccggtattattaaatttgacattatttcccgaccgtttcaccgtgttacacataaatgcaacatttctaaaggtcggagcagtcagcggcgacccgccgcattagaatttgacgggatctgcggcaaggtatttcttgaccataagagcgatcttgaagatgatagcgtgatcgaactctcttaaatcaagacctgtgagcttctttatcttatccagtctgtaaaccagtgtatttctgtgtacaaagagctttcttgaagtttcggaaacgttgaggttgttctcgaagaatctctgtatcgtgaataacgtttcgtggtcaagcgactctattgagcccttcttgaaaacttccttcaggaatgtttcgcacagggtcgtgggcaggtgataaataagacgggcgataccgaggttatcgtagcttacgatagtcttgtccgtatcgaacaccttacctacctcaatagctatctgtgcttccttgaaggaacgggcaagatcctttatgcctgtaacgggagtaccgatacctacgtttacctttgtgaagaactcgcccgaaagcgtatccgagatggagcgtgcgagcttttcgaggtccttgttgtctatgcctgcctttatttccttaacaagaacgatttcggtttctgtgatattgaacacgaagtccttgttcttatcggggaacagattctgtattacatcataagccgaaacctcgtttgcggaaacgatgcttataaggaatacaacacggcttatatccgcattgaagtgaagctctcttgccttgagcgttatatcgccgggaagaacgttatcaaggaggatattctttacgaagttatttctgtcatatttctcgtcatagtactgcttgatgcttgacagtgagatagcgaggatagacgcatactttgccgcctgatcgtccgtaccttcgatgaataccgcataatcgggctttacgtgaacgccgaagggcttatatgtatagccgtcacggatgaacacatcatgtgagtcaccaagctcaattgtaaagaagtcgctgtttgttcctatcctggaaagctcactgcaagcgactatcgtactgttttcatcgataacaccgataacacgaccgatagtatctctcatctgatgaactacgccctgaaataatctgtttgacattttcttacctcttttatcttaaatggtttgctcctgtgtccgccgaaggctataaccctgtaactgccttgtatgcggaaattactcttataattgtatctttgaatcagcctgtgaaaagtctcggaaaaaggcataaaacggccgaaaataatacaccaaatatattttactagaaaaaccgaaaaaaatcaagggttttttagacaaaatgtaaaaattgcatcaaaaatttttgcgttattgcaaaaccgactaaatagtggtatactaaaatttatgtatgggcatcaggaacttatgacctgtaccataataaacataaataaacatataaattacattcggaaggactgattcttatgatcctgaaaattaaaaacgcaaagaacggtgtgtatgcacgaatgtgcagtttggcacgaatgtaaaaatataaactgtagaaagctttgtctttaaaacgaactactatttattatccctatcccccttaccccctttccctcgtgaaaggctgtgtatgcttggttgactttgcgtcctgcaaagccttgttgcatacactgcccggcatccgtgcctggggaaaaaacggggactggcgtccctgcgacccgccttggggctacgccccaaaccccaattttgtcaaaaaggttttatagcctaacatcatatacaaggagaaaatagaatgaacaagacatattatttaaccacaccgatatattacccctccggtaatccccacataggtcactgttacacaacggttgcgtgtgacacgatagcacgcttcaagagaatgcagggctatgacgtaatgttccttacaggcacggacgagcacggtcagaagatagagcttaaagccgccgaaaagggcgttacccccaaggaatacgttgacgagatagtagccaacttcaagcgtctttgggaaacaatgcacataagctatgaccgtttcatcagaacaacggacgactatcatatagaaaccgtacagaagatattcaggaagctgtacgaaaagggctacatctataaaggcacctacaagggcaaatactgcacaccgtgcgagagcttctggacagagagccagcttgtagacggaaagtgtcccgactgcggacgtgaggtaaaagaagcaaacgaagaagcatacttcctccgcctttccgattttgccgacaagattgaaaagttccttaccgaaaccgactatttacagcctaagagccgtgtaaacgaaatggtaaacaacttcataaagccgggccttgaggatctgtgcgtatcaagaaccagctttacctggggcatacccgttgattttgacagcaagcacgttgtttatgtatgggtagacgcactttcaaactatatcagtgcgctcggctacggcaacgagaagtacaatgattttgaaaaatactggcccgcagatatgcacatgaccgctaaggaaattgtacgtttccactctatcgtatggcctataatccttatgatgctcgatctgcccctgcccaaacacctttacggtcacggctggataaatttcaacggcgacaagatgagcaagtcaaagggcaacgttgtagacccgtttgtgctttgcgagcgttacggcgttgacgctgtacgttatcagatactgcgtgatatgccctacggcagtgactgcaacttcacaaatgaacttatgctcacaagaataaacgcagaccttgcaaacgatctcggaaaccttgtttcaagaacagtagcaatggcagacaagtatttcggcggaacactgcccacagacagagcttccgacgagcttgacaatcagcttatcggtatggctcagtcgctgtgcgatacggttactccccttatcgagcaggctcagcactcaaaggcgcttgaggaaatattcaaggtaatctcccgtgccaacaagtatatcgacgaaactgcaccgtgggtacttgcaaaggacgaaagcaacaacgcccgtcttgcgaccgtactctataacctgcttgaaactattcgtatctgctcggcactgctcagcccctttatgcccgcaacaatgcctgaggtatgggagcagataggcgcaggtgcagaagataccgctttcgacaagctcggcacattcggcgttctgcatgcagacgttacggtaaagaagggcagagttctcttccccagaatcgacataaagagcgagattacagaacttgaacgccttatgaagcccaagactgtaatcaaggaggacgaggatcttgacaaggcaggaataatctctatagatgactttgcaaaggtcaagctcagaacaggcgagattacagcctgcgaaaagataaagaagtcaaagaagctgcttaaaattcaggtggacgatgcaagaggcggcagacagatagtatcgggcattgccgaatactacactcccgaggagcttatcggaaagaaaattatattcgttgcaaatcttgcccccgcaaagctctgcggcgaagaaagcaacggtatgctccttgcctgtgacgcaggagacaaggtacaggtagtattcctcgacaaggatacacccaatggcagtacagtaagataacgacacaaatataaaggaaaagaacgacggaatgaaaattaaagacttatacacacccggcaggacggtgttctcgctggaggttttccctcccaacaagaatttccccatcgaaacggtgtatgatgccatcgagggacttgcggcaataaatcccgcatatatcagcgtgacatacggtgcaggcggaaaccgtgcaaaccgctccacctgcgagatagcatcgcatataaaggaaaaatacggtatcgaatcaatggcgcaccttacctgcataaacagcacccgtgacgatgttgattttatgcttgacgatttcgccgcaaacggaatagagaacattcttgccttaagaggcgacaacaagcccgatgaagaaccgaagaacgattttccccacgcaagcgaccttacggcatatatagcgtcaaagggaagttttgatattgcaggtgcatgctaccccgaaacccacgttgacgcagaaagcgccgaggaagatataaagaacctgaaaataaaggttgacgcaggtgcatctcaccttgtttcacagcttttcttcgacaattcctgctattacgattttgaaaagcgtgcaagagccgcaggcgtagacgtgcctatcgccgcaggaattatgcccgttacaaacaaaaagcagattgagcgtatggtaacgctctgcggtgcaagtctgccctcaaaattcgtaaagatgatgcagaagtatgagaacgaccccgaggcgctgaggagcgcaggaatagcctatgccatcgaccagatagtagaccttatttcaaacgatgtgcagggcatacacctttacgctatgaataaccccgctgtcgcatcacgcatctacaacgggattaaggatctgttatgatacttcagccgatagacagaaacgaggctctgcgttatctcggctgtaaggacggcacggataacgagcagatgctcgcaatgctcgattcctgcgagaaacagcttctgaaagccgcaagcccgaaatacctctatgccgtatacccgataagctttacggatgatggtgtcagaatttcggacagcaatataatacttaaaggcaattcagccgccgctcatttaaagaactgcgacaggatagtgcttatgtgtgccacgctcggacaaggagtagacgtgcttttaagacatctgcaggtttctgatatggcaagcgcagttatcgttgacagccttgcgggtgcggcaatagagcaggtctgcaacagggctgaaacagagatattcgaaaaagtacactcgaacagccgtacatggagatattctcccggctacggtgatctgccccttgatatacagtttgatttactgacgcttctgcaggctcagaaaagaataggtcttaccgtaatgaacagcaatatgatggtgcctacaaaatcggtaacggcatttatagggctgtcggagggcgaagttgacagaagtacaagaggctgtgaaagctgtaatatgaaggacagatgcaaattcagaaaaagcggaggtcactgtggaaattaaaacattacttgagcaaagaggactgctgattttcgacggtgctatgggtactcagctgcaggctaagggacttaagacgggcgaaacccccgagcttttaaaccttaccgcaaaggatctgctcaaggaaatacaccgcagttatatagacgcaggagcggatataatttctgcgaatacattcggtgcaaattcctacaagctaagccacagcggtaaaagcgtagatgaaattatcaccgcaggaataataaactgtaaagaagcgataaaagaaagcagaaaggacgttttctgcgctcttgacataggtcctataggacagctccttgagcctacgggaagccttaaatttgaagagacttacgacatattcagggaggagatagttgcaggctataaggcaggtgcggacgttgttctgtttgaaacgatgaccgacttatacgagcttaaagccgctatacttgccgcaaaggagatcggaagagcacacgtctgaactccagtcactccgcgaaatctcgtatgccgtcttctgcttgaaaaaaaaaagggagaaaacctaaggaatagggttaggggcggcagtccctcaccctagtccctttggttgtctccctcgtgaatagtagcaacgttattaaatggaatagcgaacccgagaagtgttatctgacaaaaagaactatcggtagcttgctattataggcaaagctgaatgatataacagaagcatatccaaataaaagacttttcccacaatctgcgagcctcccacacgggaggctcgttcttcttttcacaatatcaacataaactttcagcaaagctacaccatatccccctgtttatcagcataaaatggaaaatattcacttgactttttgtgctttttgggatatactatattgtgtacaaagaaacaacagtacatctcagacgacagcagtacagcgttattctactgtcgcacggagggtaaaaatgaaaagatacgcagtcactttgtttattgcggcgcttgctttagctttggtgccggctttaagcggatgcggctcggataacacatcatcggacaattcaacaccagacataacatcaacaacaccgcagagtaccgactcagaaccttcgtcacagcagacaacggtatcggatataatatcgctcccggaaagctctgataacagcagtacaataaatgaccttcgcactcagatagtgtcaaccgctgaggctcttgtcggagtcgattatgtcagcggtatggcaacgcctgagcagggcttcgataattcgggacttatatactatgtccttcgtgaaaacggctttatcaattgtccgagaggaacagccgcacagaaagaaatgggtacgaccgtagcgctcagcgagattgagccgggcgacatccttttctttaccgataaagattcagaaacaggcgagatgattgacttcgccggaatatatacaggcaacggccagcttatttacagcccttatccgggtgaaaaggtaaagtttgccgaccttaacagctcttattggcaaaactgcttcagccgtgctgtaagagttgcttaaaaccgattatgacattgtccttcatataaaactacaggaatgccgtctgctttgcagacggtgtttttgtatattttggggaataactgcgaaaagaatcgattttgtcacctttttgtaaccgttgtaaccgttttgtaaccgaattttaattgaatttcggattttttgtgatatacttaaatcaaggacagagaacaatataaaacgataaagcaaaggtcgtgatattatgaaaaagaaactatcgttaatcttggcaatgtttacagttttggctttggcttcacttaccgcttgttccggaaacaattctccgtcctatgaaagcggaaatgatccgcagaacggcactcagagttccgtaggggaaagctctgacagctcttccgacaacacatcgagtgaggataactcctctgatgatacgtcaagcgaagacaactcttccgacaacacatcgagtgaggataactcttccgacaacacatcgagcgaggataactcctccgacaacacatcaagcgaggacaactcttccgataatacgtcgtcagacagcaccgagccgcccgctccctcagaaaaaggtgatgcaatagcaaagtcggcttatgatatgctcggtaaaccattcactgagggcggatacagcgcagaaacaggttttgataattcgggacttatctactatgcgctgacatcaaacggtgtcgattgtcccagaggacttaccgcacagaaagaaatgggaactgaaatagctcttgaaaagcttgaaaagggcgatatagttttcataaaggacggcgactcgttctttggcggtatatataccggagatgacacgatagtgttcagtccgtatccgggacagaaagtccgcaccgcaagcatgaagtcggtatattataccgacaacttcttaaaggctgtaagagtggattaaacgcttttattgcaattttccttactttcctaacaatttcgcaacgctttgaaacaacgcatttcagttatagcaacgcacagaaaaatcatactaccgcatatatcttccgccttgctttatcacactaatttttccgtaacattccgcagcattttgcaacgcattaacatcatcatataacatcaacacatcgctgcatagcagcaaattctcctctcttatatattatgccccctcggacaaccgagggggcaaaatctttttgcgtataaaccgtttaccgcttgattttcactgctcaaactgttacaataagactaacaattcatattcagctttaaagccgaaaggaaacacagatatgaaaaaacgcagaattttattcaacgataactggagattcaccctcaccgaaccggacagcgacggaaagacgcttgaaaacgcacattggtataatgttgagataccgcacgactggcttattggcgatacggcaaatctctacaagtccggctgtggctggtacgagaagtatttcaccgtagacgcactcggagaagacgattgctatatcctgatctttgacggcgtatatatggatactaccgtctatgtaaacgataaggaggtcggcaagtggaagtacggctatacaaccttcagctttgatataaccgatgctctgaaaaacggcgaaaaccgcattttagtcagagtaaaccataaatccccgaatacccgttggtacagcggagccggaatatacagaaacgtgtggctcagaaaaacctctcgccgtcacatcgttgaaaacggtgtctatatcagcgcaaagagcagtgatacagaccgcagagaacacggtaaatggaagactactgtacagataagcctttccgacacggtctgcggcttgatttcatatacattaagagatcccgaaaacagagaggtttacgtttgcgaacgcagactttgcggcaagaacgataagctggtgttctatatggatgctcctaaattatgggatataatcacacccaatttatataccctgtccgtgatactttatgacgataacggaaacaggcttgatgataccgttgaaaaattcggcttcagaaccacaaaattcagcgcaaacgagggctttttgttaaacggtatgcaccttaagctgaacggtgtttgtatgcaccacgacttaggcgcactcggcgctgcggtaaattacgacgctacccgccgacagcttgaaaagctgaagaatatgggcgtaaacgctatccgcaccagccataaccctccgtcaagagagcttatggagctttgcgataaaatgggcttcctcgttgacagcgaaatattcgatatgtgggagcttgccaagaacgagaacgattaccaccgtttcttccccgactggtataagaaggatgttgaagcgtggataaaacgtgaccgtaatcacccttcggttataatgtggagcataggcaacgaaatatacgatacgcataaaagccccagaggacttgaggttgcgaagatgctttgcgaggaggtcgaaaagaacgaccctatgcacaatgccccgcccacgatagcctcaaactatatgcagtgggaaaatgcacagaatgtagctgattatctgaagattgcaggctataactatacggaaaagctgtatgacgagcatcacgaaaagcatcccgactgggtcatttacggcagtgaaaccgcctcgacggtacgctcaagaggcatataccacttcccctatgatacaggcttactggtatatgacgatctgcaatgctccgatctcggaaacagcgttgtaaactggggagcatctccgctcagatccttcgctatggatgccgccgcagaatattctatgggacagttcgtatggacaggatttgactatatcggcgagcctaccccctacaataccaagaattcatacttcggcatcatagataccgcaggctttgaaaaagactcgttctggttctataaatcggtatgggatatagccgaagaaaagtccttcattcacgtttctccttgctgttgggatttcaacgagggtcagcttatagacgtgcttgtttattccgaccttccgtttatcagacttcactactgcggagagatgtatgacggaaaggtgatagatcacctcacggaagacaagctctgcgcccgcttcacagtgccgttccataaggacaagccgcttgcggtaagaggctatctcagccccgattgcgatgttgacgattacgaaaaggaggaggtccttttcacctctctcgacccctataaagtaaatatgagccccgatgtgagcgaaatagcggctgacggaagatcgcttgcgtttattaccgtaaccgttgacgatataatgggacaggaagttcagaatgcggtaaacagaataaagttcaccgtaaagggcgcaggcagacttgtaggacttgataacggcgacagcaccgactatgacagctataagggcaatcatagaaagctgttctccggaaagctccttgcgataatcgaatccacctttgaaacaggcgacatagttatcaccgccgaaagcgagggcttgaagcctaaaacgataactataaaagcggtagtccccgaaacagagccacagggagtaagcgttgtcactcaaaacgcattccccgcagtaaccacgccctacacaaatgaaattcccgtaagaaaaatcgagcttttcgacagtgagcctcgtacactgacaaaggaacgtgatactgccgaaatttcggtaaagatattccccgaaaacgcaaccttccgtgacatagagttcaaatgctgtacagataacggagttgagatcagctttgcaaaggtagtttcgtttgacggaaatacggcaacgcttaaagccttcggtgacggcaaattccgcctgagagcatattcaaagaacggtaccgacattccgaagattatctccgagcttgaatatacggcagaaggactcggaaaagcagaaaagaatccttatatctttattgccgcctgcctttgcgatttctcgaatgttcccgttatcacgatagacagaggctcgctcggcggctttaacggaagaacgaccgtcggcttcagctccgttgatttcggcggcggaaccaagaagattacgataagcgtcggaaacagcggcggcggtgaagattatcccgtagagctgtatctcggcgatgccgacaacggcggcagatatatcggcacgttcgcaataaagaataacggcggatgggacagagcatacccccagaccttcgacttgccgtgcagaataagcggaacgcacgacatcagctttgttatcaacaattcctgcatattcggcggctttgagtttgaaaagtacgaccgtacctatgcggaaaactctgcggcagacaacgataatctgtacggcgatgattacaaggtaaacggctcgtgcgttgaggagataggcaacaacgttgttatcgaattcaacggcctcgatttcgcaggcggaacggataagataaccgttacaggcagaacaccgcttgataactgcacgattcagctcagagtaaatgatgagaacggcggccagaccacccgtctgctcgaattcccccacgcagacgagtacacgccggtaacgtttgacatcgagcatatcgcaggcaagaacaacattgcattcgtattcctgcccggcacacagttcgatatgaaatcgttcagattcacaaaaaccgaagattaagctaaagccacggcatccgccgtggcttctgtctgcgaaaaactatataattattgaaaaatgggtgtttagccttgcttgctcctcctgttgcactaaaccttgccattcccacagccatcttataagaacatctatccttcgcctcgcaccaacctttccaaatccgcaccaccacacccgctttccgtaatgccaacatttatatgcaacgatatgctttcacattcgcactatccctcgcctcgcaccaccaccattgcctcccttgtcaaaggtgaggtgctgtcgcccgaaagaattcgggcgactaccggagggattgctccccattcgcactatcctttgacaagcaccatcacccttgcctttaaatgaacgctctgtttgttttgcgtcactgcctcgtcagccattagtgtcgctgcgtcctgcagcgactaagtgtggctgactttaagcatccgtgcttaaaactttgggcgttcaacttcgggcatccatgcccgccctcgaaaaagggtgaggttctgttgctcggtcaagccgagccaactatggtggggattgaatttgacagaacttctatcccactcgcttttcgtagggcgagcgtctgtgtgtgcttggttggctttgcgtccttgcaaagcccttgggcacacacgcttaaggcatccttgccttgcttgcccctcccgttgcatcgaacctctcaattcccacaaccattgcaaaagaacaataatcccttcgcctcgcaccatcacccttgcctttaaatgaacgctttggttctttccctcgttaatattgacaagtgtacctatttgaatagcgaacccgagaagagctatccgacaaaaagaactatcagtagcttgttaccaaagataaatactaaaaagccacggcacccgccgtggcttttcccctccaaccaactaaaaaccacctctttttcccaaccccactatcatttataccccttcgctatagactttttgtgaaaaacatgctataatataaacgattataaacaactgcaccgtgttttaatgctttgacaacgcaagcggtcagacacaaggaggtgttcggagcagatgacttatgaaaagtcctgcggcggtattgtttacagaaaatttcacggcaatacggaaatattgcttataaagcacatcaagtcgggctactggtcattcccgaaaggacacgttgaaaacagcgaaaccgaagaagaaaccgcaaaacgtgaaataaaagaggaaaccggcatagacgtttatattgactcaggattcagagaaacggttacatattcgccacgcaaggacgcaaaaaaggaagttgtgtattttgttgcccgtgcaaaaaattatgattacaccccccagcttgaagaaatttctgagatacgctgggtaggcataggacaggcgcataacctgctcgtctatgacaacgataagctgatagtaaataaggcaaagagctttatcgcacttatgaaatgaagaaattgtgttttgagtaaaagaagaaaatgcgaaaggaaaccccacatgacatacgaacaggcatttgaatacgtcggttctttcacaaaatccggtacgcctgtaaaggaccttataagatttgttattcttatgaggcttctcggcaatccccaaaacgaacttaaaatagttcacgttgcaggaacaaacggaaaaggtagcgtatgcgaatatataagcaacgctgtaaaagccgacaacaagagcgtaggaaaattcacatcgccctatattgagtgcatcgaggaacgcatacaggtaaacggcaaatatatctcacgccctgcctttgcgcttctttgcggacaggtgaaaaaggcagtcgaacagacaggctttgacggattctcacagtttgagatactctgcgccatagccctgctttatttctataaggagcaggtaaacgttgccgttatagaaacaggtataggcggacttcttgactgcactaacgttgtaaatcccgctgtcagcgttataacatcggtagatttcgaccataccgatgtgcttggcgatacgcttgccgaaatagcacgtcacaaggcaggcataataaagccgtccgttccgtgcatagtatatccgggacaggcaaaagaggtaatgcgtgtcattgacgataaatgccgtgagtataactgcgaagaaattatccccgatatgtcaagagtgcagatgctccatatggatattaccgatgtgttcttttcgtacaagggtatgaattatcatcttgttatgtccggtgaacatcagataaaaaatgcactgtgcgccatagaggcctgccgtatactgaatatagagtacagcagtgtgttcacaggacttgaaagatccgccctcagagccagaatggaggaggtaagcgtgaacggcgttgcctgcatcatagacggctcgcacaacccctccgcaatgagagccgccgaaaaactgctgagctgcgacaaaagaaaaatacacgccgtagtcggtatgatggcaaacaaggactggcagaccgcccttaaaataattctcccccgcttcgaagatgtaatattcgttgacggctttatgccgggctgtgttcccgcttctcagcttacacgctttgccatagagcagggagtacgtgctaccgcctgcggcgaccttaacagcgcaatttcacaggcagcgctcaaggcaggaacaaaggatatagcgatggtcacaggctcgctctaccttgcctccgccgccgaaaagataatcagcaagtaaaacccaataactattaaatatttaaaaggaacgataattcagccaagcaccatacttgcctttgaatgaacgctttgccagtttcgcatccacactatcccttgcctcgcaccatcacccttgcctcccctcgaaaaaggtgaggtggcttgacggcaaggcgcaagcctaaattttacagcgtttttatgtgatatatccgacttttataattactaagtcggtctgccgtcaagacggtggggattgttaatgccttagcagcttttatggtagcgctcacatcaaattcaatcccctcgcttcacaccaacccttccaaaaccgcactatcccactcacttttcgtagggtgagcgtctgtgtgtgcttggttggctttgcgtccattgcaatcgtggtcgtttgcggtcggtgcgtcctgcaccgactttttgcgaccacttgtaagcatccgtgcttaaagcccttgggcacacacgcttaaggcatccttgccttgcttgcccctcccgttgcaccgaatgctgtcactcttacaatcattgcaaaagtacaaccatccctcgctccgcactaccacccttgccttttaatgaacgctttgttggtttcgcatccttgcaaaactttgggcgttcaacttcgggcatccatgcccgcctcgaaaaagtgtgaggttctgctactcggtcaagccgagccaactatgatggggattgaagtttatagcactactgtcctaaaacttttttctgtcacagtttattttcaatcagtataaaatttgttttcacaagcaaagccgcccgataaccgagcggctttataaaaacaaaaagccgaccctttcgagccggcacaatatccatatagcaactttacctgtaagccgagttttgtcgtgtgcgatcatctatctacgccctgcgtcgccgcagacctcaagccaccttaaatcgggaccgccgagcagacggtttacccccgaaaccaatcggtgttgcatcggatagggtttacagacaggaacagtcgcctgccccgtggtgagctcttacctcgcctttccacccttacactgtaaaacaatgcggtatatttctgttgcactcgccctggagtcgcctccggctgccgttaacagctaccctgctctgtgatgctcggactttcctcacggttttcaccccgtgaccgcacagtaaagttgcgatagttattgtatcattttgtgttgcatttgtcaatacaaaaccccgattattgccttatttcaaggagtaaaagcatattatgaccgtaaagccgaatataaaaaagaacttcaatataacgtggttgctcctgtacggtgcagggcttatcactgtcggtatacttgtacttgtaaacggaaaaatagtggtagagcctgccgcaaggctgggcggtatctttatcgtcgcaaacggtatccaccgccttatccgtgcctacgcaagacatcagcggctgcccgtgttcagcggtgtcggaaacattataataggactaatatccgttttcttccccgccgctactcttgcgcttctgtcgtttatattctcgctttacgtttttcttaatgcccttgtgaaattcatcgacttcggcacagcccttaaaaatgccgttcccgatgcgttctatgactttttttccggaatattcttcagcgttttcggcattattatgcttttcggcactcttatgggaagtcaaggtatgcttgttgtcatcggactatattgcataatttacggtgcaggcgagctgaggctgtttatccgtgaggccgctccgaataaagccaaaggcatcatccgccgcaggatacgcttttcgcttccgcaggtcataaccacgttcataccgctgaaaaccttgcgcagctataccgagcggcttgattcccgtgagatagatattgaaaaactgcaaaacgaggagcgttacgaaaaaagcgccggcacccccgatatacacgttcttatccacgtcagcgccgacggagtaggctctataggacattgcgacattgtgctgaacggtactgtaatatcctacggaaattacgataaagcgtcggaaaggcttttcggaggcatcggtgacggtgtgcttttcaaagcggattttgacaagtatataaatttctgcgtctatcacgatttgcagatggtgttcgatttcggcataaagctgtcggaaaaacagcttgcaaaagtcagaaaaggcatagcaaagctcgaacgaaacatcacacgctggaaaccgccctatcagcttgcaaccgaaaacagccccatcgccgatattgcggattttgacgattattgcagttcgctgtggaacggcacacacgcacatttctataagttcaaaagcggcagattcaagacctatttcgttatgagtacaaactgcgttttccttgccgattatatactaagcaaagcaggaaccgatatagtaaagaccgcaggcataatcacccccggcgattattacgactatatgcagagcgaatatgccctccccggcggaatagtcataacccgtgacatttacagtaaatataacgtttcgccggctgaaacttaagtgaaaatccttgaacttgacacgatagtgtgatatactacaataggacaagaatttacatttacgggtagcaaaaagtcagaaatttcatcgttgatttatgtgatatcattatgtattttttgtaggggaggggttgtatgtactttacggttttgcatccctgcaaaacttttggtacatacgttaggcatccttgcctaacttgcccctcccgtgaaaagaataaagaaatccgaaagattgctaagttgtttatttatagcaatctgctttatatcggaatgattaaagtcctaactacagagaataagttggtataatatattcggcgatatatttaccccgcataaagaaaggacatactatgaagctcaatatcaagttaacagcggcaatacttgcctgtgcgtcaattctgacgtcggcctgtgcctgctcatcacagaatacaagctccgctacggacagcaaaaacgaaagcagtgcagcggaaagctccgctgcagaaagcaaggataatacaaaaagcgacacagcaagcgataattcatccgcatcttcagaaagcaccgtttcttccgatgaatcatcgtccgaaaataagaagcctgtcggcgttgacggcgttcagacaaacggccagcttgtcgttgacatagacggtcatacatggggcatctccctttacggcggcggcgacggtgcaaactatgcgtcataccttaacgagttcaaggaaaaggtaggctcatcggtaaacgtattcaatatggtagtgcctacagcaggcgcatactaccttcccgatggctacgaacaatacaacgcaagccacagggattcgataaacagcattgcaaacaagctggtgaacgtgataaacgttgacggatatgccgcacttgaggcacacacaaacgagtacatctatacccgtaccgatcaccactgggaacccctcggcgcatattatgcggcaaaggctttctgtgaaatggcacaggtacccgtaaaggagctttcgacctacaagacggaaacgatagaaggctttgtcggaacaatgtacgcatttaccgattataacgagcgtatcaagaacgaccccgataccttcacctactatatcccctctacagattacaccgccacttattataccaccgacttcaaggctgacgagcagctcacacagtttcacagcatatttgtagatcagcccgcaagcggcgcatattcgacctttatgggcggcgatcagaagatagtaaagatagaaaccgcaaacaagaacggcagaaagctctgcatcttcaaggacagctacggcaatgccgaagttcccttctttatagattcctttgaggaaatctacgtttgcgacatccgctactttgacctttacgcacccgactttataaaggataacggcattaccgacgttctgttcacaatgtgtacattctccgctgtcggtgaaaatgcagagggtataaagaacaacctgctttcaaagtaaatcgctgacaggttttctgaaaggaggagcagtatgaaaaagctcccgaagataacagcgcttatattgacattatcgctcgcctgcggatgctcggaggttttccccaacagcaacgcaagcggcaaggacacatcggcatacaccctaccacctgaccccgtatcatcggaagctccttcggacaccgaaagcgaagaaaccgaaccgcccgatacctccgctcccgaaacgttaccgccggatacttccgccgaagaaacctccgctcccgaaacagacggcacttctgccgaagaaagctccgctcccgcaagtaagaccgatataaacagctacagggcgataggcgacaacggcatattagtcgcaggtatggataatcactaccgtggaattatgttctacggcggtacatacggctactgcgaccaatatatgaccgatgtaaaggcattccagtcggcgcttcccgaagtgacggtatattctatggtaataccgacctctgtcgatttctacaatccgaccgaatacaagggctacaccgagcttcagaaggataagatagattatatcgaaagcggacttaaaagcacgggcgttacaaacgtcagcgtgtatgataccctgtcaaagcacacctcagaggagatatactcaaggacggaccaccactggatgccgctcggcgcatattatgccgcacaggtattctgcaaaactgcaggagtaaaggtgccggatataaaaaaataccgcaaggaaacctgcggcggttatgtcggctcgatgtattactattcgtccgatgagcatcttaataacgaccccgaaacctatgcggtctactattctccgaatgaggataagctgaaaaccacatattacgaccgttattacagcaacggctatgacagcagtcttttcctttgcgacaacgcaagctattactacctgtcatttttaggcagtgacgatctcatcgcccatataaagaccaacgcaaagacaggcagaaatctggttgttatcaaggaaagctacggcaacgggcttatcccgttcttcactgagagctttgataatatctatgtgcttgacctgcgctactgcgaggtaaacgcaataaaattctgcaagcaggtcgatgcgaccgatctgctgtttgcaaactgcgcctataccgttgcaggcggcaactgcgactacttctcatatataagaaacatttaaaaagtgtttttatattcactatttcaacgattgtaatcccggcttctgtgaagccggaaagggtcgcaggggcgtcagcccccacttatccccggcatgggtgccgggcgtgtatgcccaagggctttgcaaggacgcaaagccaaccaagcatacacagcctttcacgggggaaagggggtcagggggatagggatataaaaagcacttcaatgagataattgataatatgatttaattgcttgaaataaggacacacctatgaaagaacttgaataccccttcgacagcggttatctgctgaaaaagaaacgctctataaaaagacagctcctgtcagacggcagtgtgcgtataaagaaaaaaatagccgttctcggcggctcaaccacgaacgatataattaatatgctcgaattattcctgctgaactacggtatcgagccgaccttctacgagtcggagtacaaccgctactggcaggatgcggtattcggaaatgaggagcttgacagcttctcacccgaccttattttcgttcatacatcaaaccgcaatattctgaaatatcctgcgataaacgacagcaaggagcagacagacgctctttttgccgagcagatgaaatattttgaaacaatgtgggaaaagatagccgagcgctaccactgccccgttatacagaataactttgaacagccgtatttcaggcttatgggcaaccgtgatgcgtttgactgccgaggcagagtgaatttcataaacaggctgaacacagcgtttgccgattatgcagcatcgcacgagagtttttatatcaatgatataaactatgtcagcgcctgctacggtcttgacaagtggagcgagtcgtcctactggcacctgtacaagtacgcaatgtgcgttcctgcgatacccgactttgcattcaatttagcggcaataataaagtcggtattcggcaagaacaagaaagcgcttgtactcgaccttgataatacattatggggcggagttgtcggagatgacggtgttgacggtatcgaaatcggacaggaaacccatatgggacaggtctatgccgaatttcagaagtatctcggacttgtgaaggatacaggcgtaatgctgaccgtctgctcgaagaatgacgaagaaaacgcccttgcaggccttaatcaccccgagggcagtttaaagcccgatgatttcataatgataaaggcaaactgggataacaaggacagaaacatcgaggcgatagcggcaggactcaacatcggacaggatgcgcttgtattccttgatgataaccctgccgagcgtgcgatagtttccgcacagttgcctacagtagccgttcccgaaatggagcgtccggaggattatataagagtggtagaccgctcacgcttctttgagataaccgctttttcaagcgatgatttaaagcgcaacgaaatgtacaaggagaatgcggtaagagccgcacagcaggcacagttcaccgactacggcgagtatcttcacagtcttgagatggtggctgtgatagatgacttcctgcctgtctatctccctcgcataacacagcttacaaacaagagcaaccagttcaacctcaccacaaagcgttttacaaccgcagaaatggagcaggtattcgcagatgacagctatatcaggctgtacggcaggcttgccgacaagttcggcgacaacggtatagtatcggtagttatcggcaaggtgaacggcgatacgctcgacatagatttatggcttatgagttgccgtgtgcttaagcgtgatatggaatacgcaatgctcgacaatctttgcgacagagcaaaacagcgtggacttaagacggtaaagggatattattaccccaccgcaaagaataaaatggtgaaagagttgtacggcgacttcggctttacgaaggtcagcgaggacgcagacggcaacaccgtatgggagctttcgctttcgggctacaagcctaaaaacaagtatattactgtagaaaggaacaagtaaaatgagtgagcaggaaatttacgaaagattaaacgaggttttcagaaacgtattcgacgatgacgatatcgaggtcgaagcaggcacaacagcagatgatatagaggactgggacagccttgagcatatcaacctcatctccgctgtagaagacgaattcggtatccgtttcaagatgggcgaggtttcttcgatgaagaacgtcggcgaaatggtcgacatcataaaatccagagcctgagcgtgcgtgcggcgagtcgccgctgacaattccgcctttggaattgtaggcgttcagctaaagttagttgaacggcggggttacacaaaccaataaagcagataaacggtcacagcggcaagctgtgaccgcttttttatattattatcacacaccccttcgccccgcataaccttccaaaatcgcactatcccttgctttgcaccatcacacttgccatatgaacgctctgttggtttcgcatccttgcgaaactctgggcgttcaacttcgggcatccatgcccgtcccttgtcaaaggtgaggtgctgtcgcccgaaaaaattcgtgcgactaccggagggattgcctcaccaccatccttcgcttgcaccaacccttccaaaaccgcactatcaccctcgcttttcgtaatgctaacatctgtatgcaccaatatgttttcacatccgcactatcccacgaaaaccgccaacacccttgcctcccctcgaaaaaggggaggtggcacggctgatacaaatttttcgcttgctgtacagtattcagatagtcctgcctttacaattctgaaactattccgagccgtgacggtggggattgtttccccttagcaccatcattacgctgttactctctaacatttaaaagggtgaggttctgttgcacggtcaagccgagccaactatggtggtgatcgctccccatccccaccatcaatgagattttctgcactatcccttgctttgcaccaccacacttgcctcccttgtcaaaggtgaggtgctgtcgcccgaaaaaattcgggcgactaccggagggattgcctcaccaccatccctcgcttgcaccaacccttccaaaacagcactatccctctcgcttttcgtagggcgagggcttgtgtgtgcttgtacggcttcgtatttgcactaccccctcgctttccgtactgcaatcgtctatatgcattgatatgctttcacatccgcactatcccttgctttgcaccatcacacttgcctcccttgtcaaagggaggtggattgacggcaagccacaaactgtcgctttgttgcgttttgcttgcgatacatccgcctttttgatttatcaaactttttgccgtcaagacggagggattgcttgctacaaactgtttcagccctgccgtcaccttcgttaacaatccctcagtcacagtgacggaaatcttattaatttataaaaaatcttcgacctgatattaaaagtaacatcgaaaatattgtaccgcactgtgccagctccctttacacaagggagccaagagtgatagttctatttttcagaaagcactaaccctacatgaattttacatcatttcaaaaggagcaatctcccgcttgtttaatcgctccaaccttttctcacacccttgacatcctgtcatttcagtgatatactttagttagacaaaactaaccaaattgaaacggagcaacctatgaaacatctgcattttgaacccgaagccgacggcttttacggcgcatattgggaatgtaaaaccccgtccgatatcgcaatgatagcaatgctcggtgacgaccccgaagactatatgggcaaaacctgcgtgaaatggcttcatacctacggaattaacgtaatgtcaatgtcgcccggaaagaagaactacagccaccacaactatcctattgagcgtatcggctcggctatagaatggctcaaatctcacggcaacaagaaaatcggcattgtcggtgcctctacaacagccacagtcgcacttgtcgccgcctcatattatcatgacctcacgcttaccatagccctgactccgagcgactttgtatggcagggttttgcacagggcagtcgtgacggttgtaaggaatggccggtcgaaaacgaatctatcgtgtcgataggcggcaaacccgtaccctttatgccctttgtctataagcaccctgagtactggcagaagatagccaaagcgtctaaagaacacggcgattccacatattcaaaggatgtgttcgatgattccgaagccgcaggactgcttaaagaggagcattttatacctgtagagaatatcggcggcaagctcgttcttgtcggtgcggaagacgattctctctgggataccgcaaaatacatacgcagaatggacaatcgcctgaaatcccgcccgcattcctgcaaatactcggtgtatctctatgaacacggcacacattttgtgttccctgaaagcgtactgaaaaaagctctgcccgtcggtgctgatatgcttgtaaatatgtgcttttcagcggctaagaaattcccggatgaatgtaaagcaatgcgcattgatcttgatgaaaaacttaccgaagaaatccttgattggaaatcaaacaattaaattagtaatatataagcaaaatatattcagtatattaacttatgcgtgagatttttccgctcgtatgatcgcctttatcctttatattataatagtatcacaaaattcagccactcacatcgggcggcttttttctatcctttaaaatcatcataaatcatcaattgtcgctcctaccgttgccgctatcctcatcataattcatcaccgtgtgtctttcataaaggtaaaaaatacgggctatactattataatatataaaggacacgtcacgaccatattttcgccttcggattgctccgatatttcacgcaagtatacgtttacattcacccctcagtcaccttaaaaatgctcataaatcggctttcctgctatgttaccggctgtttttccgcttgtctgcccgccctttttatgtaattcaattaccatttcataacatatatgcatcaaaatctccaaatcagtataattatttttgtctaaaaacacaacaaaaatccaaacttcaattttgggcagattaacaaattaaattacaaaataagtcaacaatatccagattttaactgattacaaaacggtaacaaaaaggttacaaaacggttacagttttttcttgtgcattttcaacaaaaatgactgccccaagctatttgacattttgcaaaacggaaattataattgtctagagcttgaaaaaagcccgataataaacgtagcagcggttctctcagcacggggagttatcgtacacggtcagtggtgacagacggatctagccgtaattttaatgccgtgatgcccgtatgggtactgcttaaacctaccgatatgatgacgaaaggcggatatatgtttcccagattcagaaacaccggactgacaatacgcatatcaaagaacgcagcacttaaaatactgcttatattcggcagtatcttcggagtattccttatgacaggtctgctctacttcagaaatgacgttgagataatcgacgagaacgaaaagcgtattgtttatacggtaagtgccgacccttatgagattctcagagagaaccacataacgctcggcgcatacgacaggatagacttcacaggctttgaggagaacgtggcaacggccactcttactatcgaaagagcctttgacgttgatattctggaaggcggcaagaagaccgccactgcatacagcgttgacgctacagtggcacagctgcttgagcaggcgggcgttgagcttggcgaatacgacaaggtatcacctgcaaagacggctgttcttaaagaaggacagaagatcgctgttacaagagcttatgacgtgaaaatcactgcagacggaaagacaacaaccgtaaaatgccttgacaacacggtttcagagcttttgaaaagagcgaaaataacgctcggcaagaacgatatggtaagcgaggagcttgaatccaagataaccggacctgccgagataaaggtttcaagagtcgagataaagactgaaaatcaggataagattattccttatcagacatctaccgtaacgagcaacattctggctataggtcagagcgaggttcgtacaaagggtgtcaacggcaagataagaactacaacgactaccacctacatcgacggcgttaagacggatgtaaagaagaccacaaaggtattgaccaagaaggttgacgaggttatagccgagggtgcggcaatcgtaactccttattgcaagatagatgatacatctattgtacttaggaacggcagaccggttgactatgagtatgtggtatcaggaaaggctacagcctatacagcgcccgaaggtgcgtataccgcaagcggcagaatggctgagataggtacagttgcggtaaatcccaatgttatcccctatggctcgaagctctatatagtcggtcagtatgacaatatctgctacggctatgctattgccgccgatacaggcgatggaatgatggcaggtacgatccctgtagacgtatatatgggcagtacagaggagcattatgacgatgcttgcgcatggggtctgcaatacgttgatatttacgttgtagaagtcggcaacggctaagcggctgcggctgtgagccgcctcaaattccgacctttttaaaggttggtgcgttattgaggttagcgaacggtcgggaataaacaaagcagtaattaatataatgtgggcggctgtgagccgcttcaaattccgcctttggaattgtcagtgttcggctaagattagcaaaacggtggggttatagaaagcgataatttaatatgcggcggtcacggtgatatgctgtgaccgctttttgcggctgtgagccgcttcagattccgcctatggctgaaagccactgtaaattccgcctttggaattgtcagtgttcggctaagattagcaaaacggcgggattatagaaagcgataatttaatatgcggcggtcacggtggggtgcggtgagtgctgttaaagcgttattgctttactatgaacaccattttgtcgagtgctgagaattgaatatatagaatccgctgtttactcaaatggcggatttttgtgtttggaaattttgtaggggagtgggcttgcccctcccgttgaatcgaattttttgattttctcagcgtttttaatctgttaagtatcgaggattaattgcggttacgttttacaatataattctattaacttgttttcgataattgcagtgatgtttcgggaggggcaagcccctcgccctacaaaaagcgagtgggatagtgcggttttggaaggggtggtgcgatgcgaggggattggaattgataggagtactaccataaaaactactaaggcattaacaatccccaccatagttggctcggcttgaccgagcaacagaacctcaccctttttcgagggcgggcaaggatatagtgcttttcgaaggatagtgcggttttggaagggttgatacaggcgagggttgcgtgacaatccctccgtcttgacggcagaaaagcttgtagtataaaaaggcggatatactgcaagcaaacgcaataaatcaacagtttgtgccttgccgtcaatccacctccctttgacaagggaggcaagtttgatagtgctttggcgcaaacggtcatatttcaaaactatgcgtatgcagggacgcttaacgctacacgtccgcaggttagtacatatatctcaggttagtggcgttttttgaaaggtaaatgtcagtgcagttgtaccagtatactcacgaaaatattaataccttatcagtatagaaattgttttaagcggtgttggcgacatattttgctgtgtggggtttaataataatcagtttttcgacaatctgaaacgggcatcggcattttaccgatgcccgtttttctgtttgttatctgtcgaatcttatgtcaaaccaccttagccggtattctgtctgcaagagatatgcgaaaatctgcggcggtgttttcgggcggaaaaccgcacaattaccgaagatgagcttcacaataacgaaaaaggcaatgaggtatcaagatgaattgcataatttacccatctgggtaatgtcattttgctgaatgcggtgtaaaatataataaagagcagtgggcttatatgaactttgaaaattataatgaggaggtaaaggattatgaaaataaaatttaaacgcattacagctttgtttgcggcacttgctattatgataaccgcactgcctctgacaatcatacctatcagtgccgcaggcaccgatggtgaaagcacagagtatgcaagtgacggataccttatcgtccgtagttaccggcagctgagattggcatacaacggcagtgaggagtctaagataaggcttggcgcagatattgactgcgaccctgaggaatataagcctaactatctgacgagattgtgtccgcctatagaaagtgacaagacgctggaccttgccggatatacgcttaaaaagacaggtaacagtattgactcgaaggatcatctgttaagcgtcgaatacagtaagctgaccattgaggattcggtgggaacgggtaaaatgtatttctatgccaaggatgtagcccagaatctgtttttggctgagaacagaagtacgatcgttataaacggaggtacattctgctacacgggtaccaatgcgatgtattgtgaaatgatcaagctgagtgcatcggatcttgtaatcaacgatggttattttgacgcacagatcggtactccgataaagctggataacggttttgccggcaaacaaagaacgcttaattctactgctctgataaacggaggtactatagtaactacctccagtatagcgctctcctcgatagacggttgtgattattacgcatcgctggttatgacgggcggaaccatcacaaacaagagcaagggcagagtgaccgataaaacgggaacgataatttccgatccgtattttgtccgtgttacaagtgacgaggcgttacagaaaaagtattacaacataacgctcctgggcggaaccatgccgcttagcctaaatgatatagaggtatattatcctgccgagaaggcggtacttacttctaaagcaggtacgatcacaaattctgcagaaaaggtagagtacacgactctgcttaccgcaccgcaggccggcattgacgaaaagaaggctatggcagcaagaggcgcagacgaaatctgcaggctgaagacagacagaaataattatgtgctgagcaataacaaacgcacacgttttaccgtcaacagcaacagcgtaggtaagattgacctgctcactcaggctcccaatccgtacaacacgggcgatccgataaaaacggtagattggtatgtgtccaagaatttcggctcgttcacatcaattcccgaagctataaacgatctgtcgtatacgccgccggaggttacggaaaaatgcacaatgctgtataaggctgttataaattacggcaatgtgctgagaatcaacgagataataataattgattatgattttgaagccgtaacggaaatcaaggcggtcgtgtcaggctttcacggaggttcgacgttaagcgacgtcagcgttgcgtcgggtgaacccgaaaaatacagtctgacgataaacaatatccgtgatgtttacggaaacaatatagtaaacgatcgtcagctgtgcaaaggcttcaaatacaacatatttgtaaaagtaaagctgaaaagcggatacgttgcagcgtatacaacaggcacagtaaagatgcgcaggtttgaggatcccgcaaatgaatggcaagcggcagaccatatttacatcggccttaacgagattgcatttaagagcgttcttgtttgcgacgaaggaatcaggacggtcggggtcgaaatcagcaacttcctgccttacagaaaggtaaacgatctgcagcttactgaatcggaacctgataaatatacggtaactcttgtcacgccgcttttaaacacatgggaatataacgaagaggtttacgacgatgacgagcttatagtagataactgttatgcggtcaaattcaaggtaacgcctaagtcgggatatgcgctttctcccggttatatattccgatgcaggcttgatacttacaaagaaggattctggctgacatccgaagacaaggaactgttcacggtttccaatgacggaacggtagtgattaacagtctgagggtgccgtttgaagaatatgatcagaatatatatgtacagataacacctccgaaggcaggaggaactccggcaaagagtttaatctcacataatcttcctgagcatatgagccttataagtattgactggtatgacgatgaagagcggaaaacaccgactgtatttgagaagggcaagacgtactggtgctatatatacatcaatgccgactgctatgagtataatctcaaaaaagcaaaattctatctgaacggaactcaggtcagacaggattacagttacaattcaaaagagaactactactatattctcggttatacggaaatcaagatcgacaatgatgttgcaactcctacaggctttgcggctggatcggcgacttcatcgagtgtttcgctgaagtgggataagaacgcaaatgcgagcggctatgagatagagcagtacaaaggcggaaagtggacacagattgcaaagataaataacaactccacggtttcgtacaatgtaagcagacttgccgccgatacaacgtacacgttcaggatgagggcatataagactttatcgtcgggtacggcatacagcgactatgtaaggcttgcggcaaaaacgcagcttacaaataccgacaaatttgtcggcaccgcaatatctcctacagctgtaaagctggactggaacaggaatgataaggttacaggctacataatcgaacagtacaagggcggaaagtggacgcagatagcggtaacaaagaacaacacaacgcttacctttacggtaaaggggctggcggacgcaacaccttattcattccgcataaagacatacaagaatgccgacggcaagacaaactacagcggctataccacggttaaggcggaaactcctcctgcggcagtgaagaatgcaagagttacctcgaccacggctacatggatcactcttgaatgggaacgtaatgctaacgttacgggatatgcgatagagcagtacaagggcggaaagtggacgcagatagcggtaacaaagaataacacgacgctgaagttcattgtcaagggtcttaacccggatacgaaatattcgttcagaataagagcgtataagacaaacggcacaaagacaacctacggcggctatgtttcgatggccggaacgaccagaattgcgaacgtggctaagttcaacgcaacggcgttgtcgcagacggtggtaaagctcagctggagccgcaacacaatcgcctcgggatatgtcattgaacagtacaagggcggaaagtggacgcagataaacgttatcaaagataagaacgtaacgacaatggttgtcagcccgctcgcaaagggaacaacgtattccttccgtatgaagtcattcaaaacggttgacggaagcaacaggttcagcgagtacatttccgcaaaggtaacaacggcgaaataaaatcaaagtgacagcgagggcaggtagtgttacctgccctcagattttttgcagttttctatacccgatgaagctctgcggcgctacacaccaaagcattataaataagcggcagaaaaattaacgaatacaggcaggcagaacggaaataatagcataaaaccaattagtcaatatgcacaaaaatgcggagaatttttatcgcaaattctatcttaaaatttttaaaaaaggcttgtattccgcatcgtaatgctgtataatgattcttgcgcgtgaaagcgtactgcaatgatatgctgtgatgtctgaggttgcggctatgccggtaattcagacggagtatgtccagtgaatgggcgaaaacggctttgcaaagcggttttcggtgctttatataagtttgggatcgttctcccgtcaagacgggaagggttagcaataaggttgatacccccgtgggaaaagatcctgttttatatgagagcatacgaaacacccggcacggtatgttttataaataccgcaaaccgtatctttcccccgaaaatcttatgaaagggagaaacaagaatggcagttaaggaaaaagtgagaatcaagctcaagggctacgagcacgcaacagttgatgcagctgctgcaaagatcgttgaaacagccaagcgtacaggttcaagagttgcaggtcctattccgcttcccacaaacaaggaagtaataacgatcctgagagccgtacacaagtacaaggacagccgtgagcagttcgaaatgagaactcacaagcgtcttatcgacgtaatccgtcccaccaacaagacagttgaagctctgcagagcctcgaacttcccgcaggtgtggaaatgactatggaagcgtaagccatagcgagttatgttggcgtaaagccaaccaataaccttcggcaccggaaacccgaaacaatatcggtgtcggtggtcaagtcgggaaaccgaccaataacctaaacaggaggatttaaaccatgactaagggtttaatcggaaagaaaatcggaatgacccagattttcgacgaagcaggaaaagtagttcctgttaccgttatcgaagcaggtccttgcgttgtaacacagctcaagacagctgagaatgacggctatgaagcagttcagcttggtttcggcgatgtatcaccgaagcacacaaacaagcccatgacaggtcacttcaagaagaatgacctccccttcaagagaactctcaaggagttcagattagacgacatcagcaacgtaaacgttggcgacgttctgaaggctgacgtattcgcagcaggcgacgttatcgacgtaagcggcgttagcaagggtaagggcttccagggcgctatcaagcgtcacaaccagcacagactgaaggaaactcacggtacaggccctgttgtaagacaggcaggttctatgggcgcttgctcatctccctcgagaatattcaagggcaagggcatggcaggtcacatgggtgctgagaacgtaacagttcagaatctcgttatcgttaagatcgatgcagaaaacaatcttatcgcaatcaagggtgctattcccggtcctaagggcggagttgtgtgcattaccgatgcggttaagaaagcgtaaggaggaggatcatcatggcaaaaatatcagtatatgatatgacaggagctgttgtgtccgaccttgagcttaatgacaacattttcggtattgagccgaacacagttgttatgcacgcagcagtggtaaattacctggcaaatcagcgtcagggtacacagtcaacgcttacaagaacagaagtaagcggcggcggtaaaaagccttggcgtcagaagggcacaggtcacgcaagacagggttctaccagagctccccagtggacacacggcggtgttgctttaggccccaagcccagaagctacacatactctttaaataaaaaggtaaagagacttgcattaaagtctgcactttcagctaaggtgcaggacggcagcatgatagttgttgattctatcacagctgacgaattcaaaacaaagacaatcgttaacatgttaaaggctctcagcgctgacaaggcacttatcgttctcaacagcgttgacgaaaaggttatcaagagcgccgctaatattcccggcgtaaagacaactcaggccaacactcttaacgtatacgacatcttaaagtacaacaagttcatcgttgttaaggatgccgttgctactatcgaggaggtgtacgcataatggcaaagctcgcttatgacatcattttaaagcccgttattacagagaagagcatggaaatgcttactcagggcaagtacactttcaaggttgccaaggactccaacaagatcgagatagctaaggctgtcgaggctctcttccccggcgttaaggttgctaaggtaaacacagtaaactgccgtggcgtaatgaagagaatgggcagaaacgaaggttacacacccgcttggaagaaagctgttgtaactctcgctgaaggctctaagacaatcgagttcttcgacggaatgatataaaggagtgatataaatggctattaagacttataaacctgtcacccccggtcgcagaggtatgactgttaccgactacagcgttctgtcaaaggttgagcccgagagaagcctgcttgagtcactcaagaagaactccggccgtaacagctacggtagaatcactgtaagacacaagggcggcgcacagagaagaaaatatcgtgtaatcgactttaagagaaacaagctcggtatggacgctgaggttatgactcttgagtacgaccccaaccgttcagcattcatcgcactgattcagtacgaggacggcgagaagagatacatcatcgctcccgacggtctgaacgtaggcgacaaggtaagaagcggttccgacgctgatatcaagcccggtaacgcacttgcacttgctgacatccccgtaggtacggttattcacaatatagagctttatcccggtaagggcggtcagctcgttcgttccgcaggtaacatggcacagctcatggctaaggaaaacggctacgctctgttaagacttcccagcggtgagttaagaaacgtatccgataattgcatggctactatcggtgttgtatcaaacctcgaccacgagaacgttaactacggtaaggcaggacgtgttcgtcacatgggcgtaagacctacagtaagaggttctgtaatgaacccgaacgaccacccccacggcggtggtgaaggtaagtcacccgttggtcgtcccggccctgtaactccctggggcaagcccgctctcggttataagaccagaaagatcggcaagagcacagacaagttcatcgttaagagaagaaacagcaagtaataactactacaagtcgttgttaataagtgcggcgtttgcggcatagcagtaaagaatccgccgcatattaacttgcaatccacttgaaaggaaattatacaatgagcagaagtatcaagaagggaccttatgtgcaggaagcgctcatgaagagagtgctcgctatgaacgaagcaggcgagaagaaagttctcaagacctggagccgttcaagcacaatattccctgatttcgtcggacatacatttgctgtacacgacggcagaaagcacgttcccgtatatgtgactgaagacatggtaggtcacaagctgggcgaattcgctcctacaagaacctacaagggtcatgcaggaagcaaaacaagtaagtaaggaggagacatcaatggaggcaagagcagaactcagacaggttcgcatatctccccgcaaggttggcgttgttcttgatcttatcagaaacaagccctgcgacatggctatggcgatcctcaagcacacacccaagtcagcgagcgagcctttacagaagctcctcaagtcagcaatggcaaacgcagagaacaatcactcaatggatctttccaagtgctatgtttcgagctgccacgttggcgccggcgttactttaaagagaatcagacataaggatcacggaagagcacatcgtattctcaagagaacttccaacatcgttctggttgtaaaagaagctgaataaggaggagtacaatgggacagaaagttaatccgcacggtctcagagtcggagttatcaaagattgggattcccgttggtttgccggcaaggcaacttttggcgatacactcgttgaagactacaaaatccgtgactatatcatgaacaagagaatgctcacaagagcaaacggcgaaaagtccgaccagcagctttcaagagcagcaggtattgctcaggttgagatcgagcgttcatcagacaacaagatcaagattcatattcttaccgcaaagcccggtatgcttatcggtgctaagggcgcagagatcgaaaagctccgtgcagagatctcaaagattgcaggcggcaaggacgttaacttaaatatcgttgaggttaagaaccccgatatgaatgctaagctcgtagcagagaacatcgcaatgcagttagagcagcgtgtatctttcagaagagctatgaagagctgcatcggcagaacaatgaagtcaggtgcaaagggtatcaagacaatggtaagcggccgtcttggcggtgctgaaatcgcaagaagcgagaattaccacgaaggcacgatccccttacagacattaagagcagacattgattacggcgttgcaagagctaacacaacttacggcgttatcggtgttaaggtctggatctacaagggcgaagttctcaagggtgagattcctgcacagagaacaacagaaaagccccgtcgcagaaacaacgacaacagatcacgcagacccagagttgagaaaaaagagggaggtaacgactaatgctgcttccgaagagagtaaagtacagaagagtacagagaggtcgtatgaccggtaaagcaacacgtggtaatgtagtcagccacggcgaatacggtttacaggcacttgagcccgcttggatcacatcaaaccagatcgaagctgcccgtattgctatgacacgttacatcaagcgtggcggtcaggtatggataaagatattccccgacaagcccatcacagagaagcctgccgagacccgaatgggttctggtaagggttcacctgagtactgggtagccgttgttaagcccggccgtgtaatgttcgagatcgcaggcgttcccgaagaaactgcaagagaagctatgcgtcttgctatgcacaagctccccattaagtgcaagttcgtaagtaaggaaacaggaggtgagcagtaatgaaggttaaagaaatcagagagttatctgaaatggagctcgataagaagctcgtagagcttaagcaggaattattcaacctccgtttccagctcgccgttaacaagctcgacaatcctacgagaatcggcgctgttaagaaggaaatagcaattgtcaagacagttcagcgtgagcgtgagctggcagctgacaacaagtaagagagaggaggactttactttgagcgaaagaaatttaagaaagaccagagtaggtatggttgtaagcgataagatggacaagactatcgtagtagcaatcaaggacaatgtccgccaccccctctacaagaagatcattaagcgtacaatcaagcttaaggcgcatgacgagaacaactcctgcggaatcggcgacaaggttgagattatggagaccagacccctttccaaggataagagatggcgtttagtaaacatcatcgaaaaggctaagtaatttattactttaaatttatcggaaggagaattaatccatgattcagatgcagacacgcatgaaggttgcggataacacgggcgctaaagagcttatgtgcatcagagtactcggcggtacacgcagaaagtacgctaacatcggtgacgtagtagttgcttccgtaaagaaagcaagccccggcggaactgttaagaagggcgatgttgtcaaggcagtaatcgttcgttcagcaacaggcatcagacgtgatgacggaacatacatccgttttgatgaaaacgcagccgttataataaaggaagataagaaccccagaggtacacgtatttttgggcccgtagccagagagctgcgtgacaaggactacatgaagatcctttcacttgctcccgaagtattataatccggaggtcgtaaatgaacacattacacatcaagacaggcgataacgttcagatcatgtccggcaaagacaagggcaagcagggcaaggtacttgaagtatctcccaaggaaaagaaggttatcgttgaaggcagaaacctcgtaacaaagcacgttaagcccagaagacagggcgaacagggcggtcttgtaaaggcagaagctcctatctatgcgtgcaaggtaatgcctgtatgccccaagtgcaacaagcctacaagagtaggtcacaaggttgagggcgacaagaaggtaagagtttgcaagcactgcggcgctgagctttaatcagacgccccgaattacgacagagaggtcggataaagtaacttccggctgctgtcgctaaaggagaaataaacgatatgacaagaatgaaagcatattataaggaaacagttgctcctgctcttttcaagaagttcggttacaaaagcacaatgcaggttcccaagctcgacaagatcataatcaatgtcggctgcggtgaagcaaaggaaaacgctaaggtagtagacgctatcatgagcgaccttatgcagatcacaggtcagaagcccattgtatgccgtgctaagaagtcagtagctaacttcaagctcagagaaggaatggtaatcggtgtcaaggtaacactgagagatgatagaatgtacgagttcctcgacagattcttcaacgtagctctcccccgtgttcgtgacttcagaggtatcaaccccaattcgttcgacggcagaggcaactattccacaggtatcaaggaacagctgatattccctgaaatcgagtatgataagatcgataaggttcgtggtatggatatcaacttcgtaaccacagccaagactgacgaagaagcaagagagctgctctcacttatgggcgctccgttcgctaagtaagacagagaaaggaaactatcaactatggcaaagaagtcaatgattgctaaacagcagcgtcctgcaaagttttctacacgttcttacaacagatgcaagatctgcggcagacctcacgcttatatgcgtaagttcggcatctgcagaatctgcttcagagagcttgcttataaaggacagatccccggcgtaaagaaatccagctggtaatttaagaacaaattttcaaggaggaagtaagtaatgcagatcaccgatactatcgcagatatgctgacaagaattcgtaatgctaactctgcaaagcatcctacagtagacgtgcccgcttctaacatgaagaagcagatcgcacagatacttgtagatgagggttacattaagagtttcagagtgatagatgacgacaagcagggcgttatcagaatcaccttaaagtatactgagaacaagtcgcaggtcattacaggtttacgccgtgtaagcaagcccggacttagaatctactcaaacagcaaggatatgcccaaggttatgaagggcttaggaattgcaatcgtgtcaacctctaagggtatcatgacagacagagaagcacgcaagaacaacgttggcggcgaagtgctcgctttcgtttggtaattaaggaggagcagatatgtcaagaataggtaaacatcctatagctgttcctgccggcgtcgaagttaaagtagacggttctacagttacagtaaagggtcctaagggcacactcacaaaggagttcaagccctctatgtcgatcgcagttgacggcggttttgttaccgttacacgtcctgacgacgaaaaggaaaaccgtgcacttcacggtcttacaagaacacttatccacaacatgatcgaaggcgttacaaacggcttcaagaaggagcttgatgtaaacggtgtcggttaccgtgtacagaagcagggtaaggatcttataatgaacctcggttactcacatcaggtaatcgtatccgatacagaagacatcaagatagagtcacccgcacctaacaagatcattatcacaggtattgataagcagaaggttggtcagtttgcagctgaagtaagaagcaagcgtcctcccgagccttataagggcaagggtatcaagtataccgacgaaacgatccgccgcaaggaaggtaaagcaggtaagggtaagaaataaaccgcaaggggtgaaaaataatggttaaagtaatagacagcaagaagagcagaatcaagcgtcgcaagcgtatccgtgctaagatcagcggtactgcagcttgcccccgtctcagcgttttccgttctgctaagcacatttacgctcagatcattgatgatgaagcaggcaaaaccctttgcagtgcatctacaatggagaagagctttgaaggcttcggcggcaatgcagaggcagcaaagaaggttggtcttgcacttgcagaaaaggcaaaggcagcaggcatcagcgatgtagtatttgaccgttcaggttacgtatatcacggcagagttgccgcactcgcagatggcgctcgtgaaggcggactcaacttctaatcagtaaggcaagggtttactgaaacccgcaataaaaacaggaggacaagaatttggcacttttagatgcaagcaattatgagctttccgaaagggttgttgctctgaaccgtgtatccaagactgttaagggcggacgtatcatgaagttttccgcactggttgttgttggtgacggcaacggtgtcgtaggctttggcatgggtaagtcgaacgaagttcccgacgctatccgcaagggccttgaggacgctaagaagaacctcgtaaagatctcattaaagggtacaacgatccctcatgaaatagtaggaaaattcggtgcaggcgcagttctgatgaagcccgctcccgaaggtaccggcgttatcgcaggcggccccgttcgtgccgttgtagagatggcaggtatcaagaacatccgtactaagtcacttcgttctaacaacccctgcaacgtagtaagagctacaatggcaggtcttacagctctcagagatgcacagcaggtagctgagctcagaggcaagtctgtaaaagagatcttaggttaagcttttactttgcagaaaggacggaaaccgaaatggctttaaaaatcaagctggttaaatcactggttggacgtaaggacagccacatcgcaacagcagcctctctcggacttcgcaagatcggtgcagaaacagttcagcccgacaatgcagcaacaagaggcaagataaaagaaatttcttatttagttgaggttactgaggaataattccttacaccttatagaagttaaataagcacattaacaaataggaggtgtaacaattgaagctacacgaattataccctgcagcaggtgcaacaaaggaagttaagcgtatcggacgcggacacggttccggtcacggtaagacagccggtaaaggtcacaagggtcagtgggcacgttcaggcggcggcgtaagacccggatttgaaggtggtcagacatcactcgcaagacgtatgcctaagagaggctttaacaatatctttgctacagaatacactgttgtaaacgtagccgacctcgaagctcgctttgagaacggtgctgttatcgatacagacgctcttatcgatgcaggtcttgtaactaaggttcttgacggcgttaaggtacttggcaacggcgaggttacaaagagctttacagttaaggctgccaagttctctgaatcagctaaggctaagatcgaaagtgccggcggaaaggctgaggtagagtaatgtttcaagtctttagaaacgcgtggaaagatcccgcacttcgcaaaaagattttatttacattgctcataatagttatattccgctttggcgcagcaatcttcgttccattccttgaaccctcgactatcaaacagatgatgggtgaaggaacgatacttaattatctcgacgttatgacgggtggatcgctcagcaacggtacgctgtttgctatgtcgatcacaccgtacatcaacgcctccatcatagttcagctgctcacagttgcaattcctgcactggagcgtctgagcaaggaaggcgaagaaggacgtaagaagataaacaagatcacgaagtatgtagctttgggcattggtttattccaggcgatagcattctacatcggacttcgcaacactgtaaacgaaacaacacacaagagtgctgttctctatacggaaggctttgacggagtcatcgctgcgattactatcgtggcttgctttgtagcgggtgcttcgcttattatatggctgggcgatcagatctcccagaagggtatcggcaacggtatttcaatgatactgtttgcaggtatcatatcaagagttcccgatatggttatcaatctgatcaagcagatctcggttgctccgcagaactggttcttcgtaccgctgatactcgttatctatgtattgatgattgcattcgtaatactgatgacaaacgcagaaagacgtattcccgttcagtatgcaaaaagagtagtcggcagaaagatgtacggcggtcagacaaaccacattccgataaaggttgcaatggcaggcgttatgcctatcatctttgcgatgtcaattatgtcgctgcccgcaacgatcggatacttcttcggtgtaactgcaacatcgggccacgcattctggagcgactttatcgctctgttcagcacgaacaacgtggtttatgcaatactttatttcttccttatcatcggcttcaactacttctatattgcaatgcagtataatcctgtacagatagccaatgatcttaagaagaacaatggtgctatccccggttatcgtccgggcaagcccacatcggatttcatccacaactcactttcaaaggttactctggtaggtgcaatattccttggtatcatcgcaatattccctattatattccagaacctcacaggcatcacaggtctttcactcggtggtacgacaatactcatcgtagtaggtgttgctcttgaaacagtccgtgctctcgaaagccagatgatgatgcgtcatcataagggcttccttgaataagagaaaggaattattatgaatcttattttcttaggcgcacccggcgcaggtaaaggaacacaggcagaggtagtctgcgaaaagctcggtatacccgctatatcgacaggtaatatgctcagagaagctgtaaagaacggcacacccgccggtcttgcagcgaaagagtgtatggacagaggcgatcttgttcccgatgaagttgtaatcggcatcttaaaggacagaatcgcacaggatgatgcaaagaacggtttcattcttgacggtttcccgagaacagttgctcaggccgaggcgcttgacgctatgggcgttcagatcgacaaggtaatcgagatcgctgttcccgatgagaagataatctcaagactttcgggcagacgagtatgcgagggctgcggcgcttcttatcatgtagacttcaagcctacaaaggtagaaggcaagtgcaatctttgcggcgctaacgttgttcagcgtatcgacgacaagcccgaaacagtaatcgcaagactgaaaacatactatgaaaagactgctcctctcaaggattattacatgagaaagggcaaactgataaccgtacagggtcaggaagaaatcgctgagacttcaaagctcactcttgcggcagttgaggcaaagtaatgattcaggttaaatcggcaaaagaaattgaaataatgaagaaagccaatcagatagcggctgaggctcttatcgttgcgggaaatgcaataaagcccggaatgagcacatgggagcttgataagatcattcatgattttatcgtttcaaaaggcgctgtcccgtcatcgctcggatacggcggatttacaggcagtgcctgcatatctgtgaacgctgagctgatacacggcattccttcgaagaagaagatcatcagagagggcgacatcgtttctgttgacgtgaccgctgagatcgacggctataacggcgataatgcttacaccttcaaggtcggcaaggttcccgaaaatgccgaaaagctcctcgaggtaaccgaggctgctttatatgaaggtataaagatggcacttcccggtaacagaatcggcgacatttcaaatgctgtgcagacttactgtgagtcacgaggctattatgtggtaaggaagttcatcggtcacggaataggacacgagatgcacgaggatcccgaagttccgaacttcggcaagcccggcagaggtccgagacttgtaccgggaatgacaatctgcattgagcctatgataaatgaaactacagccgagatccgcatactgccggacaaatggacggtggtcgaggctaacggcaactacagcgctcattttgagcatactatcgcaataactaacggtgagcctcttattctcacggaaagctcacttcaccacccgaagaattaacggagggcgtatgaacaatacggttattgcagccggtatggttgtaaaaagcatggcagggcatgacagcggaagctattatgcggtcatgagggttgaaaacggttttgcgtatattgccgacggcaagctgcgcaaggtcgaaagacccaaaaagaagaatccgcttcatttacagaagacactgactactgtagagcttgcggaaatcacaaacaaaaaactaagatctgcgttatcggttctgaaccgaagtgcagacaacatcgccgaggagagtgacaagcttgtctaaagaagatgtaatcgaggtaagcggcaagataattgaggcgcttcctaacgcaacgtttcaggtcgaacttgaaaacggacataagatactggctcatgtaagcggcaagctgcgaatgaactttattcgtatcttacccggtgataaggtaacagtcgaaatgtcaccgtatgacctgactaaaggcagaatcacctggagagccaagtaattctgtataaacgaatacgagcgtatgctcgtctgtaacaattacaggaaggatgatattaagatgaaagttagaccttcagtaaagcctatgtgcgataagtgcaaggtaatcaagcgcaagggcaaggttatggtaatctgccaggaacctaagcacaagcagagacagggttaagcccgaatttaacaggaggaaaaagatatggcaagaattgctggtatcgacctgccgaaagaaaagcgtgttgagatcggtctcacatacgtttacggaatcggcagaaagacagctaacgacattctggcaaaggccggtgtaaaccccgacaccagagtcaaggatcttaccgatgatgacgaagctaagatccgtgatgctatagagcagctcggcgtagctgtagaaggtgacctcagaagagaagtagccctcaacatcaagcgtctggttgaaatcaactgcttcagaggcacacgtcaccgtaagggtcttcccgttcgtggtcagagaacaaagaccaacgcaagaacaagaaaaggtcctaagaagaccatcgctaataagaagaagtaatctttacggaaaggtggtaaaacaatggcaaaggcaaccgctactaagaagcctgtagtacgcagacgtcgtgagcgcaagaacattgaaaacggttcagctcatatccagtctacgttcaataatacgatagttactatcacagaccttcagggcaacacattatcatgggcatctgccggtgaaatgggtttcagaggctcaagaaagtcaactcccttcgcagctcagacagccgctgaaacagcagctaaggcagctatggaacacggtctgaagactgtagaagtttacgttaagggtcccggatccggacgtgaagcagctatccgtgcattacaggcagcaggtcttgaggttagacttatcaaggatgtaactcctattcctcacaacggatgccgtcctcccaagagaagacgtgtataatcataaactgagtgtagtttactcggtgtcgcggaaggtataatccttcagaaacgatatttatttaaaaaacggaggtactgacaaatggcagtagacagacagccggtcttaaagagatgtaaggctttaggcatatcccctatggtactgggatacagcaaggaaacaaatcgtcacgcaaacgctaacaacagaaagaaagtttctgagtatggaatgcagcttaaggaaaagcagaagctgaagttcatctacggcgttcttgaaaagcagttctatcactactacgagatggcagttaagatggacggcgttgcaggtgaaaacctcatcaagattcttgaatcaagacttgacaacgttgtattcagaatgggtatggctatcacaagaagagaagcaagacagttagtaacacacggtcacttcacagtaaacggcaagaaggttgatgttccttcttacagaatcaagcccggcgatgttgttgcagtcagcgaaacaagcaagaagagccctaagttcgctcagatcatcgaacagacaaacggcagaatcgtaccgttatggctggacgtaaataaagaggctatgacagccaaggttactcgtgaattcaacagagatgagcttgactatgaaatagctgagcacctgatcatcgagttatattcaaaataatctcgtcgagcagtattgcgaaaactcttcatactgtggacatcacggtatgtatcggttatttttaatttacaattccgcactgagatatgtgcggagggcattgcccgccaaatcgtaatttaaaattaaccgggcggttttccgctttcagcgggaatacagcccgttcgtacatcgttaacccgatgaaacatctgacaaacttgtgggagggtaaaccaaatgcttgaaaaaatcgaaaagcctgtgatcgagaccgttaagttaaaacccgatggaacctatggtatgtttacacttgagcctctggaatgtggttacggcaacacacttggcaacagccttcgtcgtgttctgctttcgtcacttcccggcgttgcggtaacgtcagtcaagattgacggcgttcagcacgagttttcgactatccccggtgttaaagaggatgtaacggaaattatcctcaacattaagggtctcattgcaaaaatgtatggcgaatgcccgaaaacagtttatattgaagctgagggcgagtgcgatgttactgccggtgacataaagaccgacagtgagattgaaatcctcgaccccggtatgcatatagctaccctcggccccggagctaagctctatatggagattactcttgacaagggcagaggatatgtgtctgctgaaaagaacaagcagcagcttcagccggtaatcggcataattgctgtcgacagcatttatacacctgttttaaaggtgaattatacagttgagaacacccgtgtaggacagcgtaccgactatgacaagctcatacttgaggtatggacagacggtacaatttctgcaaaagaggcagtctcatacgccgctaagcttctggtagatcatcttcagccgttcgtagagctgtctgatgaagctatacagcctgagctaatggcagacaagagtgagtcgggcaaggataagctcctcgaaatgactatcgatgaccttgacctttccgtacgttcattcaactgcttaaagcgtgcaaacatcaacaccgttgacgatcttatcaacaagtcgcagggtgatatgatgaaggttagaaacttaggcaagaagtcgtttgaggaagtcagagcaaagctccagtctttaggctttgaccttgcaagcgacgatgacaacaattgacaagtgactttcaatttgtctgaaaggagaaatatccatggcaggttcaagaaaactgggaagaaccagtgatcacagaaaggctatgctcagaggtatggtaacactgcttcttgaaaagggcaagattgttactacagttgcaagagctaaggaagttcgcagtgcagctgaaaagatgatcactctcggcaaggccggcacactgcatacaaagcgtcaggtttacggctacatcactaaggaagacgtagctaagaaactgtttgatgatatagcacccaagtacgctgacaagaacggcggttacacacgcatcatcaagatcggccccagaagaggcgacgcagcagagatggctgttatcgaattagtttaatttgatataattaaatagcttacgcccacctttatggtgggcgttgttgttttggggaaaagtcttgtatttgataaaattctgttataattattagtatttatctatgatagcaagctaccgatagttctttttgcgagatagcacttctcgggttcgctattcgaatcaatgcacttgtcaatattgacgagggaaagaaccaaagagactagggtaagggagctaggcgccccctctccctatctcttaggttctctccctcgtgctccctctttccttactcacacccccactccgcctggggtgttggctaaactcgtaaaactacccgaacattgtatatcctgtcaatgcaagaacgcttaacgctacacgtccgcaggttagtacatatatctcaggttagtagcgtttttttgaagggtaaatgtcagtgcatttgtactgataaggtcacgaaaatattagtgccttgtcggtacggaaaatgatttcagcggtgttggcgatatatttcactgtgtggctttaataataatcggtttttcgacagactgtacgcacgtctttatggtgggcgttgtttatacaaagcaatgtaataaaactgcgagaacgcattggtgtacgttataacaaggtgcgcaaagcgtgtagcataatatttgaaaataaagcagtgatctgaaaaggttaaataaataattgacatatttcgattgatatgttgaacaaaaaaattgaaacaatttgtataaaataacagttgaccccaaatagacttgaatgatataatatatataaacaagaatggatggtataaaataatcaaaaaagaaatttgaaagatagggaaacgagcaaatttccacaaaactttacagcaatcattatgcttgatatttaggaggtatttatatgaaaaagtttttaacacttgcactgataacaattatggcgcttgtttgcacggcgtgtgcaaatgcggcggctgataccgatgtttcttataaccaaccgaatttgaagtacggaagatattatttaaacggagatgtgaacagcaaactatacattgaccttgatgagaattatatagtaatgggtaacgaagaagaattacggaaattcctagaggaatactgcagcgctatagacgattattctaccgaggagctgtataaggaaaatgttgaagaagcaattaatggatatggagttaaaagtaagtataactatatgaccattaatcccggaaccattatacatgtaataatttttgattactttaaattcggaacattcgatgagaacactgttacaggtgtttattatgaatacgttgaagaaggtaaaatcaaagttttagaaaaagaattcattttagtttgattatcgtaaatatttatatgtgcccacctttgcggtgggcatttcagtttgtagaaaaagtatgtttttgaaacaaacttctaactcactacccctatccccctgccccctttccccgactcattatctaaaaacatatggattaaccgccagagaactcgcaatgagaattattttggatgtgcttaaaacaacaggaattaccgctactgcaggaatcggtaccaatctatatctgtgtaaggttgcgatggatattgaagcaaagcatattccaccggatgaaaacggtgtgcgtattgcagagctggacgaaatgagttaccgtcgaaaattgtggtcacatcgtcctttaacaagcttctggcgtgtaggaaaaggatacgcgaagaaattggaatcgtgcgggatatataccatgggagatgtcgcgcggtgttctcttgggaaacctggtgactactacaatgaagatcttctttataagttatttggcattaacgcagagctattgattgaccatgcatgggggtgggaaccatgtacaatggcggacatcaaagcgtacaagccggagtcgaatagtatcgggtctgggcaggtgctgcagagtccatatgaattcgagaaggcaaagctggtagtgcgtgaaatgacggagcttttggtcttggatctggtagaaaagaaccttgtcacaaaccagctgacactgacaataggctatgatattgagaacctgagcgatccggaacgaagaaaacaatatcatggtcctgttaccacagaccaatatggcagatccatccccaagcatgcacacggaactgcaaatttagatcgatatctgtcttctaccaagctgattacgggagcaatgatgaatctgtttgaccgcattgttgatccaaagcttctggttcgcagaattaccatcactgcgaatcgagtgatagatgagaaagcggcacagcgaaaggatgagtaccagcaactcgatctgtttacagattataaagcggaggaagttcgacagcgagaagaacagacggaactggaacgagaaaaaagaatgcagaaagctatgcttgatattaagcataagtttgggaagaatgcgattttaaagggaatgaatttgcaggaaggcgccacggctaaagatagaaacagtcagattggagggcataaggcgtgagtaataaaaaatatgacgatatcattaacctcccccatcatgtttcgcttacgcatccccatatgtccagactggatcgggcagctcagttttctccgtttgcagccttaacgggctatgatgctgctattaaggaaacagcacgtctgacggataaaaaagtggaactgggagagtatgagctggaagaactcaaccgaacactgctggagttatcagaccatatttcacagcacccgcaggtcatggttacgtattttgagccggataagtgtaaagaaggcggagcctatattacagtcagcaaggagataaaaaggattgacgagatagagaaagccatttatcttaccgatgggtcaaagatcccgttagctgatatattttccataaaggtcagcaatcgagaggagtgttaatgatgaaagagaaatgcaaaaagggtgttgaaatagtcgttgaatccgttaactttattattattacttatgctctctcaagtgtctcaatgtcccttcgctccagttgggtatatattttgttttttgcgtcgaatgtttggctgattaccatgtactgtaatacaatcaataaaacagtaaaaaacaggctgatcacaacggttttatgtctagcctgtattatcatattctgtgtaattgtatattactttggatacatagatggacagcttgtcagatttaagagttagtgggatattatatgtggaatcgaaagaaaaataagtgatggacaataaagatcaatacaataaatgaaggaaggaggaaagtgcagataatgaaaaaatatttaggtcgagtgggctttgcagtttgcattcttgcggcaatacaacttttaagaatgggaggcaagatgctgctttttcaatttgccgagcacacccttatggcagatacaatctattcactgatatttatgctgctgtgcagtatggtaatggttttacttgcccaaaagaaacatcctgaagtaaatctttttcctaaaaagatatctaaaccgtatgttgttttcagcgtgttagtactactgctttttctggtaacaccttttattacgcttagcacgacggtttacgattggctctttttgctgtacggggctttaataactccaatttttgaggaactgattttccgtgcatatttgtggaagtatttttcttttacaaaagagcctgtaacatatatcacagttacttttttgtttggaatatggcatttagggtacatagatacaattctttggagaacctcattgttccatcctgatgctaatatccctgaaatcatgttctggaaagtgataacaggccttctttttggtatagtgcttggtgcaatgcgatacaagttcaaaaatgcatatgcatcattcttgcttcattgtgcgctaaatacttttggcggataagttttataccctaagatgtcttttagaagtactaatttgtaaggaaaataataaaaggagaagaatatgaagtttataattgaacatttgtcaaaacggtttgaaaaaaaagaggttcttcgagatattgactttacctttgaggaagggaagatatacggccttttaggcagaaacggcgctggtaaaactacattgtttaattgtctgaaccgtgatctcatagccgacggaggtagtttctatctggaggagaacggaatacgcagggatgtaaaagcggaagatatcggctatgtgctgtctacccccacagtcccggaatttctcaccggcagggaatttctgaaattctttatggatatcaacgaggcctctgtaaaagatcccaagccgttggacgcctattttgattacatgagtattgatccagaagaccgagacaagctactcaaagactattcccacggtatgaaaaacaagatgcagatgctcatcaatatcattgcccagcccaatattctgctattggatgagccgcttacctctctggatgtagtcgtagccgaagaaatgaagcaactgcttcgttctctaaaagatggcagaattacgattttctccacacatattatggacttggcgttggacttgtgtgatgaaattgtattattgagccacggagaattggaagtagtggaaaaatccaatctggataatcacgaatttaaagaaaagatcatagcagcactacgggaggaagaccatgtttaaaacattacggatttctttctctttgcggaatacataccgtgttaatggcattttatattccttgaaacagatcccactattaaagaagattctgccgcaaacactgtataaagtgaaaggtctcaaaatatttgccaatgtgctttctgcgatttgggaagtagtatccattttcatcggtaaatttctgtatttcatcactatgatctttggcattgggattttatacgaaaaaacaccggtggatcagacgtatttgcacatccttttgcttttgacctttatcggtgcatggatgaacaccaatcttttcaatccaaccagagacaaatattatgcaatgattctcatgcgaatgaatgccagggaatatacgctggtcaattacatgtacacgattattaaggttatcatagggttcatgccgttttccatcttgtttggattgcaaaaagggattcctttgtggctctgtctcttgattcccttttctgttgccggggtaaaaatggcagttgcagcgtcttctttatgggattatgaaaaacgaggattggtttacaacgaaaataaattgcgtaaatacctatgggtgatgatcggcttggttctgatagccacttatgggttgccagcaataggaattgttttcccatcaatcgtttctattgttttgttccttgtgtttattcccgcaggatgcgtaggactatggaagattctgaatttccaaggataccgggaaatcaatcagcagcttttggcccagctgaacaaccagatggacagcgctaagcaagcagtcaagaaatccactgaaaagacgatttcaacagatacttctatcaccagtaagcgcaagggattcgagtatttgaatgagctgtttatcaaacggcatcaaaagattctttggaaagcaacaaaaaagataacttttgtctgtactgtacttgtttgcgtaggtcttttggttttgtatttggctccagaagcaaaagacaaggttaacaaattgattttaaactggctgccatattttacgtttatcatgtatgccatcaaccggggaactggctttacccgagcactgtttatgaactgtgatcatagccttttaacctattcattttataagcaacctgggtttattctgaaattatttcggattcggctcagagagattatgaagatcaacgtagtccctgcgttggttattggcgcaggtctgcctttacttttatatgcttctggtgggacagacaacccgctgaactatatagttttatttgtttctattctcagcatgagtctgtttttctccatccattacctgacgatttactatctgctccagccatacaatgccggcagtgaaatgaaaagcggaacttatcagattataatgtctgtcacttatttcgtgtgttttgttatgatgcaggtgcaaatgcccatactggtgtttggtatcgcttgtattatattctgtatcctctattcaatcgtagcatgtattcttgtctatcgactggcgtcgaagacatttcgattgcgcacgtaaataataaaagaaccccttccggataatcgtaggggaggtccaaaaaaataatctttcaaaagtagagattctcacctgtgaagagagactctgcattcagtgcatttacatcgccccctatgataacgagtccgaagctttacagataatggtgcactatgccaaaaaacaggaatttgctttggatttttaagtgaacggtactaccataagatttaattaagtgaagcccggcgcttcaaactggaaaataaaacaattatccgtcatccaatacgatgaggataaaaggaaaaggcaccgcttttgcggtgccttttatcatcgtttaaattattatacttaaaatattccgtgattgtactttagttgcgcatacagaataaaaaccaatccgatgacgatcgctggtatttcaataaacgccattatcgtagtactccaaaacgttgtaaaataagatataatcaaagaaacacctataataagtgttccggttccaactaactttccatatttcggaacatcttcttctgaaacttttctccggttgtatgagtgtatcgtgctgatatttccttttatattcacaattccaagaaccgaaatagcaatgcctataatcaataacatcaagttacccataatatccccctaaaaaaagaataaatcttcaaacttcttatccaatgccgtacaaataatgagtgctaatttggctgtaggattaaactgccctgtttcaatagaactgattgtatttcttgaaacaccgaccatttcagcaagctgtgcttgagataggtttgctgccaaacgagcttcttttaaattatttttcagttttaactcttcattcatactgtcacctctaaaaggcgacggataaatccaatcaaagctaaaattgtaagacataaaaacaatatggccacaaccaaatcactcttatgtttcatcttaataaatcgaactagccattgtgttgcaatcatactgaagtatatgatccacggactgtaaagcatagtatgtgcaagcatagaggaaagtaaggacactaagcaacacgctaatgcgcctactctacttgcgtgacttcctgcttggtacataacctcaatttcagctaaatccttatttttattttcttttcggcttgcttttaagatttcctctttgttcatgagcttgcctcctttgccaagttttcttgtcataattatagcactgccaagtaaacttgtcaacaaactgattagacgcttatgaaaataagatagaaatcgtaaagcagataaaaggaaaaggcaccgcagaagcgatgcctttcttttatttgttgcctttaggcttaacaaaacccctggttctactatgggtaaataaaaaagacttggcaaataaattggtggaaattagtagtaaggcaacataaatgaatgtaatttccttaacagaaaatcttatgagagaaaatatacaaaaggttaggaaccactgtaagccttaaaaagacacgtatgactggtttaccagttgcggggcgagcgatgcgatgatatttttttaggggtcagcaagtactgacccctctgtggtctgagcaaaccactagtttactagtggttttgattggattaccttatcttgtccctgaagcatactctcccatattgatatccagcacatctctgggcggctggatcaaggcgtcctcatactgacatttccactgaatctcttggttcatctggccgttcgctataccatctatggtttcaccatctttaatggggttatcgtgctccagaatataggacgccacattgtaggcatggttcaccacccagttgggatccatatcgtgaaagtggtactggaggtcgggcagaaacagggtgctcatccccaccgtgtcgatgagcatatccttggtgccctcgatgttgaagaatcggacattgacgccaaagttgataaaacgatctgagccttcgaactgttgagaacgcacatcctctgccagaaacagcttgccacagttctggaaatagaacgcctcgcaggtggggtacaattccgccagtgcctccaaaaagtcggcgtccaggttggctctctccaatgctggaagcgcggctgccagcatatcggtggctacgacctgatattgacactcacggaagatccgatctcggtcctcctgacagtcccacatctggctcatcaggaaggcgtcaaagcctttgcctttgaacttgtcgcatttcattaccatcagctgcactgggcatttgccatcttgaaattccgcgatatgatccagggcggcaaaaccggtcatctttttatcacggcagaaacactctacagcgccgatgtgcttttccatcacagcgcacatttcatccttgtccggcatgtccaccggctctttgaacagcatctgaatgagataggggcctccgggctgtgggccttttttatcatctaggttttgttggaacactttattgctcatttaatttcctccttactccaatacaattacgctctatcagcggttttatggccatgagaagcagcaaaccgcaaaccagaatgataataccgatcattctttttctttcggtctgttaacaaacagcttccaccggaactccagctctttctggacaaactctttcggcagattccgggggttggcgatgagataccatacccgaaaggttcgcttcttcggatctgtttcctgttggtagagctgatagcccgcctcatcctcctgcgtccactgtcctgtctgcctcttagcctgcacaaagggttccaccacctggtccagttcctctctggtgcggcttgaggcccaggcttgatccacatcatgggcgtgggagagatggaacaacatcgagcccatcccgttctttgccttatgctccggcgttccgcgcaattccacctgacgtcggtattcctccagctgttccgctgttccgtaccgttccaacatctgttcccgcacatagatgcaccagctgtaatcctccggctgggtaaagggggcacagaccgactggagcgtccctactgggtctgcttcaaagcagtcaataaaatcgaggtagtgggctttgatcaggggcagaaaggtgtccagcagcgcggtgttcagctgtagatcctctgtcagcatccgaaagaatgaaccgcctgttgtcggttctattctgaacgagtagaggtagtcatctccttgctttatgatacaggtgaagcccacctccacatttccatggccgatttcgtagtctatgtagttgtagcggctccgatcgaaccagatctgataggtcagcccgtttttcgttttctttttgaagtcgccttttttcagccgcttccagcccttttcctccaggcccaggccgttccataggtagtccagaagctcctgaaatatatctgccgggcgtttttgttccataaaatcctcccaaccgcttatgcttgttcctcactttttccaatcacatccgctaattgagcactgacagtatctatgtagagatacaccccgtccctgtcgcagtggtacaggttggaatagcttgtactctcattcggactgatggggtttggttctaccacttcagtggcctccagcaggccggcgcccagttctgcagcggcagaaagtgcttttttcagcacagcaatctgtccattgctccaaatcctctccagatcttcacacactttggggtcctgctccatgtctttgagaagctgcataacttgatctggagacagatatacaccggagcaatagttttcgatgattcggttctgtatggggtttggaaaggaaacaggggtcacttgatcccatgaggtgaagtaccgcccatattccggcttttcttccgccaggaaagaaaaggcactgcctctggtgtaatagtaatcccggaaaaaaccttggatcactgcaatatagaagccatggcttttgtcaaacagctcgttggattctgtttcagccccaacccgcagggtatccagatatttttctgcatagaaatcctctattccatactgtgcggcgagtgccagtaccttttcctcctgtccctgctgtatccaggttaagggagtaaaataccattcccgcatttcctctggtgaaatcgggtgaaagctcacatcgtatcccataaaaatcctccttagaaatccatcaagatgggcacctgctgttcatctgcaaaacacattgcttgccagaacattgagaaagcaaacttagccagtgactcggtgtcatactgagtatgttctggaatgtctgctttgctgtactgcccattcggacctactgctccgtcaatatatgcacaacacggaaattgccgtaaccatgcggctttccactatcttaaagacaattaaacagcccctatgattacacctaaaacgccgtagcaaggttggacaagccttgatatggcgtttttaagtgggtaggatatgccgccgcagcttcaaagaagttgtggcgtttttttatgcccgcaggaaaggaggcgcagccggaatgtatttcacaaagggcaagcagcgggcgtttgaactgctcatgcagcagaagccgggatttgaccgctatcaatccggttgtgccggagatgatgaagattgcggcacttgccgtttctaccgccccgggtggaaatatgagttttgcgttttcaaagagtgtccctattgccccggcaagaggacgcggaaaacgcccgccagcatggacaaatagacgggcaaaagcccttgtgccatgcggctttgcagacgcgaaaacggcaaagggcatattgcaataccaaaaccgccgaaaacggctttctaattgtccacgcagaccaagagaggaagtgaggaaatatggcagttttcagagtggagcgaaatacgggatataccgttatgagcaaccaccacttgcgcaacaaagaattgtccttaaaggcaaagggcttgttgtcgcaaatgctgtctttgccggaggattgggattatacccttgcgggcttatcccatatcaaccgggagaagatcgacgcaatccgcgaagcggtaaaggaactcgaaaaagccggatatatcgtgcgcagccgggagcgcgacgaaaagggacgcttgcggggcgcggattacgtcatatacgagcagccgcagccgcgagagccggaagcagctaccagcggcggacagccgcctatattggatttacctacattggaaaatccaacattggataatccaacgttggaaaaacctacgcaggaaaaacctacgttggaaaatccaacgcaattaaataaagatatatcaagtaaagaacaatcaattacggatttatcaagtacccattcctttccattccattccctaaaccccttgccctttgagcagggcgaagcggctacgccgccggaaaggaaaagaacggaagcgaaaagcaatagcgcagtagagatttacagggagattatcaaggacaatatcgaatacgaccatctcattcaaaactgcaaaattgacgcagaccgcctaaatgagatagttgaccttatgctggaaaccgtctgcacagcgcgaaagacaatccgtattgccggggacgactaccccgccgaattagtgaaatcaaagtttttgaagctgaacagcagccatattgagtttgttttggattgcatgagggagaacacaaccaaagtgcgcaatatcaagcagtatttgaaagcggtactgttcaacgcgccgagtaccattgacagctattataccgcccttgtcaatcacgacttttacggcagcaaatgagcatagccgcagtttaccgggaaaggagttgataccttgcaggaggaagtaacccaaaaaacgattgccctatccgtcaatgtgggaaaaggcgcggcaaggcttaccgaacaggcgttgcaaaaagcaatcaagaagtttttggagcagaaaagcaaagccccgcatgggaaacagaccatgcggcagcttatgaagcaaaatgcgggtgtttccaacatcgagatcaccgacagcaatatcaaagcctttgagagtaccgcgaagaagtacaacatagatttttcgctgaaaaaggttaagggcgaacagacccgttaccttgtgtttttcaaaggcagggacgcggacgttatgatcgcagcgtttcaagagttttccgcaaagaagctgaacagggataaaaagccctctatccgcaaagcccttgccgcagcaaaggacaaggcgaagcagcttaacgccgcccgcgacaaggtaaagaaaatagacagggggcgcgagatatgaagcagataaactacaaaaagctgataatcccgaatatcccctatgtgttctttgtctatctctttgataaagtaggacaggcgacgcggcttgcccccggcgcggatatttccgaaaagatactcaatatcacacagggattttccgaagcgttttcaaatgccttgccgagcgttcacccgttggatttgcttatcggcattgtcggcgcggtggttattcgtctgattgtctatgtcaaagggaaaaacgcaaagaaataccgcaagggcgcagaatacggcagcgcacgttggggcaacgccgaagatataaagccctacatcgacccggattttcagaacaacatcattttgacgcagaccgaacgccttaccatgaacagccgcccgaagcagccgaaatatgcgagaaataaaaacgtcgtggtgatcggcggcagcggcagcggcaagacaaggtttttcgtaaagcctaatttaatgcagcttcattcttcctacgtcttgaccgacccaaaaggcaccgtcctaatcgagtgcggaaagctgctgcaacgggcaggctaccgcattaaggtactgaacacgataaactttcggaaaagtatgcactataacccctttgtctatatccgcagcgaaaaggacgtgttaaaggttgtcaatacccttattgtcaataccaaaggcgagggagaaaaaagcgcggaagatttttgggtgaaagccgagagattattatattgcgcgttgatcggctacatttggtatgaagcccccgccgaggaaatgagctttacaacgctgcttgaacttatcaatgcaagcgaagcacgcgaggacgacgaggaataccaaagccccgttgatctgctctttgccgatttagaagaacgcagccccgaccatttcgcggtgaagcaatataaaaaatacaaattggcggcgggcaaaacggcaaagtcaatccttatttcttgcggtgcgcgtcttgccccttttgatatagaggaactccgggaactcatgtcctatgatgaattggaacttgatacattgggcgacaggaaaaccgcgcttttcctcataatgagcgataccgacgacacctttaattttgttatcgctattctgcaatcgcagcttttcaatttgctttgtgataaagcggacgacgaatacaacggcaaattgcctattcatgtccggtttttgcttgatgaatttgccaacatcgggcagataccccgctttgataagttaattgcgaccattcgcagcagggaaatgtccgcttctatcattctgcaatcgcagagccaactaaaagccatttacaaggacgcggcagaaatcatacttgataatgccgacagcaccttgtttttgggaggacgtgggaaaaatgcaaaggatatttcggataacttgggacgggaaacaatcgacagtttcaatacttccgaaaatcgcggcacgcaggtttctcatggacttacttatcaaaaattaggaaaggagctgatgacacaggacgaaatagcagttatggacggtgggaaatgtattttgcagctacgcggtgtgcgtccctttttaagcgacaaatacgacatcacgaaacacccgaactacaaatacctttccgacttcgacaaaagaaacgcttttgacgtggaacggtatatgtctacccgtccggcaatcgtaaagcccgatgaagcctttgacatatacgaaatagatttgtccgacgaggacgcagccgccgaggaataacggcggcattttcattttcaacaactttttttgagccgcacagcggcagaaagcgaggtttatatggagtttttcaacagcgcagttggtgtattgcagactttggttatcgcgcttggcgcaggtcttggcatttggggtgccattaacctcatggagggttacggcaacgacaatccgggcgcaaatgctcatggttaataaagaagcacaacaaaacaggacaaggacagtcagccccgccgctattccgagcaaggcaaattatagggtaaagtctaaaaagcatttgtaacatttctataaactctattgacttgaacacctccgggagttataatatgttttgctatttaggaacgctaaatagcaaaactaaagtgaggtagagagtatggataacaggtatgtgcagcaattcaaaaaaggctctcttgaaatgatacttttgtgcttgatcggacgcaaagaaacctacggctatgaaatcattacagagctaaataacagcgcgtccattttgggctatgcaaaagagggaacgatttaccctattctgtatcgtttgcaggaagccgagttaatccaatgccgattagccccggcagcggcaaatggcggatcaaaaaaatactactcccttacccataagggcagagaggtattagacgagctgattttattttgggcgagctatgaaagttgtgtaaatggctttattgccacctatcaaacagcggaggtatcagaatgaaagagcaatacattaagcaagtggaaaaggaattgagtttaacacgcaaagcaaaaaaagaggtcgtgcgtgatctgaatgaagtctttgcttctgcgttggagcatggcgaaacggaacaacaggtaatcgaacggttaggcactcccaaagagtttgcagagaataccgccgagcagttaggcattgacagcgcagcaccgcagaaacggaaagggattatttcgagcgttgcagcccttgtcgttgccgttgcagcgtttgtgatttacgccactacccaatccgggaaagtgccggacggggcaatcggacaagcagacgcaatgacaaacattcaagttgagggagcttttggatttgacgcttcacaaatcattttggcagtcggtgtaatcgcggttacaatcgcaatcattcagattatccgaaccgtccgcaaaaacaggaggtagctatgaaaaaatttgtttcaataatcgctattttacttatgctttctttggctgcctgttccaatcaagatacgccgtccgctgcggataatccaagcaatacacaaacagaaagcaataccatgcttgacgcgggtgtatggcctgtgaatgaatacaccgaggggcttcccgtcccgtccggtacggtcggttgggctatgcttgatacggaacatgagaattgcagtatcagtattgtggatataagcgaaaccgactataacgactatttagagcttttgaagcaagaggggttttctataatagaggaagtgtcggaagaaattgagggacaggactatgtttctatcggtacgcttttgtcaaatggcgaaaagggattgagtatcagctacattcccgataacttcacaatttacatttctttccttaaataatgaaaattaaaatgattaaatcgcctgataggtgggtgctttgccctatttgtggaaataaaacacgaacaaagatacgccccgatacaatacttgaaaatttccctctgttctgtccgaaatgcaaacaagaaacactaatcagcgcaaaagatttgaatgtagctgtaatcccacaacaaatagcggaatcagccggagcagtcaacggtcaagatgaacggcgcataaatgcgccgccgttgacagccctgcctgtttccgctgatgggtaatcaagggagcgacagactaaagtgctgtcgctcccctcacattatggaaatgaaaattgaatatcgaccaagctgcaacgccacagattttttgaaagtccgtggcgtttttttttgcgcccatttttggcagaccgcacattcctgttgttgtagaaagtgacggggaaatttgcccaaaacggtcttgcgtaccgtagtagtgatgaaaagaataccgcagccatttggaagaaaggtatggggctaccgtagtagtgatgaagaaatccaagggagcgtttggcattttccatttccgtccgtagaagaaagcaaaaccacagcgggcaggacacgccaccgcaatcgctatattgacggaaacaagccaagccgccccctgcggattgccgcaaagtcagccgtagaggaaagcggcagtttcttagagcaagattctaccacggtgccaaaatccgcatatctgtggttttgcccctgcggtaaatcttgttggggagtgccttccccaaaccctgcttatcccctgcgggggaagaaaaacagcgtgaagctgcctaaaaatattttgcagatatttcaaagcacccaccctgtttttgataatttttgtactgaattatgagggaatgttttttcaaattctttcaaaaacagttccgcttcacaccctgcttttctccaattagtgagaggacaaccacacccacagaaaggagttgatacccatagccaagagatacaacacgccccaccgcagccatgtagtcaagacccgcatgaccgaggaagaatacgccgacttcaccgggcggctggagcattacgacatcagccaggccgagtttatccggcaggctatcacacgggcgaccattcgccccattgtcaccgtttccccggtcaatgatgaactgcttgccgccgttgggaagttgaccgccgagtacgggaaaatcggcggcaacctcaatcagatcgcccgcaccctcaatgagtacggcgcaccatacaaaaacctgtccggcgaggtacgggcagccatagccgaccttgccgccttgaagtttgaagtcttgcgaaaggtaggtgaagccgttggcgacattcaaacatatcagctctaaaaatgccgactacggcgcagccgaacagtatctaacctttgagcatgacgagtttaccatgcgccccacgcttgatgaaagcgggcggcttgtgccgagggacgattacagaatagcaacgctgaactgcggcggcgaggattttgccgttgcctgtatgcgctccaatctgcggtacggcaaaaaccaaaagcgggaagatgtgaaaagccatcactacatcatttcctttgacccacgggacgggacggacaacggattgaccgtagaccgggcgcaggaattgggcgagggattttgcgacgcccacttccccggacaccaagccttgatatgcacccacccggacggacacaaccacagcggcaatattcatgtgcatatcattatcaattccctgcggattgaggaagtacccctgttgccctacatggacagaccagcggacaccaaagccgggtgcaagcaccgctgcacagacgcagccatggagtatttcaaagccgaagtcatggagatgtgccaccgggaaaacctctatcagattgacctcttgcatggcagcaaaaacagagtgaccgagcgtgaatactgggcgcagcggaaagggcaagccaagctggacaagcaggccgcagcacaagccgcagccctgccagccggggagcagccgcccaagcccaccaagtttgaaacagacaaagagaagttacggcagactatccgagccgccctgtcctctgctgtttcctttgatgattttgccgggaagctgctgcaacagggcgtgactgtcaaggaaagccgggggcgattgtcctaccttgcgccggagcgcaccaagcccatcaccgcccggaagctgggggatgattttgaccgagccgccgtacttgcccttttggagcagaacgcccaaagagccgccgaacagaccgcagccatacccgaatacctccgcagcattaaggagcgattacagcagggaaaaacggcgaaaaccgccccgaaacaggacggcatacagcgcatggttgaccgggaagccaagcgagccgaggggaaaggcgtgggctatgaccgctgggcggctgtccacaacctcaaacagatggcggctaccgttgcctcctatgagcagtacggctttacttccccggagcagcttgacgcagccattaccgccgcttatgcggatctccatgacagcaccgcagaactgaaaaccgttgaagcggcgatacagggcaaaaaggaattgcagggctatgtactgcaattcgccaagaccaaagatgtgcgggacggtctgaaagcgcagaaatcggacaaggcaaaagccgcctaccgccagaagcacgaaagcgactttatcatagcggacgcagccgcccggtatttccgggagcatggcattaagaagctgccaacctacaaagccctgcaagccgagattgagcagcttaccgcccaaaagaacgcccggtacaacgattaccgggagaaaaaagagcgtgtgcgggagttgcagaccgtcaagggcaatatcgaccaaatgatgaggggcgcaccgagccagcagaaaaggcacgaacatgaccgataaacaccgccccgaaatgataccgaaaccatacagaaacaagggtatgcccgacaccctatcgcaatactgcccggctttttcaaggggcttacagggcagaaaatccccgaaaatgacaccgggaatatacagatttaccgccgataccgccacacccggcgaaacggcagaaaggagcgtcacccatgccacgcatgagcaagaagcggcggctggaatggtcttttttcctcaaccaccgcaaccgtatcacttacaacgacctatgccggggctgtacccacgactgcaagcagagtttccgggcaatcgtggtactctgcccccggtactattccaaacgctggaaaccgccgggaacggcggcaaccagcaccgataaagggaggtgacaccgattgcagactacatgaccaaagataccaagctgccatcctatataccctttccccgtttcctgctgggcgcagacttgacattgaccacccaactgctctatgccctgctgttagaccgggcgacactctcacagaaaagcggctgggtggacgagcagggcaggctttacattgtctttcctatcgggaagattgcggacgcactgaacagaagccccatgaccgccaagaactgtctgaacgaactggaagcggcggggctgattgaacggaaaaggcagggcttttcagcccccaaccgcatttatgtgaagctgccggacggacaggaaactgtcttactgatggacagaaaactgtccgtcagaagtaaagaaaactgtcctactgatggacagaaaactttaccaatgatggacaaaaaactgtcccctaacaacaagagtattaacaacaagagtaataacgacctgaatagagcgagggggacacccgccgcctatggcagatatggaaatgttttcctttcggaaagcgactaccgggaactgcaagaggaaatccccggactggacaacctcattgagcagctatccggctacatgaaatccgaggggaaacagtacgcagaccacgccgccaccctgcgccgctgggcggcaaacgaatacagcaacagggcagccccgaagcagggcatacccgattacacctacaaggagggacagagcttatgacgaatgattttgaaaaggttttcgataccgcagccgagccggaggactacaccggggaggacgggcttttgtactgcggcaagtgccggacatccaaagaaaggtatttcccggcagacaaagccgccctgttcgggcgtgaccgccacccggcagaatgtgactgccagcgggcgaaacggttagagcgtgaagccgccgagcagcgcaggaaacaccttgacaccgtagaagaactgaaacgccggggctttacggacagtaaaatgcgggaatggacttttgccaatgacaacggaaaatgcccccaaatgggaatggcgcacagctatgtggagcgttgggagcagatgaaagagggaaaccacggcttgctgctatggggcaaggtaggcacagggaaaagctattttgccgggtgtatcgctaacgccctcatggaaaaagagatacccgtccgcatgacgaactttgcccttatcctcaatgaccttgccgccagcttcgagggacgcaatgagtacattgaccgcctttgccgctacccgctgcttatcattgacgattttggaatggagcgagggacagagtacggtttggagcaagtctacaatgtgattgacagcagataccgtagcggcaagccgctgatcgtcaccaccaaccacacgccggatatgctggaaaacccgcaggacaccgcccacgcccgtatctatgaccgactgattgaaatgtgttcccctgtctgcttcacggcaaagaatttccgaaaggaagccgcaaaagccaagctggacagactgaaagaactgctgaaatgaaaggagttgcctatgaccgataaaaagcacagcaccgccagcaccacagaccgccgcccggattgcgtgacggaaacccgcatgggtaacaccgtactcattgtgtccggctatttcaagaaagacaccaccgccaccgcagcggacaagatgatgaaagtgctggaagcggaaaccgcagccgcaccaagaccgccctacaccgcatgagccggaacatggaaaagcggtcatgctggggagcatgaccgctggaatgggagtaagaacggaaacttatttgaaagtaacttcttcttttttggcagacctaatcgcatattcgtttaggacaacaatgtatccgcttgcttccatatcatcaacttttttatcaaacccttttgcattttctgcatcaatggtttttccaccaataggaatcaataggcggggattgttttctgatggggcatacgaatgatacaaaattttgattgtttcaacctttccctctaatacaaatatgttttgccaatcagaactatgggcttcgtaacaatagttaatcgcccctacattaacaggagtgttcagttgttctgctttgagaacaagccattttactatatcccctacggaaaatggcgttccacaacattccatttgccaactatcataaaacacagtacatttcatcactcaatcttacctcatcaaatacgggatttatcattgtttgaacgaggaaagtataacacagaatttcaaatttttctaccgtctatgtgacatgacaagccttttttgaaaaatcgtcactttgacgggcgataaagaagcagaaaccactatacagacagccgccccgtatggtatactatttgtacggaatagcggggcggctgtcggaaatggaggaaaccatgattagacagaccacccaattagcacccgttaccgccctttacgcaagattgagtaaagatgatgaattgcagggcgagagcaattccatatccaaccaaaaacgcattttggaaacctatgcccgtgacaatggatttttgaactaccgttttttcgttgatgacggatggagtggggcgaatttccaaagaccgggctttatggagatgatggattgcgtggagaatggcgaggtaaaatgcgtcattaccaaagacctatcccgcatggggaggaactatctgcaagtcggaatgtttacggaaatcactttccccaagaaaggcgtccgctttatcgccatcaatgacggagtggacagcgcacagggcgacaacgacctaacgccgctaaaaaatcttttcaacgaatggatggtgagggatacgagcaggaaaatcaaggcagttttcagaagcaagggcatgagcggcaagcccattaccagccagcccgtctatggctatctcaaaggcgaggacggacgctttatcattgacgaggaagccgccccggtagtcaagcagattttcagcttgtgccttgccgggaacggcccgaccaaaatcgcccgtatgctcacagagcaggaaatccccacgccggggacgctggaataccgcaggacgggcagcacccgccgctactaccccgattacccttacagatgggcgacaaataccgttgtccatatccttgaacgcaaagagtatctggggcatacggtgaacttcaagaccgagaaaatctcttacaaagtgaagtccagcgtagaaaacccggaggaaaagcaagcggtattcgagaatacccatgagccgattatcgaccttgccacatgggagcgtgtgcaggagttacgcaagcagcgcaaacgccccaaccgctatgatgaagtgggcttgttctccggcttgctgttctgcgccgactgcggcagcgtcctctaccagcagaggtatgagaacaagacaaggcggcaggattgctacatctgcgggaactacaagaagcgtgtcaaggactgtacggcgcactttatccgcaccgaccttttgaccgccggagtgaccgccaacctgcggaaagtgaccgactatgcggcaaggcacgaaaagcagtttatgaagctgctgatcgagcagaacgaggacgggggcaagcgcaggaacgccgccaagaaaaaggaactggacgcaaccgagaagcgcatagccgagttgtccgctatcttcaagcggctttatgaggacagcgtgaccgggcgcatttctgatgaacggtttgcggagttgtcggcagactatgaagcggagcagcggcagcttaaagagagagccgccgaactgcaaggggaacttgcaaaggcgcaggaagccacagtaaacgcagagaagtttatgaacattgtccgcaagtacaccagcttcgaggaacttacccctaccctgctgcgggagtttatcgagaaaatcgtagtgcatgagtgcagctatgacgagaacaaaaaccgcaggcaggaaattgaaatctattattcttttgtcggcaaggtagacttgcccgaataatgcccgacctgtctggcacaatgcgcaagtgccggataggaacggcaaaaaattttacacttctattgcttctttatctcacacaaccaaagagccagggcatgaagcagctcatggcgggcggcggcgtcgctttgatcggcggcacccttgttcccctgctttctcaactttttggataatgcctaaaacaaataccacccgccgcgccctctcggaaacgggagggcgcgggaaaggagggattaacttttgatatggcagatgattgaagattggtttcgcggcattttgacagacgggattttatcgaacctttccggcttgtttgacagcgtaaatacagaggttggagaaatcgcaacacaagtcggcacgacccccgccgggtggaacgcgggcatattcaacatgatacgcagcctttcggaaaacgtcattgtaccgattgcgggcgttatcattacctttgtcatgtgttatgaactaatccagcttgtaattgaaaaaaacaatctgcacgatctcgacacttggattttcttcaaatggatttttaagacctttgttgcggtgctgctggtaacaaacacttggaacatcgtcatgggagttttcgacgttacgcagagcgtcgtcaatcagagcgcgggggttatcatatccgatacaagcatagacgttaccaccgtcattaccgacattgaagcaaaactcgacgctatgagcgtgggcggtcttttggggttatggtttcaatccctctttgtagggcttaccatgaaagccctgtcaatctgcattatgcttgtggtgtatgggcgcatgattgaaatatatcttgtaacgagcgttgcccctatccctatggcaacaatggtaaatcacgaatggggcagcatgggacagaattacttaaaatctttgcttgcgcttggttttcaggcgtttctgatcttggtgtgtgtcggcatttatgcggtgttgatacaaacaatcgcagcgaccgacgacatttccggcgcgatctgggcttgcatgggctataccgtcctcttgtgctttacgcttttcaaaacgggaagccttgcaaagagcgtcttttcggcacattaagggggtgagttatgatttgaaaatcggtttaatcgacgttgacagccataatttccccaacctctgcttgatgaagctatccgcgtatcataaagcaaaggggcatacggtggaatggtggaacgcaaaggggcggtacgaccttgtatataaaagccgcgtctttacggacacctattccaaagacacgataaccgttaccaacgcggaacaagttattttcggcggtacgggctacgacacgaaaaaccgcttgctgccggaagtggaacacagttacccggattattctatctacccgcagtttttcgggattgcctacggctttttaagccggggttgtccgagaaattgcgggttttgcattgtcagcagtaaagagggacgcgaaagtgttaaggttgcggatttgtccgagttttggaaatggcagccggaaataaaaatcatggacgctaatctgcttgcctgtcccgaccatgaaaatctcattgagcagcttatacgaagccgcgcatgggtggatttttcgcaagggctggatattcgccttgtgaacagggataatgtcagcctgttaaatcgggtacggataaaagcggtacattttgcatgggataatcccgacgaggacttaaccgggtatttccaacgttttttggatttgaccgccattaagagcagccgccagcggcgcgtgtatgttcttaccaactacggcagcactcacgaacaggatttataccgcgtgaacaccttgcgggctatgggctttgacccgtatgtgatgatttacgagcgtccaaccgccccgcctgttacccgccatttgcaacggtgggtaaataacaaacggcttttctatgctgtcccccgttttgaagattacattccgggcagaaaggaggtttgaaatggcgtatgtaaccgtcccaaaggacttaacaaaaatcaaaagcaaggtaatgttcaaccttacgaaacgacagctaatttgtttcagcgcggcggtagcaatcggactgccgctgttctttttggtaaaagacagcgttggaacaaccacagcggcattgtgcatggtgcttgccatgctgcctatgtttttgcttgccatgtacgagaaaaacgggcaaccgctggaagtgattattcggcaatttgtggaagtgaagtttcttcgccccaaagagcgaccttatcagaccaacaatttttatgccgcccttgcgcggcaagagcaattagataaggaggtacgggcgattgtcaaaggaaaagaaaaacacccaaaacgaaaagcgtaaactttcccgacaggaaagaaaacagatagatacccttatccgacaggcaaagggcgacgggaagccccatacggcgcaggacagcataccgtttgagcgaatgtataaggacgggatttgccgccttgcaaacgggcggtattccaagtgcattgagtttgaggacatcaactatcagcttgcgcagccggacgacaaaaccgccatttttgaagccctttgcgatatgtataactcgttcgacgcttctatcagcgtgcagctttccctaatcagccgccatgcgaacaaggacgatttcaagaacagtatcacgattgcgccgcagaatgatgacttcgacagtatcagagcagaatacaccgaaatgcttaggacgcagcttgaacgcggaaacaacgggcttatcaagaccaagtttctcacctttaccgttgaagcaaaggacattagatcggcgcgggcgcgtcttgcccgcattgaaacggacaccctcaaccattttaaggtgatcggcgcggcggcgcgggtattggacgggaaacagcgtcttgaagtgctgcatgggattttccacccggacggggaacgctttaactttgcgtgggaatggctacccgcaagcggtctttctgtcaaagactttatcgcgccgtcctctttccgatttggcgacgggcgaatgtttcaaatgggcggcaagtttggcgcagtttcctttttgcagatcgtcgcgccggaactctccgaccgtatgcttgccgacttcatggacgcggaaaacgggattatcgtcaatctgcacattcagagtatcgaccacaacgaagcaatcaagacgattaagcgcaagattaccgaccttgaccgtatgaaaatcgaggaacagaaaaaagcaatccgcagcggctacgacatggatattattccgtccgaccttgccacctacggcggggaagcaaaaaacctactccgcgatttgcagagccgcaacgaaagaatgtttctgcttacgctgcttgtcttaaaccttgcagataccaagcagaaattggataacgaagtatttggagcggcggcaatcgcgcagaaatacaactgcattttgacccgccttgactaccggcaggaacaggggcttatgtcctctatcccgttgggggaaaaccttatccatatccagcgcggcttgacgaccagcagcaccgccgttttcgttccctttacggtgcaagagctgttccaaagcggcgaagcattgtattacggcttaaacgccctttccaacaacatgattttgtgcgaccgaaagaagctgaaaaatcccaacggcttgatactcggcacaccgggcagcggcaaaagtttttctgcaaaacgcgaaatcacaaacgcttttcttatcacgtccgacgacattatcatttgcgaccccgaagccgaatattacccccttgtcggacgtttgaaaggacaggttatcaaggtttcgcagaacagcacgcagtacattaaccctatggatattaacctcaattacagcgagggcgacacgcccatagccttaaagagcgattttatcctttccttttgtgagttgattatgggaggtaaaaacgggctggaagctgtcgaaaagaccttgattgaccgcgctgttatcagcgtgtaccgcaactaccttgccgacccgaagccggagaatatgccgattttgggcgacctctacgacgagatcaagaagcagccggaaaaggaagcgcagcgtatcgcggcggcattggaactctatgtaaacggcagcttgaacatttttaaccacaggacaaacgttgacattcataatcgccttgtctgctttgatattaaggaactcggtacgcagcttaaaaaagtcggtatgcttatcgtccaagaccaagtatggaacagagtaacggtaaaccgcagcgagggcaaggcgacgcggtattacatcgacgaatttcatttactcttgaaagaggaacagaccgcagcatacagcgtcgagatttggaagcgttttaggaagtggggcggtattccgacaggtatcacgcagaacgtcaaagaccttttgacgagcagagaagtttcaaatgtttttgaaaacagcgattttgtctatatgctcaaccaagcccagggcgaccgggaaatccttgccaagcagcttaacatttcacaacagcaaatgacctatgtaacccattccgaagcgggcgagggacttatcttctatggcaacgtgattttgccctttattgaccgttttccgaaagatacggagctctaccgcgtaatgacgaccaagcccggcgaggtgtcggcatgaggatagaaacggataaaatctattgcggcgacagcttgcaggtgcttcaaaccttgccggataactgtttggattgttgcgtaacgtccccgccctactatgctttgcgcgattacggcacagacgggcagatcgggcgtgaagcaacgccggaggaatatgtttcccgcattacggcggttttccatgaggtaaagcgggtgcttacgccggagggtacttgttggctgaatatcgcggacacttattgcggcacaggcagcaaagccgaccaccaagacccgaaataccccaaaggcaggaacgggcagcaagtggcggtaaaccaccgcgcccccggctgcaagccgaaagacctaatcggtattccgtggcttgtagcccttgccttgcggggcgacggttggtatttgcgaagttctatcatttggcacaagggaaacgccatgccggaaagcacgcgggacagaccgacccgctgctatgaatatgtgtttctgcttaccaagtcaaagaaatattactacgattggcaggcagtagccgagccgatagcccccacaacggcggtacggctgaaaagcggagttgggaaaggcaacaaatatgccgctaccgttccggggcaaaaccagccgcagaaaatcaaccgcccccgcaggaaaggcgcatacaccgacgaaatgatttcccccgtccgcagccgccgcaacgtttggcagatcaacacaacttcctatcgcggcgggcattttgcagcgttcccgcccaaacttgcggaaacgtgcattttggcgggctgtcctgtcggcgggattgtgcttgacccgtttttaggcagcggcacgaccgcagcggcggcaaaaagcctttcccgccgctatatcggtatagagatcaaccccgaatactgcacccttgcaaaacagcgtattggaggtgatgaacattgagcaaggaattaaaagcccccgacaaggtaacgcagaaaatgacccgcgacggggcgattgcggaaaaccttacgacgggcgaaacgacgagtatcagcgaaagaccgccggaggaaaactattcagcccccgcagcgggagcagcggaaaaagcgacccaacgtatcagcacagaggttagccgccatttagaaaagggcgcggagaaaaagagccttgacgcagcgcagcttaaaacccatacttcccgcttgcagttttccgcagaggaacgggcaacgccggaacttcaaaaggcaattaggaagtcggacaaggcggcagaccgtttagacgcggcgcgggcggctatccccaagcataccaaaatcaagaaagagcgcgtttttaacgaagcgaaaggcagggcaaaaacgcgcctttcctttgaaaagacggataagcccccaaacggcaagttgcggcataaccccttatcacgtccggcgcaggagttaaacagcaccgtacatggaaaaatctacgaggtagagaaagaaaacgtcggtgtggaaagcgggcaccgggtagaacttgcgggcgagaaagcgggcggcatggcggcgcggacggtaaaacgcggcatacgcagccacaagctgaaaccctaccgggcagcggcggcagcggagagaaaggcggtaaaggcaaacgccgatttcctctatcaaaaggcgctgcacgataaccccgcccttgcgcactctaaccccatttcccgtttttggcagaagcagcgcattaaaaagcagtatgcaaagacgctgaaagcgggcggcaaggtgaaaaagaccgccgaagccaccgcaaaggcagcgaagaaaaccgcgcaggaaaccaaacgggcgacgttctttgtcgtccggcattggaaaggctgcttgcttgtgggcgggattgcctttatcgtgctgctgcttttcggcggcttgtcctcttgctccctctttggcggcaacagcggtagcggcttgattgcgtcgtcctatctttccgaggacgcggatattacgggcgcggaagcagcttacaccgatatggaagcagagttacaggatatgctgaataatatcgagcgcgaataccccggctacgacgaataccgggtgaacgcagacgagatcgagcatgacccctatgtgctaatctctatcctttccgcgctgcatgagggcgtgtttacccttgatgaagcgcaaagcacccttgaaatgctctttgagaaacagtatatcttgaccgttacggaggaagtcgaggtacgctaccgcaccgaaacgaggacggacagcgagggcaacgaatatgaggttgaagtcccatataactattacattcttcatgtggatttggaaaacttcaacctttcccatgtccccgtctacattatgggcgaggaacagctatccatgtacgctatgtatatgtcgtcgctggggaaccgccccgatttgttcccgtcgtccggctatgtgtcaaaatactatgaaaacccgcccgccgattacgaagtacccgccgcgctgcttaattccgatgaaaagtttgcgcggctcattgaggaagcggataaatacgtcggctttccctatgtgtggggcggcagcaccccggaaacctcttttgattgcagcggttttgttagctatgtgctgacgaacagcggcttatacaatacgggcagacttggggcgcaggggctttacaacatttcaacccgcgtttccaacccgcagccgggggatttggttttctttacgggtacatacgacacgccgggggtatctcatgtgggtatctacgttggcgaggacggggacggaagccccgtcatgctgcattgtggcgacccgatacaatacacaaaacttgatacaagctattggcaatcccatttttacgcctatgggcggctacattacaactgactttgaaaggagttaatttctatggcaaacacgaaacttgaccgtatcgaacgggatattgagaaaacgagggcgaaaatccttgaataccaaaaaaggctgaaagaccttgaagcgcagaaaatcgaggaagaaaacgcgcagatcgttcaaatggtgaaagcggtacaccttgacggggcgcagcttgccgcgttcctctccgcttacgccagcggcgaaattgccttgccgcagccggacgcagactataccgacgaacaggaggaaaccgaagatgaagcataaaaaactgttccgcagcgttaccgctttgcttgccgcccttgtactcatgggcggcttttctgttaccgcttttgcgggcggcggtgatgtgagcgacgagccgcctacccccgtaaccgaaaccgagccggaagaaacgacgggcggctatgagccgcagcccttaacgccggagggcaacatgagccttgtggacgacataacgggcgaagcgtccggcgataaacagtttattaccgtcgttacgaaaaacggaaactatttttacatcatcattgaccgagccgaggacggagaaaacaccgtccatttcctcaatcaagttgatgaaaaagaccttttgcagcttatggaggacgaacagaccgaaacccccgcttgtagctgtactgaaaaatgcgttgccggaagcatcaacaccgattgccccgtttgcagcgtcaacatgagcgagtgcgcgggcaaggaagccgagccggagctggaagaaaccgagcagccggagccggaggaagataaaggcggcggcatgggcggtgctattctgcttgtcgtgctgcttcttgccgcagcgggcggcggcgcgttctattactttaagattatgaagcccaaaaaggacgcggcaaaaggcagcagcaaccttgacgatctcgactttgacgaggacgacgaggacgcggaagaattagaaaccgagcaggaggacgaggaagtatgaaacttgtaattgcagagaaaccgagcgtcggggcggcgattgccgccgtactttgcgcgaatgaaaagcgcagcggatattttgagggcagcggctaccttgtgtcctggtgtatcgggcatttgattagccttgcggacgcggcgacctacaacgagcagtaccgaaaatggaagtatgacgatctccccattgtcccgcaggattggcagtttatcgttgccagcggcaaggagcagcagttttccgtactcaaagaccttatgcaccgcagcgacgtttccgagattgtcaatgcgtgcgacagcgggcgcgagggagaactcatttttcgatttgtctacgaacaggcaaattgcaaaaagcccttttcccgcctttggattagcagcatggaagaaagcgcaatccgcgagggcttttcaaacctcaaagacgggcgcagctatgacaacctctatcaatccgcgctttgcagagcaaaggcagattggcttgtcgggattaacgcgacccgccttttctctatcctctatcacaaaacgctgaatgtcggcagagtgcaaacgcccacccttaccatgctggtaaaccgcgactatgcgatcagcagctttaagaaagaaaaatatcatgttgtccgtctggacgcgggcggtgtttcggctttgtccgaaagactgaacgacgaagcggcagcgcagcagatgaaagcggcttgcgagaaatcgcaagccgtttgtacttccctcaaaaaagagaaaaagaccgttgccccgccgaagctgtttgaccttaccgcgttacagcgcgaagctaaccgcctgtatggatttacggcgaaacagacccttgattatgcgcaagccctctatgaaaagcggcttttgacctatccccgcaccgacagcaaatatatcacttccgatatgcaggacagcacaaaggaactcattaccgggctttgttcgctgcttccctttatgcgggacgtgaagctgcaagcagaccttataagggtttgcgacaacagcaaagtaaccgaccaccacgctattttgccgacagccgagtttttgaaagcgggctttgcttcccttgccgacagcgaaacaaaacttatgacccttgtgtgtgcaaagctgctttgcgccgcagccgcgccctatgcgtatgaagcggttacggcggttttcacttgcggcggctatacctttaccgcaaagggcaggacaacgctttgcgagggttggcgtgagattgaaagattatcccgcgccgcgtccgaggaacaggacgaggacgcagagccggaagcggttttgcccccgcttaccgagggacagacctttgaaaataccgcagcggagatctccgagcgttacacgcagcccccaaaagcatataccgaagatacgcttctgtccgctatggagaacgcgggcaaggaggaaacgccggaggacgcggaacgcaagggattaggcaccaccgcgacgcgggcgggtatcattgaaaagctcatttcagcgggctttgccgagcgcaagggcaagaagctaatccccacaaaggacgggtataaccttgtcgccattctgcccgaaagccttacgtccccgcagcttacggcagaatgggaaacgcgccttaccgggattgcaaagggcagcgacagccccgccgactttatgcgagggattgaggaaatgacagcggggcttgtcaagacctattccgcgatttccgaggataaagcaaaactgtttaccccgcagcgggaagcaatcggcacttgcccccgttgcggcgcggcggtttacgagggcaagaaaaactactactgttccgacagggcgtgcagctttgtcatgtggaaaaatgacttgttctttcagcagcgcaaaaagactttcacaaaggcgattgccgccgcccttttgaaagacggaaaggtaaaaatcaagggtatgtactccaccaaaacgggaaagacctttgacggggttgtgctgcttgccgacacaggcggcaagtatgtaaacttccgcgtcgagcagaaccgaaaatgattaggcttgatgaaaagcagtatcgagccgttaagaaaatggcccgagccgcgtgcgccaacaatgattgcgggaactgtctgctattggacgacggggaaacttgcgtttgtgtgcagagtatcagctattcgctgttatgccgttatttccgcgaagcggttttacccgcagacaggcagctatgcgaacagatcacccgcagcggggaaaccgatttgaagcgttgcgcggtatgcggcagcacgtttgcggcgggcagcaatcgggcgaaatactgtcccgattgtgcggcaaagatacgccgcaggcagaaagcggaaagcgagagaaacaggcgtttacggataaaaataactacatagcaagcacagcaaacgagtacccgtttgcgagaaatacccgcgctgctctatgggaagcgcgggcattttgcttgttgggatagtcccaaacccttaaaaatcgagaaaggacgtgatgaaacaatatgccgtattcttcatacgaccatgacaaattggaaaccgccgaaaccatgcggatagaacgccggatatattttgaagcaaaggacggggatattgccccctatgtttctttgccgctggaacagctacacgccatgcgtgaggaaagcgcggcagcggaacaggcgatttttaacgatctctcaacccgcgccgccgcttgggaacagcaggcgggaaaaacgcttttgcttgacaaagcgattgaatacacaaggacaaccgttgtgcagcacacttctaacgagtggcagaaaggcgaatatgaccgatatacccgcagcaaccgggtatatcagatgaactaccacatttacgagaacacccgttacgacagggagaagcagcaaagcgtcccttactcttattctctcacatggggcgtttataccaacagcccgaacaggaacgggcaagcgaagattgccggacaggacagaaaggttttttccgataaggcggctatggaaaagtatctgaatggacgtatcaaagcatacgaccgtctgtttacggaaatctccccgcctatcccgcaggagtacgccgagcatttcaaagtaaacggtatgcttttaccgggctataccattgagggtgaggaacccccgcagcagcagccacaggcggcagctatccccgaaactaccgggcagcaaaaggagcgtgaacacatgagcgaacagttttctattatgattggcaaccgcagccgttttgaagcgggcgaccccggcggttattggctggatatgcccgccacaaaggagcagttacagaccgctatgcagagcgtcggcattaccgccgataacccgcaggatttttccattcgcggctattccgacgacccagagaaacatattgctttgccttatgaaatggtatgcgccgccgacgtggacgaactcaattttcttgcggcgcggctcgaacagcttgaccccgccgaggttggcaagctgaacgcagctttgcagcagaaaaacgggcttgcaaatatcggacaggtaattgacttcacctacaacgtggatttttacgtccatattcccgaagtacatacctaccgcgatttgggcgactattacttaaatcaatccggcatggtacaaatgcccgaagaatggaaaggcggcattgaccttactacttttggcaggaacgccgccgcgcaggaaaaaggcgcgtttaccgaatacggctatatcgtggaaagcggcgacgagtgggaacggcagtttgaggggcgcgaagtgccggaggaataccgcattatgagttacccgcagccggagcgcggcgaacaggacaaagcctatatggacgcagccgaaacgcagcaagcagccgtacagaccgcagagccgcagcagccccgccccgtcgtgccgattatcctttcttctgaaaaacccggcgacaaggtaaaggagatcaccgcccgtctggaacagggcatacaagcgatttttgacagcgaccgctacaaagagtttttaacggctatgtcaaagtttcacgattacagcttgaataacactatcctaatcgccatgcagggcggcaatttggtaaagggctattcacaatggcagaaagagtttgaccgccatgtgaaaagcggcgagaaaggtattaaaatctttgcccccgcaccttacaaggtaaaaaagctggtggataaaatcgaccccgacacaagaaagcccatacttgacagcgagggaaagacggttaaggaagaaaaggaagttaccgttcccgcctttaaggttgtaaccgtctttgacatttcgcagaccgagggcaaggagtttcccgacctctccgtcaaaccgctgcttgccgatgtggaacagtacgaggactttttcgctgcccttgaaaaagcgtcccccgttccgattgcttttgagcagatcacaaacggcgcaaacggatatttcagtttgaccgataagcgaattgctatcaaagagggtgtgagcgagctgcaagcggttaagaccgccattcacgaaatcgcccatgcgaagctgcatgacgtggacttaaacgccccgctggaggaacaaaaccgcgttgaccgccgcagccgcgaggtacaggctgaaagcgttgcctatacggtgtgtcagcatttcgggcttgatacgtcggattactctttcgggtatgttgccgggtggagcagcggcaaggaaatgaccgaattaaaagcgtcccttgaaacgatacaggcaaccgcaaaggaactcattaccgagatcgaggggcattttaccgaattgcagcagcagcggcaagccgagcaggagcaggaagcgaaaacaaaagaaaccttgcttctcaacggcaaggaggacagctacgggatttatcagttagcccgcagagaggaaactatggatttgcgctttgagcctttcgaccgtctgcaagcaacggggcatttcgttgaccgggcaaattatgaactcgtctataccgcaccgcttacaaaggatatgacgcttggcggcatttgggaaaagtttaatatcgaccgccccgccgacttcaaggggcatagcctttccgtttccgacattgttgtgcttcatcagaacggcgagaacaccgcccattatgtagacagcataggttttcagcaggtgccggagtttttacaggagcaagcgcagcagacccccgtatttgataagctatctcccgaacagcagcaagccctatccgataccgtaaaagatacgctgcaactgcttgtagacgcagacaagcggatttatggcgacgttacgggcaagacccttgaagcaatcgcggcgcaagggtattcctacaagggcgggcagcttgaaaagcagcagccggaagcgacccccgaaagccttatgacgggcgaaaccgtcagaacgccgcgagggaacttttacattaccgacatgagccgcgaacagatcgaagcggcgggctttggttttcatcatgcgtcggaggacgggaagtatctcattatgggaaatggcacacaggcttatgccatagccgccgagcagccgcagcgggataatcccttaaagcacgttgaggacattgtagagcagaacgacaacaactttgacgggattatcaataatacgccgcaaacgcccaccgtcgcggatttggagcagcgggcaaaggcgggcgaagcgatttccgttaccgaccttgcgaaagcggtaaaagccgagaaacgggagcagccgcaaaagaaaccgtccattttgaagaagctggacgagtacaagaaacaggcggcgcagcagccgaaagacaagcagaaagagcagaaaaaggatttggaggtttgatagtatgaatatccgctttaccattgaggaagaaaacataattgcgatttacgccgaggacagccgggaaacaacgcttgaaaatatccttgccgccatgccctatatggacgaggatatgcgccagcttgccgccgcagcggtgaaaaagctgcaagccatgacggacagcgagttttccgaacgggagtttatcttgaccgacgaggcatttttatgttcgtttgttattgataacatgtaaaccatgtgcttgcacaaagtgtaaaccatgttactcttgacacaagcccctcccctacgaaaagcgagagggatagtgtgggtttttggaagggttggtgcggggcgagggatggtggtgcggcaatccctccggtagtcgcccgaattctttcgggcgacagcacctcacctttgacaagggaggcaagcgtggtggtgcggacgaacttttcgttaccggaaattttaaagagagcgtggaaactgtgatgaagggaacaatctgtttttgaaatcgcacaggtgaaaataatgcgaaatttaccgaaaactgcgttattacacttgcaaaagtatcggatttctgttataatgtctatcgtgtaggcataggctttgatttgaatttccataaaaagccatattacataaccatattataattaaccgacgcaggaaaaatgcgtgaaaggtcgtgttatcagtggaacgattcggttccatcgtctttgcctgacggcgagatcaaatacaggataataaacaacgaggaaagaataaaggtatgaaagaacagttacagaatataaaggagcaggcgctgaaaactatcggcgactgcgttgacgttaagcagcttgacgagctgagagtaaagtaccttggcaagaagggcgagcttacagcgatactcaagagcatgggtaagctgtccgctgaggaaagacctgttatgggtcagcttgcaaacgatgtaagacagtcgcttgagggctttattgcacagaagcaggcacagcttaaatctgcgcttatggagcagaaattaaagaaggaaacgctggacgttactatgcccggaaagcagcaggcgatgggagtacgtcatccgctgaatatagttcttgacgagcttaaggaaatattcagaggaatgggatacactgtagtagacggtcctgaggtcgaggaaacgaagtatgttttcgatatgcttttaacagaggacggtcaccctgcaagagatgagcaggatacattctatattactgatgagatccttctgcgtacacagacatcttccgtgcagataagaacaatgcttaaaaacaagcctcctatagctatcataagccccggacgtgtttatcgtcccgacgctgttgacggcacgcactcgcctattttccaccagtgcgaaggtcttgtaatagataagaatatcacattcggcgatcttaagggtacgcttgaaacgtttgctaagcgtctttacggcgacgatgtaaagctccgcttccgtcctcaccacttcccgtatacagagccgtcagccgaggttgacttacagtgcttcaagtgcggaggcaagggctgtccgctctgcaagggcgaaggctggatagagatgctcggttcaggcatcgttcatccgcaggtacttatcaactgcggaatagatcccgaagaatacagcggtttcgctttcggtataggacttgagcgtattgctatgatgagatataacatagacgatatgcgtctgctgtacgagaacgatcagcgtttcctcgcacagttcagataagagaattcagaaataccgataggaatcgtaaaaggagatattaacgtggatttatcaatgagatggcttaacgactatgttaaagccgatatgccaataaaggaattcgtagcggatatgacgatgagcggttcaaaggttgaaacctatcataagatgtccgatcctataaataacgtggtagttgcaaaggtgctgaagctggagcgtcaccccgacagcgaaaagctgtggatatgccagcttgacgcaggcagggatgagcctgtgcagatagttactgcggcgcagaatctgttcgagggggctatagttcccgcttgtatgcacaacagtacgattgcagacggaacaaagatcacaaagggcaagttgagaggcgttgcaagcaacggtatgatgtgctcttatgcggagcttggccttacaaaggatgattttgactatcccgtagcagacgatggaatacttatactgaataacgatcccgatgttgattctttcagaatgggtatggatatatgcgaggctttacagacagacgatactatagtagagtttgagataacgaacaaccgccccgactgtctttccgtactcggacttgcacaggaggcaagcgcaacgtttgatattcctatgaactacaccgagccttcattcaaaggcgttgacggtgatattacaaaggaaatcagcgtaagcgttgaaaacacaaagctctgctcacgctatatggcggcgcttgtaaagaacgtaaagataggaccttcgcccaagtggatggcaagaaggctgagagcgagcggagtaagacctatcaacaaccttgttgatataacgaacttcgtaatgcttgaatacggtcacccgatgcacgcattcgatttaagatatgtcgaggacaacaggatagttgtaagaaacgcaaaagagggagaaacattaaagctgctcgacgaaatggcagagcctgtaaagctgactcccgaaatgctgataatcgcagacggaaagaagcctatcgccatagccggcgttatgggcggcgagcatagcggtatcatggaggatacgactactgtcgtatttgaggctgcctgctttgacggcgtatcggtaagacgtacagcaagaaagataggcgagcgtaccgaggcaagctcacgttttgaaaagggtcttaacccggtaaacgcagaaaaggcgctcaagagagcattacagcttatcgagatgctgggctgcggcgaggtagtgaatactatcattgacgagaaccacagcgagtatgttcccgaaagattaaagcacgactataagtgggtgaacgagcatttaggctcggatataagcgagaacgagcagatagagatattaaagaagctcggcttcggctatgaaaacggcgagataatcgttccgcctacccgtatagatatgcaccgtgcgtgcgatgttgcggaggaggttgcccgtatatacggctacaacagaatcccctcgactataccgaagctgtcatcacagggcaagagaacgcccgaacagatattcgaggacaaggtaatttcgcttgcgctggcactcggattctacgaggtaatgacctacagctttatttcgcctaaggactatgagcttctgcgtatggacgagaagtcaagaaagagcgttgtgttaagacgtccgctcggcgaggatacaagcgtaatgcgtacttctgcgcttacatcaatgatggaagttgtaagaagaaactggagcaacagaaaccttgaaggcagattcttcgagatagcaagagagtatttcccgacaggtgagaatcagctccctgttgaaagagatgttctgtgctatgcgctttacggaaacggcgaggatttcttcacggcaaagggcgttgccgaggaagttatggcaaaactcggactgaagaatgtcgtatacacggctgaaaagaacaatccgacattccaccccggaagatgcgcaaatgtcactgtaaacggcgagcttatcggctatgtcggtcagcttcatccggaggctgcggctaatttcggtgtaaatacagaggtttactgtgctacgctcagcatggaggtaatgttcaataatgccaacggcgatgtaaagtacaccgcactgcccaagttcccctcaacatacagggatctgagccttgtgtgcaacgaggacgttccgagcggagatatagttgcggtaatcgaaaagaccgcaaagcatcttgaggctgtacgtctgttcgatatgtacaagggcgagcaggtgcctgcaggtatgaagagtctttcatacaagctgatactcagaaagaaagacgctactctgacagacgatgaggcggacgcagttgttgcaaaggtgcttaaggcacttgaggatataggcgttacattaagataacggcggaatttgcagaaataatcggggcacagccccttataaacagtaaggagaaaagcaatgaaatattttaaaaagctggcagcggcaatatgcgccgtggcaatcacattaagcgttgcaggctgtgcggatgtatcgactgtaggctcggttgacaatcagaccataaatgcgggcatatatcttctttatgagcagacggctataggcgaggctcagcaggaggttgacgatcagcttaaggctatgggaacaagctcgtcaaagatagagaatttcagctactacaactacaaggtacaggacaagacgttctcacagtatgttcaggaccgtacattagagcaggtaaagcagtatgtggctatccagaacaagttcaaggagctgaacctttcactcacagacgaggaagaggaaactgtgaagacctctgtaaagaagatgtggaatacagaaatctcatattatggctacagcacaggaaaaacctacggtcagaactatgaggcaggcggaataagcaagaagtcatacgaggctgttcagcttgtaaacaagatgagcgagaaggtatttgacgcttactatgagaaaaacggcatatccgcaacagacgaaaaggatatagctacctatttctatgacaattacggcagattccagataatacaggtttctcttaaagagggcaacggcgacaagataacgaccgacgagggcaagaaggcaaagaaggaacaggctcagggctatgttgacagactgcttgccggcgaggactacgataaggtatatcacgagtatcaggatcttgtggcaaaggaaaaggctgaggctgaagccgagagcaactcgggcaattcatctgcggtttcttctgcggcatcatctgtaacttcttcgacaagcgaaaccgcatcggacgatacaacgagcagcggaacatcgggaagtaaagaagaggagcatgaccacgaattcctgctcggcaagacggatacttcaccgagcgaggagtttgtaaagtgggcatttgagcttgacacagacaagggcggagtttacgaggacgacagcgtttactatgcggtagtacgccgtgatataaaggaacgtgaggactggctcacggagaatcacagcaacgtgcttcacgttatgaaggatgacgagtacaaggctatgctcaacgaaacggctaaggactatgcgcttgatctcaacaacgacgcactcaacaagtacaagcccgaaaatttaaagaagtaaacaaggcataaagaaaagtacaaagatatgcggtcagagcaggaaatactctgaccgttatttttcggaaaggacaatgcggtatgatagtattatccggtaatgatatttcggtgtccttcggcggtgaaacgctgtttcacgatgtgaatttccggcttgaagaaaacggcagagccggacttgtaggtgtaaacgggtgcggaaaaaccacgctgatgcacgttataaacggcaggcaggaggctgaaacaggcggtataagcaaggcggcggggataaagatcggctgtatggagcagtatgttatccgtgacgataatatcactctatatgacgaggtactggagatattccgtccgcttatcgacgctgaaaacgagcttgcggatatagcggttgcgatagatacgggcgaccacagcgagcagacgctgtcaaggcagatgcagctgcaggaaagatttgagcgtgagggcggacttacctataaatcaatgacttgctcggcacttgtcggtctgggattttccgaagacgatttcaacaaaccgataagcgttatgagcggtggtcagaaaagcaaggcacagcttgcgaagctgcttctttcggggagcaatatactgcttcttgacgagcctacgaaccaccttgatataaccgcttgcgaatggctcgaaaagttccttacggaatataagggcgcatatatcgtaatatcgcacgaccgttattttctcgacaaagtcaccgacacgacttttgaaatggaaaacaggacgcttcgtgaatataagggcaactatacacgctatcttgagcttaaggctgaggcgagagaggctcagcagagggtgtacgacaggacggtaaaggaaataaaccgtatcgaaggcattgtagagcaacagaagcggtgggggcaggagcataacttcatcacggcggcatcaaagcagaagcaggcggacaggctgaaggaaacgctcgaaaagcctgaggatctgccggaggctataaagttcacgttcagggcgaaggaaggcggcgcaaacgatgtgcttatcgcaaagggcctgtcgaaatcgtttgacgggacggcggttttcacaaatgcggagcttgatataaagaagaacacgacaacatttatattaggcgagaacggctgcggaaagactacgcttctgaaaatccttacgggagaatatcaggcggatagcggagagtataaatttggcaacaatatacaatttggatattatgatcaggcacagacggatcttgacccgtcaaagacggtgattgacgaggtgtgggacaggtatcccggaatgacgcagacgcaggtgcgttctgcactggcgcagtttttgttcaagggcgacgatgtgttcaagaatgtgggcaagctcagcggaggagaaaaggcaagggtgtcgctccttaagctgatgctgagcaaggcaaatatgctgctgcttgacgagccgacaaaccatctggacatacattcgagagaggctctggaaaacgcactggcaagctacggcggaacgcttcttatcgtgtcgcacgacagatacctgatcaacaagctggccgacaggatagtgtggctcggaaagacgggtactgtaaacatagacggaaactatgacaggtatatcgaactcaaggaagcaaaggcacagtccgagcaggctgtacaggtaaaggcggcagaaggcaagaagaacgactacaaggagcgcaaggagcgtgaaagcacgctcagaaagctcagcggtgcgctgaagcgctgcgaacaggcgatagatgaggtcgggttgaaaacagcggagcttgcacagcagatgtcacagccggagatagcgacagactacgaaaaaacgagtgcgcttgcacaggaaatagaggcactgaaggaaaaaagaggaggcgcttactgtcgagtggatggagctaagtgaacaaatcgaagcgtttacatgagttacaagcaaaaattaagtaatatatggaataattagctaaaaaaatcgccgaaaatatttgtgcatattcaacaaagtttgattaagcaaattaaggaattagctaaattaagttataagaattttcaatgtggaaatcgtttacaccaaaaatagctcataagacgcccgaaaaatcaagatattgtgcagacaaaaatcaaattcagcgatatgcacaaaatttgcgtgtgaagtttgtaactgttagacaagcgcaaaagtgatttgtacagaaaatcaaaatcatttgagaaatgtgaaagttcttttatgaaccttgacagtaacgtgataatttggtataattactacgttatagacccttgtgctgttttgtacattatttctaaatacggcgtgtttacagccgaaaacgaataatacaattgtgcatatggtacaaaaagcagatgaaacaatttgcagggcaaacgtagcttacggacttttttgaggatcgaaactgcctatggaaacgattttaagagcggagaatatctccaggagctttaaaataaacgataataccactgttgacgctttgaaggatataaatctcgatgtggaaaagaacaagctggtcgtgctgagaggcagatccggctcgggcaagaccacgctgataaatatactcggagcgcttgaccgtcctacaggcggcgatgtctactttgacgggaagaagataacgggtctttccgacaaggagatggataagctgagaagaaacgatatgtcgtttgttttccagtctgtagcgcttataccgacaatgacggcgtacgagaacgttgagtttgcaatgcggcttgtgggcatgccttatgcggagcgtgtaaaacgtgcgaaggaatgccttgtaagagtgggacttgaaaagcgtatgcaccacagacccggagagctttcgggcggtgagcagcagagagtggcgatagcgagggcgatctcgcacaagccgaagttgatatttgcggatgagcctactgcggcgcttgatatgcctacgggacttgcggttatgaatctgtttaaagagcttgtacatacggacgggcttacaatagtgatgacaacgcacgacactgcgatgatggagcagtgcgacgtggtttatacacttgacgacggacgcattacagacgtcagaaagcaggtggagtgatgcctcatagaatgatgcttgcaccgcccgaaaatgtgatggtgcaatgtgagaaccttgtcaagatatataagacgaccgatgttgaggtaatggctttgcagggacttgacctcacggttgagcgtggagagctgatgggcattgtcggtgcgagcggaagcggtaaatcaacgcttctgaatatgctcggtgcgctcgataagccttcggcaggaagtctttacgttgacggtaaggatcttcttaaatttgatgaaaaggatcttataaaatataagagagaaacggtcggtttcgtgtggcagaacaacgccagaaaccttataccgtatcttacggcgatacagaacgttgaaatgccgcttttactttcgggacacaagaaccgaagggagagagcggaggaactgctcgacatggtagggctttcagcgagaaagaactcggtactcggtcagctttcgggcggtgagcagcaacgagtggctatcgccatagcgctttcaaacaatcccagcctgctccttgcggacgaacctacgggtgcggtcgataccaagacggcggcgatggtgcttgatgttttcaagcagctaaaccgtcagacaggcgttaccattataatagtaacacacgatacaaatctgtcgaagtcgatcgaccgtgttgttgctatccgtgacggccgtacatcgagcgagatgctgagaaagaaaaccgagatcctctcattcggggaactcgaaaagatgagcgagcagcaaagggcggagcatgaaaagctcatgcagcaaagcggctcggatcaagaggagcttgttgttcttgacagggcaggcagactccagataccaaaagaatatctcgaggctctgggtataaggggcggagataaagtgcgtgttgagcttgaggacggaaaaatttccgtttacaactcggactacaatatgcacggataaattccttaactcgtcgaaattagcatattttcgattggacataaacgacaactatcagaaaggtggattattactgtggcaacaaaagtcagcaggatgaaaagaacattagcgggtatattgtcatgtgcgacactcgtatcctcattgtcacttacatcaaccgcagtcagcgcagaagcgacaacagatacttctgccggacaatccgaggaaagcaaaaccgatagctcagtgagcgaaatcacaatcaccggtatggagggcaagtacagcacttattacaacagtcataaggacgccgctaagcccaagaaggaaatcactatctatgctaccgactacaaggaaggtacgatagacggcacatccttcgtcaacaacgtatcggagatgacagccgagcaggctgcagccataatgcctgcacttgaggagattactcagaaatcaggcgacggctacaacggaatcaaggcattcctcgaagaagataccgatctcaagacagatcactactcaacgataaagtggaagagcgacaagctcacgcttacatatgagttcaatgtcgaggaaacgggtctttacaatcttgagactatctattatcctatcgagggcaatgaatcaaagaataccgttcttgacataggtcttaagatagacggcgaatatcctttcgcagcggcacaggacatcacgctcgaccgttactggaaggacgagagagagataacccgtgacagcaaggacaacgatcttcgtcccggacaggtaacctatgattgctggataaagtatcctatcaaggacaaggaaggtctttacaacgagccttactacttctatcttgaaaaaggcaagcacacaatgacacttgagggtatcagaacctacggtgttttccattcgtttacgttcaaaaactacgatgagcttgtaagctacgattcaatcaagcccacagatgatcagcttcagaacactcccgcactttcttcaaagaacgaggagctgggaacgaacaccatcttccttcaggctgaggagtctgaatacaagacagcatcgacattatatgctacttacgacagaacgacctacatgacaaatcccaaccacccgaccaagcagcgttacaatactatcggtcaggcaacgtggagtaaggcaacacaggcaatcacctacaagttcaaggttgaaaacgacggttattaccgcttcaacttcaaggcaagacagaatcagatgagaggcttcttctcaaacagaagaatctacattgacggaaaggttccgtgcaaggagcttgacgatgttaggttcatctattctccggactggtacaacctcactccccaggacgagaacggcaacgatatttacgtttatctgacagcgggcgaggagcacgagctgacgcttgaggctatacccggttcaatcggcgcggttatgcagagacttgacgaccttatactcgagctcaaccagtactatagaagaatacttatgataacgggtcccaaccccgatgaatacaaggattactttgtagaaaggaagatacccggtattcaggacgcattccggagaatagttgattctctgcgtgcggagaaggcaagcatcgagaacctcacaaagaagggctctgaggcatcggcgcttgaaacaatgtgtatctaccttgaaagatgtataaagagtcctgaggatattccgataatggcaagcagtatcaaggacagcatctcgtctatatcggcgtggatgcgtgactaccgtggtcagccccttgagcttgactacatagaggtggcaacctgccacgaggatttcgcatcaccgtacggcaacttcttcggtgaacttgcattcggcttcaacgcatttatcggttcgttcttcgaggattatacgaacctttcggattcaagtgcaacatcgctcgacgtatgggtatcacttgcccgtgaccaggcaaccgttgtaaagaaccttgttgacaacaagttcaactcgaatcccgactataacggaacacaggcttcaatcaaccttgtacaaggctctgtacttgaagcaacgctcgcaggcaagggtcctgaaatcgcactgttcatcggcggcgacttcccgatacagctcgctgcgagaggactgctccttgatatgacgcagttcaaggattatgaggcggtaacaaagagatttgcgaaggacgcaatgacgctgtacgaatataacgacggtgtatcgacaggcgtttacggtctccccgtttcacagacattcccgatgctgttctacagaacagacgtacttaaggagcttggatatgagaaccctcccgaaacatgggatcagctcacagatatgctcccgacattacagagaaagtaccttgacgtaggtcttatacttcctcagaacgtttcatcgaacacgttcgactcaggtaacacattcattatgctgatgctccagacaggtcaggacatctacaacaaggacctttacacaacggactacaacagcatgaaaactaccgacataaagaacgtaaacctcacgaacttcatgactcaggattctatcagagtatttgagcagtggacaaagttctacacggtattcagttttgatcagacattcgacgcattctcacgtttcagaacaggtgagatgcccctcgttgttcaggcctatacgttctacaaccagctgtcagttgcagcacccgaaatcaagggtctgtgggacttcacactggtacccggaacaaagcaggcagacggaacaataaatcacgctgtaaactctgcaggcagtggtgcggtaatattcaacaaggtttcaaatcaggctgcagcctgggatttcgtaaagtggttcacaagtacggatattcaggttgactacggtaagcagatcgaagctcttatgggtcccctgggacgtttcgatacggcaaacgtagaagctcttgaacagcttccttggtcaactgccgagtatgagaagatctcatcacagcagagctacctcaaggaagtaccgatcattcccgcatcctatgcagtaacaagacacatcaacaacgcattcagaatggttgttaacgatgcaggtaaccccagatacacgcttatgagctacaacgatcagattaagtctgagatcgtaagaaagtatcaggaattatcgtccatcaaaaaatgatcttgaaaagcggtgagggcttttcgccctcacaggctttgctgaattatagaggaggttatcggtttgtttaacagagaaaagccgcagtatattgaagacagcaaggtcagatatacactgcgtgagatgaagaagaacgcaagcgtatatgtgcttcttgcgccctacttcatactctttacgatctttacgatcataccggtgttgctttcgttgcctatgggctttacgaacttcaacatggtacagttcccccagtttgtgggactgagcaatttctattcgctgatacttgaggacgaggtcttcttaaaggcgatacagaatacgctcgtattcgcaattataacaggtccgttaagctatatcatgtgctttatactggcatggcttatcaacgaaatgcccagagcattaaagacaatgttcacatttatcttctatgcgccgactctggcaggtaacatctataccacatggcagctcatattctcgggcgatacatacggtatagcaaactcttatctgcttgaccttggtatcataaacagcgcacgtcagtggctgacagacgcaaactacatcatgggtgttgtaatcgtcgttcagctgtggatgtcgcttggtgccggattccttgcgcttcgtgcaggtcttcagggtatacctaaggacagatacgaggcgggtgccatcgaaggcatcaagaaccgtacacagcagttactgctcgttacggtgcctgcaatgggacctcagctgctgttcgcagcggttatgcagatcaccgcttccttcacagccggtgatgtaggtcgtttccttaccgcattcccttcaacagactatgcggcacacacgatcatgacacacgcttatgactacggttcaatacgttatgagatgggttactcatcggctatatgcttcgtattgttcgcagtaatgctgcttgccaactggggtatcaagaaggtactcggcaagtaccttgactgatcggaggatctcacattatgaatttctctctaagaaaggaaggcagttatgaaaataactaagaggagaagaaaaagatatggcggttctctgggcggcgacattttcatatttgtagtgctcgctctgctgggtctgttcatgatcttccccatttatctttctgttatacagtcactgaagcctgttgaggagctgttcctcttcccgcccagactatatgtacagaacatcacggatcagaactttgctgatctgcttgctacggcatccaacatgtgggtaccgttctcaagatacattttcaactctgtatttgtagctgtagtagttacagttgcacagcttttattctcgtcatcggcggcatatgcgctttcaaaggttgcattccccggtgcgaaggcgctcaacaagataatcgaggttgcccttctgttcacatctaccgtactttacatcatgcagtacatggtaatggcaacacttggtatgatcgatacatactttgcaatcattctgccgtacatcgcaacgcctatgggactgttccttatgcgtcagttcatgggacagctgcccgacagtatgatagaggccgcaaagctggacggcgcaagccacatcagaatctgctggcagatagtaatgcccaacgttaaacccgcttggctgacacttctgatattcgctttccagggcgcatggcagattacaggttattcattcatttataatgaggcattaaaacccattccgaccgttatgcagcagataagtgccgccggtattgcccgtgcgggcgttgcggcagccgcagctgttatcacgatgctgccgcctatcatagtattcattttctgccagagcagcgttatggaaactatggctaccagcggtcttaaagactgatttattattagattatacagaaaggatgattttagtgccaaacatgaagaaaatcgctacggcagccgtatcggccataatggcggtttccatgctgtgcagttcagcgtttgccgatcagccgtacgaaggttacagctacgactggtggggcgatcctgttccttcacagaccggatacgttgtagaccgtgtagttacaggtcttgatttcggctccggcacaagatataataccgatgctcagctgaaagcgatttcagagcagacgggcagtgaggtaacaaaggatgttgagatcggcgagcttaaagagcctcaggatcttttcattgaccgtaaaacacagagtctttatatagtagactccggtaataaccgcatacttgttacagacgtaacttattcaagagcgtttactgtaatggattatttctataatcccaagacagacaaatatgaaacactgaagaatccgcatggaattttcgtaagacacgttgaggacgctgcaaacgaaaacgagtccacaatgatatacattgcggactacgacaacagccgtgtaatcggtgtttatgcagacggaacggtattccagatattcgaaagaccttccactgaattctatgacgcagatgttacattccttcccaacaaggtcgtagttgacgttgcgggcaacgtttatgtaaacatcaagtcaatcacggacggtgcggtaatgttcgcacccgacggttcattcagtaacttcttcggtgcaaaccgagttgagcagacagcacaggctatcgccaacaagttctggagaacgatcctctcccgtgaggcagccgcagcattcattcaggcggttccgatggagttcgataacttcgatatagacgatgagggctttatttacaccgtaacaggttcaaagagtgccacaacggatatattcaagaagatgaaccctgcaggtgagaacatccttatcaacctcggttattcggattacacctacggcgatatggcttcgtactattataagaaccagacatacggctcacagattactgacgttgacgttgacgaggacggaacgataagacttcttgacttcgcaaacggacgtatctttgaatacacaaacgaatgcgacctgctgttcatctacggcggcaagggcaaccagaagggcctgttcacaaacgtaacggcaattgaagcgtacaacagcgttgtatatgtacttgacagccgtaagaactctatcacatcattcaagcgcacagagtttggtgacatcgtacacgaggcgatgggtctttacaacctcggtaagtacgaggaggcaagcggtccgtggcaggaagtcctgatccgtgacagcaactactggttcgcttatatcggtcttggtaactcagagctttctcagggtaactacgagcaggcaatgaaatacttctaccgtaacagcagatccggatataacagagcgttcaagcagtacagaatgcagtttatcagagatcacttcaatgtatttatgataatcgtgcttgtaataatagtagcgcttgttgttctcagcaaggtaagaaaacgcattaaggctaagaaagcgggaggtaaataaaaatgagatttgatttagatatgcccgcctggaaatggccgttctacgttgcaagacatcctttcgagggctttgaggatcttcgttggaagaaagcatacaacactaaggtttcacttgttatagttctttgtttctttgttataacggtgtgccagcaggtaatgacaggcttccttttcaacgacaactatgtaaagatattcaacatcgtgccgctcctggttcagactgttatcctgttcttcacatgggtaataggtaactggtcactgtgtactctgttcgacggagaaggctcagtaaaggcgattacgagcgtcagcgcttattcgctcgttccttatcttatcactcaggtagtggtaatactcgcaagtaacgtgttactcaagagcgagggtgcgttcatcatattcttccagtatctcggtatactgtggacggtggtgcttatgatctcgggtatcaagacagttcatcagtactcggtacccaagacgcttcttgcaatggttttcactgttgcggcaatggtaataatcctgttcctgctcgtgctgttactcagcttgttccagcaggtttacatcttcggtttctctatctataccgagttgatgtacagattcagtttgtaagcggaggtgtgacagaagatgataaaaatcagaaaaaagatacttgcagttctgctcacagccgcaatgctcgtttcgatgagctcgcttgttgcatggtctgacgaacagcccacaacggacgacggcacatcacagacagagcagacaaccgatgacggcgcatccgcagatgataagcaggacgacaagaaagacgataaaaaagatgacaaggaaaagcccagaaccgacgaggaaggtcttgcggatatgagcgttgtggctgaaaacgacagctacaagttatactttaacgaatcgacgacaaactttgcagttcagtcaaagagcgacaactatgtatggtgggctactcctcttaacgcagacaaggacgaaaatgccaagactgcgcagaagaagaatatgcagtctccgttatatgtagtatacggtgacgtttcatcacacacaagtcagagaataaacatttacgatgcttcgataaagtcgggcaaattcagctttgagccgatcgaaaacggtgtaaaggtcatatacagattaagcaagattgaagctgaaattcctatgatgatcacacttgagaaagacaatgtaaatgtttcggtaataacggaagaaatcaaggaacagcaggcaaccgacacgagcggtcttgtacttcttgagatcggtatgttacagttcttcaatgcggcaggcatggaagatgagggctatatggtagttcccgacggctcgggcgctgtaatcaactacaacaaccgccgttacaacgcacaggcatacaacagtgaggtatacggtcgtgatacatcgatcggtatgctgacacgtccgtcaaagacagagcaggtttatctccctgttatcggtgctgttacaaacggtgaaaagacaaatcacggttatatggcaattgctaagtccggcgaaacctgtgcaagcgtaaacgctactgtaagcggacagaactcaacatcatacaacaacacatggttcgagttcaaggtaagagcagaggatacctactacatgggtaaccgtaagctcacggtttacgagcagggcaagataaaccagcccaacctcacggtaggctattatcctcttgcaaaggaaaacctttcttatgttgatattgcggaagcatacagaaactaccttatcgagcagaagggattcaaggataagagcgacaatataacaaacagctattatcttgacctttacggcggtacgataaaggcacagtcgattgctggcttgcctgtaaatcttgaaactgccgctacaacatacgagcaggctcaggaaataataaagcagctcaacgagcttggcgttgacgatattgttgcaaactacaacgatttcaacggcgcaggcatcaagggtatgatcacagccgatgtaaattacgcaggaacgcttggcggcaagaacgcatacaagacgcttgcggaatatgtaggctcgataaacggcaagctgttcgcaagtgcgggaatcacctacatgaaggacagcggtaacggctacagctacacgctgaacgcctgcaaggctataacaaaggcttatgcaacaacgaataactgggatattgcattcggcattccgaatcaggtaagacttgttacaaagacaaccctgtcaccttattactggcctgatctttacaacaagatcagcaagtcgtttacaagcgaaggaataacaacgataagccttgatgacgctacaacgttgctttacagcgacttcagccgtgagaattattccagagcagacacaatgaacaagctggtagacggctacaagcagttcaaggacgcaggattcacgcttcttgcaagcggcgctaacgcttatgcgctcccctatgttgattatctgacagacgtacctgttacatcaagtaactttgatctgtttgactatgacattccgttctatgagatcgttatccacggttacctgccttacacaacaaaggcggtaaatgcaagtgcaaacgcagatgatactatcatgcttgcacttcttacagcaacacctgttcactatgatatgatgtatgccgatcctaacgatttcacagacagcgattacgagacgctcttctattcaaactacaagggctggctcgaaccctcggctaagatttataagctctatcaggacgaactgaaggacttcgcaaatctccacatcacaggatacaacagaatttccggcgatgagatggaaaccgagtttgacggcggaaagacaatcagggtaaataccagaaaaatgactctcaccgtcaacggcaaggaaatcgatcttgcacaatatggactgaagggagaaacagatgaataattcgaatttcaacccgaatgaagaaattgaagcaatgaagacgaccgacgccgccgagactcccgttgatgacacacccgcagccgacaaggctgtggctgccgaaacggcagcagaagcaacagcttcagagcctgatgtaaagcaggaaacggtcgaggaaacagcttcagagcctgccgataaggcagatgacgctgacgaggcaccggcttccgttgctaacaagtcagcacatatgaccgcagcagctgcggcactgaacgttgaggacgaggaagtggacatccgccgcagacaacccagagttcagaaggaaatcaagaaatcccgtatttcatacgagaagaaaaaaggactttacggttacggattcatagcgatatggatcatcggcgtaatctatatgttcattgtgccgatattcaagtcggcgtggtactcaatgtgctatactgagcttgttacaacagcagatcaggccgcacagagaggaatgacttcagcaggtatctataccgagtggaacaacttcggaaactatgaggaggctcttttcaagaaccaggattacctccccaagctgaccgagtcacttggtgcaatggtaccgcaggttatcgtagtaatgatattctcgctgtttatcgcacttcttcttaaccagaagttcagaggcagaacattcgcaagagcggtattcttcttaccggtacttgttgcgacgggtcctgtactggcggtaatcaagggtgatatatcgaccaacggtatttcgagcggtgagcagttcagcgcactgttccagaccgaccttgtcgatgagctgttgcagttcttaggtatatataatctgaaccaacagctgaccatgacgatacagacgataacgagtgatattttcaacttattatggagtgccggtattcagatactgatattccttgcggcgttacagcagataccggtttcggcaaaggaagcggcatctatggagggcgctacgggatgggaattcttctggaagataacgttcccgatgataagcccgatgatattggcaaacctgatttatacggttatcgatacgttcatcgattcggaaaacccggttatgtcaatagttcttgcacagtcaagaggcttaagatacggtctttcggcggctatggcatggatctacttcctgatagttgcggttgcacttgcaattatcgttgctattgtatctaagttcgtattctatgaaaatgattaaggaggtgtagttgtgagcgaaaaagatttagaacagttcaatgcagatgttcaggaaaacgaagcagccacagctgcacctgtcgataacgcttctccggaagcaatcggcgaggctataaaggagattaacggcgaggctgacgcttctgccgctcccgaaaaggctgatgacgagcttcaggtaggtgttatcaagcctatcgcaacaggaaagcccgaatcaaagagagctttgaagaaggctgaaaagaaaaaggctaaagagcttaagaatatctaccatgtaagcaactggcagataatcaagaattaccgtaattacaaccagcaggaaagaaagcactacaagtacatcttcagaagaagaattaccgaaaaggtatggcctgttttccgtttccttatcctgttcggtctgggattcgtaattctctatcctatactttatatgctgtctacggcaatcagaccccagacagaaatgagcgacccttcggtaatgtggatacccaaggaggttatattctccaacttcgttgacgtatggatcgcaatgaatttcccgaaggtacttttgcagactgtacttgtaaacgtagtatgctcgatgatacaggtcgttacctgtggcgttacgggctacggatttgcacgattcaagttcaagggcaagggacttatgttcggtatcgttatcttacagatcatcgtacccgtacaggtaatccttatccctctgtatatgcagttcagattcttcgatatattcggtctgataaagctgtttacaggcaatgcggttaaccttgtaagtacgcctatggcactttacttacaggcgttcttctgcaacggtatcagagcaggcgtatttatacttctgttcagacagttcttcagaggactgcccaaggacctcgaagatgccgcttatctcgacggctgtggacctttcatgacatttatccgtgttatggtgccgaatgctaagacttcgttcttaacggtattcatcttctcaattgtatggtactggaacgactcttatgtaacgggtatgttcttcactgacccgtatacgatagcgatggaaatcgaccgtcttggaacaacgatgatactttatttcaccggagagcaaaacggtatggcgagtgactatctggtatggatagaagcgggatgcttaatgtcattacttccgatacttattatgtacatcttcttacagaagcagttcgttgaaggtatcgaacgttcaggtcttgccaactaaatgggcggcaatgtgccgcttcaaattcgccttttgaaagaatggcgatatgcgtaggttacgttgacggcgggcggctgtgagccgcagcaaatttgccttttgaaaaaatggcgatatttgaaagtttcgttgacggcgatttgaacgatagtgaaaaacaaatttaaggggagtatcggaagatgctcctctttctatatccttttttatcggacaaacagaggaaatatagcaggagggtaaaacatgaacgatgtatgccgaatgataaagaagcaaacggtaacgaactttagtaatatggaaacggcgataaagacatatgacagaaatgcgtctgtctgcggtacacctgcttggcggtatgtgtatcacgctattcactcggcggacaagtggtttttcaatccgtcaaaattcacagaaccggattttcacgaaaacggaatggataatcccgataatccttgcaatgttgttctgagcgatacagagctgctcgattacctgcataaagtgcagataaaaacagaaaactatcttgataatctgagcgacgaagagcttaacgaaaagcctcaagggtgtgaatatacaaggcttgaacttatcttagggcagtttcggcatatttcctcgcatataggaatgataaacggtcagactatagagagaacgggaagattccctgtgttttcgggtcttgacggaaagcagacagataaattatatgacgaataagaacgaaggaacagaagatgtacattgattttcatatacacgcttatgcggacgaaatagcagacagagcggtgcagaagctgaaggatacggcaaactgcaacgtttatacaaacggaagaatagacgatacaaggcagaagctgaaagagtggggcattgattacggcgttttactgccggttgcaacaaagccgacacagcagacgaccataaacaactgggcaaaggagcaaaatcacggcaacataatatcgttcggcacggtgcatccggacagtgatgagctttacagtgagcttgaacgcatatcgtccttggggcttcacggcgttaaattgcatccggattatcaggggcattttatgttcgagccgtgtatgcagagaatatatgaaaaatgcggtgaactggggcttcctgttattcttcatatgggatatgaccctatatcatctatgacgttccacgcaatgccggcagaccttgccgaaatggcaaagaagtatcctgattgcacatttatcggggcgcatatgggcggaatggcaaactgggagcgtgtgctgtattatatcaaggacgcaaggaacatctattttgacacggcgtactgtgcagagtatatgtcggacgagatgtttatggaaatgttcagggcatacggcgaggacaggatattgttcggaagcgaccttccgtggagcaatccgcacgatgagataagaatgatcgacagaatgccgataagcgacagcgcaaaggacaagatgttttataaaaatgcggcggagctgttaaagatagatatataaaataaaggacgtgactttatcggtcacgttcttcagcttgtagaaaaagtatgttttttcaaaaaaagtgcttgttctcaatccctatccccaaacccctttccccgggaaaggggctatattactggggctaccgcccctagaccctgtcgggggctacgcccctgcgaccccatttatataatcaagaggtttatcgacagtctgaaagacgtgactttatcggtcacgtccttgtcttatatccggttattcggcgtctttgcctgccgccgcaagtgcgatggcacattcgatacgctttttctgaagctcgcaggacagcttgtggggcttctttacatcgccctcatagataaagctgtttgcgttacagccgcctgagcagtagaatcttgcccagcagttaccgcagttttccttgctgtagatatgtattccggcaaagtaatcctttatcttctgatcaatcttgtctgagaaaatgtcgcccatcttccattcttcgatacctacgaactggtggcaggggtaaatatcgccgtcgggagtaacggcaacatattcgttgccgcatccgcatccacgcagacgctttacggcgcatggaccctgatttaagtctatcataaagtggaagaaattgaacttacggttatttgcgagcttctgctcctccatcagcttttcaagtctgtcatattcggcgaatatagtggggaggtcgctctcagtgatagcgtagggcattttgggatcggtcacaacaggctccacggagagctgttcgaagccgagatcgcttatatgcagaacatcgtttgcaaaatcaagattgtactttgtgaacgtacctcttacatagtagtcctttgtacctctgccggctaccagcttctgatatttcggaacgattatgtcatagcttcccttgccgttcggagtggggcggatattatcgtttacttcttttcttccgtcaagcgataatacgcagtttgacatttccttgtttatataatctatcttttcatcgtcaaggagcataccgtttgttgtaatggtgaagcggaagttcttgccgtgctgtttttctatgcttcttgcgtactttacggtttcgactacggtatcccaagccattaaaggctcgccgccgaagaagtctacctcaagattttctctgttggcgctgtgctttataaggaagtccatagctcttttacccgtttcgggcttcatcagcattctgtcgccgccgaagtcgcctgtctgggcaaagcagtatttgcatctcaggttgcagtcgtgcgaaacgtgcaggcacatagccttgataggagccttcatagccattgcggcgtactgctcgtaatcgtcctcggtgaagagcatctttgcgtcataaagctctttaagctcctgatagcattcctttacgtcatctttgtcgaagccgtccatcttagcgattatctcatcgggacatacatcggcaaaggggggagcgacatagtcgaggagcttatatgtcagctcgtccacaacgtgaacgccgccgctgcatacgtcaagtacaatgtactgaccgttttgctcatacttatgtatcatttctttcattggtcaaatccttttctgagttatataaggcggttttccgccgaaatattcaaacaagccaaaagctcccgtatttgttcgggagctttcaaagcttttctcttacccgtgccttacttgtttaaagcctcgcacttctggttagctactgtgcagcttgtcttgcaagcagactggcatgatgtctggcatctgccgcaaccgcccttagcagctgtttccttgaggttagccttgttaacagtcttaatgtgcttcataaaaacacctccgtttatgttatcattctaattgtatcataaagatacggaaatttcaatagttattttgaaaaattacatccaaccgcagtcgtcatattcgctccacttgtcctcaagctgttgctgttgtgatgcaaacttcataacgatataggctacgcacgctacaacagctatgagagcgcctataacgggaatgacataattctttttctttttttcttccatagtattttttcctttcggtattattaaagcctgacggcagatttacatattaagatattccttatagatctccgactttgagaacggggtttttcctgcgacctgtctgcaggcatcggacggctttattccgccgtcaaccagttcttttgccataagtgcggcatcggcaagcgtaatatcctcgttttcctttacctttggttttccctcgaccacaagcacatattcgcctctcggcgtaagatccttgtagcgttctatcatttctgatatagtacccttgataacttcctcgtgtatcttggtaagctctctgcaaagggctatctgtcggtttccgagaactctgtacaaatcgtcgagcgtgtttttcagcttatgaggcgcttcatagaatataagcgttcttgaaaagtccttgatttcgtcaaggtgttcgtcacgctgttttttggtaacgcttaaaaatccctcgaagctgaagcgtgaggtgtcaagcccactcatacaaagcgctgttattgcggcgctggggccgggtacgctttctatttcaacgccgtgctcgtggcactctcttacaagctcttcgccggggtcggatatgcagggcatacctgcgtcggtcactatggcgcaggtttcgccgtcaagcagacgggcggttatatcctcgccacgcttgttaccgctgaacttgtggtagctcaccataggcttgcttatagagaagtgggtaagcagcttctgagttactcttgtatcctctgcggcgataaaatcgaccttgccgagcgtttcgaccgctctgggtgacaggtccgacagatttcctatcggagtgccgactatatataattttcctgccatatttctgtgtcagcctttcttcatttttgtgccgtagtagattctgttcatttcatcgctgtagccgttgtcaccgtaaacctcaaaatcggggagaagctccattccgggtttgccgcccttttttccgcttataaggacgagccacggcttaccgcctttgcggttcactacattctgcataaccttcggctcgatcccgtgcgaacgcatagagcagatgacatcggcaaggcgaagcggtatctgacagagcttgaggctaccgccgaacttcaacagcgacgaggctgtcttcataacatcgtcgatattgcacagtatctcgtgtcttgccgccgcctgtgcatcggaaagtcgttcctcgcccgagccttttttccagtagggcggatttaccgtcactatgtcgaagtattcacggggtacgccctgcgggtctttaaggtcgcaaagcacaggctttattctgtctgaaaggttattttcggcaacgcttttatcaaaaagctctaccgcttcgggcattatctcgacgccgtatatctctttcgggggctttttggatatgtttctgcacattatcagcggaactataccgcagcctgtacacaggtcgcacaccttatggtgaggtgcggggtcggcaaaatccgcaaggagaaatgcgtccgtgccgaaacggtgatcctcggaaacgtatatctttgtgccggaaaggtcgaagctctcatatttttctgccatatcagcctaccagtatatttccctcggggagaatcctgttcttgtccgagttgtgattttttcttattataagagaggtcataagcgttacgggaccgatccttcctgcaagcatggtgaataccattatcagctttgcggggacattcatctctgcggacgcacctacagagaagcctgtagtagagaatgcggaaaccacctcgaatattgttttctgaagcgacataccctcacagcacataagtatgcctgtgaatgaaacggctataagagtcagcgacagaacgataacggtgaatgttttatatatggcgtcacgctttatcctgtgacccataagataggtatcctctctgcccttcagcacggaaattaccgtacaaacgacaagcgcaacggtcgttatcttgataccgcccgctgtggacgcaggtgcggcaccgatgaacataaggatagtgataattatttttgtaaagggcataagatcgttcatatcaaagcaggggaagccggcggtacgggagcttgcgcttaagaatatagatgtgagaattttttctcctatgggcatctgtccgagcgtgtcctgattgctgaattctacaataaatattatagcggcgccgacaagcagcataactgcggccattataagaaccagctttgtatgcaggagaagtctttttgctttgctgtaatgccttatattacgccatacgataaagcccagaccgccggtcgttataagcacaatgagagttatcataactaaagggttatttgtatattcgctgagtcccacagctccgggtgttgctgtgagcaggtcaaagcctgcgttgcagaaagcggaaacggacaggaatatcgcttcgaaaattccgagtgcgccgaagtcgggaacaaagacaaacgcaagtatgacagcgccgacaaattcgatggcaaacgagtaaagaacaatttcatagaaaagtcttttcggtgtggtttcgagtgcgttgtcggtaaggtcgcttgcggcgatttttacggttgaccagcccagctttttgccgagtataaggttgatgaacgttaccaaggtcagaaagccgagaccgccgacctgtataagagcgagtatgacaccctgaccgaagccgttgaaataattgaaggtatccaaaacggttattccggtaacgcaggtcgcacttgtggcggtgaacaggcagtctatgaagctgctgaactgaccgctttttgaagatatgggcaggaaaagaagtgttgcacctgccagtattatgatggaaaagcccagcacgagcatccttgacggctgcatttgtcgggttttctttttgagtttaggcatttgggattatatctctccttagcatttacaaagatgttatttactctcggaaacggtattgtttccgggcttttcgggcggttcgccgttatcgtggcggattgcattctttcctatcgcatagacgtttatatcatcgatgcgtccgataagtacgcaggcaccgctgacctttacggagtcggagcttacaacgtagcaatctgtcggcagcgttccgccctctttaatatattttaccgttgacgactggttgtaatactggatactcatagctgtcatgcggtcattatcgtaaactattatggttttgttttctgtgccgccggaatattcagtgatacagcggtttatctcaagcgtgtcggaaacattttcacggctttcttccgcatagccgaaaagaccgcttgaggcggatgatacgcaggcatagcagataacgcccgtgaatataaaggcggttattacggaagcgtggttttttgtacagcacacaacgggtaccgccgccgcaaacacggtgaaaagaaggcatataggataaagcatatcagagcttgtaagtccggctgacgagtcgcatccgataagcatagaggtgatgcccggcgttattacgttgctgagcatctgtccgcccgactgagtgcagttgtacatcagcagtgcggcggtagcggcaagaccgttcccggtcacagagataagaagccttgtatagcttatgccgtacacgaaaatatagcagaagaacaggaggataaagggaatcgttacggcaaagaccgacgctgcgccgaataccgtatcctgcgtcgaaatgtcacaatcggctttcaagaaagcgtcaagaggaacggcgaatatgaacataagcgtacacagcacgcccattgatacgaatctgttatcataatactgttcttcattgcgtcttttacagcggatgaagctgacaagtgcaatgacggcaaagatgacacctgcgccgccaagtccccacgaggatactatgaagtaatacaagcgaccgcctataagagtaagcagagccgcactgttttcggataaagcctgcaaagagcctgcgaccgattgcaatatacctccggaataagcgtaaaggtcttttgtgagccacgtcagaataatatcggcggcaaaaagaagtataaacgttattgcgtatgtgctgaaatatatgctttttctgactcctgcgagctttacataaagacagtaaaggcatacggcaaggaacacacctgcgcacgacggcgacaggaaataagcgcaggctgtaagaagtcctgcagtgaccgaagcaaagaaggcacctgctttttttccgttttccttttcacttctgaagattacaagcaataaaagccagacaaaaacggtggaaagcggttctgaaagcaggtagtgggaatatataagcactgacgggaatattccgcacaatgcagttacgagaagtctctgccacagctttgtgacaccgagtttatctgtcagacggaaagcggaaagagggataagcgcataagcggctgaatttatcagcataaacagcttatactggaacacggggtcggggcagagcatagtcggaaggtagggtattccacgcaggaagccgcttatgcttcctacaggcgacattacacccgtccaatctctgccgagaaatgcggcggcggccgcagctcccgtaaattcttcctcaagagatgcggtctgcataaacataccgagcgtagagcctaatataaaaaacacaaggaaaacaaggagcgacattcctttttcgcccttttttccgtaaaatgttttaagtctgctcaaaatgccgtcctcctttcattaatgtcgtttatctgcaaaaatatcagtttaccagttccttaagaacggagatgctgataccgagcgtattgttgataagctggaaaacgagcatcatagctatggcggtgcagaaggagaatgctatcgcatagaatattccgggttttcctgcggcttcaatccttgcaagtatgcgttcacggctttcatcggggtattgctgttttatcgtctttatttttctgaccgcagttttcagatagaagtagttgaagaacataagcgcaaagatattcagcgcaagggatatcatagcggtaacgatatatgcaacggcaaggtcgcttgaggacaagccgagattatcggcaaagtagttgagaagaatccttgtttccgtactcagaaaaagcaataccatcataataacgccgaacagattcatcctgcggtaaaagcaatggatagggaagaacaggaatgacgcaaagttcagcttgagcaatttgttgttttttctgatgtccttgaatacgggaagatagtaatatccgttctttccgacaaatttcagaagctcctgagcggtcacgccgtcaatctcctcaaaatccttctgctgttcaagcagttttctgtccattatctcacggtattcgtcatagctttcaacgtggaatatttcaaagccgtcctcgcttgtttcgggcttgtttatccttgcggattcgacgttttcgagatgctcacgcagttctgcgctgtcgcccttccattcgtagctgccgtgctcggcagagtgtatgcaggtgcctaccctgttccagcactcacggtggtacggggcgccgcattcggggcagactacaatgtcttcatcgtcaaagaatttcatgccgcaggcggcacatttttcgtttttaaactgttcgtgcattttatatccttaatctgattttgtttagtgactatatttaatatattataacacggtttattcacgccgtcaaggtgtgtataaaccgtgttaaaacgttctcagacacagtgcgccggcacaccgcataattatgcgggtaaaatcggcacattgtcaaggtataaaaaccgcttgtataagcaggcgtgacggtgtataataacagcagtgaacagcttaaggagcgtgggtatgagaaaaaggatattatggatacaaacgggcggaacattttcgtgcgaaggcacaataagaggacttgctccgcagtcaagcgaagaacaggcagggaaaatactggcgctgatgccgcaggtttgcgaaaaatacgatattgtgccgatgacgctgatgaacatagacagcagtgatatgacaatatccgaccagaagcgcattgcagatacgattggcgataacatcgggaaatatgacgggatagttataacgcacggaacggacactatggcatatacagccgccgctttatcggtcatgacggaaaatccgcccgtgccggtcgtgctcaccggctcgcagcgtccgttctttgacagcggcagtgatgcaccggcgaactttgaagacgctctggctgtggcaggaagcggtacggtgtgccgtgtctgtgttgttttcggcggaaaaattatggacggaagagattgtaccaagattgataccgtatcggataacgctttcacctgtgtgaagggggatataggcactgtaaaaagcggcagggtgaaaatcacctgcaaggagccttgcggcggtaaatacaggtatgactgctctttatgcaaggcggacggtaaagtcgccgttcttgatatgcatccgtcattcaacccggatatgataaaaatgctgtatgagggcggtatcaggggctttgtcatacgctgttacggggcgggcggaatacccgaaaaagtgagggcggcgctcggcagagcaatagccggaggcgcaaaagcgattgcggttactcagtgcctttacggaggggttgaccttggtatttacgctgtgggcacagacgcaagaaaggcgggtatatctgacggagggtatatgacgactgagtatgctgtggcgtggatgatgagggaggtggggaggtcacccgactgaaattcccgcaaggaacggcagcaccgcttgcatttgaaagaaacgacgtttgaaaaaatgtatatttcggctgttctgacgggattttttgaaatcttgcatttttcgcttgcaaaatcggcagaaatgtagtacaattaacatatatgaaacattcacgaaatttggcggaatgccggaaggatactaaaatgcaggaagatctacttgttcagattgaaaataaaatgagcactttctcgaaaagtcagaagctcatagcaaactatattataaacagctatgaaaaggcggcttatatgaccgcactgaagctgggaaacgcagtaaatgtcagcgaatccacggttgtgcgctttgccatagaaatgggctttgagggctatccggagcttcagaagagcttacagtcgctgataaagaaccgtcttacagcggtacagcgtatcaatatcacaaatgaccgtatcggtgacgacggagtgcttaagaacacgctcacgcaggatatggatcgtatccgcagaacgcttgaggaaatcgacccgaaggcttttgacagggctatagagaagatatgctcggcaagaagaatatatatactcggcgctatgagcagcagtattcttgcaagatttcttgattataacttccagcttatattcgataatgtgcattttgtacaggctatcaatacaagcggtatctatcagcagattatacatatgaacagcgaggacgcatttatagcaatatcttttcccagatattcgcagagtacgataaaggctacggcatacgcaaagaaatgtaacgcaaacgttgtggctataaccgacagcgtgacatcgccgctcgccgtttatgcgaacgaactgcttatagcaaggagcgatatggcgagctttgcggattcgctcgttgctccgctcagcctgctcaatgcgataatcgttgcggtgagcgcaagaaacaaggacaacatcgagcagacctttggcaagctggaaaagctgtgggaagaaaatcaggtatataaaaaggacgtataatgaactacgacttagcaataatcggcggaggtgcggcaggtatggctgccgccgtttttgcctctgagaacggtgtgcgcaccgttgtgattgagcataacagacagctcggtaaaaagctcgccataacgggcaagggcaggtgcaacgtcacaaacaacagcgacaacgacaatataatgaagaacatacccacaggaagccgctttctatacagcgctcttgcaggtttttcggcgtatgatacaatgaatttcttcgaggggcttggagtgcctcttaaaacggagaggggaaaccgtgttttccctgtttcagacagtgcaaaggatatagttgaggcgctgaaaaaacgcatgggtacgcttggcgtcaatgttatcacagcgcacgcaaaaggcgttataaccgaggacggcagggtaaaaggagtaaggctcggtgagagcgaggtttatgcaaacagcgtcataatagcgaccggcggagcgtcctacagcggtacgggctcggacggcagcggatatgagatagcacgggcgctcggtcatacgatagtagaaccaaagcctatgcttgtgccgatatgcgtaaaggaaagctgctgctgtgatatgtcggggcttagccttaaaaatgtaacgctgtcgcttattgatacggcaaagaacaagcctgtgtacagggagcagggagaaatgctgttcacgcacttcggggtcagcggtccgctggtgctttccgcatcggcttatgtcaagaaaagcacttacaggcttgagatagatctgaagcctgcgcttgacgataaaaagctggacgcaagactgctccgtgacttcggcgaacagcacacaaagcagatttctactgttatgagagggctgttgccgcaggctatggtagatcctgtgcttgacaaggcaggggttgcggtcgatacaaggataagcgagattacaaaggtgcaaagagcggcaattgtaaatgcgctgaagcactttgatcttacggtgacggggctcagaccgatagaagaagcaataatcacagacggaggagtatcgctcaaggaattagacccgaaaacgatgggctcgaagctgattgacgggttatattttgcaggggagataatcgactgtgcggcttatactggcggatataatttacagatagcgttttccacagcgcacagtgcggctacggctgtgagccgcttcaaattccgcctttggaattgttagcaatcagcttaggttagttgaacggcggggttacacgaagcagtaatttataaaacgtcgggcggcaatgtgccgctccaaattccgcctattaaaataattgtgctgacggagtgcaatccctccgtcttgacggtagataagtttggcaaattaaaaaaggcaggggtatcgcaagcaaaacgcaacaaagcaacagtttgcgccttgccggcaatccacctcccctttttcgagggggaggcaagttgtgatagtgcggggtgagtgatagcacgagggcggtggaagctgtgatgttattagagtgataaatacgcagttgcgtaatgttgccgccggtaacggaggttgctcatatcgctgacaatcggaacggcgaatttgaggcggcacattgccgctcgccgtgcttgacaacggtgggaaaaggtgatatactaagtctatatcaaaccgttgaccgagagtagtaatatcggcagagatactacagagagccgcattagctgaaaagcggtgtatttatccgatacgaatggacttgcgagggcagaccgaaagcgtttaagcgagtagtttctgacggaaggctctgaccgttacacagagagcgcatttttatgtgcgtaacaataaggtggcttgcagatacggcttctgttccttattcggaacgggagcttttttattaagccgtataaaaaatgaggtaaatattatgagcaagattattttaacgggtgacagacccacaggcagacttcacataggacactatgtaggctcgctcagacgcagagtgcagttacagaacacgggcgattttgacgaaatatacatcatgatcgcagacgcacaggcgctgaccgataacttcgacaatcccgaaaaggtacgcagtaacataggagaggtagcgcttgactatatggcggcaggacttgaccccgaaaagtcaacgatattcattcagtcgatgatacccgagcttaccgagcttacattctactatatgaaccttgttacagtatcaagattacagcgtaaccctaccgttaaagcggaaattacgatgagaaattttgaagcaagcatacctgcaggcttcttatgctatccgataagccagaccgccgatattacagccttcaaggctacgacagtaccggtaggcgaggatcagctgcctatgcttgaacaggcaaaggagatagttcacaagttcaactccatctatgagcctgtgcttgttgagccggaaatattacttcccgaaaacgaggcttgtatgcgtctgcccggcactgacggcaaggcaaagatgagcaagtcactgggcaactgcatttaccttgcggatagccccgcagacatcaagacaaagataatgagtatgtttaccgatccgcttcatatacaggtgtcagaccccggtcatatcgagggcaacacggtgttcacctaccttgacgcattctgcacagacgagcattttgaacgttatctgcccgattacaagaatcttgacgagctgaaagagcattataagcgtggcggtcttggcgatatgaagataaagaagttccttaacaatgtaatgcaggaggagcttgaaccgataagactgcgccgtgaggagcttgcgaagaatatggactacgtttacgatgtgctgaagaagggtaccgaaaaggcacgtcagtgtgccgctcagactatgagcgaggttaagaaggctatgaagatcgattatttcggttaaggcgtgaataaatgaatataataacagccgtatttgttttatgagcaaatacggctgtttcagtttgtggaaaaagtcttttatttggatatgcttctgttatatcattcagctttgcctacgatagcaagctaccgatagtgctatttgccggatagcacttctcgggttcgctattcgaataggtacacttgtcaatatgaaagagggagacaaccaaagggatcagggagagtctgagcctcgcttacgcaaggctcgtgcgctccgctaaagctccgctggactgccgcagtgaagcaaagcgaaacgattgagcacttgccaaaggttagtgctcagccctataccctgtcccttaggttttctcccaaatcagttattcctcttgagcgacgtgaggagcgggagcattgctaaagcaatgctcagcatccctatccccaaacccctttccccaggaaaggggctatattactggggctaccgcccctagaccctgtcgggggcggtagcccctgcgaccccatttttatataatcaagaggtttatcgacagtctgcagcacccccgttcagttgaacgggggtgcttattcttatgctctcttattttagcttattttagcggtataaccacatcggagcagaataccttacccttatgatagaaggttgccgtaccgccgtgtttttcggctgtgaacagcaccgattcaagccctatgccgttaccgcccttggtggtgaaataatagtgtccgccctcacaacgcactttgccgttaaaattattttcagctactatgtaaaggttgcctgatgcatcgtcagcctttaccgaaagtgagattctgcgatcgtcgttttcaggaagcataaggcttgcgtttaccgcattttcaagtatgttaccgactatacagcaaagctcatcatcggacagcacagcctcctccttgttatcggtatcgatccgcaatctgagagtaataccgtgttgctgtgcctgttcttcaaagtggctcagcagagcgttgagcgcatagtttccgcagtaacgcacgggcgatctgctcgggaacgtatctatatagttatcaagatagcttttcagctcctctatatcgccgtcctcggcaagcgtctttattgcaatgattgagtgcttgaaatcgtgacgtatgcgtgaggtgtcctcaagatatttctgctgggcgtcgtactgcttcttttgcatttcaagcacacttatatgctccttgtccttgccggctttcagcaaagcggacgctatgaaataaaacacggtatacataagcacaagcataacgaacataagcgttgttatcaggatataaaccagaaaaacacggttaagataaagtgtctgataatgcacgggctgtaccgtaaaattgaacccgataaacataagcgacattactatcgaaatcagccatacccttctgtacggaagcccgtttataagatgagagccgtattttgctaccggataagcaatagcggcagtcactgcacaggatattccgagctgtatcaatgcgccgtcggtgctgaaggtcggcactccaagctcagggtgtataactgcatcaatcattatagcataattcttgcagaagctcattatagcaaacgacaacagaaacgttgcaaagcatttgacaatatccgcatcgacaatgactctgtacgcaagaaacaaaggtaccagcagaatatagaaaactaccttcggatctacagggagcaatgccgttgcgccagaaactatcaccgtcaccataacaagcacgcctaaaaacaacgggaggacatttttgatggaatatttcatcttgtccttcataggcagtaagcaaagcaccgtcgtaggtacgattataaggcaggataatgcctcgtttacaaatctactcagcatctcattcatctgaccgtcacctgatctttctcaaattcgctgtgaatacgattcagaacgaaacgtgtatagtcgtttttgatctgcgtcatcttacggcggcttatcggaacggtatcgccgtttatcatcagaaaattttcaccgtcaatacgggctacatttgcaagcgacacaagcatgcccttgttgcaggaaatcactccttcgtattttgaaagcgattcttccattatcttatgcgttgtacggatcttcagcggctcgtttccgaccagaaacacatttacataatgtccggaacatgaggtatagacaagcgatgacagcggtatcaccgtaccgtcggggagtgccgccgcacatcccgtattcttaagctgttgtgctacggtttcggcaagctgtcttatgctttccgcccttacgggcttcagcagatagaagttcgcctttaccgcatagctttcgcttgcaaactcgttgcttgtggtgacaaacaccagcataacattcttatccagcgccctgatacgtttggcggtttcaatgccgctcattccgcccatatatatgtcaagaaaaatcagatcgtatctgccggcggaaaactgcctgagcaattcctcgccgcttgtatattcgtctatattgcctacgttcagccccacttttgaaaacggagcgattattgccgatgacagcttttcacgctctgagttaaggtcgtccgtaattgctattctgagatccattggttatgcaccttccgctttgcttggtttacatcgctgtaattatgtcctgttatgattatactatatttccgctttttgtgcaataaaattctgccccgcaatgccttttcaagcccgatttgcgccgattaaagccaatttgttgttacagctgaacgttattgttataatatttatcgcaaaacatcaaacaggaggttcctatggaaaacgagaacgagaaaaagacagccgacactgctgtcaaaaaaaagccggatatggacaagctcaccgagcttataatagtaataatgctgggcgttaccgccctgctcacagcgtgggcaagctggataggctcgcttcacggcggaaatcaggctaccaactacgccaccagcaacaatcttgcttccgagggcaactcggaatataatgcaggcgttcagcagatgaatcaggatatgatcctctggaacgatataagctcattgcagattgaaatcgtctttgcgcagaacaataataacgaggctgagcttgcaaagctgtgcaaccagctgttctacaagatggcggagaacgtgagtgaaacaatggcggcaaagattgactggaacactgccgacaacagcagcagcgatcctcaggcaactatacttgcgtggctcgaaaaggaaaacagtatgagctcgcccttctttgacgagaattatgtcaacagctattttacaaaagcaaacgagcttcttgcacagtcgcaggaggtacttgaacagggtcagaaggataattcaaacggcgacgcattcggtcttgtaacggtcatctacagcgttgtactgttcttactcggtattgccggctcattcaatcataaggtgaacaaatatgctgtggtaattatcgctcttgtcgcatttgttatcgcaacaatctatatgttcaccctgcctatgcccacaggcttcagcatcaccagcttcttcaagggctgaaccgattaatgccaaaatgcaaccgatttgcgccagttaattgaattaaatcatttcggtgagtataatttgctaaggttggaaaaacaaccgatattacataatcagaggcggacataccgcaaagaaaggaataattatgaagaaagtaatcaagtcggtcattgcacttgcaatggcagcagtaatggtaatggcactcgcagcttgctcaggctcggcaaaggataagatgaagggcgactggatttacgaaactatcgcaggcgattctgtagcagactatgcggctaagctcggcgttgacgaatcatcattcgcatccgtatggacattcacagatgataaggttataataaagtcagttgccgctacggaagaacacaacgttcagtacaagagcaacggtgcagaagtaatggaagtaggcagcacagacaagattcagatgagcgtaaagcttgaaaacgacaagctctctttcaagctcaagggtactgacggcaaagagtacgactacgttatgaagaagggtactatggaaataggctcatctacagcagtaaaagaataattttaaaagcaacagctccttacagttgtttttcttaatgtcacgtttgatgtgacgaagatcttttccttcagacagcggtatcggttttccggtaccgctgttctttatatacaaataaccgccgtcctgagaaacggcggttcagcttgtagaaaaagtctatttttgaaatagacttctgatttattatccctatcccctttaggacactctattggctttgcttcgtgcaaagcttggtgtgtccttatttcggcatccttgccgaaaacccctttccccgtggtgaagggctgtgtatgctttgttggctctgcatcgtgcagagcctttgtgcatacacgcccggcatccgtgccgggctgaatgtggggctgccgccctcatcctgcttggggctacgccccaaaccccatttttataagttatgtgggtttatcgacagtctgaaaccgccgtcctgagaaacggcggttatttatatagggaatcagaaaatatcggtaatatcaggcgcttatcggagcgtaacgctcagacataagcgtatcgagcatagctttgtaagggttaagctcaccgcttgccaccatcgagaaaagtcttggcgaacagcccgaaacgagcgcaacaccgttctcgttcattgtgacaggctgctgagcttttctgctctcaacattccagaaaactatctcggggagcgtatatcctttttcggcatactttctccttgcacattcgaagttcgttttgcctgcgttatccgcacactcgtcaaactccatatccgagattatatataaccgtttcggaagctcttcctgcggaagattatactttacggcggttttcagcaaaagattgaacacagccgatatattcgtgtttgcgacttcgctataccgacggcagtactcaacctttcctgcaatatcactgccctttatttcgacaagctgaggtctttcagagaaggttataaaatgattgtggaacctgcccttgtttctttcggcaaaatatattccgagcgacagcgcaacagcaattgccctgggatacatcgaacccgaaccgtcaatcacggcaagagcgttttcatcgttgccgaaatcttcgagggcgttccacgtcacgtccattgcgttgcgttcctctgcggacagtccgtctgaacgccaattgaagcacggagcgataacgtcatacggggtcagtacgcctgtgtgcattttcgctttgccgtttttcacattgtcgatatactcgcagtaacggtcaaagtcgttttcatagaacgcaccacgatatttcagcattgcgagagcgggcagttttgaatagtcaaaggtatagtcctgcacacgcaggcggttttcaactatatcaatcttttttctcagtgcgacaactgttttacggtactgcttttcgctcattccgagcagacgtgcaagacggcgtgccgtgcggacagtttccttatttgacgtattgacagagggaagccattttgcaagaagcgacacgcccgtgtcagacgctatatcctttttgagctgaccttctataatctgcaaagcgtccttctcgcagggcgtaccgataaggcacagcagatcgtcatatctgccgtactcagcgatgtattctatatttctgcgcacaacctcaggctcatattttgcaagatagttcagtattatacggaacactctgcgctcgccaaggccctcacgggcatcacgggcgaagaaaagcgtttttacggcaagattcttatcctccgaatacgcttttacaaagcggccgataatatcgttttcggtgctgctgcggattgctcctatcgtgccgaacagatcaaggcagtgcgattttgtgcttatgtaggtcgctgcaccgttttcggtcagggtcatgtttgattcttcttttaaatagtgaagcattgtaatttcctcctctgcggcgcagagcaggttactcacacgccttgaaattatatatcggtttcagcacttcgataacatctaccgactctctgataacatcaataatatccgacagtgacttatacgccataggcgcttcgtcaagcgttgaattgttgaccgaggtcgtgtatatgccctccatactcttcttatactgctcaatgtcgagcgtttccttagcctttgttctcgacataatcctgcctgcgccgtgcggtgcggaataattccagtcgggatttccctttcctcttgcaagcacgcttccgtccctcatatttatcggaataagcacaagctcgccgctctttgcggaaattgcgcccttgcggagtatgcgctccttggtatcaatgtaattgtgtatcgtatggaacgcagacacggcagtaagtccgcacctgtcaaggattatctcagccatacgctcacggttacgctttgcaaagcgctgacatatctcgacatcataaagataatcctcaaggtaattatcgtaaagatagcagagatctgcgggcgtatcggggactttcgcctgccactctttttccattgcctttaacgcagactgaatttcggtgcgtctgccctgctccttatatgtctttataagctccgctttcttttcaaaaagctcgcccttaccggacgcaagctcaatcgcaaggttctgataatactcagctacctgcttgcctaagttacggctgcccgaatggataacaaggtacttgttaccgtccgaggaaacgtctatctctataaaatgattaccgccgccgagcgtaccgaggcttctttcaagccgttttgcctgttcaagatgtctgtagcaacgaagtcccgtaaggtcaaagcgttcataacgtccgtcccatacatttcttccgctcggtatgtagtgtgcggcttcatctgtcttactaagatcgatttccgcctttccgagctccgctgtgtacattccgcaaccgatatccacacctacgacatttggtactgccttatcggttatcgtcattgtcgtgccgatagtgcaacccttgcctgcgtgtacatcgggcattattctgatttttgagcctgcggtgaactcatagtcgcacattctgcgtatctgttctatcgcttcgtcctcgactacttttgcgtaacatattgcggtgttgattttccctttgatttcaagcatatctctgctctcctttctcaaaaaataagaacaacgtcccttaaaaaatatgatgggaatagtcagggacgctgtctgttaacaagacgcaattaaaaatgggtgcacggactttaaccgcactgtaacaagccgtaaggctgtgtcgccgtcaggtcggcaaaaaatggtgtttaaaaaacacaggtgtaaaatgctgctgtatgcgtctttacaaggcactgttattttccatataaataatatgaactgctgtctgtgccttaaacattctgcaaggcactgtttttaacctcatataaaaactgctgtcagtgccttttgtctgcggtgaagctttccttcatcgcatgagtttattatacaggatgggatttggtttttcacggaaaaaaagctgcgaactatatttgttcgcagctttaatatgatttattaaaggcaaattgctatattacccaaaattgcaattttgccgttatcatcgaagctacagcatatcgccaacacccttgcctttcaatgaacgctctgttggttttgcgtcctgcaaaactctgggcgttcaatttcgggcatccatgcccgccctcgaaaaaggggaggtggattgacggcaaggcgcaagctatatttttacaacgtttttgtgcgatatatccgactttagaaatcgtcaaatcaatctgccgtcaagacggtagggattgaaattgatagcactcctatcctcaaaacttctgagcaatcacaatccccaccgtcacggctcggaatagtttcataattataaaggttggattatctgaatactgtgccacaaggcaaaaacttatatcagccgtgccacctcccctttttcgaggggaggcaagtttagtgcgtggcaaagggattattgtccttttgcaatggttgtgggaatgacaagggttggtgcaacgggaggagcgagcaagacaagagtgacggcaatttacttcactttctgcactaaaaattcatttcactccgcacgccatctgctcttccagtctttcctttatcaatccgacaaagctatccgggctgataactttaacgcaagggccgaaggacaacacacggataacaatctccgtttcatcggttgcgtaatatttcagatgaagcagatacttattatcgtcaacacgctccgcctgcttttcaaagtgtgcaaagtggagcattacacgctcaagcgcattccgctcgtcatttatctgcagggtaagctctcttatctgcattgtttccggcttttcgttccactgacctgtgcctgcgtacagctgacagtttataattctgccgaggtttaactgtctgtacttacagccgtccattattactcttatcttatcgtccttttccgaatattcaaaccctttggggaaaaatctcagcgttgcttccttgccatagcggttattcagccttgcgattatcggcagattgttctttatggcataatatatcagcctgaacctaccgatatagccctcatcgccaaaatcatcaccgtccgagtatttatcgtatactttataatcgtcctcggtgaaaagcggctcaacatcggataagtcggggaactgtacatcaaacagcctcactctcttatcaagcgatacggctttcagccagcgcttctgaagcaatgtcagcggcattgtcggctcgtgctttaaaagcggtcttaaattgccgtcaagcagcttccactttccgcttttaagcgacggcattatagtcagcacgctttcggaaaatgcgttttcgctcacgatacggtcaaggtccttctctgtcgtattcttatcgaatgcggcagtgattatccttgctaccgtgttataatatgccgagtaaagctcactgaatatcatcgctttcacctccgctgtcagccgtgttatcttctatgccgtatatttcatacattttctctatatcggctttaaaattattttcagctgttctgtccgaaaaattgagccttgttatacggcagataaacgtgcgtatccacggtatcatttcggtagtgtcgaatacatcggcggagtatctgtaatggttgtcgtctattttttcaaccgtaccgcaccgcttttcacgctcaaggcggtttactatatactgctcatcatcagctattcttatatcaaactcaacgtgttccgcactgtcggtatcaagcctgccgtttacaccccacatacaactttcagccgcattcagcttctccctcagctcgtcaaacctttcgcacggttctccgatttttacatcggatatgtaatcaagtcgatacgaaaacagcctgttcagctttatattataggctataaggtgctgtctgccgttctgtgcactgatataaattctaagcggtacaagccctactgacatcggcttgtcgctgtgtctgccgagattttccaccgtgacacagcttttcttctgcattgcgtcaaacagcatagccgctatatcgctgtcaagcgcctgcgtgatatagtggtgcttgaatgtgaaaagttcatcgtgcggcggtaatttatccgagataaacgagccgataacaccgcacggtgcggtttctccgaaaaagtcaacaacatcgcatagctgtgacacatcaacatcgggagaacggctgtaaagcacctttctgccctgcttttcggttatgataatgccctcggcggtgtattccttgagcttttttctaagggtcgattcgtcaaacgtaaaatcccccgacagcaataaatcaatctcatctacaagctccgacagcgtcagctttatatcgggagtgtaaagtatatcgaacactgcgaagtgcagagttatatccccgtccgtaaagctctttgctttccacgccttatagaaagggtttttacaggcggtacggctgtctaccgacagaaatacattcttgccctcgttggtttttgcaaagcgcatataatccccgagccagctttctaccctgcggcgttcatcgtcatacgagcgtgcgcttttcctgtcgtacccgtttctgctcttgaagccgaatacatagaattcacgcatatatgaacgtattttctcaaagttctttataagctcgctgtaagccatttccccctcctttttgccggtagtcaagatatgcccgactgcattcacaatcgggcatatattcagcttttaaattccgagatcaagcatcggtgcggtacctatcgtatatccgtccgcacttacgcctgcggtagtgccgtcccaacggtactttgtaatctcatcgccgttttcatcgacccaggcgacagttgtaccgaactgcggaacatcgtttatatccgatatatcggtcgtatcgggcgtataccacaccgacacgcatacgccttttatgcagttggctcttattacaccgtttctgagctcggggaagcagtttttcagatacattccgagcaattcttctccgtactgcgacgatgtgatggttgtgctttcgtcaacgtctgcggcattcccccacgttaccgtgtccggagaaaatgcagagggattctgcgccgcatctatatgccaattgccgtcacttacagtcagagtaaacacctctcgacaatcttcccccataagcatatagttcttgcggtttgcgtccgccattgtcagaaaatagcctatctgcttcttgatttccgaagcggtgctgtttgccgagcctatattcgcccttatcgtaactccgagcagtacaggcacaagtattgcggcaagcacgcctattaccgccataaccacaacaagctcaactatagtaaagccttttttcttatgtaattgccgaattgtatacatcgtatttcctccgtgttagcttattaagttaataataacacatttcacgcaggaaatcaacagctaattaataatattataaattcacattattgcaaatttatctcttttctgtttttgtactcgtgctgtgagtgtacaagcaggtattcatctatacaatcgggtgctgtttccagccagcctatataataggcggttatgtcggttatctcctgcgttatgcgtttaggtaatgctacaccggtttcgctgtctaaggtagataacataatatctttattgttattttcacggcaatattctacaaattcgggtgttgtaccataatttaaacctatcgcatcaaagcaatataaatccggtgcgccaaataaatgaagtatttcatgtgcaataattgacggtgcaatcctgtcagtatcagcaaatttagataagcaagcaagttcatacggatatgcgttagccttgtcataaacatttgcaacatacgaatttatgataatttcatcgtcattctttaattcagcgtcatagttgtttgtgaacaaaagatatataatattatcgcaattatacttctttttcagactttcgctgtctatattactttcaatatatttccattcttcttccttgtcgaaagcctgtaccgcatttcctactatatttttaaaagcagtttcataataaaggtcgctgtcttcatcattcggaattacaaactcacaatccttgttatatttttttccttgttcgctcagccaatctgtagcaattttcaatgaacaaaaatcattttttctggtttgtttatcattgtctgtagtgaaatcccatttagtgagtttatcattacagaatatagtgaccactgcggttttcccaataggtgtatcagcactgcccaagttatcaagctctatcactttttcctgcttcggagcaggacgagggaaaattctgattacagaagaacggtcaagcataaacagcacaaacacagcgcatatcagaataaccgctatgccgacaattaaaatcaatttttcctttttactcatatctcaccataacaagtatcccccgacagtcacccgtcgggggaatagcatatttgtttaaactttatgccaatagtcaatcagctattacgttgaagatgatgatgtaccaagtgaaagtgcaggagctgtaccaagtgtgataccgtcacttgtaatgccggctgtgttaccgtcccatgtatatgtacccttcttgaaatcagcttctccgggcatgcttgtaggctttgtattgccatcagctgtataagctacatataatgtcttgccgccctcgcagtaagcatagatatatgaactctttacatcggggaatacgcttgcaaggtcaatagttaaaagtgcagttgcatcccctgcagaactcttcggtgtatcctttgtgatgccagcagctgatgcaccccattgaatagaaccgcctgtcttgaaagcgtctgtaagagcaccaccggctgcaccgcctgtgtaagtacctgttactacagaagcttcccattcaccgtctgcattaattttgaatgtgatgttagccttagctgctgaagactgcttcataccatagcctgctgtatcggcatctgttaagaagttatcaatctgcttcttgattgaagctgctgttgagttagctgatgttactcttgaagaagtaacgaagcccagcattgtggggatcaagatagctgcgagtacgccgatgatagcgataacaacgatcagctcaacgagtgtgaagcctttcttggctttcagtttctgtaatttctttatcatgggaaattacctccttgaaatatgtaaaagtttttttatgtttaacggtctgcgccgttaaatccaaaattccccgtgggtcttcagaataaatatatgccgaagaatttcttctcagcaccttttctgttgcccttggtgttttctgtattcttaggataccacaacacattcaaaaaagcaatagccaaattgctaaattttgtactaatcttcaattttagtgaattttatatataagcgatttctttttgtggtacattttgcacaaggattgtgtaactgggttacacaatcaagtcataacactcatattatgctgtcatcaagcagaaaatccactattcctatattaagaacaccgctttcgttataccaacgcttagttatatcatgacgtactattatcttcgggaaataatcgcctgtgagcgaaaacggcttgttttcctgtactgctttttcttcatcaggcaacgcaaaagccgactggatatacagccttttttctccgtcatttgctataaaatcaatttcccttgcgacctgcttttgttttccgttgtcatccttttcgctcgaatacaccactcccacatctaccatgcaatcacggataatcagctcattgtatataatattttccataatatgcgtcatttcctgctgtctgaagcctatccgtgcatttctcagccctatatcctcgcaataatatttgttcgggtaatcaaaataacctttacctctgacatcataccgcctgcactcactgaaaagatatgcgtcgatcagattatcaatatactgctttaccgtattattagcgacagcaccttcgcccttcagcttctgctttgaattaaggctgtttgcaatgttggtcggattcgtaagagaacctaccgatgaacacaataaatcaagcactgccgacagaatatcctcacgctttattctcctgcgttcaactatatctttaatgtatacctccgaaaacagtgtggtaagatagttcatctttgctttatcggtaggtcttgacagtacgagcggcataccgccgtaaaacgcataattgtcaaacgcttcgtatttatcgccgcccacagctgaataatactctgcaaagctaagcgggtgaacccttatttcgtcgctcctgcctctgaactgagtgagtatatccgccgacagcatttttgaattgcttccggtgacgtatatatcaaggttcggcattgaacgcagatcattcagagcgtcatagaacgtaatctttttaccgtccttattataaggattaggcacttcgtcagacatctgtatttcgtccacaaaaagataatactgctcaccgtccgtccttactctttcacggacgtctttaacaagctccaacggatctctgtatcgtatatcgctcgcaaggtcaaatgcgtaggaaaagatattatccggctttgttccgttttcaagcagatattttctgaacagcgtaccgagaagatatgatttgcctgagcggcgtattcccgttattactttcacctgtccgtcccacatatatgaaattattttttcaagatacttgtcacgttttatttccatattgtcctccgttgaaaacttactgcgaaaattatgctacttttcaataaaattatacactgtttttaacacaaaagcaagccgtttgtcataatttcactgaaaacttactacaaaatccgatcaagttttcagtgaaaccgctcttataaagcaagaaccccctccggctctcgccggagggggttctctatattagtttaaaacattatggagcttgcgattaaactgtttcgtcaacgccgtagtaagcattgaggtacatctgcttgatctcgctcatcagcgggtatctggggttagcgcctgtgcactggtcgtcgaatgcctgctctgtcatagcgtcaagtctgtctaagaagtccttctcatcaataccgtagtccttaattgtcttcttgatgcctacagtttccttgagctgttcgatcttagcgatgaacttctcgaacttctcttcgttgttcttgcctgttacgccgcagaattcagcaacttcaacgtatctctcaagagtatgggggtgatcatactgtgagaatgtacccatctttgtggggttgggaactgcattgaaacgcataacgtgtgtgataagcagagcgtttgcaataccgtgaggcaggtggtggaaagcaccgagcttgtgagccattgagtggcagacaccgaggaatgcgttagcgaatgcgatacctgccatagcagaagcattagccatcttctctcttgcttcaacatctgtctgaccttcagcgtaagctctgggcagatactcgaagatgtttcttgcagccttgagagcaagaccgtctgtgtagtctgtagccatgattgatgcgtaagcctcgaggcagtgtgtgagtgcgtcaacacctgaagcacttgtcagacccttaggctgtgtcatcatgttgtctgtatcaatgattgccatgttgggcagtaactgatagtcagcaagaggatacttaacgcctgtcttttcgtcagtgataactgcgaaaggagtacactcagaacctgtacctgaagatgtggggatagctacgaagtaagccttttcgcccatcttggggaatgtgtaaactctcttacggatatccatatatctcatagccatatcgaggaagtcaacatcgggatgctcgtaaagtacccacatgatcttacctgcgtccatagcagaaccgccgccgagtgcgatgataacatcgggctggaactgcttcatcagctctgcgccttccttagcgcaagcaagcgtaggatcgggagcaacgttgaagaatactgtatgagaaatacccatctgatcgagcttatctgtgatagcctttgtgttgccgttatgatataagaaggagtctgttacgatgaatgccttcttcttgtgcattattgtgcccagctcatcaagagcaacaggcatagaacccttcttgaagtaaaccttctcaggaagtctcagccacagcatattctctctcctctcagcgactgtcttgatgttgatgaggtgcttaacaccaacgttttcggatacggagttaccgccccatgaaccgcaacccagtgttaatgaggggaggagcttgaagttgtaaaggtcaccgataccgccgtgtgaagaaggtgtgttaacgaggatacggcaggtcttcattctgttggcgaattcgttgatcttctcacgctctgtaacagcgttgcagtacagagatgatgtatgaccgtaaccgccgtcagcaacgagcctttcagcctttgcaactgcttcttcgaagtccttagccttgtacatagcgagtacgggagagagcttttcgtgtgcaaactcttcttcgatgtctacgctttcaacttcaccgataagaaccttagtcttggggtcaaccttaacgcctgcaagctcagcgattgtagcggccttctgaccaactatctttgcgttgagtgcgccgttgataaggattgtctttcttaccttttctgtttcttcgggatttaagaagtagcagccgagtgatgcaaattccttcttaaccttgtcatatatcttgtcgagtacgattactgactgctcagaagcacagatcataccgttatcaaatgtctttgagtgaacgattgaagcaacagcgagcttgatgtctgctgtagtatcaatgattgcgggtgtgttacctgcaccaacgccgagagcgggcttgcctgatgagtaagcagccttaaccattccgggaccgcctgtagcgaggattatatcagcgcttctcataacttcgtttgtgaggtcgagcgaaggaacgtcgatccatgcgatgatgcccttaggtgcgcctgcagcaactgcagcgtccagaactaccttagcggcagcgattgtgctcttcttagctctggggtgggggctgattatgataccgtttcttgtcttaagacagataagtgtcttgaatatagctgttgatgtggggtttgttgtaggaataactgcggcaacaacaccgataggctctgcaaccttcattgtaccgaaagccttgtcttcttcgataatgtcgcaggtctttgtgttcttgtaagcgttgtagatgtactcggctgcgtagttgttcttgataaccttatcttcaacaacacccatacctgtttcttctactgccatcttagcgagcgggattctcatctggttagcggcgattgctgctgcctggaagatcttatcaacctgctcctgtgtaaaggttgcgaattcctgctgtgcagctcttacttctgccatacgagccttgagagcgtcaacattgtcaacgatcagcgggcttacgggagcagattcagctgtcttgttgcttacgatttgcttcttagccattttgtcctcctgaatgttttaaactgttctttcttattgtaccgtttttgcggtctgctattatagtttaccgcagggtcggcggtttacccatttgttatttttttaacaatatcattatatcaatttgaagcgcattttgtcaatctttttttctatgaaaatggctaaaattagaccgccgcttttgtgcatattgtataattgaaggtgaagaggggcggatatgaggaaaaaagcggtatcactcagcctgttgtgcaaaaacagccgtgacttcaccgccacggctgtgcattatttaattgtaatcagctcttgaaatgctccccgtacttttctttaagtatcttccactgataacggtatgcatagcttgcagtgaacactccgtcgtctttcctttctgattttaatacagacggtttgctttgttctaaatcaaaaacgataggataagcactattgtaaatatttccgtcaacttcatttgcagtagtatcattgtcggcaaaaatcagataagattgacccttttgcaaaaagacaggattccacgttgtttgtatatatcttccgtttccacttcttaaagtgttgtaatattccatttgcccgtcataatattttttttcaatttcactgtaatgactgctgtcaaactcacccgatttattttcaaattgagctttcagattttcttccgctttttgcacaaaatttaagcttctgtcgttatactgttctgttatacgataagattcacggatatataatatatcccctttattatacaagcattttccgttattggaatcgacaacttcttctataacaacaggcgtgtagattaaagataaaaacggcttcataatcaacgtttcaccgcatttaccgtcaatgataacataactgtcgcctgcaactctgcatttgagcgctacaagttccgatgatttaacgtctatcgtttctttatacaagtcatcaagattcggctcaacaggaagatacatactatacaagttacgatatgtgttagaatatatgtattcgtttgtaatctcgtatttgtccttatcgtaagaaaacgtctgatacccctcgatattctttacaaggttttcttcactttccttgcttgtattatcagttgcagagctgttatctgtagccgagctttcatttttactgtcagtgaccgaattttccacaggcggagtagtatcgccaacgctgccggttgcagagttacttgtacagccgaataacataagtgccgataagatcagtgctgttgtttttgtaagttttttcataattttttcctttcgcgtagttgtgctttgtgaataaaaactgcaggtatagattgatactgatagattgatactgatagattgatactgatagtatatctaccgcttttatactatcacgaagttaatcagatgtcaatttctcccccccgatttgtgaaatatagccaataagaattgtcagaatatccaaacggcttgccctcgctctttcttatctgctttaacttttcgctgaaatccatattgtcttcctcctgttttcgtttggcttttgtgaacagctatatcgtaccctgtttttcgagtagccgcaataaacatatgcttacaatcgttgtttttctgtgctactttgcgttgcatacaagaaaatcggtatagcaaagcggaatgtgaagccacattccgccgttattttcaattaaactgcagcagcattacgacaagtgccaccataaatacaggtgagaatattgcaagcaattttctgtgcttgttttcgccgcccacggcagtcagccttgccgctccgcagaacgcaagcagtaccgccacgaacggcgccgcaaagtaggagatattcacgataatgtttcccagtgccgccgccgcatttacaagaccgtcccataaaccgccgatgcccgtgagctgtttctgatacgttatgaccgtaacaaagaagttatttatcagatgaagcaccattccgggaattatcgagtcatatctcaccgccataagtccgaagatcacgccgcttaaaaacgcatacgcaaactggtcgaaatttccgtgagcaagcccgaatatcagcgccgacaggataattgcaggtgtatcgcctatgggcttcagcgagcggagcaataagtgacggtatatcatttcttcaaatacaggcgcaacgaatgcggtaaatatcagcgttacaatgcccgatgagaagctcgacggtgcaatagcgtccatcacattctctatctctcccactccgaacagaagctgaagaatatagtttatgcaggtggttatattacttccccacattgcaaaggcaaacatcgcagggataaatataagcggataatacgacttgttttcatactgcgtatcaagccgcctcagcggtcggtatttaagatagaccgcaccgaacgccagtattttcggcagatatgtcgatatattgctgaacgtgtaattcagtacggtaaacagtgtactgcccgtgtcaagccctgcgttcacaaagcccctgagcaaaaacaccatcgcaacaaatattaccttctgaaacagcacagatatgataagtgctattccaagatcaaagcatatcctgcgtatatccgcaggcttaaggtcgtccttcgaagtaagcgcatcaaaatcctgctgtctgtatctgtccgctatgacagcaataaggcttttctgcattttaacagagtcctttcgttaaataatcatcacaactattatatacgcagtacacgcaagaaatcccacgataaaaatcggattctttgcaattgcggcaaatttctgcttttttgaaagctccgggtaattatttaccggacggtaaagtcggttattcttcagctttcctatagccgcaccaatacccacaagagcaattatcagtaccagcacaatgtatatcataaggacagtaagataggcttcctcgccgcttgtcacagggcttcccttctgcacctttgacatcgctgttacaaacgtgtctgttttgactgccacaacggctattgccgctatcgagttgaacattgcgtgcattatagttgtcggcataatactgcctgtcgcatatctcacatatccaaggcagatacccactataaacgtatagcagaactggtgtatatttccgtgcgccataccgaagcaaagagcggaaacaagtatcgcaaatccgttgccgtaaggcataagcgaggtctgtataacgcctctgaaccagtattcctcaaacaacggagcaaggattaccatctgtatgaacaaaaacgcaagataccacgcaccgcttcccgttcccgaagaaattatcggagtaagcgtatcctcgaccgccgattgattgtgtataagcagaaatgatacggcaagcactattatattagctatctgacctgcaccgtacataggcacaaaccacgatatagccttgccgagccttttcggctttttgtacactgtcttgtcaaaccgataaccgaaaacccttgcggtaacagctatcgcaaggccgtataatataattatgctcgaaagcgactgcacggatgatactatctgactgtcgcatccgctcataacagtgcctataagccacgccgccgcatctgcaatacaacgtgccgcaaatattattataagcgcaagccccgctttcccgcaggcgctcttgaaatcagcggcgcacatcaagcacctctcccgtttccagcatttcctttacatagctcggcagagcaaaacagcccttgtgaagctctgtattataatatcttgtcttaattccgagtgaattccagtgctgttcatcaagatcctttatcggatcaagtcccttgcttgcaaagccgaacagccagtgtccgcttgcgtatgtcgggatatgagcctgataaacggcgcacacggggaacaccgactttatacgctcgtgcgccctgcacatagcctttgcgtcatttacatagaacgggctttcgtgctgattcacaagcacgcctgtatcggtcagtgcattatagcagtttccgtagaactcgggtgtaaaaagtccctcgcccggtccgaacgggtcggtagaatcaactattataaggtcgtattcgccctgcttgcgtcttacaaaacgaagtccgtcggtaaaatgtatatcaagtctggggtcgtgcattgaaacggtcatttcggggaaatattcctcgcagacctcaacaacctttttgtctatctcgacaaggtcgatatgctctatcgtgctgtaacggcacagctcccttaccgtaccgccgtcgcctgcgccgataacaagcacgttctttatatccttctttaccgccataggaacgtgaactatcatatcgtgatagataaattcgtctttctgcgttatcattacatatccgtcaagtgcaagcagtctgccgaattcgagcgactgaaacacatctatgcgctgatattcgctttgttcactgtaaagctgtttgtcaactcttatagaaaatcttacactgtcgctgtgattttccgtaaaccaaagatccatttgtattaccgtcctttcaatctgtaaacgcataagtcaatgtggtacggcggacgaatttattcgtccagtatcataatattctttatttcgaggtcctgtgtacctgtaaggaaacagcccttatcccctgcatattttatatatgcgagaatttcgtctgttatctgctcacccggtgcaagtatcggtattccgggcggatagcacattacaaattcgccgcttatcttgccggagctttgttcgatcggtacgcttttcttgtttccgtagaatgcgtcctgcggtgacagcttaactataggattgatatactcgtggtcaagcatacccgtcttatcctttgaatagatacgctttatgtcattgagcgctccgatgagcctgtcgagatacagctccctgtcgcctatcgaaacgtaagcgagtatatttcctatatctccgaattctatctgtatgccgtatctgtcacgcagaatatcatacacctcgatacctgcaagtcctatatcccttgtgtgtatcgacagctttgtcacgtcaaaatcatagaacgcaccgccgtcgcacagttcctttgagaatgcgtaatatccgcctatctcgtttatctcgtcacgcatatactgcgcataggactgcacctttgcgaatatctccctgccgtgaagagcaaggtttcttctcgatatatcaaggctcgacatcagaagatagctgccgcttgtcgtctgcataaggttaattatctgccttacatagccctcgttcaccgtgtccgctgtaagtaaaaaactgctctgcgtcagcgagccaccgctcttgtgcatacttactgcggcaaaatccgcacctgccttcattcctgcaagcggcatattgtcaccgaagtagaaatgcgttccgtgcgcctcgtccgcaagaagatacattccgtgtgcgtgtgcaaggtcggctatcttcttaatatccgagcatactccgtaataggtaggattatttacaaataccgcctttgcgtcggggttttcgagtatcgccttttcaacatcctcgaccgtcattcccagcggtatgcccagctccttgtttactcctggattaacgtaaacaggcaccgctccgccgagaataagcgcatttatcgcactgcggtgtacgttacggggcattattatcttctcgccacgctttgctacggcaagcgccatagcctgcactgcggctgtcgttccgtttactataaagaatgcgttctttgcgccgaaagcctctgcggctatctgttccgcttcttttattacggaaaccgggtgacagaggttatcgagcggctttgacgagttcacgtccaccgtcatacattctctgcctaaaaattccgtcagctcggggttgcccctgcccatcttatgaccgggtacgtcaaaaggcactatgcgctttgcccggtattcctttaacgcctcatatataggcgcacgctcctgtgagagcatatcatcagtcctttcgggaaggaagtaatgttgtcataatatcacattgatatttttataggggaggggcttgcccctcccgcagatttattgtttatgtcttttgccggttcatcagtcaaaagtgtgagatccgctcacccataaatattcatccccgaatatatctctatcatctcacgccttaggctctccgtaattctcagtcgctccttaggcggaatgtcatatatatccgtattgaacaggtagtttttcagatccatttcacgcaccataagccttgtgtggaatatgttcgcctgatacacatttatatctgtagcgtcatatttcgtcagcgtataatcgttgataaaatcctgtatcgaggttatatcgtggtcgagatacagctttcttccgcctacatcacgggtaaagcctctcaccctgtagtctatcgttataatatcggaatcgaaactgccgataagataatccagcgcattaagcggcgaaatctctccgcaggtcgaaacgtcaatatccaccctgaatgtagaaatactgttgttcgggtgatattcgggataggtatgcaccgtaacgtgcgacttgtcaagatgtgcaaccaccgtttcggatgacagagccttgccggcaccgttacgctgaggatggagcggctttccgtccaccattcctctgttgcacgacttgtctatctccatactgtccgtagccttttcacttatcagcagtgttacgcttgcaccctgcggatcgtagtcctgctttgaaatgttaagcacatttgccccgattatatccgtaacgtcgcacagtatacccgtaagtcgctcggaattatactgctcgtcgatatagtctatatattctttctgctctcttgctcctttagcataacagacatcgtatatgttgaagctcagagtctttgtgaggttgttgaaaccgtacagcctcagctttttttccaacagacacacaacctttcggaaaaatatctgcaataaacgcagctaatataataatatagtaaaactgccctcttgtcaataaaaacttgtgtaaagaagccgccgacggcttttatgctcatcggcggctctgaatattatttgtttaatttgagattacacgttatcctgaccgggaacatactcaaggctgtcgtctgaagttgtaacctctgcagcttccttagactttatttctcccgaagtatcattcttatccttgaatacgaacttcagcaggataggagttactacagtagtgataaccaccataattactataggaccgaaaagtccgctgctcataaggcccatattaagacccttatccgcaactatcagcgcaacttcgccacgggaaatcattcccacgcctatctgtaacgcctctttgttcgtgtatctgcatatcttcgcaccaagtccgcagccgataacctttgacagtatagcgactaccagcagtacaacggcgaatatgattattgtaggtgtcatatttgtaagcgttaccttaagacctatgcttgcgaagaagataggtgacaacagcagataagacattgtatcaaatctgtgtgcgatatacttcgtctttgacgtacttgaaattacaagacctgcaacgaacgagcctgtaatatcggcaacaccgaagaattcttcggcaacatacgcaaagagaaggcagagcgcaaagctgacaataacataacggcgctgattttcttccgttctctgtgtccacttgttgaatacgaagtggaagaatacaccgaacagcagagcgaatgcgaagaagccgagtatcttcagtattactataccgatatttcccgactcgggatctgcaagagatgtaattaccgtcagtgcaatgataccgagtacatcgtctataagagccgcaccgagtattgcgttacccgctcttgtgttgagctttccgagttctttaagcgtttcaacagtgatacttaccgatgttgcagtaaggataacacctacgaaaacatcctgcaggaatgtcgatgtcgaaagagtgggatctgccgtaccgaacaggaacgctgtagcggcaccgccgaccagaggaacgataacaccgataagagctattatcgagcttgcaagtccgcactttttcatctcacggatatccgtttcaagacctgcgacgaacataagcactataacgcctatctccgacagattgctgagtatcggagcgttgtcaagagatacaaggttaagacacacagggcctaaaataatgcccgcaaccagtgcgccgactacctgaggcagctttataacctttgacagcagtccgaatgcttttgtgaaaatgaggattatcgctatataaagcagatatgtgtaatccataattcatcttcctttccgtttgttctactttttcttttcgtcacaaaggctatatcgctgctgtgcgatatagcccctgttttttctgtatgcccgtattataacacctatttagaatatgtcaatccgccttgaatgttaaaacaaaatttttcgtcaaaatctatgaatttaccaaacaaaaatgttataagtggataattttcttgacaaatttccatgaattttttgaatggctcgttattcatttttgcaatactattatttgtaaagctgacatttaaagcattttctttttcggctgaattctttcaaatcggcataaacaaaagcgttgcaggatttttacattcccgtaacgcttttatgattatgaatttttcataaatatttattcagcatctgaacatttcagccgatcttttcgaccatacatacagcgtgggcggctataccctctcctgctatgccaagaccctcctcggtagtcgcctttacgtttacatcgtccgtgtcaagtcccaaagccgccgctatgctcctttgcatatcgggaatgaactttgcaagtttcggcttttccgcaactatcgttatatccgcattcgtaacgtgagcgtttttcccgtcaagcagttttctgacgtgttcaagcagcttcatactgctgatacccttgtatctgctgtcgctgtcgggaaaatgccgtcctatatcgcccagtgccgccgcaccgagcatagcgtccataagtgcgtgtaccgcaacatctgcgtcgctgtgaccgagaagccccagattatccttattcggcacatccacaccgcagagtatcagctttctgccctctacaagcctgtgcacgtcatatccgtgacctacacaaagtttagatgcgcctgttttcccgataatatattccgccattgctatgtcctctttcgtggtcagctttatattgtcataactgccctcaacgataaacggctttatcccatacagttccattaccgatgcatcatcagttatccttgcgtcattcacatcgagcttttccgccgccgcaagatagtcggcttttcttgccgcctgaggtgtctgtgcaagccacagaccgcttctgtccggagtagctgtgacaataccgtcatcgcatatctttaccgtatccttcgctcttaccgccgccagtgccgcaccgtgccgaaatgcctccagcgcaaccttgtctgccgtctttgccgtcacaaaaggccttgctccgtcatgcaccgacactacatcgcactcgcacgaggtctgccttaccgctttcaccgccgactcaaagcgtgtcgctccgcccgtgatgatttttatcggcttatcggtatttatgttttcgcttacaagctctctgattttatctgtattatcctcgcttgccgctattattatttcatcggcgttgctttcgacaaaccgttctatgctgtacagtataaccgccttgccgcaaagccgtgccgtcatcttgtcaaaacccatcctcctgccgctccctgcggcaagtattatcgcacttgtaaacatacctctgctactcaaaacatggacaaatatatccatattgagaaaattcctgcttctacctatatgcttttgtattattactaatactactcacaagttcctgtatagtccacaggcgtaaattcccgattagccatcggtacacacttacaatagcttgtttatgctatgctgtaagtttgacaatctcttaaattaagacttgcattgtaatctctatcttccgtataaccacactcattacagtgatacgttctatctgataatttcaaatcagatttgacactaccacagcaatgacaagttttacttgaaggatagaaacggtcaacaactcttaattcaattccatattcattacacttggcaagtagctttgttctgaactcaaagaacttctgctgtgcaatcgttttggagagatgtctgtttttcatcatacctgacacattcaaatcctcaatagtaatccacattggtttggttttcaccaattctgatattactttgtttacataatctattcttatgttgtcaagcctctgatagagtttttgtacctttagcttttgcttttggatattttgtcgagtagcttctcctttcaaatttttattaagtttcttgtagctttcgtatttcctcgataagctacgttgttctcgcctaagtttcttttcgagtttccttatttgagaacttttgttgatattcttataagttttgccatttgagcaaatagcaaaatcttttaaacctaagtcaatacctatcccaaattcattcaatacaggcttttgttgttcttgttcatcaactaaaacagatacataatatctacccgctttataagaaacagctccgcttttgattgtatgtgtattggggtttgtagggatataacctttttcttttaatcttacccaaccaagtgtaggaattgtaattctgtgtctttcacaagggataattgcctttgcatcggttttcacgaaatacatttttacatctgattttgctttcttcttaaattctggaaaatgtgatttccctttgaaaaaattcttaaaagctctttcagcgttcataacgctttgtttaaccgacttgctactaacttcttttatccagtgaagatcagggttattaggaatgaactcattatttaaccacttagaaaaatccattccagatacaaaacgtttatcgtttttatatatctcttgattgtgagcgagataaaaattgtaaacatatctgcaaaccccgatagtgcggttaattatttgtttctgttcaggggttggatttatttcggttttgtaactctttagcaatttcttcgtccccttcaatctgttttttatacttccttatcccaacgctgtaatgttttaacagacacgcctatcatttcagcaaactcttgtgtcttataattactcatataaaaactcctttattttccttatgagtacattgcatcatatctgtctacgtttgtcaatgatttgctaaattatttttcttctcctttacgatcagtcaaaatgcttatagttgccgaggaacttgaaatacttcatttcctcctcgagtatcgtcataagccttactacctcagggtcaagcgcatttccctcaaagtcgagatagaacaccacatcaaacgtttctctctttatatcctgctttgcctgcggaacaggcgcactctctatctttgtgatattaaggccgtacagtgcaaaacgtatcagcattctgtacagtgagcctgttgtatgaggcagtgacatacagatagaaattatatctgcgtccggtgtcacctcaggccgctttgatatgcatataaaccgtgtggtattatccgggttatcggcaatatcacgctttaccgtttccagtccgtaaagctcggcgcatctttccgagcatatcgccgctatcgtgttatcatcgctgtttgcgaccatttctgcggcaagagccgtgttcgcataaggcacctgtcttgcaggatattccttaagaaatccgaagcactgctttagcgcctgctcgtgtgaataaattgtctttatatccgcaccgggctttgcggcaaggcagtggtttatctttatctgggtacgcttacagatataaaaattgtacttcgcaagcaggtcgtaggtctgccttatatctcccgccgtgctgttttctataggcagtacaccgtaatccgcacttccgttctctaccgcctcgaacacgtccgaaaaatcagggtaaaaatctatttcagagtcgggaaacagcttcaccgatgcctcctccgtattactgccctttgttccggggcaggcgattcttaccggctgtgttttcgggctttcaaaatgcggcacgggtgcgtcggacaatattctctgctgtaagcattttgatatatccattatacaggtgaaaagctgacctgcgccctccgccagatcatctggagattcgctctttatacgttcaagtatttcctgctcacgctttccttgaaatacctgcatattgttttccttcttatatttggcgacccctacgcaaagctccattcgcttaaggaacaagctgagtatctgatcatccgttgcgtcgatctcttttcttattttcgcaagatccatttttattctccgtttctttatttcggcatttatacattatacagcaattgccgcagagcttataggaagtcctgcgacaatcataattttttatcagttcgtttttgatgatgttgaagatgatgaagacgagccgtccgactttgcgtagtaaaccgtaaccttttctgaatccttaacgtttaccgtttcgcctatctccttactgcatttaacaacatatccgtcctttacgccgtgcgtatcgctcgttgccttcttctcaaactttacattcttctgtgaaagcagagctgtatactggtcaaccttaagacccgtataatccggcagctttattgaagcgggacccttgctcacaacgagtttaatttccgttccggacttgatttcggtatcgggctttatgctctggcttattacaataccgtttgctaccgtatcgtcaaacttgtactctgcggttattttgacaaagttatatgtatcctggatagaagtaaacagtgcacctgtgaaggtgggacatccgtaaactatatcgggcgcagtatctgaggaaaccgtagtgtttgaagtggtggtttccggagcgctcgaggttgtcgtgctttcgggagcggaataataattgggatctgtcgagcttgtgttgcccttatccgtgattgcaagtacagttatcgctatcgcaaagcctatcacgatgaccgcacatacaattatcgttgcgataacggcaatcttgttattctgcttctttttctttgcgttagacgattttgtgcctgtgggagcgggcttcacttcttccttcgtttcaacctttctgacacgctgaacggggcgcacaggctcctgctctgccatattgaacttaggctgttcaaacagctttacaacaagctccgttatagtctgtatacggtttgacgtattcagcttaaggccgttcattataacctttgaaacgtggctcggcacatttctgtttatcaccataggctcggggcagttatcatttcccagccttgaaatagattctgtaggcacacagcccgtcagcaccctgtataaagtagcagatatgccgtacacatctgtccacgttccctgccactcggctgaggaatactgttcgggagcggaatatccggggtacatttcgcaggcgatctccgtacctgttgttcttcctgcgcttatctggaaatctatcagcttaagctcgttcttctctgttacaagtatggtctgcggactgattcctctgtggattatccctgccgaatgcacaaggctcagcgttgtcagtatcggagggaaaagctcctttactctgtcccagctaagctcgcccgagcagttcgcaagataagccttcagagtaattccgtttataaattcgaatattacatacgccgtattgttctgggggaaaatatcaagcaccgtctgtatatgcgtcattgagcgtgccttgagcagtgccttgttaagctcaacgaattccgacatatacgttttataaagcggaagcctgttagcatcaaccactatctgaggatcgcccttcttgcgtgagcaaagcgtatccggcatatattccctgacggtgacctttgcaccagtcaccttgtcgaagccgatatatgtagcgccctcgccgttatagctgagcagttttcctacaatataacggtcgttgagtatcgttcccggtgccagatatgacggcagataaggagcgtcattgctgtagccgcacttctcgcacggtccgtcgctctctttctcgttcatacaacctaaacacagtctgtttatctctgtcattcagacattcctttcaaaagagggttaccctcgcaaagttttatgtatataaccgccgtctaccgacagtacagtctgttgaaaaacctatataactttttaaaatgggtgtttagcgttgcttgctctgccggttttgcatcgtgcaaaacttttggcaagcaaccaaagcatccttgctttgggcgtagccccaagcggggtgagggcggcagccccacactcagcccctttccttgggaaaggggtttggggatagggattgtgaacaagcaccttttttaaaaacagactttttctacaaactgaaccgccgtttacagcggtaattctataattcagctactatataataacttaaaaaccgccggatgtcaacgcttttaaccgatttgtaataatattgtaacttttttaaaaaaatcggtgttaatttaaataatattggcatttctttctataaattattttgtgtaagttgacaaagcctgcttttaacgctatactgaaagaaaaaattctgatagggtgataactatgttcggtaaaagcaaacgtcctaaggatacaatgtccgtaaaggatatgacacggctcgacaaaagaccgctgaaatacgtcacaatgcgtgaccccgaaacctataaggaagtacggctcggtgaaaacggcgcagtgaatataatggacggcgacttcgtccttgtgtgtcttggcagggatgtaatgcgctgtgacctgacggaagtgcgtgtaggcgagcttatgaacctgtcgggcataacggtcaagggcattgataaaggaacaggtaaagaaatgtcggttatcgcatactttgcagataaattctgatgcgacaaaaaacaggtttgttatttttgccaattccgcaaaacgatttttgtgaataatttacaaaatatcatatcgagtgataaatgatataaatatgcgattgacatctttttttgctatggtataatttaaataatatttaatgcgtattatttgtgtgttattatcacattttattccgctgtccgattatcaattcaagcacaaatttctttcaattatattcttacgtcgaggtaaaaagatgtcctgttatttttatattctctgcaaatactggagaaaacatttgcgtaccgctctgtcactgctgttttccggattactgctcaccgcaataatcacatcggtttttcttttcattcgtgaagagataaaccgtgaggtcgaaacgggatatgacaccttcggaaaatatgatcttattctgagtggcattcccgatgatataaaaaacgagctgatcccttcagacctgaccttcacgcacgaaaccgtgaccgtaccgggaaaagccgatttctacggcaaggaatataactacggctatacggataaggcttgcaatttacttcacgttccgatgaaaaacggttcgatgcctttttttgaaaatgaagccgctgtcgagcagtcgcttctcgaaagtgtcggttatctcggaaaaaccggcgacagcataacaataaacggcaagcagtatattcttacgggcattatcgacaaggcgtactccgaaagaccgctgtgcgaaaaagccgaatataccgatgacgatgagatacctcccgatccccttcctcttatatatgtcggaaaaccgtcagacactgcgacaacaggctacactatcgacctgtacggaggcggcggcattacagtcaaaaataaggaaagcggcgagctcagcattttcgggatttccgaccgtgagtttgttaccttgattgaagaaaaatattcatcgcaaaacggcgatgacgcatatttacatttctacgcaaacaaccacgaagaaaatatcaccgatgaacagcatcttatcaacagaaatacgctctggcttattattatgtcgtccatttgtgcgttgattgccgtattgtcttttatctgcgtgcttaatatagttttcagggaaagagaaaacacaggccgtcttttgcacaatataggcttttcaaaaaccaaaagcactattatgtacgcaaccgaagcggttatgctttttgtcgctcagaccgtgttcggaatagccctcggcatactgttctattccgtttcctactccgtgcgtacaggaattatgggtatgagcggatacagcgcctttacgaccgatcctatcgttctcggtgcgaccgccgacccccttattatcgccgttatattctctgcaataaccatcacactcggataccttgtgtttataccgatcactctttcgtcaaaaaagcaaaagaaaaaaagattactccactgttcaaattcggcggaaggtatgctttcacgttcgctcggcagtaagggcataacgcttatacagaccgtcgctctgtcgctgatagtattcggtaccgttctcggctatatgcgatacacccgtgacggaaaggtagtaatgaactggcttttgtttgactttccgccgacctatactatcggttcgcttgattcactcgatatggaggaggacggcatagccgattatttatcctgccctccgataacggcgacctctctcggacaggatgaagcacacaaccttaaaatagcaaattacggctacacctacggtctgtctgacaacgacacggaaaaattcaccgatgccctgtctttcggatatatcgaaaacacctttgctgtgtgcgacagcgaaacccccgcctataaaaacagccccgaaacggcgcttcagacagatgatgacacgatagcctccgtttcagagctttccgacaaagaatataagagctttttcggctcagacggtatcggtggcaaattctgctataatattccgataagacttgccgatgaaaagacgctgaatgagctttcctcatatatttccggcggcctgcccgacatttccgcacttaacagcggagaaaaggtcattatggtgcaggaaagcggccgtaacacctataaggtcggtgacagcattcggattatgggcgttaccgcaaacgacagtaattacggcataggcaaggtagcagaccataccttcaatatcggcgctacgctaacgctgaacaatttgtcggataaaacgctccgttgccttttagatttcggctttcaggaaaaagaaaacagcggatgtttcctgctgaccactgccgcaggtgcggcttcttcgggcttctcaggagcggtatacaacagcgtctattcatcgaccgatattgacggcggccttgttccgccggcggcaggtatgacccgtaccaatttaggcgagatgaaaaggcaggaaaccatagacaaattcaacagaatgtcgggtactctcgccaccgttcttataatgtcgcttctcggctttgcggcttatttcagctgtatcggacttaaaataagaatgaagtcttacgaaatatccgtgcttcgtgccttaggaacaccgctttcacggatacggcgaaagctgtttatctcaaacctcagaataccggtcatagcgaccgcctttgcaggtcttgccgcttacggagtacagctctttacaaacaggatgtacgacaaggtcgatattatgaaagaacagcttgaaagcggtatagccgattttgacgaatcggcggcttcggatattataaacaactgttttctgaatgatgaattctggatggttccccttataaaaccgcttgttataatttttatcgccatctcgataataaccgttatactcactgtgctttcaacaaaaaaattcacatctgaaatttctgttcaactgaacgaggaaaggaaaaggcaatgattacaacaaccggacttacccgtatatacggcaaaggcgaaaacgccgtgaccgctataaataacctcgatatacgcatagatgacggagagcttgtagcaataacaggcaagagcggaagcggaaaaaccactctgctgaacatactcggaggactggacaaggcaacaggcggaagcgtttgctatgacgataccgacataacaaaactcgcagatacggcactggcggatttcagattgaacaagattggctttgtgttccagttttacgatctgataccggagcttaccgcaaaagaaaacatacttcttccgtcaaagctcgccaaaaagggcaaaaccgatatatcggataccgtaaaaaagctgggtgtcgaaaatctgctcggcagatacccgtcagaactttcgggcggtcagcaacagcgtgtagctatcgcaagagcgcttgtcaacgacccctcggttcttctttgcgatgagcctacaggcaaccttgacgtttcgacaggaaacgatgttctttcgcttctcatcgacctcaaccgcaacgacaaccgcacaatagtcatagtaacacacgataatcagcttgccgaaaaatgcgaccgcattatccgcatttcagacggtaaaatcacagattaataaacagccgtatttgctcataaaacaaatacggctgtttattaaagccacgcagtgaaatatatcaccaacaccgctgaaagcatttcccataccgacagggaattaataatttcgtgagtgtatctgtacaactgcactgacattgactcttcaaaaaaacgccactaacctgagatatatgtactaatatgcggacgtgtagcgttaagcgtccctgatttgacaggatatacaatgttccggtggttattctagttccgccaacaccccagcggggtaagggtatgggtaaggaaagagggagccacgaggaagaaaacctaagggacagggtatagggctgagcactaacctttggcaagtgctcaatcgtttcgctttgcttcactggccgattgttgggctttaatgctgttttcaatatcgacgacaagccggattttcttatcttcccgcagcggctttgacttggcaatatatacgcccttgatacgctcctttatggcttcttccgtataggccgcgccgagcgtctttgcgcgggtaaaccgttcctgtccggcagcgcggaaagaaatatatttgccctgtttgatttcataccccatttcctgcaaacggcgcagcagttcgtcaaaatctttgacttggggaatgagggtatctatcgccgttttcagcttggctttgtagcttgttccttgcttttcggcggtgtattccgcatagcttttccctttgtcctgtcccggcacgacgacggatagcccatgctctttacatatcctgtcgctggtgcgtcggatagcgtgatagctttgcttgttggaatgatactttttgtagtcaacgaagctaaccgcgttgaaaatcaagtgattatgcagatggtctttatcgacgtgggttgtcaaaacaaactcatacttgccgcctaacaccgcttgcgcaagttccatgccgattttgtgcgcttcttccggcgtggtttcgcctaccgcaaaggattgtatcaagtgccgccctaaatgtgtgccgcgatctccggcagcttcccgcgtccatgcaaactctatatcggcggtttccagcccgcagccgaaagaggacgcaagcagctttccgtctgtcttttcgggatttaagatatagtctattgcggcctttaaggttgatttaatagggtgcgtctttgtaaccgccatatctcgtccaccgccttttttatatcctcaatgtcctgctggtaaaccgcccccgtcgcgttggcgcgtttggcaatttgattgatgttccggctcaccgcttgcagttcccggatatatgctttcgtgtcgcttcggtcaatgacaaggatatacccgtcaatcgccattttgcggaagtatgccccatactgctttatgggaagctgcttcatcttctcgtcgatcagccgcttttcttcttccgtaacgtaaaacttcatttggatatttctctttcggttttccatttccgcgccgcctttcggtataagggtttgggattatcccaacaagcatttttcgcaaacgggtactcgtttgctgtgcttgctatctactccatacccctaccgaaaggcggtatttgttgcgcattcccttgattttggacgcaaaaaaagattgcagccgccatgcgctgcaatctcccgatttctcatattgtgaggttaatcctctgctttttcgacttccgttatctcccttgctgttgcggttacaatccgtatgcctttatcgctcataccgtccagcagcgcgtcaagctgccgccgcccggtggatttctccgcattgctgttcgggaagaaaaattgatctaccgaaatatgataccgggttacaaggtcatagaatacctgtaaactcggctgttgtcccttgttctcgatattcgcaaggtagcgcggggaaatatataactcgtcgcttacctttttgcggctctcgccgtattcatttctcgcggcttttatagctgccccgaaagccttaaagtcgtacaatggtacgggtctttttgccattttcattcaccctgttacattttacagttcacctttctttttggatatgtccacacaattcatatcattaggttaaatacttcctgttgtgtattgacagtagactgattttctgataaaataaaatttatgtaaaaggaggcggcgtttatgttgcatagcatgcgtattagataagcattgaaaaaaaggattttcccattttcaacatgggcttttttgtcatgcttattttgcggatgctatacaaaaaactaacgacgtatagatatagtgcaagctatgccttagttttgttgtactgctctgtgcatttttttgtgtaaaaaggacgagtgaaatataatgcttaaaaaatattggataaaatgtccgatttgtaacggaaagacgagagttcaagtatttcataatactgtattaaaagattttcctcttttctgccctaaatgcaaattgacgcatatcattgatgtagaaaaattagagattgtaatcaaaaatacagaaaaacaaacttttattatttagaagaaaggatataaaaatgaaacgtttacctaaatatacgcctgcggaagtacggaatgatccatacggatttacttacaaagaaatgtcggaagttattggcgagaatgaagcaaaagccttatatgaagaattatataagcaattaccacgcaaaaaaaatctatcaatgttggtaaaaaatatttgcaaaagcagtgatactgaaaagtatgtttacgaactgaaagacaacaaatacattgaaacggtttttatcaagcggcgagatggtggaactgtttgcgtgagcacacaagtcggttgtcctgttggttgtattttttgtgagtccgggcgaaatggctttgttcgtaatctaacatcgtcagaaatcgtacaacagattatattgttgcgtcgaaaagtaaaccgtatcgtttttatgggtatgggagagcctttattcaattatgacaacttgataaaagcaatccatattctccgagatagatatgggctcaactttccaaccgacggcattaccatatcaacagttggtccggtcgatcaattaaaaaaattgcgcgaggaacatcttaaaattcagttgacaatatctttacacgcagcaacacaatctgcaagaaatcgtattattcctcacatgcgcatatatgctattgaagatgttgttaagcaagccttatcctattctgaaaggcataatcgcaaaattgtctttgcgtatttgcttttaccgggtataaatgaccggccctcagatgtaagacaacttgcaaaatggtttcggggcaaaaaagttatgattaacgtgttacaatacaacccaacaagcaattcaagaattaaagcaccacagaaacgggaaatagttgcattcaaacatcaattagagcaagcaggacttgaagttactatgagagtttctcatggcagagagattaacgcggcttgtggacagttagctaacacatataataaattcaaaaaaaaatgattaaaagtgccagacgcatagacgcagagccgataacgcattaggtcaaaaaacctatgtgttatcggcttttttatttaatattgcgcaaaagccgctgttccctattatagaatggattgcgggtagtgtattaaagtcgcccttttttaaggatacggcggtatcggggaggtatcgccgtgtccatttttatttactgtaacccgcctaatgctttgcggtcaaaaaaagctatgctccgcaagcgggatattccggctatgaatgtgaactgtcaatacatttagctactgcttacatttcctttgcgcccgtccgcgtcttgcggacgggcgcattttgcttttttcaacttttttctgaaaagcgcactcaagagccatctcccgaacgggtacggagcgaaaggggcagagaggacaagcccttaactcccgtcctctactccacgcgggaaggaggtgaactctatggagctatcttcttccgacaaggaaagaatacaacatcagtacgacgcattagcaaagaaaactttggtcggcgaagcgaaaagccaccgccgcactcttgcgaaacgcgcagcacgcgaagttactttttcggatttgagcgaaagcgaactcgcgcagcttttcacaacggacgaatacgaaagcgattatttccgttttcaagtgtccggctttgatgtactcgtcaaaaatgaactgcttgccgaagcccttaacgctttgcccgaaaggaaacgcgacattatccttttgtcctacttcttggatatgagcgacgcggaaattggcgaactgctgaatgttgtacgcacgacggttttccggcacaggaaatccgcgcttgcgaaaatcaaacagtatttggagggaaaagcagatgatgaataccgttaggaagtctgaaaatctgttgccgttccctgtcatttccgcagcggcaaacggcgacacaaccgccatgtgcgcgatcttgaagcactacgagggttacatagcgaaactttgtacccgcacgctgaaagacgacgcgggcaatacctattcctatgtggacgaggaaatgcgtaacaggctgcaagtgcgccttattacccgcacccttgcttttcatgtaggataatcttttagcccatgcggggagcgtgtcccctttccacgcttcccgttatgggctatttgtcgttccgcaaaagcatatccgctgttgatgtgcttttgcaggccgacaaagcctattgttctttgacaaagaaagcggcctttggtgcgcagcataacaggcaaacgggtacattccgtctgtaccgagccagtcggcgggtacgccatgacagcttttcccctacggggaaaagtcgagcgacaactaccgcgccgtaaaacaggtttagcagcttgtgggcgacgacatacaaggcggcacaatgatactcccgcgttgaacaccctcaaagtattgcgcggcgcacccataagcatgggccggggtgaaactcccgtgaggttgcagctaacaaccgcccgtttcagccttatttctcatatcgtacaagccggagcgcatattctgtactatgccgctaaccgggagggaaagaagatgattaccaagttacaacttcaacaaatgagaaatgttgatattacacaggttgaccgcagcactttggttgatattcgtaatatccatattgacagttctttgccagcagcaaaaaaaatgcaaagctacttggagcagatcgtcaatccgtattgttttctttgcggcgatacgcccgtaagaatacggtttgtcgcagaggatagaacgctaaagcaatcattgtgcgattactttttaagtctgaaataaccgccgactttccctaactctatgggtaagaccttgtgattacggggcgaaaatggtataattaactcgtaattatagggggaaaggaggtataatgccccgcatacgcaaagacaaaatggcacgcagttatgcagagccgttttggaaaattgggctatacattcgactatccagagaggacgacaacgaggacgaaagcgagagtgttatcaaccaagaaaagatactccgcgactttgtagacagctattttgagccgggaacctatgtgattgtagacgtgtttgccgacgacggattgacaggcaccgacacagcgcgaccaaacttcaaacggcttgagggctgcattgtccgaaaagaagtaaactgcatgattatcaaatcccttgcacgcggtttccgcaaccttgccgaccagcaaaagtttttagaggagttcatacccattaacggtgcaaggtttatttgcacaggcacaccatttattgacacttacgcaaatccccattctgcaagcggccttgaagtacctattaggggaatgttcaacgagcagtttgccgcgaccacttccgaagaaatccgcaaaacattcaagatgaaacgggagcgcggcgagttcataggcgcgtttgccccttacggctacaagaaagacccaaacgacaaaaacagcttgattgtagatgaagaagcagcggaggttgtcaaaagcatttaccattggtttgtcaatgaggggtacagtaaaatggggattgcaaagcggcttaaccaaatgggagagccgaaccccgaagcctataagaagaaaaaaggctttaagtataacaaccctaattccgacaaaaacgatggtttgtggtctgccagcacgattgtaaggatattgcaaaatgaagtttatacgggcgtaatggtgcaaggccgtaatcgcgtaataagctacaaagtacacaagcagatcaacgtccccgaagaagaatggtttgtcgtccccaacacacacgaagcgattattgacagggaaacattcgagaaagcgcaagccctacataagcgcgacacaaggacagcccccggcaaacaggaagtctatctcatgtccggctttgtccgttgcgcggattgcaaaaaggccatgcggcgcaaaaccgcccgcgatattgcctactactcttgccgcagctacaccgataagaagatttgcagcaaacattctatccggcaagacaagttggaaaacgcggtattggcagcgttgcaaatgcaaattgcccttgtagatcggcttgcagaagaaattgaacggattaacaacgcgcctgttatcaaccgggaaagcaagagattatcccattccttgaaacaggcagagaagcagctaaaacagtacaatgacgcttccgatagcttgtaccttgattggaaaagcggtgagattaccaaagaggaataccgccgcttgaaaggcaagattgcagaacagatacaacagcttgaagcgaacatctcctatctgaaagaggaaatgcaggtaatggctgatggtatcggaaccgacgacccgtatctaaccgcctttctgaaatacaaaaacattcagagccttaaccgcgggattatggttgaactcgtaaaagcggtttgggtgcatgagaacggggaaataacggttgacttcaattttgccgacgagtaccagcgaattattgattacatcgagaataaccacaacgttatccgagtgattgagaacaaggcaatctaacggcttgcctattcaacacaaaggaaaatctaatgttgtgcataaataaacggctctacagtaccatctaccggataaccttctgtttcggtccaacttagaatagttttctcatcagcctgccatgccagctgattcagtttttccagctctttccgaagccctcccactgtaccaattgtggctgtatcgttggtaggaagcggcccttgaaacaggaagctgtccgacaaagggatccaccaggtagcaccgcgaaacaatgaccaaacccgttcttcatctcccgaaagacgggcgataacagggttctccatgaagtcccagtctttttccacagtaggtggcaccggttcctcgtatgtacgacaggcggctaccagcagcatggcgccaaaagcatcccagtccggcttgtcggtgtagtaaggcttttcgttatcttccggccacggtgtataaggttcatgtcccggcgctgcaattgccgccagaatctgatcccgccagttttccacgatatcctgtacttcagcaggcctcatttcttcctcctcatcatcaaccgccgcaccatccggcgtgattttttggaaggtatagccgttttcttccgcccattgttgaacagcacttttccagttatgcgcgtaatatcgtgtcagtgtgccagcgtagatatcaagtcccataagtttttctccttttctgttatatcaaagtagctccagagtacaatcatgtccagaaccgttagtatccaaaataatttctgtaatggtgtctatggtctcttgacccagatcgcggacgcttttttgataggcaatccatttgatgtgaataggctccccatactcatgccgtccaaaaccgccccggagaatatcattaaaggcatttagatttcgcccaatcttccaattaagaccacaggtaaacacttgttctgcttcatcatagaagccagccatagttgaaaagtggcgaccgtctatggtgaacgcctgccgctgtggttgctttgccagcatggtatccctccgttcttatatcatttcatacagcagggcagtgtcgtcacggaccagctccagatgggagcacagtgtttccaaaccgctttgcactgcctcgacagtcaaatcccagtctggagcaatttcgacggccagctctgggagatcctgttcccgcagagcttccaacaaatcagacgccaaatttccctccatcagagcacagtccagagtttcctctgtctgaggagcagggaagcggacatctatatccagttcgctctcgcagtagtcccaaatagccatataaaccgcaccggagcagttgccattggataactcctgccgctggttatttttaatcaaataaaaggatgcaatctgtgacatggtggttcctcctaatctttattccttttccatcagcccttctgcctgcatccgaatcacatagaaggcacgcacccattccaactcctgctccatggattcctccaaagccagcaggcggcgctttcccagcctacggtccagaagggagaagatacggacgaggggattctcgctgacaaggctttgctcaatgctctggttgtcaaatttgtgaaacgcctcatagaaaaaaccgttgtcaaaacagccgtcgttcagcgtcccttcatgggccagccggaaaggggttttcgggtcatcttctccaacgccctcacgccgcagggcctgatatctgttccagtagttctgttcataggcatagtagttgcttcgcaacacctccacgccgtccagtcgaatggccgcccggcctgtttggtcatggctttcccagtagctggtggcaaaatactggatgcggccccggagcgccgggcacaggtaatcattttccagtttgttccgaattccgctccaagttgacataggcatcgcctcctttctgttgccgcctgcaggtgttgcacctggcacaggctttgccttttgtatttgaagtgttatccgttgaatccgccgacttcaattttatatttgcagttgacctcgatacaaactaaatgtcccatgaaatagtcgggttccgcatccaaatcgatgtaaaagccagtttcacttccatttacaaataccgttacattgtttacaaacagtgcttttacaaactcatcttctgaaatcttcccatccgcttccagcgttccatcttcgatcatttcattcacgacgtctatgcagtcatcgttctcatccaaaaatgctcggataatggtatctttatggtcattgacccaatttaccttttccaaaacgatatcgcctatatttccctctgtgctctgaaactcaaggagaactttagtctttctatcccatacggtccattctccaacatgaaagccgagtttgtggtcaaatacaaattccgtatttcccaaaatcattttatccggcatttcgacccttttcttcaaaaacagtcccataatacacctccaaagattccaattgattgctcagtaggataacccattcgcttgctgcttttggagatactcccggaagcattcgatgaactcccgattccgcttagggacatcgaaccccttccgatggggaaagaacccatcccgttccacatcgtccagcagcttgggcagattggaaaaccgggtaaagaacggcagagcatagtcctggatctgcccggaaatctcctggatagagcgttcccgctccagcagagtagatacctcataacggggaaagtcatcataccggcgggtcagccgggcgatggaggtacccacgataccatcataggtttcctccgtcccttcccgctcactgcgccaccgagcaatcaccggggaactcacatcgaagaaggcagtaaaagtggtggagccaaagcggatagagggggaaaagtaaaaggagaacacaaagatgccgtcttttttgtagatgtcatttttgctcttgcggtatttgtagcccagcgggatcaaaggctccgcaatccgctcacaagtatacacaaatattccccttggttttgttcccttgggaaaatcctttttctccatgttgccaccttccttcacttatttatagcgcagttctcatctgccacgcggatttttccttttttcagtgctcattgagatacctcgccaatttcttctccagcagttctgtcatatcattgcagagtcgctttaccttgtcctgctcatgggcgtagtaccagatggtttcctctccagggcagagcagaagctggtcaccgtctgcttctttccagaactcgcccagcacacaataacgatttccgtgtatggtcagctcgaatagcccagacaactcaataatcacaccagtagacacattgattcctgctgtcaacaggaaaaactcccgcacctgggccggaagtgcgaaatccagcacgctctcttgattcccgatctgctcctccgtggcggcaggctggatctcatcagtggagtccagcacctttgccaacgccttggagaactttgggtatcggccaaacagctccgggttgttggtcttgaattccttttgcttttcccgctgtactcgctcctgctctttgcagaaagcgtccagctcggccagatatcgctcctgatagagattgctggcctcaaatgctatactgttcttttccagaatagcaatggctcccttttggctgccaaacaacgggacccattgaaagccatgctgacagggctttagtttcagatattctccacggttaagcatactctccagttctgcctcgtgctcattccaccattcccgccagctttcgggggtttctcggccctcagcaaggtccagaagttttgttatcaatgtttctttgtccataggtaaatactctctttcccaaccttaacttccacattactcggtagcacaaagctcattcatttttggaatcagtaatttatccatccactgacaaacaatctcaaaggtattttcaattttttcttcatttcctatatcaggatatatttcattgtctcttaaactgtaaaacagtggttgtgtgttgatgtctggttttgcgtaaccataagggtcgtatggacgagtgttgattatatagcaaacctctatacttatgctatcctttgtgttcccgccgaatgaggaaaatgcaatcatataggtgaaatttttactgtgcctcgtaagcgttttatcggattttttatacttaaagcctaaatgtccgtactttccttgcaacttgcctccaagtatttgcattgcttcgttaaagttcattgtgcccctccatttttcatcgtaaaaataaatatagttcatttctccgtttcaggggcgcaggaatagatgctcatggccccgtaatcggtgtgcaggacaagctcgctttgggtaaaggcaaaattcacctgccgcaccacaaaggggtcatcaatggtggccagcagctggccgctgccggtatcccacacctctatgggggagctgccccgatcatgctgaaccgccatcagtttgcctcttgtccgtattgtacaggtatccgaaaaactcagaccctgccgaacagtaaagggaaaaggattggttgtttcttctcccgtctgactcacatagaatttgccgccaacagagaagatttgatcgtccggagaaaagaatggatgccatctatcgtttgagattattgttttttcagcagacttcaagtcaacaatcacatactcactctcagcgacgcggtaaaccaccttagtttgcctgggagagagcataccgaagcagtaataaacaaaattcggatcctttgactttttgcatttcacagtttcccgccatacctcagtattgctgccaaagtcaaagacgacgatctcttcgcctgtgtaccacatagccaaatcaccgctgacatccagcatagtcctcatgctgtttttcttgttggcgaaaggcgtgatctcatgggtatggagagagaactgctcaataaggtagctgttgttcatcagcagagtgtcatttggacagagaatctgctcataggtcatccgcttggcacccagagagaccgtttcaagtatctctccgctgtcatcgaagtgatagagggtctcgtcctcaaaatctccgaccacccttgtcagaaagaagtcatcccgtgtgagtgcagtagccaggggcatgaagccgttgctgtcttttccgacaaaacggtggcactgtgcttctccaatagcggcgtttggattctgataaacaaatcctttccgcatctgtcccatcatggcgctggccgctttgctcttgacctggaaggcagagtcgcacaaaagctccttgactttcccgccattcaaacaggttcggatagttaaaccgtcaatttcaatacaccactgtttgtttgtggcagggttgataaaagttttttccatgggtgcaggcacctcctcaatcgaaatccatccagaccaagtgctttccacagtggagacactggaacaaatagcactgcagatgtcctccattaatggattcctgaatcatttctttttgttcatcgtcccacatagggtcatccagcacttcctcaagcacaccaagcgcccgtagttctctgacacccacgttacccagataggcacaatagtcaccacaatggacacgccagtattcctgctgccagccggaatagccgggagtgcggtggatgagttcatcgagcttctctggatcgtctacgccatcatccagagaaaaatcgtcctgaaagctgccgtcgtatttccgtgccgcctcgccgctggcaatgcattccggacacaagtgctcaatattttctaccgaaaagaagggagtagtatagtagatgtgtgtggccttgccgcaacagtcgcagacaaccccgtctttagattcctcaaatgcgccagtttccagaggattggggtgataccggaaggtgggcagacccagttgggcctgcctctctttctctttctgcttttcctccggcgttttgggcttggggagggcataatgattgccccagttttccgcatattccttcagcgtgcccagccgcttgagtgtctttttatcggaacgatttccgatttggcagagcagttcgtaggcatccttcttgaagtccagcagatcatacacatccaccagcacttccttggcctgtttgtcttccgaatgctccagtttcttcttaaaggtatagagagcgtggatactgtctggatttccttttgtctctcgaaactgcttttggagttcaatatattgtttcaggtattcgttcatggtcacaatctcccatcaatcccaccagagataccaaacagtggactgccgcagcacatcagccaaagcacccacagtggcgtcctccggtccctggtcgatgacatcggggcagaagccatacatttccaccgctgtttccatggccttttcctcgggaacaggagccgaaagtaagaactccaactcgtcgtggctcatggcggcaggtaccgcgccatactgctcgaaccagtatttggccgctgccattagctttggtgtgtcgggacattcattccagtttccgaagggcaggtaggcaaagatctcccaggggttcttgactggaattttcgccagaatgagaggataggtcatgtcggtgtcggaatcccagtagcaggagaaacggttattctcatagccgccctccatctcgcccaggatttcctcatcccagtccatatcgtcatcctcggcttcttccttgcgctggccgatcaattcctccaaaaccgcctgtccgtctttgacggaggtggagagcatcttcttccggtactccgttacggttttgaggtcaaattcgtaaaagtccgcatcattgtccgggtcggcgttcatcaccaggcactccagcagcgtttcgtcatccgccttgatgagtaccggcacaaagccttcctgggcgctgtcccgcttggcataaccgtaagctgccatgatggggtcatcgtccttcatggaggggaaataggtacattcgcagtccagatactccataatggcccgggctgtatcagaaggctccagcgtgtcctcgtcaaagtcctgtccctgccagttggtgaagcgtttctcaatcacctttgccatggcctgatagtagtcctcgtcaaaggggatgaacagataggcttcatcctggatctcgtcggagtaattgcgctcctgtccgatgacactaatggcatagtcgtcgatatcactgggaaaatgggggctgtccggctccccatagtaataagaggcaaaggcccagccgatcttgttgaacatcgggccgaccagctgcccgtccagctcatcccggataaacgcccgcaggtctacactggcaggatcagccttgaccttttctactacctctttatactcagcgaggaattcttcacccatcaggtcgtgctccatgcaccaacgcaggtaaatcgccatgtggttgtaggcgctcagctcatccaccggcagattcttttcctgaatggtttccaggtgccagtcagcgcaatccatttccatcacaccgccgtcctccacgctgccaagtttgcccatagtcatggcgttgggacgggtgttgtaagtcacaaagctgatgccgtccattttgtccaacagagcgtctgcgtcatgctccatcttatattccaattcctctcggtagaggggaatcacctgatagaagtttacctcctcgccactcggcaggatgcagacctcgctgccatcttcggtgtcctggggaccggtcagcatggcggcgcacagctttgtgtcctttgcaaagtcatcctcattgtccatggtatggccgaagcccagccaggtatcgctggcaatgggaagtctggccaaggttttcagcaggcgaatgggccagtaccaccgctcgttcttcagatcctcatgctttagcttccagtttcccggcagcgcaatgaccagttccgctcgttccagcttgtattccgcaagctcctccggcacattcattcggtgagcacccatacccatcgtaaccagagtgtagtaatcccgttcctcagaaggcggaacaacgcagatgtccacatggatgtccggggagtccagttcgtgaaacacattctcgaacttgccgaaatactgctggatgtgctcctcgacggcattcatttcttcctcagtatagacctctggaacaccggattcttcgtcttcaggcctttcgccgtccgagtcatcctcatcgccgtcatccgggctgccgcctgtagatttccaggagattttcagagtcatctgatcttccggcagactgacaccgggactgcgagtgatggtgtgcttatcatctgctgtaaagccaatggtctccccatcctgaagttccacatcattctccagtacataggacacaaggcttgcaagaaaatcccgcagatcgcccggttcagcatcggtgcccagtacctccatctcatcttttccaaacacatccatgccgtaggtgtagccattcatgccattctcgtctctccacagaccgaaccagatccagttgaagatgggcagctcgtcattctgcatcatatcggcaaagccctcatagaaaccaggttcgaacaccacaccgctggtgtagacaccggtagcgtatttctggcggcagcaagcagctaccaccttagtgaacagcttgcctttttcaagcagattttcttctttgcccagcaccgccaccatgatgtgggcgctgtgctttttggcaacttttacggcatctggccacatatagttgttttctgcgtttacctcagcttcgccgccggggataggatagttgttcaggctgacagcggcaagcatgtcgcccacttcaaataccagtgcatcgtcgtccttctcttcactggcatcatactcatccacggtgatgtcccatttttctttcatatcccggatgaactgctccttgtcccacttgcctttagacaaaagtacaaatccggtaaaaacacctgtgtggtcactctcgtccttgacctctgcctcggctcgttttgcgatctccttttggcattcttgaatcacagtggcagcgtcttcatcttccggatcaagctccgcccagcgctgtgcgtagggaatggctttttcttcctgaccgtataggtactgatagccgtaagccattcgcatattccattctgctttgtccttgccttcttctcggacagattccagcacctcaatggcacggagcagcgccttgtctcccttgtatcggggagttccctcatcgtggtctccaatgatggcgtagttttccagcgcccgtgccatggcgtaggcaatgcggtagtcccgcaagtcttccggtacagtattcaacgcctgaatgcagcgggtgtactcgtcctcgtcgttccactgttccagctgttcatagaacgcctcggcgttctgtttcgtgtagggaatatagtccatgcccgtcagcgtctcgtccaactcgtcatcctgattctcggtttccggctcatcatcttgttgctttaggggcacagaacctgcttcacggcggaatgagtggaaaatagcccaggggatgtccgtaccttcaaagaactctttcgccatgttcagcgcctctcgaatgtcccaggcaatgaagtccacatagccgcagtaaataccggtagcgccgccggttaaggtaagaacttccgatccttcatcagtggtaaacactttctccaactcatcccggaaatcaaagatcttctgtgatccttcctcctcccgcagggtatccagaggatagcagaagaagcccgctaccgtgccgtcggcgtggagttgatccataaaatcgttgtcagcattcaaatagccgttgatgagtggcacacagttggtggagccgaccatcacatccagccgccaatcggcgtccgggtcttcattaggtttcatttcgtagccaagatagctctccagataagcttccggatcagtagagagttccagaccccgttccttcagatggtcgggcagttgggacaagagtatggacggctctgccttaggctcctccaacacatcaaaactgtctatgtatctcatatgggggatctcgcccagcacttggtcagtgagagtggtgagcatccaccagactctgccttcttcctcttgaagcttaggcagcagcttttcacagtaagcggagatggcaaagctgttttcaccctgttcctccagccagatctgcacatcatccccggaaatctcccagccatcattggttcgcagaccgatgttttgaacaggttgacggcccaccaggatgttccagtgctccagcacctctttcggagcgtgcttctggaagtagattagctcaaacagtttgactttgtcgccctctggggtgaggattaactcgtgcttttcgccgttgaagcccatctcgaaagaaatttcatcaaaaaccagattcagggttccctgcatttgggccacgagttctgcaccacgggtgcgatccttatcctcgtccatcatctggcgcaattctgcttccatctcggcaaaggtttcccaccagtcctctgtccgctcccggaagcactccgagaactgaggcagagaaatgcccttcttgcacccgtcgatcagctgcatggtgtcctcgtcgtcggggcgggcctccaatgccttttcaaagtaacgaagagccctgccctcctgatccagatagtaataggaataacccatgcgaaagttccagtagtagtctccctcaaagtattcctcatgaggtttcaagagagcgatggcctttttgagcatagctctgccttccggcgttctgtgatctgcttcgttgttgtacgcccttgcaagctggctgtccatttccggagtgcgctcctcaataccctccagtgcttcaatgatcttgtgatgctcgttgttctcattccacttctggcattgctctaaaatatccatatccgggtcctcctcgtcctgttccggtttccagtctttaatcttctggaacacgccattctcatcccgttcaaaagcacagggggcgggtgtatgcagcaacggaataatatcgggatcgtcgttgcagattgtgttcagcttataaattccggcattgttggggtcgtccatgtactcatcgctctcgtcaccggcagtgaagcgccagccgctgtcccagttaccgtctggaatctcacgatagcagtagcccaccttgcgaccctccaccgtgatacggttggtggcgatgcatccatcggcaccctcccagtcaggaagcagatgtttcacatcctccgctttcacatggtagttgcggttgcggccagctgcctcatacagttctttccgcagcgcctctacatgatgtgccatctcccgaatttcctcatcatccatcatctcatggagatcataagataggggattttgggcaaagtccgcaagtgccttgttcatggcgtcatgttcctctggtgtggcggtgatgcggatacgacgagaaggagtgttatattcgtctaaatcttgcaggttcacactgccgttgacgctgcactccagcagaatagcggccagatcagtgaccacatcaatagcgaaatggaagtccatctccacaccgtctgaatgggtgaattccagatactccacagtctgatggaagtcccagttctgcttgtccaacccgatcttggcaaaaatctcgctgagggagatttcttctttcttcagatcttccaaaaataccacaaggttcaggctatcatccgagcctccgatatagttgtcccaatatttgtcgatatacatatattactcctccttttattccggccactcatctccgtcacaacggctgatgaagtcatagtgcaggctttcaaaatagtcgttggggtaggattcaccgtcctgatgaagctccaaaccatccaagtccatcattttattgatatacgcaagagtggtatggatacccgcaatatgttcgtcctgaagcatctcggccagcacatctttctgctccggggtcagtgtggcaagaagatcgtttttcgccttgttgtccgctatctttgggaaaccatcacccttgacccacagggccgtcacgctgtttttccgttctacaagaccatcaataaaatttttatacaactccagttctttgcccatatctgtttcctcttttcctgtttttatcttattttctcaccagatttccgttatcaataaaagcagcttcccggatgcgccggagagtgtccggttccagtaaaaattcccgcaggtttggatcttcaaagaatgtcatcggtcgtacctgtgtaggtccggcaacaacccataatcgttctgttgctaacctttccgctgtctgaagtgctttttcccggtcaccaagatagatgtaacgggcgattgcgtctcgataggaggagtcagccataggcacgccctgaatctcctcaaacagatccaccgcatctctggctgttccgaacatacagcagtggttatataacttccgtttggcatcgggatcgtccggcgagaactttttattctgttccaccagctttgcccagagctgctcctttgtctgtggttcttccggttcatggtagggatagttcttgtcattgtccgcgaagggcataacgccccgcttgaggtagtccatcaggatgtcacagaaacgatcccgctggggaaggccattctcagaccggatacgcgcctgttccttcgtcagcgcctctatcagttcctgctcccggtgtagctggatagcggctaccgtcatggcgatcatgtgctcgtcgcttacattgctgtaataccactcttccagccagggaagaaccgtcagatccagattcagtgctgtttcatagtccagattgaaataggcaacctctgccttgattgctgccacttgatgcgggtatttgtcagcgaaagtttccaaagcagtgagtgcttcttctttgccatccatgatctcatagcagaccatgcggaacttttttggcagtttgattacttccatgtctgtatctccttttacttcagtttatcatcctttttattatcagaacagcacgtttgtgttttctgtacatcattttttgagggctgaaagttcgattgaacttttgaaaaatatgttccatatcgtccccaaagcttggtgtccagattttctgtttgcaaattctccaccttgcgatataccggtgctcctcgaatacaggctcctataaaatagagggttccgcagctgcggcaacgcatatattggcagacggtataatgctgctcggctcccagtatagtatcagtatcttccagaggacagtcgccggcaaacagctccagtacacctttccgttccaacttcatcaaggtttggagaatccgattatattgacggtaggaatcgctgctggtttccttcatctgcgtcaacagcagaccgcaggagagacagcttttattccatgccttttccattatcatcactccaaatcatagattactttctaccacaattacatcagtataattcagagcagtttccaaccatcccagtatggaacgaagaaattccgcttcttcgcttgttagattcgtcaaattctctcgcacaagaagtatccagcgctcccagtctgctttaccaatccagttagagaagcaagagtcaaactcctcctgtacatctccgttggtggggtccattacagggaagatttgttccaatatgggaattaagagcagctggcaatccggccatccaatagataaaatcgagtggtagcagttccagtcctcccattgaggatcttctttacaacctggacgcagcggcagaaaatcaagatgaattttctcgtctttagtggtatagagctgcggagacagtcggatacttgttttctgagaattgagtggaagaaatccgtggtagattaggtctgtcagattttcttttttcatctgtttccccccagtttatccgtccatctctactcgtatgatagggcgacaaaaatcatagtcgccatttaattgcttattctcctgtacttccggcttgcagtgcggagaacagggcaggaaaccgagaaagattccaagtccgccgcagatgctacgcccgccatcaccgccgcatgtagtaaacacatcagctttcactatttctcgcatatatggatcataggcaatggataagccgaaaaagtttggctcttccatatcgaagggtttatcctcatcttccgggctttcaaaatgatgcaggtgcatggagtagtccattccgtcaccccaaggaaatagggtgcggcatccgccgccgcataagtaagcccattcatttgcagtgggcagcgaaaggccctgcttttccatttgctccataagtgaatcgtaatccatttggttataaatccagatctgaaagcccttttccgtccgttcaatgcgggctgactgatgcaaggtaaggctatcaaggtcgctccaggcaaaatcccggaactccttcagccagtcaggatgggtagtcagtctgggatcgtccatcttgaccggttcccaacagagttcttccaactcccgtccaaccagcatgggaccgattgctgcctgtcgaacggaagccatgctttctcgaatcatctcattcggatcgcactccatctcccattcctgaatcagatagtccagttcctcttggctgtcttgattcagtcctacggcgaactgttcccaacccagtgtaacagtatcacccggaacaaaaacaaactctcggccatctttctcaaatataccggtggtgcagctctgaccccatcggtcaaaggtatgcagaccaagaaaggtcatatcataacgagcagccaggctctccatcagcgcctgcttctcggtggtttctatttgattaaattgggtgcgaaatagtttttcattcatagcaagtcctccttcgatcctttctgcgtgttccagtacatagcgccggccatcctgcttggcccgttccaagtattgtggaagcaggtcggaatggatggcgtccagcgaggccagaacagcgatccgctggtattcctgtaattcaagggaataacagtttcgctcccaaaacagcggagcgaactgttccacacagtcaggacgcatagcgggcatcgccaaaaacgcccgacggctcacatattcatcggggtcctttgcaaaatccaggaccatatctttgacttcctggctgcactgacattccggcagatatgcggcaaactgccactttgcctcactctcattggaggctgcggccctgcggcagaggcactcgaaccattggggatggaaagtggtctcctgtataaaaccctccgcttcgttagctctggcgatcaaatagaccatctcatccagtaggatgctgtctgcagcttctgcatccatttgggtcaacacatggcaaaaggcactgtaagtgtcattccagtatggataatcgacttcccactcaccaccgatttcttcggcggttttgccgggataagtggcttcctgccattgatggaattttattgcctgctccagcaggcgctcacgaatgccatttgccatgtgttcacctcataatatatctttgttattctccgaaatgttccaggtacaactcccgcacggaatagggacctacaagggtcgtttcctgtctaccatcccaggaatacacatgaattttgccttcatccccaatgtattgctgatcctcaaagggcgcgggaaagggaaatctctctaccacgctccagttgatcttgggtttcagcccatcaaactcctcgcgtttgagctttttgaagttaaacaccaatgctgccccaattccatcaaacagcaagtctgcgtattctctgggggtgatgctctcgcttacattggcggcatctatattgacatccagaaccttgttgccgcagtttgtccagattttatcgggagagaaccaggtggtgcgttcctcagcatttgcaaaatcctcacggggataccatccgtttgcgctgtccagcttaacaccttcccgaagcgtcccgttgtacggggaaagcggataatatcggtgccgcaccggatcaaatcggtcaaacgaaattttcagcagatacttatgcttttcgctgcgcatgagcttatggggcttcacgatatgttcttcgatcaagctccaaatgtactcatccacacggatggatacacggggtcggtcgaatagtgtgattttattattgtctgtatccacattgagccagacgcgattgatctcaaccattgtcactcctcgctttcaccaagtaccccgccataaaaacagctctcccagatggcctcaaattccgcctgctctatgatgcaggcgtggagtttctcgccccagacacgggcgttcaattcctccacggtggggatcggcgtgatctcgatggcaccgtcgtaaaggtcagggatgttgcgggtgcggccatctgcaaagatgtcgatggagcggagggccagccgctcattttcgatatccacttcatagaggatgaccggaggttctccttccggtgcgccctcccaaaagagcttgatgtattccatttcatctttttccttccgatttcacgagtacagctgtccctcatttactgatggcatcgtgctgcgccccgccagcagttcttccagttttttcgccagcgcctccacaatggcgtggcagggattttcaaatcctgtaatctccagccgctgaagctccatacagtggagagttccgtagaaaccaagcataaagtccgtcaattcagaaatcatctcgtagccttccatattatccacatctgtttgaccttcttttgcggtcatcagcccaatgattcccaccgccacggtaaaagcgccacagcaggattgctcggtctgcatacccagacccatgacagaaaacatcttccgggtttcttcagataagtttagatgataatactcattgcaggccatgaacatcgcttcggcgcaggtcagttttgtaccgatatgatatttgttgaccagttcataaagtttcattttccccatactgaactccaatcgcataacatttcattctgagttactcggcgcagctcatcccgcacttccatcagcgcaaagccaagcaggttttgtccacgccacctaaatggatcccacgcttccggtgaattcgctgagagtcgaatgccccagatgttatcataagggcttgcctctacaagcacactgtctccggtagaaagaagaaactcccgcagttcgcggttctggctgaatttaagccaattaccgttcagcacaatggcgtatttaaacttatcccatacggcttggtcaaatcctcgtaccttacggcccagtgctttgatttgcttgggatcattgcatttcagaatttccttgcggatctcctcgtcgccaaacagctgggctttgctcgccatcatatactgttccgtgtagaggtaggagtcagccatcgtatagaagtcctccatccaccactggctgaggcagctctttgttacattgccatctttagaaggctgatgtccccagaacaaacataattccagctttctcccagcggaaatctcttgctgaagccattgtcgtgtgtattttggtcgtccttccgcctgccatgcttctacaaagaagtctccatgctccagcaattggctattgtcctcgtcatcccaccagcccttccaggtcaccggttcgggaaagagtgcacggtattccacccgttcctccggggaaagagtatccagccaatctccaaatctatatatgtaatcttcgccatagcccatacgccaaccaatagaatatctttcgatctcccgataagccagccaagggggaggcattattttcttatcttgtagtgccatagggtttgtcctttcctatcatagctgccgcagttcttctttcacatccagcggaacgccgtctggagatgtgattcgtgctaactctgtttcagtcagattcttcaggaaaatgcagtattcatttgggtatccacccacaaactccattttgggcattccgatttgctgagggtcagtaatccacaagcagggttctcccgttgcccaaaatcgtgtcaaggtaagaacttggccgttataaataactttttgctccatcctcatccctcctgtaacctctttagtagcttcacaatgcgctcccgattctttgcggttttcatgaaggaggggagatgatcagcctgggtctttttcgggcttccaagtggcttttcccgcaggtcggcgctgagatagtcaatcagataggcaagatgttcccggttgagggcccagactggcttgccctggaatgaggtcaaaaaccacagctccagaccaaaataaggttctcgtccattctgaatatcagcaatgtaggagaaagcctccgctgttttatgaacttctcccgacatggttgttccacaatagggacaggccacatggagaacggaaaagtgctgctttgttttatcttcaatatccacccgatagtacctgccacagtttttgcactggttatggacatcatagcggtagatcgtcctatcccgggtctcctgatggccgcaactcaagcagcggaaataggcgttatcctcatccgctgtcaccatacctgcgccgtggcacttggggcatttcacttggatgccggcggtgagggcgctgtaggcactatatgtaaagtagggttcatcaattattcggctcatgcgtccacacactcttttcaagaaattgctttcacagacgaaaccggaatggtttcaaatccttcgctttcgttgtcagatccgccacgctcttttgcaggtcctttacctgttccagatactccacaggagcgtgaacttgttccagatagcccatatagcggatgatctgatccaacgcacgctttctgtatttggcaatctcacctaatccggaatagttggggctcgttacatagtttgcaacatctatatcccgaatggtctctatatcaagcgtctcatgctcatctttctcagatttgatggttgacagcatatcttccacggaaaaacggatgccgcgctcacagaggaaccgtagttcatcaaacaaaccattctttgcaaagtgttcagccaaaggctcaaagatcacatcatcttgataccagccaccgtgagcgcaggagattagttcccggtaacgcttttcagaaatccatttgcgaagcatctctttgctcccgcgcatccatgcgtccaaccgagcctttgtcacttcagcgctgtcataggcagttccatagcagggcaaatcatggtctttcagccacttggttacttccttgctgaatttcgtatagctcatgtgataccctctttcaaaaatcccgcagttcctcgaacttctcgatcagggcatctttctggagcgtatctcccggcagggcgtccagaataccgcgcagagccatatagatttcatctcgctcctcagtttcgatgaagcccatcttgttgaaggtttgggtgtaggcttccaccgcctccagtgcctgagtctgggagtcttcgcccggctcagcggccagcttcatcagctgggaacgggtcttgcggtattgattggctgcctttttcgcagcagcggcaggaatatgttccgcaccgtcccagcctcggaaaggattgtccagattctgcgccagccactccggttttcgtggtttggtgatccgcaaatccattcccggcttgcttttccagagctgttttgccacttttgccgcatcctccggcagactggtcatccaaaaccatttaagcgcaggcatctgttcctgagtaggaatatcagccgcaccaaatccaaataggtcaaaggtggataggttcgttaattcccggaactgtgacacagcagaaaagttcctcagatttcctggagcgccccagagccgtaattcctttaaatgagaatgaaaggaagacataccgcttaaatcaaaatccttcagctggattccgtgaattcccgataggttcggaagttcaggatgaggacggtattcaccgataaactgaagtgtcagccggctgccatcaccataggcatgaataatgcaatcgtccggaccctcgttctggaacaggagcagctccgtatcctcacacagccacagttcctgaaggccggtcatgtccagcatcagctttctgatgctcgtgccttgcagatcaagtgtcctatgaccgtggttcagcaaagtcagttcatcaacgaaggggttttcccgcaaaaactccagcagatccgggtgccactgctcgcagataagggtggagaggcaaggcaacgcctttagttccagcgctgaatcgaatggttcgtactggtccgtcacccgatggctgctgaccttcaccgggataccgccgatctccgtttgctcgtcactgtccatggcctccttgaaggcccgccgtcgttcctccggaatggcctgccaccggatctggagatacacatcatagccgtcactccagcctccataggagcggcagggctggtcggtgaagggcggaagtgtacccaccagcgtatactgagatgggacctctatgggcactcgcagcaggtgtagttcacgggaccagtacatgaaatccttatagaggggatggagaagaggaagttcctccgctgtcagagggacatcacctacccaatccagagagaggaccaccgcccaagactccttgctcaccgtgtccggcggcgcaatataggccacctggcaggcggtgtagcgttccaggtatttgttataaactgtataaacatctccggctttcgccttcataatgattcctcctctcatttatagatgagtttccagatagaatccccacacgcagttagaaaactctccggcggcaaaacgccggatttgcccgtcgatctctacctgccagacttcaaaggtgtgatcctgatgatagagtggatcttgtacttttacacgtctgccagtggtttgccaatcataatcaaaaatatttactccgaacagtttgcactggccgtccggaccaactgtttcaaatttccaagccatatgatgcctcgcaatctaacgcacttacctacaaagcaacaattttattcctgctgtaagagctctatcaaagaatccaaatgcttatcccacgattcccagtgattactttctttccaaagttctacgatttctctttcgccatcttcatcaggaacttgatttttaatactcctcaatcgcctaagaaggtcttttcgagcagtagctgaagctgagaaattcgttattgctgaccaaacattagaatcctcatcatcgtagtttagctttcctgtttcctgccattcagaataaagttctgcgagagcgatagcggtattatcatagagaaagtcaatttcgctcactgtttccccaaggaaaccttcctctttcagaaagccaatcaatccccccaaagtcagtttcttatggtggggtaaatattctgttctcaaaaggaaaattaagtctaagccattatcactttccaatgcttttacaccccatgaacccatttttgattcctccaatcttaaattagcgaacacatttaatcaattataatcctgtgcgctgccagccatccaaacgctcctgcaccgcgtcgatcatccagctctcattcactcgcttcatgaggaatcggcggtcaaagccggtgtttttctctctggtatagatatagagcttgttcttggtgatctgttccgcatccaggaactgttcacccttgtaggtgccttgggcactgtacgagaggcccagaggtcggtaaccagcacgaggcttttcactcacatatttttcccagatcgccatcaggcggggcacagcctcggtatcttcaaacccggcctgttccatatactgctcccattctgtcatttcttcaaagaaagctgagagaactttgcgacaatcctctgctgcctgttcgtctaaaggcgtgggctttttggccttctccctctgtacctgagagaagtgttccatctgctccttcgtaaactgttcatgcgaaactggttcaattcggttgttttcagcaatggcaatcaaaccttcataggtgacagcggtgcggtcgatctggatatgggagagcttggggatagaagccgcctgcataaggccggcgtcattgagtccggtacggtttaaagtcaaaaggtctatcttgcattcctgcaaggtggaaaggccgcttccgttgattccggcattaccatccagcaatagaatccgcagtttaggcatagcggaaaaaacagggaaacaggcgtcggtgagtgtaccgttctccacaccgaagttgaccatatttttatgtgcggtaaatgggatgagcatttcatctgtcaccggatagcctttcacatgaaatccaaccagagtgtaaccggccagctgctccatgatctctgcggtcagctccggaatgtcaaactgtttgtctccatccaaggtcaggacgccgttttcccaatccgctgtccgtgctcgttttggccattccatagcttacctccttacacctgttccttgtagctgtcctcaatgtcgatgaattgtacatatacggcacagacttcgccttttgcgtcatagccgaagtagacgggatagtagccgtcaccccagccggaggcgaagatgggcagattgcagtccgtatccggcaccgtccagttgagccagtcgccgcagtcaccctgatattttgggtgggtattggcgttttcctccaaaagatcgcagaacaggtcgttgtatgggtcaatgtccggatcttcttccagccgcttggcccagtatgtcttaaaagccgcctgagtctggatgtctgcaatgcaccccattccggcatccactccaaacccaaagtagtcgtcctcgcccagttcttcatcaaaattttcgttgcccgtcatacccagctcatagcgaaccggcttctcctgactgacctcaaccttaacgcaggcgtagcggtcaccatatttttcactgggtactacgcaaattttcacagcataatttccggcagggagcgtctgcatgaatggcagtgtgtcttccagctccaccagcggatcacaggcaatgatcgttccggtaggaaaatgaacagcaccaatgtccagcacatccacgctcatgtttccaatcactttttctgtgaaatatgtgtccaggtctgttttgcagaccagtttatccttgattgattcgtatttatttagccattcggtagtcggcatgatagtttcctcctgttgattcagtttgagcacaggtcagctctctacaatgcgaacctgttttcctccaatttcaaattcgagctttacgccgtagtcctccgcccacgcagggcacttgctgagcagggccaggatgcgctcatccggctcccggccaagggttacacgcaaaatcacagaccaatttgcatattccttttgaaattcctcactccgggtgtggttcagatagccctccatcttgtccaacagggccgtctgtgtttccggggagccgtcaatgaaaccgttgcagacgagaaccatcaaaacttcctttgtttcgggtttttccgccagaatgtcgatcttatgcagatccccaaacatatcttcaatcgtcatcgttatcaccaatcctttttggctcaatcttgctctaaatgcttgatgtactcgctctttgagccgtcccagtaacagtttacacaccggccattctgaaaatgatggggacaatttgggtaaccatagaggatatgcgcacattccgggcacagtcccatcatctgtgaggagcctttccaaaacaggctgccgcactcatcacaaatgaccagttcttttcctgccatagggttcaccagtcccgttcccggatagcctcctcaatatcaatcggaatgccaaaccacttcaaaatgtagtctacggttacgccgatgcagtcccgtgctaccgtttcgatttcactctcgttctcgtaaaactcttcttgcagatcgttgatagctaacactgcctcatccagcttttcctgcaccacctcagtgtcggtttcaccgctctccagcaaatcaatgaccttttgaatctcgtcttttaccttgtctaccaaaaaagcaggatagtaatcatcctggtacatctcgtccaatagtttataattagggtcaaatgctttcattgtgatttctcctttattattcaaacatcagaccgtatgattcggtcaggcttccgtcatcctcatggaaaatacactgatacagaggttgacgctgtgttgcttttcggaaccgctccagaactggagccagcgactcatcggtatgaataccgagagtatcagctacacgccgccagctgtccatatccatatcttccaagttacagttacgctgcctctgtccgtattcctccagtgttttggagtccgcatactcctttgcgtcacagcagtcgtgccagcagatgcagctcacgatcagtgaaaaaaggtcatccatactatcggccagacggcctgcctcaccttcgctgctgtaatagccgatggagccatcttccaacaggtggtattctccgccggagccatctctggcaaaagccataccgggcagggtgaaggttgctcgaccgtctgcgtcatcccttggggacaactcatccagcaggaagaagtcaaaaagagaatcaaattcatcagccaaatcagggtcttcatgtaatattttcaaataatccataactgttttcttccttttactgttcttgtattaactcgtgcagcctttccagccacagcgattcttcaatcatctcatcattttggtaaaaatggtctttgtcacgggccaggtggtcagcaagtgggggagcgttcaacggagtacatacagtgaaactggctcgatcagctcccttgatttcccggttgagatagtacacccgcttggtatcgcgggaataccagtggctaagtagttcccatgaggtcagatcggccttggaaagctgcttaccgtaggcatagatccgtttctcatctctggcaaaataggtgtcacccaatgagcggaaagaggagacctccgcgcccttgatgatcttcaccttgccgtctccgttgtggaagtaaacctgccggctgtcctttgcatatccttgaggcgcacccgaatcgttctggccgttatccagcacttgaaaggctgccagctctacatctgggattctcccgctggtggtgtagacggctgttttatccattgcgtaggcatagtttaacacccgaaacgatgccgggtctgctccacgcaggcgaatcccgccgagaaagcaggccgtagaggatttgccccagtaatgccagcagcagaagtctttgggcaaaacacccttcaacaagccgttttcatatagaccggagaaatagacggctccatcccgaaagaaaaactcattgtccaccggctctgtgttggtgattggttgcagcagttcttcgtgatgatctgttatgctcagctcgatttcgtcgtcgctgtaaactaagtagagcccatgcggggtctttctatcgaaatgcagttcaatgtcatgatatttgaggattaaaggtttcccgtcgcttctcatggtggaaacgacatcgggattcccgaagatttctatgacctcatcctgcgatattccgaatttcagcggtgaaatgtcccgcggattctgcaatatttgattgcgccaaatagtaaagtcctgtttcatatttttaatagcactggaggatcagccagatccggtcaaagcggcgggcggccaggtcctctttggtaatgtagaaatagatgtgcccgcagtctccgaacatcagctcaaagtcgccaagctccacgatatccagctggaacagcaacatccagcggtcacgggctgtttcttctgcccgctggcgtacctccttcggaattttaacccaaccatcacccagatagtagccctgggtcaccaaatcacattcgtcgaacatactgttctggatcacatcaggccagcccagcagctgggagcggtcatccggatcctctgggtcctcaccggtcagttcctcccaagcgtcgttgaaagcgtcgtcatccttctcatctggaaacacctcgctgaagtcctcccaggaaggataggagtattttgagtctactttgatcttgaccataggaaatttgaaatcttcctccatatccgcaggaaagtttgcagcggacagcgccgaaagatcctcaaaccaatagacgcgggcgcagcccttgtcctttgggtcatagccccagcactgggtatccgtttcataaaagaaggagagcagaccgtgatcggggagaagatgctccttgtcaaactgagccagctcctcacagttgaactgtgccaggaaagtgaggggacggttcttcaccacatggtcgtaactttcaccctcataggtgggccaaacgaagtctggcggtacatccggcttcccgccaaagcgagtggcgcccagcttgtatgtttcttttctggcgatcttcagccttatgctattcttgcccaacgactccagtttttctttcatgttcataatcagttcctccttgttgcttcgtcatatctttccatccagtgcctccacagttttcatggcagcggaatcaaatttgcaatgctgcagatcccgttcaatcagggcaaacacatctggaaaacactcaatctcatcctgatactcatatttcgcatacagtttcccatactcggagatccaaacttctgccgggtagtagtagccgatatgaccgataggctggcatttttcaccggcagcctgttcgatctctgccagttcacagccggacatatcccgaaaataggcttcttccaaatgatttttgattccgttgaccaggtagggaaacaaagcaaattgaaagtccgctgcccagttcatctttttctgttccaagtaccactcacagcacagaccgaaatacttacggtaaaatcgctgggtagtcttcatcattgggacgccatgttcggtgtaatactgctccgcaatggagatgtccacttttcgtccttcataccatccggcgtactccatcagctgtttgaccttgcttcccagatcgcctgagatggggatgcgttctttgatcattcagttcatctcctgtctgctgcgaatcaaagttcatttggatacccgatcttatccagacctgccttgatttcttcccattcattgcgcttcgggtttaacgaagcgaccagttcttttgtcactggcaccccatcagcaagctggcgcataatatccaaaggcaggtcagcgggataccactttccatactccacataggtctgtggattgccatcaatcgtggagagcagatccttagatgcgtcctcgccgtccatgggattgcagtgccaagtggtgccatcttccgtccaaacacagaaggtgcttttcatctttttgacttcacggctgctcatgagcttttgcaaagcagggggcattccctctgtcaggtcttcaatatggggaagtttttcctcccagtcgtagagttcggaatctacaccgttaatgacacagccttccggcacaaacatgacaatcatgctctggtcactaccatcggtagcaaagaatgcctctttgccttttcgccatgcggggctgtatgtatagtggcggatgaagctccattcctcctccaccatgatgatgtccagagctgccagccctttgcagaagttcttcaggcactccacattgggtaggccagataaatcttttgttgaaatcataatattatcctcctgtctttcgtcaccacagctggtcgatctgggtatatatcttattaggttctctgtccgtaaaactggtcaatgagtcggtaggttccgcaagcagcatcacattcaaaatgtccagcacataataccagattccggtatcccagtcccggaaccgcccattacagacagcttgcccgtactcaccgggagccaaatccaatgccagctcattgagtggctgtttctgcccagtcttatcgtaggtatatcgctccggcatcgcaccgatgtgccaatcatatcggtatcgcacttggattccagactcctgctgaataagttcaaaagggtgaagtcgcattgtgccattcggcttccattccatcagtctacgacagtccctatcgatctgaaatccatctggcctctgtatgatagatgcaaagtgagtaggtagaccaaaaggataataggagaagaagtctttaggcagccgcatgactctgggatactggttccgctgtgcggcggcttttccaccccggcagtctttataccattgcaggcggatctgctgaaccagaagtgtgggcagatgctccaactgatgcttattctgtttcatcaccatacctccttccttgatagatccttccaatgatcttccatgtttcagaaatttacaactctgctgcaaactcataggaaactgcaatgatgttgtaaacatcatcgtatgtaaacagccggtagtgccgatagatgtctttgttaaaatcctcccgcaccggcaaagacttcagccaggtgctgtcctcgatcaaattaaaggagctgcggttcagatgtcccgtttcagccagattttcataggtgtccaattcacaggcaaaataggccaatacttgccggaaggtgagcgtgtagcgaaaccagtctttttcgtccctgtgctgggagatcagatggccattgatgtcccccgtaaaagtcagattgttcagaccatcccgttccactttatccagatagatacagtctcgtcctttcaaaacacctaaacaagtgttgacagcagttgctttgtccatagataactctctttcctcagctctcatgggtgatacagaaaatctccttattcaaatcaaagtagatcaccatcagctcgtcggtgatttccggattaaaggaaaggtccagaataaatgcttgctgttcggtttcactatccaccaggctgccgaaccgcttgagcttcaaaaagtccaccatctcggcaaaggacagtttggatgggtcggttcccggaaaaagttccgccgcaatatccgggcctacatcgtctcggtggaactccatgaaaaatgtcacaacatcgtggtaagggctgttttcatccttcgaatgagcccggtacaattccgaactcattctcaaaatacttaatacatttttgtctaaactttggggttcacttcatttgagagtatccgtttttatgtcaatagagtatcttggcgcttttatcaatctccgccctcggcggtgccgttataaatcttcaccagcttttcgccgatcttctttatatccatattttcaacagccttgcgtccgttctcacgcagtgacgggagcttgccctcataaatctcctttatcatacgctcgaattcgtccttatcctttgccttgtagcaatctgtaccgccttttaaccaatcgaataccggtatgtcacggacaataacgtttgcctttgccgcaagcgcctcaagaagcactatgccctctgtttcctctaaggtagggaatatatacacgtcacagccgacataagcctgtttcagttcatcgggctgtacatagcctgcaaatgtgaggttaggcagctttgtctttaccgcctttcttatcttgtgcggcacgctgtaaagcggagttttgccgaaccagataaacttatagtcgggcatatcctttgccatctgaacaaaatcgagaagacccttacgctcaaagtaaagtcctacggagattacgaccttgtcatcgtcctttaaaccgaactttttgcgaaatgcctccctgtcgttttccttaggctcatatcttgcaaggtcaataccgttggatacggcatagatcggtgcggtcagcccgtagcctcttatcagcgactttgaatactcggtcggagtcactataacatcacccctgcggtagcagctgcatatccacttcttgaaaagtccagaaataagattcgagccgatgaacgaattacggaagtcctcctgcgttgagtgagcgtggtacaccactctcttgcccgcctttttggcttttttcgcaagatgcttagatttcagtccgagcgtgtttatgtgaacaacatcgtagctgtccttagggtcgagcgtatattctatgccgttaagctccattgctctctgctggtgcataatcgctctgccaagaccggatattttgataaggttcataccttctgaaaacaggagtaccttcatattagtttccttccatataattactgtgtgcgtaaacgtataacagatattttatcataattgccgggtatcgtcaagtaatatcaggaatgatacctttcaaggaactgacgtgtacgctcgttttggctgttgttgaatacctcgtcgggagtgccgttctcaataacatatccgccgtccataaatattacacggtcggaaatctcgcttgcaaactgcatttcgtgagttacaataaccatagtcatcttttcttccgcaaggctctttattacctttaatatctcgccggtaagctcagggtcgagcgcagatgtcggctcatcgaagaaaagaagctcggggctgagtgcaagcgctcttgcgatagacacacgctgctgctgaccgcccgacagattgcatgggtattcgtttgccttatccgcaagtcccattttgccgagcagctccatagccgtctgttccgcctgtgccttatcctgctttaacacatggacaggtgcctctgtgatattcttcagcaccgacatatgcggaaacaggttgaagttctggaacacaagaccgattttaagccttatatcgtggagcgttttgttatcggcatataccgccttgccgttttcatcgtttcttgtcatagtgatgccgcatatctcgcactcgccgctgtctatcttctcaaactgatttatacagcgcaggagcgttgattttccgcttcccgacgggcctattatagatattacctcgccctgctccacattgaatgaaatatcgtttaaaacttcgagctttccgaagctctttgatagattctttacactgagtattgacattccgcctgctccttatctgtagtagttcagtttcttttcgataaagccgaacagcgctgtcagcacagtagccattacgaaatagaaaacacctgcaataaacagcggaacaagcgagctgtagttcatcatctgctgttttgccgcaagcattatttccgagtaagcaacgacatttgcaagcgacgtatcctttacaagcgtaattacttcgtttgacgacgcaggaacgatacgctttattacctgtgggagaattatcctgaagaacgtctgtgcctttgtcattcccagagccgccgccgcttcatactgacctctcggtatagattctatgccgcctctgaatatctcggcaaaatatgccgcatagttcagcacgaatgcgataattaccatagtgaacataaagctctctgcggcagggtcaacgccgctcagcagactttctacgaatccgcccgagcctttggtagccgtctttaaaaacggcagtgcatagtagacaactatgatctggagcataagcggtgttccacgcattatgagtatgtatagatttgtaagccacgatattggcttgaacctgcacatcttcagtgccgcaacgataagtccgagcggtattgaaaaaagcaacgtaaagccgaaaatcttaattgtggggataaggttttccaggagtatccccgtaaccttcattatctgttcgccggtcatatttaattcttccttaatcttccgataatttatcatagtaaagcgataattcgctattacggcagtatattattattgtaccataagtaaaggggtatttgcaagtaaaagatgaaaaaacccgtaattcacagcattttatcgttgacggaaaatacagcaggtatatcccgcctcaagcaatattacagcctgtacaaacacggcggctgaatttacaaaaaattgtgcaagttccactataatcttgactttggtactatttcatggtacaattatctatgtgtaatcagaaaagaaatacagacaggaggtggattgcttgtacatcggcaaatttcataaatacgcagtagcagggatatgtcttgtgggaatgcagaatgaccacgctgcacatattgtaaaagtagcctcggacgctttgataaagaaaggcttcaaggttatgatattcaacgcatttacagatatgttttatgatacaccgtattcaaagggagaggcaagcgtctatcatcttattaacctcgatattgtagatgttcttgtcattatgcccgaaactataaagagcgaatgggtaaccgacactatcataagatatgcaaacgccgcaaaaatacccgtaataatgcttgacggcagtcacaacggctgtacgaatataacatacgactacggcaggtcgcttgagtcggtagtggaacacgtcataacagagcataaatgcaccgacctgttttttatggcaggcacaaaaggcaactgcttctcagaagaaagaatagaggctttcaagcgtgttcttgcacgtcacaatattgaatttaacgagaaaacaatgctcggctacggagatttctgggaagcgccgacaaaaaagaccatctcggatcttattgtctgtggaagaaaaatgcctcaggctataatatgcgcaaatgactctatggctatcatcgtaatgaaagctcttgaagaacacggcatgaaagttcctgaggatataatagtcacgggatttgacgctatatatcaggagcgtatttattcaaccaccagacttaccaccgcacagatggacgcagatgagcttgcgacaaccattgccgacaccgcatacggatatatcaatggcagtgaaaaaccgtccgataagcatatccatttctctatgatactcggtcagagctgcggctgcggcgattttgacgtagcttataccaatgaaaagctggagcatatgaataaatataatctcgccctctatgacgcagagatcaagatggcttcgctttatacccatacggtaaactgcgacaagctcgacgagcttacaaaggctatgggcagatatttcaactaccatgcagcactgtgtctgaatgatgattttctgaccaaggaatcagccgtcataccaaaagcgtatcacagcgtttttaccgaaaatatgaccgcacacgtcataaggacgtggagcgattacagctataatataaattatccgacaaagaaggtactgcccgatctcaacgatcttatcaaaagatataataccattatgttctgccctctgcattttcaggagcatgtcataggctattatgccgccattgcagacgatcttcttgtaaatcccggcagcttctactatgttcagcgactggtggaatctataaaccaggcgcttgaaaacttccgcatagaatatcttctgagaaacgcaaacaatgagctttcgctcacgcacttgatagatccgcttacaaacatctataaccgaaggggatattttgagcgtataagcgagcttatgctcggaaacgaaaagtgtaatgttatccttgtatcctgcgatatggacaggctcaaagagataaacgatacatacggtcactctgagggcgacatagctataaaagcggtggctgacgctataaagacgggctgcggaaaagacggtatatgcgccagattcggcggagatgaatttatactgacagtgccgtataaaactgacaaacagcgtgagctgtcaaggcttgtcggtgagatacagacggagatcgacaagttcaaccgcagtgcaggaaagccttatgatgtgtctataagcgtaggcggatcatacggcacagtgagcagtgttgaagaagtaaacgaacttatgcgcaataccgaccggcttatgtacgagcagaaaaaggtgaagaagggcgagcgtggtcctgtctttcagcccgtacccgaggctcagaaaaagcccgatgaggtgcttgaaggttatcgcagcagaatacacaaaatattctcgcagtttgacaaatgcacctacttctatatggactatctcaacttcaagtggtacatcatagagaacgaccatatgccaaagtgccttaaatcttcctctgtcggtcctctgcgtgcgatatggctgagcggagcggtacaccccgacgacaagctcatctatgaaagcttctgccgtaaaataaagaactcctttgacgataagattaccgattcctcattgaacgtaaacatacgtctgtgcgaaggtgacaagcctgtatggtacggtatttatgtacagctttcgggcaaggacggtaaaatggaagagatagccggttctatcaaaaaactcgaaatcaacgaaataatgagcatagacattctggattattacaccactaccgataatccgataatgttcaacgatatgatctcgcaaaggctcacggcatatccggacacaaaatttgctcttgtacagtttgatataaaacgtttcaagctgataaatgaaaactacggcgaagacgcaggaacggaaatgctccagttcatatcacgtcagctcagcaacttctgcggaaaacagcagatgggagcaagaatgagcggtgacgtctttacacttctgaccccttacgaagataaggacgggttgctctccgttgtatccgagcttcagcgttgtctgaagaatttccgtcaatacagctatgaattcgtgttcggtatttatcttatagaggacaggagcgtatctgtcagaacgatgtgcgactgtgccgctatggcaagacaatctatcaagaaaaacgctcttgaaagcattgcattctataacaagaatatgcagaaggagataaaggaacgtaagtttgtcgaatcgcatatgaaaaaggctttggacaacaacgaatttatcatctatctgcagccgaagttcagcatatcaaacggcgaagctgtcggctatgaagcgcttgtaaggtggcaaagtcccgaaaggggaatgatatacccgggcggatttataccgctgtttgaggaaaacggatttatcacaaagctggacgcttatgtttgggaatgtgcctgcatggtactgcgtgactggatagacaggcatttcacgccgcttccgatctcggtcaatgtttcccgtgcgaaccttgacgatgaatcattcctcaatgtccttgacgggcttattgagaaatatcgtctgccgaagcatctgcttgagcttgaaataaccgaaagcatagaaaatgacacaacactgcgtatgaccgaaaagataaaggaacacggctacattctgctgatggacgacttcggctcaggctactcctcgctgaatacgctgcaggatacaaagttcgatgtgctgaagctcgaccgtgaattcttctcgacacatatgtcaaacgatcgtggaaagaagataataatgcacaccatctcaatgtccaaggacgtaggtctggggcttattgctgaaggtgttgaaaccgcagatcaggcgcagttcctcgaaagctgcggatgcgatacggcgcagggttatctttatgcaaagcctatgccagtgcaggaggcggagaaatatctgaaaaatgcttcgcagagtaaaactgataatgaaggcgtaacgccgtaataaaaaaatcacccgatgctaaaatgcatcgggtgattttttgcataatgtgattaccgcatactttgcgataatattttttccgcctcgtctttcaccctgtctttcaaccactgcggtgaaacgacctcgcagtgacttccgaaccccatcacaaagcacatgatattctcctcattctgcattgtgcaacgaagctctgttgtatcttcgtctatcggcgtaaccgtctgatctctgccgtagatacgttcacgggcgagcatcgcatatctgccgtgcagcagcataactatctcataccattcgccgttctttttcataccgaaatcgtcaagatagtcgctttccttgtatgtcgcaagaactgtgaagcggttttccgtgacaaccatcgactgaatacggctcagcttgaaatagcggatctcgtatgactttttatcataccccagcataaaccacgcattgttatacataaacagcttatacggatcaaagcggcggtgcgacaccttgtttgacagcgacagataatccatctcaagctcttttctgtgagcgatgcactgtgccaccgtatcataccgtctgctaagctcctgctcgtcaacggcaagcggaaaacggttggcaacggatatttcctgcggctgttcgtgctttaccgccgcaaagacctttcccatcgctttttcataatcgcttgagtaaggaaaatcgttgcggctcttaagatattccgctccggaggataacgcacgctgttcagcttcattgagccttaccgtaggaatcacgctctgcgttatcagacggtatccgccgtatttgccggggataccctctatataatagcctgccatttcaagctctgtgcggtactcggctatattgcggacgtttgtttcaagaatatcagccagctcctgtcccttatacactctgcccgagcttaaaatctgcagcattttaaggcagtttgacgttttccccattgccgttcctccgtttgtgtatatcatagtatatataattatacactatttatggcaggaattcaatcgcttacagccgttcaaggaactccttcttcttttctgcaaactcttcttccgtcagtataccgttttctttcatttcgtgaagctgttttatctgctccattatcgctttcggatcttccttctttgcagacgctgtgcttgaatgattctgcatatttgccgccgcctgcgacgctttgtccttgagattttctgccgcacctgcgatgcttcctgcggcattctgtgccatattctttatgctgtcggcatttactgaacctatcgccgattttattccgtcagcgtttattgacggcagagatacgcccgcagtgccgttttcatcttcggctgagtttactgcgtcaaataccttgttgcccttaagccctaagaactgtattaccgacattgctataagggcgagcataagaataagtattatccagaagcctatcagatagttaagttctacctttgcagatactcccgtgcctgcggttgctccgcctgccgccgcatttactgccgatgccgccgaaccgggcgctatgaacaggcagacgatacctgcaaccgagcctatagcggatataatctttctgaaaggcttcagctgagggatataacagcttgccgctactgccacaaggcaaagtataaacgcaaagccgaaaaatccgccgtccgtcacaagcgaaaagccgttcatcgactgatcggcgcttccgacgccgaatcctccgacagaaacctccgcctttaccgacataaagggaagaaacagtgcaagaattatcacggcacatataattcccataagatttttaagtataaattctttatttagtttcataacaatctccttttgaattaaagcttatcactgtagtattcctgttcctcacatattactatatttccgtcaccgatgagcgttgaagaagatatttcagcatctgaatcaaaagtgaagtatataacatattttccgtcatcatataaaccaaatgtaccgtcatctctgagtgttatataatcgccgtagtttttatacagataattgctgaaagctccatatgtcacataaccgtcaaaatctgtaaagaaagatattataggacactcgaccataattgccttgcctcgtcctaagatcgggtggtcttgaataaagtcttttctgcaatagtagatatcaagaccgtccttttcgtagcaggcataatatccggtataaatgctggctgtaattccccatacgtcggcaaaatccttgtcaaaataatactgtatatagtccggaagtgctatagttccattggtaacggcaggagcttctggttgtgtttcagcaggtgttgtttccggtgcaggtgttgtctgcactgtagtttcgggtgttgtctgtgctgttgtgaccgctgttgtctgtgccgatgtggtatcaggtgcttctgacggttcatcatctgaaatatcgggtacggaataatccgctccgtccttgtcgtagataccgccgaaaagcccactgccgtttgcctcagtcacgagcgacatctgcttttcgtttacgtttgctatgcaggtatcactgtaggtctgaccgcctgcaactattgtaagtatcagctttccgtccgctatatcgtatgtaccctcgtcggattgtgccgtgaccgtgccgtctgccgccgtctgcttatatgacagctccttgttgtccttgaatctcagttcgtatgtgctgtcgcctgctttcttgtaccatgcaccgtaaatgttgacggtgttcagttccattgttgcactgaccgcaggctgaccgttatccttctgaccgcttattacaaaataggcaaccagtgcgacagctattactgcaataaccacacacagtacaattatgttgttcttcttcgaacttccctgttccatacttattcctcctcgtttttctttttcagcagttttcttatagtcctctccgaatagttatactcggtggctatcttattaagcgaatcagatgagccgtcataggttttttccgcctccagtgcgacatattccttagaataaagccgtgtgggaaaatttatctgactgcccttcatctgattgtacagcttaacagtattttcaaagccgataatttcacatatcgtcccatatacaccgttaagcgattccgatttgttattcttatccatgacatctcccgaaatctataattttatagctttattatatactgttgaccgcatcttttcttctgcctttttccacgcaaaaagacttggaaaaaagctttgaaaaccgcttgaaaacacattgcaatgttcgtttttcaagtatattaaaacaccgtttgcaacattatttatgtatggatagaaaaatgtttggaaaaaaaggataaaaaaattcccgacctgccataaaacagatcgggatgtatatcgggttttactttgccgcatgtgaggactttatcataatcagcatacttctgaactgaacgctcagcatatccgaaatctcgttttcgctgaacagacagatgttggatgaaagcaatacacctataccgtaggtgaatatccagacgtgtctgaacaaagtcattgcgtcctcttttgaaagcgagtaatcgttcattatatactcaatgcacttgtcagccgtaacgccgagcatagacgagaacattccctcgaaattgaaagtatgatcctgttccttcataaaaagaagtctgaacagcttcggcttttcctttgcaaaagtgatcatctgtatgccgacctgcttgaatgcaggcatatcgggcgtttctttttccgcaaactgtccgaataccttcatagcggactcacggacagcgctttcaagctcctccatatttctgaacgctgtaaagatagggcgtgtcgatgttcccatagcttctgcaaggcttcttgcattcagcgattcagcaccgctctcggcaactattccgagcgctatttcggttatttcttctcttgtatattttgccctgggtggcataatatcacctcgtgatatgggtttttctgtaacgcttgttgcgtaatgctcatattatagcattatagcaccggtttttcactatgtcaactgtttcggataagaatgatatttttgcctattgcgtttcgcagatttccttaaagattaattttattaaattaaattattgacatcagtctaatattgtgctattattaagaaaactttcagggaggtataaatatgaacgaacagaacaattatcagcagcctgttgaacagaactttcagcagcctgcgccgcagtaccagcagcctgcgccgcagtaccagcagcctgcgccgcagtaccagcagcccgcaccgcagtatcagcagcacgcaccgcagtatcagcaaagctacggaccggtaagacaactcaatacacacagaggtctgattaagctgattctgttaacaattataactttcggaatttatccgttagttttcttttccggaatttcagaagatataaatcttatcgcaagcagatttgacggaagaaagacaatgcactactgccttatggcgtttatcatcgggccgcttacattaggtatcggttttatcgtatggttccataacctttcttcaagaatgggcaacgagcttgcaagacgtggcatagcatattctttcggtgcttcggattactggctatggaacgttctgggaagccttatcattatcggaccgtttgtttatctgcacaagctcgcaagagcgtctgtgcttcttgcagaagattataatatcagaggctgagccgatacatatttacatattgtataagcacaagtaaagaaggggcgattttccggttcccttttcaatattcagtaaagcttatttatcaccgaataccttgcggtagtcatcctggaacttgatgatgccctgatcggtgagcggatgcttggtcatctgctcaatgaccttgtaaggaacggtcgcgatatccgcaccggccagagcgcaatcggcaacatggatcgggttgcggacagacgcgcagatgatctcggtcttgatctcggggaaacgggagaacatggcggtgatcgtttcgatcagctcaatgccgggctgagaaatatcatccagacggccaaggaaggggctgacataagtagcacctgcacgagcggcaagaagtgcctggtttgcggagaagatcaacgtgcagttggtcggaattccttcggaggagagaaccttgatggctttcaagccttcaacggtcatcgggatcttaacgaccatgtgcttggggtcgagcgcatagattgctcttccctcttcgatcatgccttcagcgtcctcagtggtcgctttgacctcgccggagatcgtgccgtcaacgatctgggcaatttctttcagaacggtcgcatagtcgcggccttctttggcgatcagagaaggattggtggtaacgccagcgataacgcccatgtcgtttgccttacggatttcttcaatattggcggtgtcgataaagaatttcgtgataattacactcctgtcatttggtcagaacgcttgcgacagccgctttccagccgtcatagcgctttttacgggaagattcgtccaccttcgacagatagcgggtgcgttcttctttttcataaacagactgatcccacagccccagagcaaaaccggcagcataagctgcgccgatgcccgaaagttcttcgtttttcggaactgcaaccgggatcgaaagcatatccgactggaactgcatcagatatttgtctttagtcggaccgccgtctacccggatctcagtgatcggcagaccggactcctgctgcatcagcagaacaagatcggtgatctgatacgcaatgcattcttccgccgcctttacgatttcggcttttccggtgctgcgggtcataccgacgattgcggcctttgcctcactgtcccaatagggggcgcccagcccggagaaagccggaacgaggtaggtcgtatcctcgggattggcctttgcagcaaattcgcccgattcgcgagaagcacccaacagcttcacatcatcgaccagccatttgataaccgagccggtatagttgatgttgccttccaagacgtagtttactttcccgcccatgctccatgccagcgaggttacgataccggcgtcagagaagatcggtttttcaccaatattcatcataacggaggagccggttccgaaggtcgctttaatcatgccaggagtcagacagccctgcccgaagagagcgccgtgactgtcgccgagaacgccgtgaatcgggatttctttggaaaagtacccatcaagatcggtataaccgtaaagaccgtcggagtcggtcacagtcggaagcgtctccgggtcaattccaaagattgagcagatctcactgtcccaggaaagggtacggatattgaaaagctgtgtacgggaagcgttggagtaatcgcatcggaattcttttccgtgggtcatcttaaagacgagccacgaatcaatcgtgccgcaacaaaggtgtctgccggaaaggtcgccagcgttctgtagaacccatgcgatctttgccgcagagaaatatggagagagccgcagacctgtgtgctcgcgcaccatttcggcataatcagacagtccttcacagatctttgcaccgcgtgcgcactgccatacgatcgcatcataaaccggaaggccggtatcgcgatcccaaaccagagccgtctcgcgctggttgctgatgccgatgccaatgacttcgtctttgttgatgccgtttttttcaataatagcacgggcaacgcctttggtgttctcccagattttcatcggatcatgcgcgacccatccgttttctgaaatcttctgtttatgcggaaggtcgcttcggccgatcagccgggcgtcttcgtcaaaaagaagggctttggttccggaagtgctctggtcaatcgccagaatatatttcatgctgaaaaccagtcctttcccctcccgcaccggatatgtcgatccgatgcgggaggaacagtcgcttattttaacagttcttttgcggcagcaatgataccgtctttattcagatgataatagtcaaagacctcgcgggaattaccggtgataacaggagcatcgggcaagcccatgcaggtgactttacggggagcattggctgcgacaatctggcagaccattgaaccgagtccgccgatccgggtatgctcttcgattacgatcacagcttttgctttttcagctgcacggataactgcctgttcatccagcggcttgacgcagtacatatcgagcacaccggcggagatcccctgctcattcagttctttggaagcggcaacggctgcttctaccatttcaccgcaggcgatgatggcaacatccgtcccttcgccgataacggtcgctttatccatctcaaaggggcagttgtcctccgagtaaacatccggaacggcgtagcggccgacgcggatataagcggtctgatcgtcctgataaagcgcttccatcagcttacgggtctggaaacggtcggaaggaagataaacgcgcattccggggatcgatgccatgtcagcaatatcggtcgccgaatgatgggtcatgccgagcgcgccgtaggaaacaccgcccgaaataccgatcagcttaacattggtatgggaataagcgcagtcaaccttcgcctgttccatgcttctggtcgagaggaagcatgcgggagaagccgcataggcttttttgccgcatttagcaagaccggcagagatcgaaaccaggctctgctcagcgatgccaacttcaacaaactggtcgggatatgtatcggcaaacggagtcagcgaagcgcttccgcgggagtcggagcagagaacaacaacgtctctgtcctctttagccttttccatcagaacttcgcagatcacctgcttattcgcaatcttattcatttgccgcagcctcctttgctttcagttccgccataccctgttcgtattcttcgggagtcggaactttgtgatgccatgcagctttattttccataaaggatacgccgcagcccttcgtggtgttggcaacgatcagggtgggtttgcctttggtggcttttgcttcgtcaaatgcacgatccaacgcatcaacatcgtttccgtcgatcgagatgacgtgccaaccgaaggtcgcccaacgctcttcctggctttcctggttcataacatattcggtcgtgccggagatctggagacggtttcggtcaatgacggcgcagagattgtccagcttatagtgaccgccggccatggcgccttcccagacgcttccttcggcaagctcaccatcgcccatgacaacatatacgcggtaatcgcgcttgtccatcttaccggcgagtgccataccgatcgcgaccgacagaccgtggccgagagaaccggagttcatctcgataccattgactttattgttggggtgaccgatgtacttggagagatactgggaaaccgttttcaaatcctcgcgggggaagaatcctttctggcagagaaccgcgtaaagtgcctcaaccgtatgacctttactgaggataaagcggtcatgatcgggatcatgaaaattctcgggagtaacattcatctgcttgttatacaggacgttgagcgtatcgattacgctcatgtcaccgccgatatgtccgccctttgcgtggtagacgatatcgaggatatcctgacgcagtttgtaagagtttgctttcaggttcataagtctgtgtccttttctgatcaggagtcggaagagatactcttttctcccggctctccttcatttattcgccgcgaagatatgctttgatttcttcgtcgttatcgtcataaaggtcgggtttgacgccgatgtatttgcaggcttcgtaaagtctcgcgacaacatcgccgtgaataccggcacagtgatgaatataggggccttcgacaatctttgcctccagcttcttccagtttttgacctcgacccagagataggtacccttggtgtaaggaccgtcaatacctttagcggtaccgagcagcaggctgtattcgccgttgtcgccatcaaaacggcagagggtaacgttgccgtgtttgcactcggcagcaaccgcaccggggtaatcaaatgccagcggataggtcagctgaggacgctctttagcaagagaaaggggccaggggccgcagtgctgaagcagctcagcgttgtcgttggtaggatggcgaaccgtccagtcagcaaagaatacgggatgctcgtccataccggcagcctgaatcagcagagaagtgatcgcaccgtggatatcggtctcacagacgaccgggaagccttcatcaaagagcagggagtttgcacagcagggcataacgccaagttcatcctgaagggcgttccaacactgaataacagcggcgttgcaaccgtatttctttgccatcgtttcgatcgcaactttcatagcggctacattgtaaagctcgtcctcggtgacgtggatgtccatattcattcgcatataagcgacgcaggcttcgacctgcgttttttcctcttttgccttgttgacgttctgaaccagttcggtcatcggaactggcgaaagctggatgttgaatttctcaagcagctcaccttcgttgcacatcgtgctccagaagtcaaacggacgggtcgagatctgaaggatgcgggtatgacggaaggtgcggacgatattgcagacggcaaggaagtccttgatcccccgctcaaattcgggatcggtcaggttgcagttggtcatgtaggtgaaaggtacgcggaaacggcggagaaccttaccagtcgcgaacaggccgcactgggaatctctcaggcggacgccggtttcgggatcgggacattcatcgcggggaccccagagcagaaccggaagattcatttccttggccagtcttgcgacctcgtactcggtgccgaagtttccgtgagggaagaagataccgtcaaccttctcggctttgaatttttccacaattgcgggcagatcgttgtcatcgtagagaagcccttctttattgatatcggtgatgtcaacaaaatccacgcccagttcgcgcagacgatctgcggtcagattgcggtattcaatagctgcaggtgcggaaaagatactgcgtctggtcggtgcataaccgattttgatttttgcaggagtcataaaaattccttcctttctgaaattagagactgttggcatttatcataagcggtcagtcagtgcgtttgcacacgcttccccgctcaacaaactcagtacagatctgagatttggtcacaaaccggtcgccgttccggatcagttccagaagccttcggacggctgtgcgtcccatttcctgtttataaacatgaatggtggtcaggccgggggtcgtgatgctgcaaaacggaagatcatcaaacccgatgatcgatacgtcctcagggatccggatcccgtgatcctgcatggccttcatcgcgcccagagcaatgatatcgttatcggctaggagtgcttcgggaagcctgatcccggcggaaagcaaacggttcatctgtactcttgccccgtccatcgtcggaggcagagaaatcagcccgttttccgggatctcaagtccatgtgctttaagcgcccgttcatatccttcctggcggtagaagaagtttttgatgttaatgttgcttttcaggtatccgatctccttataaccatttgcgatcagatactcggctgcggcacaggtcgaatcggtgttgctgatcaggacagagttgaaagaggagttttcaaaccagttatccagtacaacgaccggtgccagcgcgcttttgaacttagcggcttcttcttcatccaactcggttgccagaagcaggataccgcttgtcggatcggtcagaagctgttttaagcgttcgtcataatccggcgcagaccggttcaggttccagatcaccgtttcaaaattcccgacccggctttccatctcgactccttcgatcagggcggagaaaaaaggcgtatcggaaacgacctgtccgctgtctttataaatgacgaaacgaatgctgtggatatttccgccttctgataaatatccgcaggcatgggcggcttcgagaatctttgcggcggtttcatggttgacgccgcgtttattgttaagcgcgttggatacagttgccggagaaaatccggtcatttcactgatctgtcggatactcgctttcatctcgttccctcctttgtttttattataatacgtgtgttgcaaaaacacaagtgttttatataaattttcatgtaaatttttagatttcgtctttatgcaaattactcaaccgttccgactccgtcgccgtctttacgtctgaattccagtggcgtcatcccttgagaacgtttgaactggcgcgcctgctttgaatagacaaccgccgtatactcttcgccacgctgtgaggtgcgttgccttgtttctattccgagctttacaccctgctcagtaggcagtctggtttttctgccgcttggaagctcggtgttttcaagtacgccttgttcttcgagccattttgatacagagcctgttttaagcgtacccgacttttcttcatcgacataagaattgatattctgcgttatatctgttgccgtaacgaatttctccgtggaagtaagcttctgacgcatttcgtctgtgacctcaaacggcagtctgttacgtttttctctcggcaagccgttcatttccgctattgcgtctatgttgtcaagcacaaactgctgtgccgcagggctgagcattattgcgtatcccggaaaaccgcccggagtgaaatattcattaagccgtataccctctgaaatgccgttttcggtcggcactcttttgagcttgccgttaggcagtgtttcttccgtcagcatgcctatcacggtcagccaatcggcaattgcagagcctttcagctttacggaaacatcgctgtcaatatgcttgtttatcatatcggtaaaggttgacagcgacacttcgtttataaaacatctgaattttgcccatggctcgtcggttattaccacactgccacgcttatgcggccttacagcttcggtgacttgcggcttagccacctctccgccgttttcaatcaccttttcaagtattcccgaaatgtagaaaaagcatcgtgacagcttgacgttattgataatatcgccgtccggcacaggcttatcgctaaaagggtctattccgtttgcgagcttgtctatgtattccttggcgtgcttcatgatttcgagttctgtaggcatagcgatttctccgtaaaaatatgttaattaattttaacacagatgaattctgattgcaatgtcatttgcaaaatcagaacggtttgccgtattttctgcgttctgatttttcaccaaaaatttcatttgatatttaaaaaatctccgaacataataatattgcaaggtcaaaaggacctgcataacaaatacggaggaaaacaacaatggctagtaccaataaaaagaacaaggcagcattaaacagcatcaagatgcaggctgcaagcgaagtaggcgtaccccttaaggacaacggctacaacggcgaccttacttcaaagcaggcaggttcaatcggcggtcagatggtcaagaagatgatcgaatcctacgaaatgtcaaacaagcagtaacctgaaatattgcgatcggtccggtgccattcaacaggcatcggaccgatttatttgcataataatatacgcacggacttttgatgaaagaaatccgctcaaaaaattcaaataatgtgaaaaagatattgaacttttgcaagaatagtgctataattttctttgtacaattagtcggtactgcaagcatacataattttcctgtgatttcatcagacagatgctgaaaggaaacggtatttcgcttgcataaggcagacgagctgccgctatggcggaaattacggcgagaaaatcgctttcaggaaggaatgtttttacaatggaaatcaaaattgagaaaactaaaacacctaaggcaaagcccgttgacgaaacaaagctcggtttcggtcacatctttaccgatcatatgttcgttatggaatatgacacgggcaagggctggcatgacgcaagaatagttccctacggggatatttctatttcacctgccgctatggttcttcactacggacaggaaatcttcgagggtatgaaggcatacagaactcccgacggcagcattcagttcttccgtccggaagaaaatttcaagagaatgaacatctccgctgagcgtcttgttatccctcagttaaacgttgacgattgcttacaggctctccacgagcttgtaaaaatagatgcggactgggtacctcatacagacggtgcttcgctctacatacgtccgttcatatttgccgctgacccgttcctcggcgttcgtcccggcgacaagtattactttatgataatcatgtcaccctcaggtgcatattatgcttcgggccttgatcccgtcaacatctatgttgaaacaaactatgtccgtgcagtaagaggcggtatgggctttacaaagacaggcggtaactacgccgcatcgctcatcggtcaggacgaggctcacaagcagaactactcgcaggtactgtggcttgacggcgttgagcgtaagtacattgaagaagtaggcgctatgaacatcttcttcgtaattgacggcgaggttgttactcccgcacttcagggctctatcctttcgggtatcacaagaaagtcatcaatagagctgtgcaagaagtggggccttaaggtaagcgaaaagagaatcacaatacaggaaatcgcagacgcttacgatgcaggcaagctgaatgaagtattcggtacaggtacagccgctgttatctcacctgtaggtcacttaaagtggggagataaggttatgcttatcaacgacaacaagataggacctatctctcagcgtctttacgatacaatgacaggtatgcagtacggcaagctccccgatgaaatgggctggatcgaaaagctgtaaggtgctgtaagttccgacctttctgtacagcaaaacggtcggaggcaaacactatttaaaacgaattatacggcagacaagcacgacagcgcagatacgttgccgtgcactgcttttaaatgcaaaacatgaaaggaaatttcgtacatgaaaaacacagaaaaaaccatggataagctggttgctctctgtaagggcagaggctttatatatcccggcagtgagatatacggaggacttgcaaatacatgggatttcggacctctcggcgttgagctgaaaaacaatatcaagtccgcatggcgtaaaaaattcatacaggagtgcaagtacaacgtaggtcttgacagtgctatcctcatgaaccctcagacatgggtagcatcaggtcatatcggcggattttccgatccccttatggattgcaaggcttgtaagacacgtcacagagcggataatcttatcgaggactttgacggcacaaactgtgcaggctggtcaaacgagcagatgatggattatatccgtgaaaaaggcatcacctgccccaactgcggcaaggctgatttcacagacataagacagttcaaccttatgttcaagacattccagggtgttacagaggactcgaagagcgagctttacctccgtcccgaaacagcgcagggtatcttcgtaaactttatgaatattcagcgtactacccgtaaaaaagtgcctttcggcgtagcacaggtaggcaagtcattcagaaacgagattacacccggcaacttcatcttccgtgtaagagaatttgagcagatggagcttgaattcttctgcaagcccggcacagaccttgactggttctacttctggaaggactactgcaagaagtggctcctctccctcggcataaacgaagaaaacttaagactgcgtgatcacgatcaggaagagctttgcttctactcaaaggctacaaccgacttcgaatatctgttcccgttcggctggggcgagctttggggcgttgcggacagaaccgactacgaccttacacagcacatcaagacaagcggtcagaagatggaatatttcgatcccgaaacaaatgagaagtacgttccttatgttatcgagccttcactcggtgttgagcgtctgttccttgcagttataactgaggcttatgacgaagaacagcttgaggacggtacaacaagaaacgttatgcacttccacccctacttagctcctgtaaaggcggcagttctgcccctgtcaaagaagcttgcagacaaggcgggtgagattgcagacgagctgtcaaaatacttctgcgttgattatgacgatgcaggcgctatcggcaagagatacagaagacaggacgagatcggtactcccttctgcatcacatacgacttcgacagcgttgaggacggttgcgtaacagtccgtgagcgtgactctatgaagcaggaaagaatgcctatcgcagatgtaaagaagtacatcgaggacagaattgcgttctgatggataaataatatgatatagaaaaacgaggtgcgttggcacctcgttttttattttcataatacttctccccctcttgcatttcttccccctttatgctatacttatccttaaccgaatatcgaaaatacggtacgaaaggctttttgcccggtaggtaatagggaatccggtgagaatccggagcaaccgtcattactgtatctgagcctatgctcacaagtcagaatacccccgtatttttcggcattgtctcttggacgaggaagaagtacagccgatcttcagctaaggctgtacctttatgctttttttggcatatccgtatggcttatgtttgctatgcttaaagatcagttgtgctttcactttttttggtgaaggcattttttattgccgtttttcgtatttgtttacggaggtgacgttatggcggacgaaaaattaagcaaggctgtcgctatgctttgtgaaaagtatgaacagcttggcactctgcccaaacgctccgattttactccaagcgaagtctgctttataaagcagaagctgggaccgtggacaagggcgcttgaagccgcagggctgaaagagcctccggcggtttcagcaaaggagaaaagccgtgaaaagcgtgaacgctccaggcaaagaagaaaagcggcaaaacgcagattagacggttaagccttacggcaaaaaagaataaaggaaggtaaaactatgacaaatgtaaagaaatttacagcaaaagtgacagctttactgctggcactttcactggcactgctgtcagtaccgcaggtgagctttactgtatttgccgatgacgacctcggaagcgtccgtgttattgtagaaaacacaacgtttaccgaagcggtcagcggcggtgaggctcctgcgtggacaggtaccaaggtcgacaagtgggtatcgcttgacaagacctcaagcgcaatgacctgcataaaggacgctatcgaaagctccggctttactcagctgggcgcagacgatggctacataagcgagatcgcaggccttgcggcgtttgacggcggctcgatgagcggctggatgggtacgctcaacgactggtttacaaacgagggtttaacagcctataccgttgctaacggcaagctcgcaagcggcgatgagatccgtatgcagtacactatggactggggtgcagacctcggcaatgactggagcggtacagatacatcgcttaaagcgataagcagcgattacggcacgctttctcccgaattcagcgcaaagacctataattatactcttactgttcctttcggcacaaagagcatcaatttccgtcctaccgcactgaacaagaaattcaagacggtaagcaagatcggcgacaagacgctgagccttacaaaacctactgaaataaaggacggcgatgttatcaccgttacggtaggcgaggatgcaacagcaagcgcttataaggtaacaataaaggagggcacaagacccgccgcacgttttgacagctttgcactttcggctttctcgcttgacggctgggacaatgacgcttttgaccccgaaaagctcgaatatgatgtaaagataaagtcttacagtacatcatctttctatatcaacagcggcactaagttcaacaaggacctgctgaagtgctatgcggtatacaccgatataaacggagttgcacagagaaacgagataaagtccggcagcttcaacagcatttctaatattcctttcggcttgactaagctgattttagagctttgctacattgacgatgaaagcataaagacgcagtatgtgttcaacataacacgtccctatgactacactgcggaaatcgcaggaacaagcggcatcacgcttgttcccgtcggcagggagctgtatgcgacaaagtacaacggctttgcagaaggaacggttttcagaaatgacgaaaacggcaatgtgaccgatacgaccggcacaaatgcagaatgccacagctacacagcctatgttttgggaggcaccgacagcgttgcacttactctcaagggcaaaaccgcaaacgttcatttcagagcgaaggctgacggcgaatatacagagcttaaaagcggcgaaacaactcccgcatattccttcggcaaggacggcactgttacagtatcaatagatgtggtttctgacggcgattatcttacagacaagtttgatgacgcagacaagataacaagctacaaaataaagctcgtaaaggctgacgtttctataaagaacgtacactttaccgagcttaaaagcgaacacggcgatatgtatcccgcattcgacccgtcacttctcagctataatatagttatagcaaatgacgcagaattccccacagtatatttcaaggttgccgacggttgcacagttaagataggcaacgatgccgcaacagcagatggaaacggcttttacagtcttgttaccaagagcgcaaacactactgtaacggtaacagacggcactctttcagaaagctatactgtcaaggctacaaagagaagcaagtatgacgtacccgacaaggtcgttgattatctttgcatcaatagccagtacaccaacgtttcctacggtgtaggtcccgagcagacgctcgcaggcactatgaaatcactcggtaacttcggcggttatatcacatattactatgaaaacccagtaacagatgacccctcaaacccctacggccttgacttctacgcttacggcaatagctttgtaagcggcggaagtgcggctgaaagcggacaggtatatgtttctgaggacggcaaaacatggtatgcgctcgcaggaagtgagcatttcgaagatacaaccatcaccgattacgaagtaacatacaaaaagacagccgacggtaaaacaagctggacagacaatcagggcaactcaaacgacggctcaaagcagacaggcagatggatttcacccagcgtttattatatgaacgatcttgcaaagggcgatactgtcacactcagaggcgttgttatccccagtgttcagggcagtatacagggcgacagctctacagcttcctttgtaggcacgacaaggttcggctatgttgactacttcaagaacggcacgataggcactaatgtaaacgcatacagcgaaaatgccgaatcaaacggtttcgacttaaagtgggcggtagatgaaaacggcaaccccgttacattcaaaaacggcgttcactatataaagatacaaacagcaagcaacatctgggcaggcgtattcaacgagaaatcgacagaggtttcttatgttgtaagaacaactgcaaacgagcaagaggtcggcacgacatcgcttcccggaaaaatcgtcttaacagacgcaaacggcaagacaataaaggaaatcactcccgatgataacggtgtttacgagataagcacaggcatcgaggaaagcgtgaacgtttccgtatcgggcgctgacgatgataacatttatatcaacaatcagcgtgtagcctccggcacagaggctaaaatcgcacttgaccggtctgaaataaaggttgtcagaataatcgttcagaacggcgaaaaacagcccgtatacgcttacttaaagctcgttcccgatgatgtaaaggcggctgagcaggttgaagaacttattgacgctataggcgatgtaacgctcgacagctatgacggcatcacagcggcaagaacggcttacgacaagctcagcgataacgcaaagacgcttgtaggaaactacgaaaccttaacagccgcagaagaagctctcgctaaggctgaggctgatgttataagcaatgcgatgaaggcgatagatgcaatcggcaaggtgaccgctgacagcaagaataagattgaaaaggcaaaggacacttactcggcagttcccgagcgtttaagagataaggtcacaaattcggatactcttgacaaggcaacagaaagatttgccgttatcgacacgataaagcaggcaggcacaaagagcaaggatcacttcgacactgttctcggcactcttgcggataacaatatctaccccgttcagtctatcggcggcgaatggtcggttatcgcactcgcaagagcaggaaagctctctgccgacaaggcggcaaaatactacaacgagctttgtgaagcagtaaaggctaacggttcagacagactttcagacagaaagcctacggagaacgcaagagttataatcgctctgtcctcgctcggaaagaattccgcagacatcgcaggctataacctgctgagcggtcttgacgatatggactatatcacatcgcagggtatcaatgcggttatattctcacttatagcattcgacactacagattacagcgcaaagacgcacgatgagcttatcgcttatattgttgacaatatgacaggcaagggctgggcgctcgccggcgataccgcagacgttgaccttacggctatggctatacaggcactcgctccctatgcggctgacgagaaggtaaatgcggctatagacagcggtcttgagttcctcgcagaatctcttgacgagaacgcaagatatgcaaacggcagtgaaagcacctcgcaggtacttatcgcacttgccgctctcggcatcgacccgcttacagattcaagattcatcgttgacggcatcacgcttatcgacgcacttgaaagctacgctacagaaaacggctacagccacacgctcggcggcgaagaaaactacatggctaccgaacaggcggcactcgctcttacagcttatgagctttcaaaggacggctcttcactttacgaaatgtctgcgaaggctgagccgacagaacctgaaaatcccgatacgcccgcacagcccggcgattctgtaaagcccggcgactgctcaggcaagcccgaagataaaaacgatcccataaatcccggtacaggtgtacttgtaacaggcggtatggcagttctcatctcaggcgcagttatgcttatttcgaagaaaaagcgcaaataagtaaaactattatgtaaatgcttgttccgtacctgtttttatgataaaataggtgcggaacaatttttacataaccgatatttcacggagaaaaaatgaaagctatttttgataaatacaaatatatactcggtcttgggctggctcttgtcgctgtggtgataattgcggtagtttccgccgctatgggaaaagatgccgccgaaaacagcggtatatcatacgttccccccgaaacatcatcgtttacaaccgctcaaagccttgtcgcaacaacggcttttcagacagacggcaattctcaggcaacgcccgcaacaaccgttacggacacttcttcacaaaccttacctgaaagcgaaaagccggaaacaacggcaataacctctgtcgcatcaacatcatctactgccgcagacatttcaaagccaaccgaaaagcacgttttcacatccgccccgacatcttcggcaagtccggcatcttcaaaagtcacaacaatatcgaccgcttcatctgtaatatcaacgaccccgaagccagacaagccgataaagaaatatgacaacacctgtacattcgttatagagtgcaaaaccatactcgataacaaggataaactgaaaaaaggacttgaaaagtacattcccgatgatgccgtaatattcagcggaacggtcggattcgacagcggcgaaagcgtatacgatatactccgccgtatctgtgacgaaaacagtattcagatggaggcaagctacacccctgcgttcagctcatactatgtcgagggtataaacaacctttatgaattcgactgcggacaaggctcaggctggatgtacagtgtaaacggcgttttcccgaactacggctgttcatcgtacaagcccgcaaacaacgatgaaatagcgttccgctatacctgcgagcttggctacgaccttcaaaactaaggagcaacaatggaaagatcacaccctgtaacagcggcaatgtattttctgtcggtgatactgataaccgcaatagtgcaaagccccgtctttatggcggaggctcttgtctgctctgccgtttttgcttttttactgaacggaaaaaccgccgcaagaacgctttttgtaatgctgcctatggcactgcttgcggcggttataaatcttctgttttcaaacagaggcataaccgtgcttgcaaagttgcccagcggcaacagtatcacacttgaaacgcttattttttcgctgtttacaggcgctatgacaatatcgctcgttatgtggtttatcggacttaacaagtgtatgacaagcgataaaacggtatatcttctcggaaaagcactgccgtcactcgctttgctgttatcaatgacgcttcgttcagtgcctatgtttgcaagacgggcaaagcaagcggcggcggctcagcgttttgttggaaacgatatatacgagggcaactttagaagccgcatcagaagcggtgttcatgttctctccgttgctgtaacggatacccttgagcatagtgcatataccgcacgatctatgaaatacagaggttacggtacggcaaaacgtacagcctacagcatattcagatttgcgccgtcagactttgtcataatgtctgttaccgtgatatgcacaacagcaattattattctttttgcaagcggtaaagcctattatctctactatcccgaatttatcctgccgatgacagctttcgatatttctgcggatgttttctggcttatactctgtgcgatgcctgttgcagccgagctttattcacgttttaaacggagggaaagaaatggagctttataatatttcaaatctgtcatattcctatcccggctcggataggaacgcactctccgatatttcgcttaaaataaacaaaggagaattcgtaatactctgcggcagctcgggaagcggaaaatccacgcttttaaatcttatgaaagcgcctgccgatgcaggaacgcaaaaaggaaaaatttctttcggcggtcattttgcaggctttgtcacgcagtttaccgatgagcagattgtctgcgataaggtttggcacgagcttgccttcggtgcggaaagcataggactttcacaaaacgaaatacgctcgcaggtttcccagaccgcattgttcttcggcatagaggacttgctgtactgcgactgcgacaagctctcgggcggtcagaagcagataattaacttagcgtctgtaatggctatgaaccccgatgtactgctccttgacgagccgctctcacagcttgaccctatcgcatccacgcagtttatttctctgcttgtgagaataaacaaggagcttggtatgaccgtgattgttgcggagcatcagctcggcggtcttttgtccgttgcaaaacgtgcggttatgctcgacaacggcaaggtgtgccacgacggcgacgcaagctctcttacagagcatctgtcagaaaataatcaccctatgctttttgaaatgccggcaggagtaagagcaagcgcatctgtcagcaatgttcttccactgcttgacgttccctccgctaagaactggtatacgtcctacggcgaaaatcacaggctcgtatcacctgccgccgcaggcgatacgctgtcggaggaaagctgtatatccgtaaaaaatctgtctttcggctataagaacagcaaaagagatattataagaaacctttcgcttgacataaagcaagggagcataacagcaatagtgggcggcaacggcgcaggaaaatcgaccctgctcagccttatctgcggtacgcttaagcaaaacagcggaaaaataacgataaacggcggaaagataggttttcttccgcaggaccctaccctgcttttcaataaggaaacgctcagagaagaatttgccgataatgccgatgaaatagtcgccgcatttaatcttacgcacctgctgtcacgtcacccgtttgacttatccggcggtgaacggcagaaggcggcgcttgcaaagctcgtttcctacggtgcggatatacttcttcttgatgagccgaccaaggcggcggacgcagtatataagcagatgttctcggcattgttgaaacagcttaaagcagacgggaaaacgatagtaatcgtcagtcacgatatggatttctgcgccgaaacggcggatatatgcgccctgctttttgacggtgaaataagcgtatctctgccgccgtcacagttctttgctgattcctcattcttcactacagacagtgcaaaaatcgccaaaaacgtatgcgataatgtttacactgtcgcagggcttatagcttctctcggaggaagggctgaaaactacggcgatctctccggacgttttcacggcataaaaggcgataagcccgacatagcagtaccacaacgcaaaaaacgcaaaaagctctcggttttccgaaaggtaatgctttcgctcggcagtgtcggatttgcttttatgcttttagccggtaccggcatattcccttttgagataccgtcagagccgttctggctgcaatatgcgttgctgtgcgtcccgatgattatgcttataatcggcgtcgctccgaaaaactcaatggcaaagccgcccgtaaccgcaaaaaaagttacgccgtccgatattgtcgcaggcattataaccgccgttcttatcccattcacagtaatactcggcacactttttatcccgaacggcacaagaaagcatctgctgataattcttgctgtgcttgtcgagtgccttgccgctttctttatcagcttcgaaaaaaagaagccgtccgcaaaggatattgcggtgcttgccgtgctttctgcggcggctgtcgcaggaagggagcttttctttatgttccctcagttcaagcccgttgccgcaatcgttatcataagcggaacggcgctcggtgcacaggcaggctttcttgtcggtgcggtttccatgcttgtatcgaatatgctgttcggacagggtatgtggacgccgtggcagatgtttgcaatggggcttcttggcttttttgcaggtatcatcttctcaaaaaagcgcaacacgctcgccctttgtatctactccttactgtcagtcctcgttatttacggcggaataatgaatatatcaagtgtgcttacctacacgaccgatataaacttacagacaattaccgcatatatcatctccggcataccctttgaccttatccacgcagtatccacagtaatatttgtgcttataacaggcgacgcgctattgaaaaaatgttgccgtctgagagtaaaattcggattatttcagtgatttcaataaattcgacaaaatttctgacatattatcccatttttcaactttatttttgatttgttattgaaatgcgcctttctttaaactataattttattataggataattgtaaagtgaggtgggagcatggcttatgtacttgaggttataagcaaggatggaaaaatcaaatacatcaattccgcaaaagcaaccgtatattgtccggaatatgccgcacggtatgacgacaagaaaactgctatgacagtagcggcggcactcctgagaaatgagtgctaccaatctataagtgttaaaaagctctcgttggagctatgtgttgcttcgtataaaagaaaccgttcattatcattcaattttatttatcccgatatatataagggcagcagctacaaataaaacgggtgttttatctgcattttcggcaggataaactcacaccgttaaaattataactttctgcatttatgtacaatctttcccgcaagcaaaaaatggcgtcacgcttttcggcgtgacgccattttcatatatagcaaggagaatcggaagcgtttattcctttacagagcctgaaacaaggttgctgtaaataaacttctgcatcgaaaggaagattatcaacgtagggatgatgcagataattacaccggcgaagataatttcccactgcgagccgtaaggaccgatgaacttgtaaagggcggtcgatacgacctgaagtccgtcgctgggcatatacaggtttgctgtatagaagtcgttgtatatgcttacgaacttgattacaagaacggtcgcaatagcaggacggagcatagggagaatgatgctcaggtatactctcggatatgaacagccgtcaagtatcgcactttcgtcaagggatacagatatgttattgaggaactgtatgaagatatagatcgaaactatatcagtaccgatataaaggataatcggtgcggcgagggtgtcataaagaccgagtgcgtgcactacctggaataccgttacctgcatagagatattcggcaggagtgcggcaataaggaatatattctttacgagctttgtgaacaccattgtaaaacgctgtacaacaaaggcggtcatagtacctgtgattatcgttcccgcacacgagaacacaaggataatagcggtattgataaggcctctcattacgttaccctgcaggaaagccgtcttgaagtttgccagctccaccaccttaggaagctcaaacgctccgcttgtcagaaaatcctcgtggcttttcagcgagccgagtaatacgactaccagaggcacgataactataaggcaggctatgacaagcacggcgtatttcaatacgtctatcagtattcttacacccttaggcgtttccttgaacctgtatttatccatattgaaagaggtctgtccggagttttcggttgttgtgatattatctgtcattgttacacctacttttcttccttaaagaatatcttctggatcatcgtaatcactattattataaacaggaggacgatagccattgcggacgcaagtccgatcttctggtactggaagcccgtttcgatcgtcttgataacgaaggtcgatgttcccatcttaccgccggttataatatacggtatctcaaatacagacgccgcacccttgatggcaaggataagctgtaatgcgatgattgttctgataccggggaaaattatgtgccagaacttctgccatgcgtttgcgccgtcaaggtctgccgcttcgtaaatgtcgggcgagatagactggatagcgccgatgaacatcagaatatcaaagccgatataacgccataccgacgcaaaaaccagacaccagttgttgatagcgccgtttgacagccactttacaggatctgctccgaaaagtgcgattatggagttgagcgtaccgccgtcatcgcctctgaagaatctctggaagataagcgctaccgcaacgccgttcataagataagggaagaagataactcccttgaacagtcctgcgaactttattttcgagcataacagagttgcaatgaaaagtgcaagtccgagctgtataaacgagccgacaaagtagtacaagctgttgatgagcgttgaaagatatgccatatcggtaaacagcgtcttatagttatcgaaaccgacccattgtacatttacgccaagctggtcacgttgctggaagctgaatattatcatattaacagcagggataatagtgaaaagtatcagcagtgcgacaggtatcgccagaaacagcgccgtggtcatgtatttctgacctgtataacctttaagccactgccataatgtgcgacgcttatgaattgcggtaacgccttgagtagccataaatctatcctttcaagaaataatttctatttttggtaatcagttgattttccccataaaaacctatacggaaagacttacgcctttccgtacgggtttgtgtgtttggagtatctatgaagaaaatacgatagcgttaattagccgttagccttgatgtatgcttcaagctctgcgttagcatctcttgtagctgcccatttcttattaacggagtctgcgatagccttgaagccgtcttcgcccttgccggcaaatgctgcttcagcaagctggagcttgaagttagctgagtcgcctgtccatataccaacctcagaatccttgtcgatagcgttgaatacacctgtcagaccttcgggagctgatgccgctgtgaagaattcacaaccgtcaaatgctgagaggtaatcggggagcttgctgccttcaagtgtattgataccgccctcagcctcagagaagccggattcagcgatgaaccattcaatatacttcttgccgagatccttcttgtcatcggcaatgttcttgtttacacccatgcagtagtctgctgcgtactgtgcgtactgcttgccgtccttagagaagggagcgggcatataaccgatattttcgggatcaagattgttatccttagcgatctgctggaactgtgaaactgcccatgaacccattgtcattgtagcaacttcgccctttgcaatcatcagctttgagccttcccagtcggagctcatcgggtcgccctcgataagagtagaatctgaatatatatcgtacatcagcttgaatacgttgtagtagggcttgccttctgtgaagaagtcttccttgtttacgataaggtctgtttcaaagttggggttgcccgaagaaggaacaacaaggcttgaccactgtgaagctgtccagcttgcttccttgaagtttgtgtagtaaggaattacatcggggaacttttccttgatcttctttaagtcagcgatgaattcatcggctgtcttgggcatttctgtgatgcctgcgtctgcccataccttcttgttgtagcagataccgccgctaacagaacctaagtgagcaaggccgtatactgttccgtcatacatcttctgatctgcccacttgtacttatccttaagctcatcgtacttgccgagaggctcaaagaagtttgaaagatcggcgagcttaactgtatcgggaatcatgagtacatcgccgtattccttggtgctcatcattgtcgaaacgtcatctgcgtagctcttgaatgactgatattcaacagtgcagttgtacttttcttcaaaagcgtctgtcatcttgtcgagtgagccgtcatccttacggtctgtacggtgagtaagaaccttgagtgtgatcttttcgcccgaaggtgtagtagaagattcttcacccgatgtcgcagagctgttatcttctgtctttgatgaagatgatgtactgcctgatgttgatgatgttgcattgttactgttgcaggctgccagcgaaactgctgtgcttgccgcaaggatacctgcgagtatcttctttgctttcatgtgataatttcctttctggtcggacagtgcttagccactggtccttagttgatagttaatgaatttagcttatgtttattaagctgtttccgcttgcttaattcacttaagattatacaacgttttagctaaaagtcaatacggctataggaaattcagctaaaacacataaattatatttgtttattatgtgcattaaaaacaaaattcacactaacttaactgtgttacacgattttattaagtaagtatcggtgtaacccgttttcacacttacaaattcgtttaactaaaattattttacgttaggttacatatatttcacactgtttttagttgtttttaaacgctgttaaattcgcccataaatatgataactcaaaaattcccggctattcattaaaaataaaaggagataaagttgcgggtgtgggggaagtgtggtataataacctcagacttaaaatccgccgggagcggattttgccgtgcaaaagcacggcttgcggcgcaccgcaacgacaaaatacggcgtaccgccgtgtcggtttacaccgacttgatttatggtataataacctcagacttaaaatcccattataaaaattatataggttttccgacagcctgacaggcatagcctgtcattatttcactgctcgtttcatataatgtacaaaaatttaccgaaaggtcggacaatatgaaactgaacatgaaacgatttgaatttaaacggctaagaacacgaattcccgcacttatagtcctgctcggctgttttaccgtcattgcggcaactgcagattactcgcagatgagcgtgagagcgtcaacatctcacgttacaaataagaaaaccatcgtacttgacgcaggacacggcggagcagacagcggagcggtcggcataaacggagagcttgaaaagaatatcaatctcgctattgtgcgtgatctcagcgatatgctgactttatcgggatttaacgtagtgctgacccgtgacagcgatatttcgatacacgatgaaggcgtaaaaggcacacgggaacagaaggtttccgatatgaagaaccgtcttgatattataaacaattacggtgactgcctgttcctgtctatccatcagaacaagttcaccgagcccgaatatttcggcgcacagattttctacacggcgaacaacccagacaaccgtatgatagcgcagataatgcaggataatttcaagacaatacagccgggcaatgacagacagataaagcaggagggcgacgagctgtatcttttcaagaacacaaagatacctgccgtgctgatagaatgcggattcctctcaaatcccgatgatgcggcaaatctgtcggacgccgcctatcagcgtaaggtagcctatactatatacaacgggatacttacatatctcacctcaaagcctgtggacgatgcaggccggacgggaatttcaacgagcagtattcccgaaaacagcggtgatattacaagctccggacagtaattcatcggaaaggacgaaaaaatggcaaaatcaaaatcagtatatatatgcagtgagtgcggacaggaatatccgaaatggagcggacgctgtaatgcctgcggcgcatggaacacgcttgaagaaacgcttatacagccaaaatcccacggtcttgcgagaagcacgggcggcggcagacttccgctttcaagtataaacaacctttcgttcagtgatgaaacaagatacaaaacgggaatgtcggagcttgacagggtactcggcggaggacttgtcaaaggctcgcttgttctgctcggcggcgaccccggtatcggcaaatcgacgcttcttttacagatatgcggctgtcttgcacaggataagaccgtgctgtacatatccggcgaggaaagcgaacgtcagataaagctccgtgccgacaggctgggagttgcaagcgacggactttatatcagtgcctgtaccgactgcgatactataatagagggcgtgcgtgagaataagccagatgttgtgataatagactcgatacagacaatgcagttgacagagcttcagtccgttcccggcagtcttgtgcaggtaagagaatgtacctcggcatttatgcagatggcaaagagccttgaggtagccgtgtttcttgtaggtcatgtaaacaaggacggcggtatagcaggtcctaaggtgcttgagcatatagtggacacggtactgtactttgagggcgacaaacagctaagctacaggatattaagagccgcaaagaaccgtttcggctcgaccaacgaaataggcgtattcgaaatgcaggacaagggacttgagcaggtcgaaaacccgtctgcaatgcttcttctcggcagacccgcaggggtaagcggtataaccgtgctttgtaccgttgagggcacacgtcctatactggctgaggtgcaggcgcttgtcagcaagacctcattctccgctccacgcagaatgacgacaggcttcgactacagcaggctgtgcgttctgctcgctgtgcttgaaaagaggacaggctacaacttcggcggatatgatgtatatataaatgttataggcggacttaaaatagacgagcctgcaagcgaccttgcgattgctcttgccctttattcgggacttcgtgatattccgataggcgatgatgtagcgatgttcggtgaggtcggtcttggaggagaaataagagcggtatcgcatataagagagcgtgtgcgtgaggcggcacgaatgggattttcaaagtgcattgtgccgaaatcctcgcttaaaaatcttgacaagagcgaaaactacggaataagcatatacggcgtggcaaatcttcagcaggcattcaaggtgcttgagatgttcacaaaagaaagcgaaggaaacaaagaatgaaacttaccgacatttcaacaataagacagctttttgaaaagcacggcttttcttttacaaagtcgctcggtcagaacttcctgataaatccgaccgtctgccctaaaattgccgagatgggcggcgcaggaaaaaatgtcggggctatagaaataggcacgggtatcggtgttctgacaagggagcttgccgagcgttgcgaaaaggtcgtagctattgaaatagacacagggctgaagcctattcttgacgaaacgctcgaagaatacgacaacgttgaggttatttttgcggacgttatggaaaccgatcttaataagctgatagccgagaagtttcccgatatggacgtgatagtttgtgcgaatctgccatactatataacctcgcccgtaataatgaagctgcttgaggaaaaactgccgataaaagcgataaccgttatggtacagcttgaggcggcagacaggatatgtgccgcagtaggaagccgtgagtgcggtgctatcacagcatctataaactattacgcaaagccgaagaagctgtttcgggtaaacaggggatcgttcatgcctgccccaaatgttgacagtgcggtcataagtcttgaacggtacgaacaaccgccgtacaaggtcgataacgagcctcttttcttcgaggtgataaagcaggctttcgctcagcgcagaaaacagcttgccaatcccgtttcggcatatttcaagataccgaaagcggtgcttgcggaaaagatgaccgaaggcggtataccggctaccgcaagagcggaacagcttacgatgagcgagcttgtgaagctgtacgagataataaacgaactgaaattcggataaagtgttgccacgatgtaaaaatcgtggcttttctttttatatttaatagacattttctctcatttgtgctatactttaaataaatgtaatctacaacattcgcaaagggggcggcgcatgaaaaagcatataccggcggcaacgcttgcagtgggtataatcgcactgtgtgccgttctcggcggctgtaacggagaagggcagacaccttctgttcagacgaccacaacctccgtcacaacatcggcaacggtaaaaagcaccacagcatcacagacttcaccgcagaccgcatcttcggcatcgtcaataactactgtaacaacaaaagaaacaactacttcggctgtcaccacaacaaaacaaaccgctccgccgaaaaccgagccgcctgcgacggtcgctcccgtaacagacccgccacagaccaagccgcctcagacagagccgtcaccgccgtatataatcactccgacagctgacgggatcaaggtttacagcaacgatgacgcacttatagacgcatcaaattcatcgcagggttatctgatgataaagctgaaaaaggcgatgagcggcagctacaggatattggtaaatgccgatgatataaacgtccgctacacgtttcagcttaataattcgggaaactatgaggtcataccgataacagagggaagcggaagctatactgtgagcgttcttaaagtaacaagtgcaggaaaaggaacggtaatgttcaagcaggcgctgagcgtttcggtttccgacagtttccttccgttccttactccgaaccagttctgtatgtataattccggttcatcgtgcgttgcgctttcatcaacgctgtgcggaggaaataaggatactatagcaaaaacagcggcgatttatgattatgtaataaacaacatcagctatgtttccactgctgaaaacggtgcaaacggctatattcccgtacccgacacggtgcttgcaaacaaaagcggaatctgctttgactatgcctcgcttatggcggcaatgctccgctcgcaaaaaattccgacaaaggttgttgtcggctacgcaggcgacatatatcacgcatggataagcgtgtatgtagacggaagcggttggatagacggctatatctattttgacggcaacaaatggaacagaatggaccccacctttgcggcaagtgcaaaggacgaaaacgattataaaagcatagttgatttcatatcggacggaagcaactattccgtgatatattattattgataagcaaaaaatgatacggagggataaaatgagcaaaaagcactacctttcaaacgaggatatttcgatactctgctccgagcttgcgtctgtcgtaagctcaggccttacaataacagacgggatactcgtcatattacaggacggagaggataagaacaaggcggcactccttgaaaagatactccgctctatagaaaccggcagcagtataacaagagcatttgacaaaaccgaagtgttccctaactattttataaagatgcttgaggtcggagaaagcacaggcagacttgataccgtgctggcttctcttgccgactattacgcaagcatagacgaaataagcacctcgatcaaaagtgcgattgcatacccttcggtactgcttatcattgtttttgcggtaattattctgttgtcggtttatgtgcttccgatattctcagacgtattcgcacagctcggacttaccctgcccgacagcgcacagtggattatgagcgtcggaggcgtcataagcgatgtcgctatattgataatcggaatactcgcttttgtgataatactcggcgttgtgctttacaactttgtaaggcctttcagaaaagcggttcttcgtgcggtttctcacacgaaaacggcaaaaactctgtatgccgcaagattttcagccgctctttcaatgacgctttccagcggaatggatatagacgaatcgctcgatatgtgcgaaaatctgctcgaaaacgaatatatgcgtgaaaagctgagcctctgccgtaaggaaatggcagacggaaagcctttcgttgacgcactcgacaacacaggtatgttctctgcggtcaatatgagaatgataaacatcgcattcagcacaggtacgctcgacaagactatggcaacgatagcggaaaatgcggaaaagaaggtttcagctgttatacagacctccgttgcccgctttgagcctactatggtaataatcatggctgtagccgtaggtttcatacttctttccgtaatgataccgctgatgagcgtaatgacggtcataggataatatcggtgataatatgaaaacaagaaatcattcaagtgcattttacataataagagatgcggtcattgcggtcgctctttctgcgacggctgttgcgattgtcacgctgtcgatagccggcagcgaggaaaaccgcaggagcgaaaatctcagaataatcgaaaacggtgtacgcaaggcggcggcggaatgctatgccgttgaaggattttaccccgataatatcggataccttattgaaaattatgacctgcatatagataaaaacagctgtatagtgcattacagcccggtttcatcaaatataatgccggatataaaagtaattgctaaatgaaacccaacattcaagtcaggaggaaaagatgctccgaagtcgttcaaatacgttaaaaacgaataaaagcggcgtagatatgatttttgtgctgacggtatttgtactgttcgtgtgctgtctgctggcggcggtgcttgcttttgccaaagcatataagcatttcggaagcgagatcgaaaagcgctttgataccgctactgcacagactcttgtgcttcagaagctccgcagctatgacagcggcgcagtatccgtcggaaagcagggagatacggattatctcggcttttcggatacgatagacggcgaaagctacataacgtatatttactgctatgacggagaactgagagagctgtttgtcgaaagctccgctccttttattgccgaaaacggaaacacattgttcccggcggataagttcacagcgactgccgataaaaacataatcagcttcgcaataacctgtaacggtgtgcagacctcgtcgcactactgcctgaggagcggaaaggaaggtgccggatgagcataaaaagacgttcaagaaacggagcattccttatcgaactgctgacggtaatcgcaatatttgccgtatgcgcggcggcttgcgtgagagttatcggaattgcggcaagcgaaatgaaatatgccgagcgtctgtcggacgcacagataaaaacagccgacattgccgagtgctataaaagcggcgaaagcatatccgagctgtcacagcgatatgccgatggtgacatcaggatacagctttccgaaagaacatcaggaaacatacagtaccttgacatcaccgcctcggacgatgaaaacacatatatcaccataacaagtgcaaggagggttgcctcttgaaaaacagcgcacgcagtgagaacagcagaaaaagcctgaacagcatcgggctgtcctcgcttcttgtcatattcgtggtgctggcgtcggtcacactgtcggtcatgtgtcttattacggtaaggcaggacctcgacagagcaaaaaaactcgccgtaacgcacgaggaatattactctgccgacactaaggcgacagaaaagctcgacagcctttatctccttcttgctaacgacagtgtaacggatatttctgcggcggcaagggagcttggcattgaagtgacaggcgggaaccgtgaaaaccgtgttctgacattctcgtggagcgaaaccgtaaacagcgggagcaggcttgtctgcaaggcggaatacgaaaacgaaaatctcgtcataacaagctggaaaattataagcaataactattacgaagaagaaaactcgcttcctgtgtggaatggcgagagtttaccggtataaaaacagccgacagtgaaaggataacattatggaactgatggaaatacttaagggtgcagttgaaaagaaagcctcggatatttttattatatcgggtcttgccgtgacatataaggaaaacggcattatcaccaagcaaaacgacaatataatcctgcccgccgaggcggaaaatctgataaaagaaatataccgtcttgcaggaagggatatatcaagatacgaggaaacgggcgacgatgacttttcggtatccgtaaagggactcagccgttttcgtataagtgcgtacaagcaaagaggaagtatggcggcggtcatccgtgtagttgaatttgatatacccgattacaatgagcttaatattccgcaggagatcataaccgatacagtagcaagaacaaaaggtcttgtgcttgtcacaggccccgcaggcggcggtaaatccacaacgcttgcctgcattattgacgaaatcaacaagcagagaaacagccatataatcacactggaagatcctatagagtatcttcacaagaacaaaaagagtataataagccagcgtgaaataaacagcgacagcaagagctatatcgtagcgttaagagcctgcctgcgtcaatcccccgatgttatactgctcggtgaaatgcgtgactatgaaacgataagcacagcgcttacagccgccgaaacaggtcaccttgttatctccactctgcactctgtcggagcgcagaacacgatagacagaattattgatattttcccgccgagccagcaacagcaggttcgtatccagctttctcagcttttatgctcggtaatatctcagcagcttatcccctgtgaagatggaatactgcgtcctgcatttgaaataatgaagtgcaacaacgctataagaaatatgataagagagtcaaagacccaccagatagacaccgttatcacagcgtcgggtgaatcgggtatgtttactatggactcctaccttatgcatatgtacagaaacggtcagataagcaagagcgagcttgtcaagcacgcatctcaccccgatataatgctcagaaaaatcggagaagaaaagtaaaatttacaaaaatataaagtttggttcagaatttcataaaaataaaaaggcaggctcaaaagtgcctgcctgtaaaccgcattccacgcaaaaaagaaaaacagcatcactacaacctctgctgcggtatgctgtttctcatgacggaaagaaaagtaaaaacgtgaggtagacatcatctcaaatctacatctcaaccttacgagcatattatgccacatcgtggttacatttcggttacattgcgaacagcagccggaatcgacgtcatatttctatttatacgatagttgattcaacattttagcaagcgaattgtgcatatttacacgatattagttatttctgtaagcctgatttacagaatatagcatcatatttacacaaatcgccaacagtgcaacgcttgttgcataacatcaatcagaaattttgaattttgcttaaattattttcacgctttagcgtgaaatttcattaaagcacacgttaagacgaaagaaaaaacagggaggtgaaaaaatgccgaataagatacatattactatgttcggtcagttttcaatatcataccgtgacaagcgtctgtgcgaaaacgagtacaggggttcgaaaatgattttgcttcttgaatatcttattgcacagcgtggcagagagataacacagaatgagcttatcgaccttttttggtcggacagcaaaaatcctgccaatgcccttaaaacgctggtacacaggacaagagcgatgcttgacgagatgataccctgcggcggcggcaggctcatagccggaagccacagctcatacgcatttaccgaaaccgacgactgtgttatagattcctctcttttcaaagagtacataagcaaagcggaggacgagtcgctttccagaacaagacgcataagtatgtataaaaaggctatcgccctttacaacagcggttatcttgcaggagcggtcggagaaacgtgggtacagcctataaacgtatattttcatgcactttataattccgctgtggacaaatgcgctcagctactttaccctatgggcaaattttccgaaataataacgctttgtgagcgtgccacaatgcttgaccagtccgatgaaaaaatgcatgcaaaccttatccgtgcctttgtcgcaatgggagattacgaacgtgccgcaaagcagtatgattatatccgtgcatatcttatggagcagtacggtgccgcaccgggcgctcacctcaccgagctttatgagcttacggtaaagccaagaaatgatgtacagaataatctcgatgcggtaataggcgatctcacgggcgatgacagcaaggagcaaaaaggcgttttttactgccagtacgaaatattcaaatacatattccgcctgtacaggcgtgaaagtcaaagaatcgagagcaagctgtctatctgccttgtttctgcggttgacagcagtaaaaatgaacttcaggatataaaactgctcgaaaaggcaatggataaaatttcgttcagcataagcaattcgctgagaatgagagatgtatacacacgctacagcagaagccagtatcttcttttgttacttgatgcggacaaaagctcgtttgacggcatagaggaacgtattatgacgaggttcagacgaagtaagacgatggacagcgtaaatgtaaaatttgatttcaaggaaatatgaaattcgcccctgcaaaagcaggggcgaattcctattatcagattttatcagagcgtgaaacttccgccgtggtttgcctttctccagtcaacatattcctcatatgttccctgtctgtcgtaacagcccttgtcggctatttctattatacggtttgcgaccgtctgtactatctcatagtcgtgagaagcgaacagcacgttgcccttgaagtccgaaagaccgttgtttacagcggttatgctttcaaggtcgaggtggtttgtaggtctgtcaaggataagaacgtttgattggaacagcatcatgcgtgagaacatacaacgtaccttctctccgcccgataaaacgtcaacattcttgaatatatcatcgcccgagaacagcatacgtcctaagaagccacgcagatatgtttcggtttcgtcctttgaatactgtcttatccagtcaaggatggacagcttacagccgttgaagaatgcgctgttgtcctgagggaagtagcttacgcttgcggtgcttccccacttgataaagccctcgtccggttcttcttcacccatcagtatcttgaacagtgtggtaacggcaatctcgttatcgccaacaaaggcaatcttgtcgtttctgccgacagtaaagctgacgtggtcaagcaccttaacgccgtcaaccgtctttgtaagcccttcgacctgtaaaatatccttgcctatctcacgctccatatcaaagctgatgaacggataacgtctgcttgacgcaggcagttcctctacagtcagcttgtcaatgagcttctttctcgatgtagcctgctttgacttggacttattcgccgagaaacgctggataaagctctgtaattcctttatcttttcttcgttcttcttgttctgctgctttaacatcttctgtataagctgtgaagattcataccagaactcgtagtttccgacatacatcttgatctttgtatagtctatatctaccgtgtgggtacaaacgttgtttaagaagtgacggtcgtgcgatacaacgataaccgtaccgaaatactccgcaaggaagtcctcaagccaagccacagcgtcaatatcaaggtggttcgtaggctcgtccataaggattatatcaggatttccgaaaagtgcctgtgcgagcagtaccttgaccttttcgttacctgcaagactgctcatctgagcgtacataatactctcgtcaagaccaagaccctgtacgagctttgatgcgtcactttcagcctcccaaccgccaagctcggcaaattcgccctcaagctcgcttgcgaggtttccgtcctcctcagtgaagtcctccttcgcataaagagcgtccttctgcttcattacctcataaagacggggatttcccattataacggtatcctgaaccgtatattcatcatatgcgtagtggtcctgcttaagtaccgacatacgcagaccctcctgaaccgtgaccgtacccgttgtaggctcaagcgcaccgcagagtatctttaagaatgtggactttcctgcgccgtttgcgccgataacaccatagcagttgccggctgtgaacagcaggtttacgtccttgaacaacatctgtccgccgaatgaaagactaacgtccgatactgtaatcatttttgtttcctttctcttttacactttaaatcttatgatttccgtacttttttctgtttctcactccgtgttttaaccatatagatttaagtatatcatattgcaaggaataatgcaagcaaaaccgcagaaataaaggaaattatagcttacagcagtattattgcacggacagctccatagtttctgcgtcaagctcatacgttgtcacagagccatcgtcattctccgtgccgataataaagcagggcttgtctgggtacttgttctgatttacgctgattacaccgtctaccgttatctgcttgtcgagcattacattgataaaagtccacgtccttttgccgctcttattatatgtgtctgtgattccgtacattcccgttccgtcgccgaagccaagcataaagacgcttttcccttctcccgccgtataagtgtttacatagctctcctccatatcttcgtcaaggctgtacacgcttaagcagtcatagcccacatcatagacggtggcaccgccgttgtttatattgccgtacttcacaagccgcagagggaacacggccttcttatttctatacgagtcgagatttataaagctcactcgtccctcataggtatacgtcttgccgttatcaagattcacgcagaccgttttataagcattgccgtccggataagaaataagattttccgcaataaagctgaatctgtcgtcctccttttcgaacacctgctcctgtgttataaggtcaaatattcttactccgttcatatccaaaaccgccagcttatcgccgtttctgttaataccgatgccatcggcgcttttctccgttttgatattgctgagcagtatttttccgtgagcgccgtatatattatatctgccatcctcattgccatctccgattatatatccgtaactttgcaatctgtcaagcgtcctgtcgcctttcacaaacggagtgccgtcaaggttcagatagtaattcactgttgcagagtttttgcccgtttcgtcatacataagcacgctgagcgtcaccgccttgccttctgttatgcaagggctcatataactctgatctacgctgttgctcacatagtattcctcataatgacggtttccgtacctgtctgtataataaagcctttcgccgtcatctgcaacaaaaatataattcgctatattttgcgttatttcgggcgtgctttcataatatacggcacctgcgtagaaatcaagcggcgaataaccgtttgccgcactgttgccggcattgcacattccgcttattccttccatctccgccttgccgttgagatcatttaccgttacaccgataagctcaggcgcatagccgttataatcatagccgtttttgttatttatgtatgtcttagatacaaaatatccgtcgggcgacattgcacttacaaattcgtactttgcctcaagtgcgaccttgccgtcctttccgataaatcctgttttgccgttctcagccgtcagataagccatatagccgttttccatcggctgaatatcatactttgtagtcagcagtacgttcatatccctgtcatagcaggtgaagctgccgtcatcgtttcttattaccacgcttccgctgttttcgcttattctcggcttgttttcatactgagccaacagctgaccgtacttgtcatagatataatacttgtcatagtcaaagcacatcagcctgtcaccgtatgcctttgcgtacacgaactttcctatgctctttccgtatgccgtgtaatattcggcaagggaattattgtccttggttttgtagaaatcgtttcccagaaccgtaaacgccctctcgtacaccgcatatacatgaccgctgttcctgtctgccataacatactttttcttagctttgccctgcttgcccgaatctttttcacggtcggaactgaacgatgcaatatacagcttatcgccgtattcattcagattgaagctgacagaagatgaaaccgtcagcacagggcaaagcctgttatcgtatatcaccgtctgactgggcttattgctttgtataaggtcgcaggctgtgtattcgttcattgaatatctctcagacgagccttgcaacgccgctttattaccgaacagatcttttaccgcagtacgctcctcctcgcagtatcttataagccttgcgctgtccgtgtcaattaccgatgcgttgacaagttcgttttccgtatcggtatctataagcgtttctccgggagctactattctgccgcttaatgtgcggctgttgcagacgataaaatatccgtcatctatacggtaatcgcaatactgcggattgtactttctgtatacctcgttgtatgactttgcgttttttgctacaggtatcatatcgctgtaaatataatcccacatatcttcgtcaaaagtattgcctgcaatctcggagaaataaaactcccccaaaaacatattctccccgtcaaacttttcaaagtcctcagggtcgtaccagctatgcacggtatttgcaaacatcagcttgtcggacgcatagctaagccttcctattacggtatttccgttcatatctatgacggaatactcagtgccgctttttacataggcgtagccgtccgcataatatccgctcgctccgtcaaaccgggcatccgtcaccttttcgccgtttgtgttgatatatcctattttagcattatcataaaacggcgcaagtccgcagttgaacgagccgaattgattatcgctctcaaattgctttccgcttgcggtatatccgcagtattttcccttttcgtaaacgcaggcatagccactcatatcaaatccgcttacaatgtgtgaacccgttgaacaaagatatatttcgtttgcgttatcgcaaagcagaacatccctgataaagcccttatcatctcttttgagcagtaccgcaccgctgtcgtaagactttatatcggcgccgcaaagatactctcctccgacctgttcaagcgtatcggctttgagcagctttgccttatacagcctgctttcgtcatccgtaccgtcacagacgatgagcagttttccgctttttgcaatgcggtcgtaatagtcggtaagctgtatgccgtctgccgagaacacggcatactcccttgtaaagtcaagcgttgtttcatcttttctttccgcttgtctgaagccgatatatttatcatcgtatatcgccgatattcccgtgccgtttgcaagctcggtcacttttccgtcagaactgagaaggctgtatattatatcataatagccccttccgccctcaagttccggcatcatcaaagtatacgcaaacgcataaccgctgtcgttcatatccgaggcatagctgaacatactgccgtcaaacgcttttcttcccctgctgtcgacaaatccgacatttccgttttcgtctgtgaccttagcaagtcccttatccgaaaagctccctgcgaagctgtactgcggctgtgctacaaactcgccgtccttttttatgtatccgaactttccgtcaaccgcaacgggcgcaacgtcatttgtgtcctcgttaaaggcataagccgcactgtactgcggtttcagcgtggtgcttccactcttgtcggcatagccccacttcccgtcaatgcacacgggtgtcaccgattgaatgaacagcttgtcgcccgtgccgtaaaacgtttccgttttttcgccgtacattccgaatatatcaaacacaaacaccgcaaggcttgccgcacccagtgccagcacacctgccgcaccgcctattatcgcaccgacagggcttttcttcttttcctgcggtgtttcacccgtaaaagccgcacagaacgggcagaattttacgttttcatctatttctcgtttgcagttgggacatattttactcatattttttctccgttatatctgtcttaatttataatctcagcacactctttgatttacatatcgtgcgatgacctttccgtaaggctaaagtacattacgcacatacgaaagactgtcgcagtccttttcgataaatgaatctgttttagaaacgtatttcatacgctttggataagcatatgtctgttcgattttcacggtatagatcatattttcctccaaattacaacatcaacagccgtttttttagatttgcgttcatcattcaacgttcattacttcattaaactctctgaccactcttctcagcccgctgtcaatgagcagatttccttttgtcgcaatctctttaggtatctccctgtaatacgcctcggcgattccaccggttatacacgcaatggtatcgctgtcgccgcctatagaaattgcctttcttatcgcactctcgtaagagtctgattcaaagaatgcttcaagtgcaggcggaacagaatatgacgctctgctgtcaaagacataatctctgcggatttcatcaagcggttgaaatctgtaaccgtacattttctctattgtccgcttgatgctgtccttgtcctcttgctttcgtgcaaggaatacacaggttgccactgtctttgcaccctttatcgcctcacggttatggtgcgtgtagtaacagcttgcctttacttcctttaaaagcggttttaagtcgtcaaacgcataaccgatagccgtcaccctcatcgccgctccgtttccgtagctcctttgaattcggagcgtgtcactttccgcccactttgaaaacatctgtccgaatcctgcgttacgatagcggttataatactgcttatagcgagcggcataagctttccggctgttacagcccgaattagcgttcagtagcttttctgcgaccgccactgtcattactgtatcatcggtgaaatgacttcccggtggaaacagctcaaactcttccgtttttacattatgcagttctcttgtcgaaccgattatatcaccgaaaattgctccgagcatataccctccgatgtcacgttaataatagactttcagcggtaattgtaaatatagtcgcttcccgcttacccaaaatatcttatataaatattctatcacaaacaaaatttcttcacaatagaaaacctgaaactgtaactaatttgtaactatttgttaccgttttgtaaccttaggctcggattgttatgataagcccggacccgccgctttgttgtactatactcataaacaacaagccgtttaaaataaaattgacaaaacgcttgacaaagggaaaatttgattgtataatcaatgtgtatgatatttaaaggctgtgacgaggacagtagtgcggatataaagccaaagcgagccgacgacggtgagaggtcggtgcagagttaccgtatgaatatcacctccaagctgcccgccgaaattgccgtttaaggcgagagtagaacgggacgtttttccaacgttaaaaggaacgcatttgacggaatgacgaaacggtggttataaagactgttatgaaattatagtccttatccttttcggaggataggggcttttttattttccgcaaacgcaaagaataaaataatatgcaatgggctgacccccaccccatataacttccggcttttgccgaagagatttatatgacagggtgaattgcaaaaacaggaggagaaaaaatgtcactttatgaaaaagtacctgcctcggtaaattttgtcgagagagaaaagcagacagagaagttctggcacgacaacgacatattccgcaagagtatggagcagagaaagggcgacaagacctacacattctatgacggtccgcctacggctaacggtaagccccacatcggtcacgttcttacccgtgttatcaaggacatgattccgagataccgcacaatgaagggctataacgttccccgtaaggcaggctgggacactcacggacttcccgttgagcttgaagttgagaagatgctcggtcttgacggtaaggatcagatcgaaaagtacggacttgacccgttcataacaaagtgtaaggaaagcgtatggaagtacaagggtatgtgggaggaattctcacgcacagtaggcttctgggctgatatggacgatccgtatgtaacctatcacaataactttatcgagtcagagtggtgggcattaaagcagatatgggaaaagggtcttttatacaagggcttcaagatagttccctactgcccccgttgcggaactccgctttcaagccacgaggtagctcagggttataaggatgtaaaggaacgttctgcggttgtacgtttcaaggtaaaggacgaggacgcttatatccttgcatggacaacaactccctggacacttccttcaaacgttgcactctgcgtaaaccccgatgaaacctatgtaaaggtaaagacagcagacggctacacatattatcttgcagaggctctgtgcgataaggtactcggcggcgataagcccacagccccctacgagataatcgaaaaatacactggtaaagagcttgagggcaaggagtatgagcctttattcgactgtgccgttgagatatgtgaaaaacagcacaagaagggctattatgtagtatgcgacaactatgtaacgctgacagacggtacaggtgtcgttcatattgctcctgcattcggtgaagatgacgctaaggtcggcagaaagtatgacctgcctttcgtacagcttgttgacggcaaaggtaatatgaccgccgaaacaccttacgcaggcatattcgtaaagaaagccgatcctatggtgcttaaggaccttgacgaaaagggcttactgtttgacgcacccaagtttgagcatagctatccgcactgctggagatgtgatactcctctgctgtactatgcaagagaatcgtggttcatcaagatgaccgctgtcaaggacgaccttatcagaaacaacgaaacgataaactggatacccgaaagtgtcggcaagaaccgtttcggtgactggcttgaaaacgttcaggactggggtctttcgagaaacagatactggggtactcctcttaatatctgggagtgcgagtgcggtcacaagcacgctataggcagtatcgaggagcttaagtcaatgtctgacaactgccccgacgatatagagcttcaccgtccttatattgatgcggttacgataaaatgcccgcactgcggtaagcagatgaagagagttcccgaggttatcgactgctggttcgacagcggttctatgccattcgcacagcatcactatcccttcgagaacaaggaaaagttcgaacaacagttccccgctgactttatctccgaggcagttgaccagacaagaggctggttctactcactgctcgctatctcaacgctcttattcaacaaggctccttacaaaaacgttatagttctcggccttgtactcgacaaagacggtcagaagatgtcaaagtcaaagggcaacgcagtagacccgttcgagtcactggctgaacacggcgcagacgctatacgctggtacttctatacgaactctgctccgtggcttcccaacagattccacgcaaaagcagtaaacgagggtcagagaaagtacatttctactctgtggaacacctacgcattctacgttctgtacgctaatatagacaatttcgacgctactaagtatacgcttgatgttgacaagctcagcgttatggataagtggctgttatcaagactgaacacagttgtaggtgaggttgacgataaccttgcaaactaccgaatccccgaagccgcaagagcattacaggatttcgtggacgagatgagtaactggtatgtccgccgcagcagagaacgcttctggtcaaaggagcttacacaggataagataaacgcatatatgacgctgtacacagcgctcgtgactatcgcaaagacatccgctccgatgactccttttgtatgcgacgatatttacagaaaccttgtctgctcgcttgacaagaacgcacctgtaagcgtacatctgtgcgacttccccacagtaaatgaaaagcttatcgacaagcatctcgaggaagaaatggacacagttctgaccgttgtaacgctcggacgtgccgcaagaaatgccgctaacatcaagaacagacagcctatatcaaagataatggtaaagggtgacaagacgcttgagcctatgtatgctgatattgtcaaggatgagcttaacatcaaggaaatcagctttatagataacaccgaccacttcacaagctacaccttcaagccccagcttaagacgctcggcgctcgtttcggcaagcagataggcgaggtcagaacaaagcttgctgaggttgacggtcagaaggctatgaatgaaatccgtgaaacaggcgctatgacacttacactttcaacaggcgatgttcagattgcaaaggacgacctgcttatagacgagcatcagaaggaaggctatgcggtagtgaccgacagaggctacacggtagttcttgccacaacgcttacacccgagcttatcgaagaaggtaacgtaagagagattgtaagcaagattcagacgatgcgtaaggaggcaggctttgaggttatggatcatatcgttatctactgcgacggcagtgacaaggtagccgagatactgacacgcaacaaggacagtatctcagaggatactcttgcagacgatatagtgaccggcaagacagacggatttacaaaggaacaggatataaacggcgagaacgtaactctcggtgtaaagaaagtatgagtttcaagcagacgctgacaaatcttttcggacataacgccgttaaaaaggcgctcatatgggtgctggtcgtggctgttgcggttatagtcgtggttacgcagtttgcttttcccgtaaaggcacaatatgcgtacacacggctgtacagctacagcggacagagctttgacaatatgataaaaaacgtatacgataagctgaaggacggcactcaccttgacagtgggtctacaagcaagctgctgagcgacacggattttgatatgacaaaatccgaaaactatctgcgtgttgagatggtgtttgattttacaaacatcggtatgtataaaataagcaacatacagttctccattgacgatataccgtatgacaaacaggcttttgtactgaaggaaacaaacatttcgtcaatagaccgtttcaacagcagtaaggtttcgctcatattcgttatcgacaggtcgggacttacaaacgaggaaataacaaaggctgtaagctcgctcaagataagctacaagttcgaccgccccgagcttttctcatcgggcggagaaataacactgcccgaaaccgtactactgccgtttgacgaagcaaaaacaggtggttgagtatggcgaaaattctcagtaaaatatccccgaagcacaaaggcgtgctgtgcattatcagctccgccttttgctttgcttttatgggtgcattcgtaaggctggcaggcgatctgccgtctgtacaaaagagctttttcagaaatcttgtcgctttcatatttgcggcggcgatactgataaggcagaaaggctcgtttctgccgcagaaaaaaagcaacatcggcgcactgctgatacgctcagtatgcggtacgctcggaatactctgcaacttctatgcggtagaccatctggcattatccgatgcggcaatgctgaacaaaatgtcgccgttcttcgttatcgtattttcggcaatgttccttcgggaacgtacaaatttagtgcagacgctcggtgtaatagtcgcatttgcaggaagtctgcttataataaagccgagccttgcaaatctggagcttgtgccgtcactgctcggttttctcggcggtatgggcgcaggtgcggcttatactgcggtaaggtggctcggcatcagaggcgaaaaaggaccttatatcgtgttcttcttctcgggcttctcctgccttgtaacattgccgttcctgctgttcgattttcacgttatgacctggcagcagtggctcgtactgctcggtgcaggacttgcggcggcaggcggtcagttcagcatcacagcggcatataaatttgctcctgcaaaggaaatatcggtatacgattattcgcagataatcttttcggcactgctcggatttatcttgttctcgcaattgccggatatatggagctttatcggatatgtaataatatgcggcgtaggtgttgcgatgttcttctataataaccgcaaggacaaatgacctacagcataaaatcaatttcaagcgcaagaaaatattgacacgcaggtatcaatgtggtatactgacataagacacataaaatcggaatgtgtgtcacttattgaaaaaagaggtatgttattatgaaaacagcggcacaggtatttattattttaagtatggtatgcggattctggatgatacttccgcttatcttcggcggtatcgcattaagccagatgagcaagggacagagaccttcaacaggcataagcgtttgtgttctgttgttctgcagctttgtaggcggtatccttctgctttgcgcaaaggacgaggacttctacaagcccggtacaaactacggctacaaccccaacatgaacaacggctacaatcccaacatgaacaacggttataaccccaatatgaataacggctacaatgccaatatgaataacaacgcttataaccccaacgcaaacacaggttacagcaacgcaaattacgctgcgcccgttaacaacactactgcagacaccacaaacaacaacttcaacaataacggtattcagcagtaagaccaaagataaataaatcagctgtgacggaaagtaatattccgtcacagcttctttttatacatataaatcagccgcagttttcactgcggctgaaattattgttatatattctctgctatcttgtcgcccatctccgagcaggataactttgtcataccctcgctcataatatcgcctgtgcggaaaccgtccttcagcaccttgcttactgcattttccacagcgtcagcttccttcaccatatcaaagctgtaacggagcatcattgcggctgaaagtatggtagctatcgggtttgccttgttctgacctgcaatgtcgggagcagaaccgccgctcggctcatacaggccgaactttgtttcgttcatgcttgcagaggggagcataccgatagagcctgtaatcatgcttgcctcgtctgacagaatatcaccgaacatattctccgttaccataacgtcaaactgcgcagggtcctttacaagctgcattgcgctgttgtcaacgagcatatgctcaagagtaacctcaggataatcctttgccacttcggtaacgacctttctccacagccttgaagaatcaagaacgttagccttgtcaacgcttgttaccttctttcttctcttcatcgcaacgtcaaatgccttgattgcgattctgcggatctcgtcctcgctgtatgtaagcgtgtcagtagctgtcataacgccgtttacttcttcggtctttcttgcgccgaagtaaaggccgccggtaagctcacgcataatgagcatatcaaagccctttgcgcttatctctgtctttaaggggcaagcgcctgcaagctccggataaagcaggcagggacgaagatttgcaaacagtccgagcgcttttcttataccgagcagacctgcctcgggacgcagatttgcagggagcttataccacggcgatgttgtcgtatcaccgccgatagagcccataagcacagcgtctgacgctttgcaggcggctatcgtttcatcggtcagcggtacgccgtttgcgtcaatcgagcatccgcccataagaagctgtgtgtagttgaacttgtgaccgaacttttctgccaccttatcaagcaccttcatgctttcggtaactatctcaggacctattccgtcgcccttgataacggcaatattcttttccataggtaatatcctttctctgagcttaaagctctattttgtataaagcggattttccctccgccttttcaaagccgaatctgacaagaaatcgcactgcgtcctcgctgtcgggggtcactacggcatacttatatccgcaggcacgcattgttctgagcgtgtggttcagcagttttctggcaacgccgtaatgcctttcttcctcgcagacaaacagcttctccagtctgacctctttgttcaggctgtcgggtatttctgttgttatgcagacagcagacagcacatcatccgtataaagtccgaagccgtgcattccgcccgacgtattgttaaaaccctgctcttgcagttcgctgtccgataacgcttttatatctaccctcatagcataacgctttctgcggtcttacttctttaaggagttcagcaggccgcccttgttgattatatccttgatgaattcggggaaaggctcagccttgtatgtacagcccttcgtcacatttgtgataactcccgtatcaaagtcaacctcgacctcgttgccgttatcaatatccttggcagcctcgtcgcactctaagattgcaagtccgatattgatagcgttgcggtagaatattcttgcaaatgtgcttgcgataacgcaggagatgccgcttgccttgattgcgataggtgcgtgttctcttgagcttccgcagccgaaattcatattagcgactataatgtcgccgtcctttacattctttacaaagtccttgtctatgtcctccatacagtgacttgcaagctccttgtgatcggctgtattaaggtatcttgcaggaatgataacgtcggtatcaacgttgtcaccgtatttgtgtactgtaccgtgtgccttcatatatgtctgtcctttcttatatttcaaaatctacgcagctgcgtcttgccgtgtaaggtcttaccgtgctgtcggctaccttaacgtgttcgggatgagtggaatatccctttaacgcttctgcactttcgaatgtgctgtcaagcataaggtcgcccgtggaagagccgagaatatcggttatgacctttatctcaagaagtccgtctatcttgcctgcaagcccttcaagtccctgctttataagacggcatctttccttcttttcttcagccgaaagctcgtccttcaagttccagattattatatgctttaccatattctcaccttactttatgcctgttatcttacctgctatagcacttgccgccgcaactgccgggcttgcaagataaacctcgctgtcaacgtgtcccattcttcctacaaagtttctgtttgtggtggaaatagcacgttctcctgccgcaagtatacccatatgaccgccgaggcacggaccgcaggtgggagtagaaagcacacagcctgcatttacaaatatctctgcaagaccttcctttatgcactggagatataccttctgagtgccggggattacgatacatcttacgccctttgcaatgtgcttgcccttgagaatctcagcggcgatacgcatatcgcttattctgccgtttgtacatgagcctataaccgcctggtcaatctttatatcctctgttatttcatcgactgtctttgtgttttcgggcagatgagggaatgaaaccgtctgctttacggttgacaggtcaatgtcgataactcttgaatatacagcgtcctcgtcagccttgaatatatcaaaatcacggtctgctctttccttcatatatgccattgttatctcgtcaacttcaaatataccattctttgcgccggcttcgatagccatattggcaatgcaaagtctgtcgtcaatcgaaaggctcttcaagccctcgccggtaaattccatagactgataaagtgcgccgtcaacgcctatcataccgattatgtgaagaataacgtccttgccgcttacatatttattaagctttcctgtcaggttgaactttatagcggagggaaccttaaaccacgcctcgcctgttgccatacctgccgccatatcggtcgagcctacgcccgttgagaatgcgccgagtgcgccgtatgtacaggtgtggctgtctgcgcctatgcacagctcaccgggacctataagacctttttcgggaagaagtgcgtgttcgatgcccatttctccgacatcgtaataatttgtaatatcgtactttcctgcgaactctctgcactgcttgcactgagtagccgccttaatgtccttgttcggtgtgaagtgatccattacaagagaaatcttatccttgttgaatatgccgccgaagcctgccttgttgaactcatttatcgcaactgggcttgtaatatcgttaccgagtaccatatccagctttgctcttataagctgtccctctcttacgctttcaagtcctgcgtgctttgccagtatcttctggctcattgtcatgcccatgtgtttgtcctgcctttcttctgccgctcgttacaagctatgccttatgatttgtttacgttaatcacgttcaagtgccgaaatacccgttcttacaatctcttttactccgtagggctggagaagtcctatgaatgaatctatcttctcgggttcacccgtaagctcaagcataagcctgctctccgctacgtttacgaccttcgctctgaaaagatttgcaatctctatcacaggctgacgtgacgcagggccgttgccgaccttcataatgatatgctcacggcatacagcgttatgcagtaccttgacctccgatacatcgtagagcttgcggagctgttttaccagctgttccatcacgccctcgtcgccgtctgcaactattgtcatacgggaaattccgaggttttcggtttccgcaacgttaagacttattatattatatcctctgcggctgaacagacccgttactctgccgagtacgccgatgccgttgtttacgcagacggaaattacgtttctctctgtcatttttctgcctccgttcagtcgtcgatttctatctcaaggataggctcagttatggattttcctgcgggtaccataggaagaacgtttatatccttgtctattctcgcctcgataagcacgggggctgtctttgaaacctcaagagcctcacgcagtatctcctcgcacttgtcctcgctgtctataacaaacgactttatgccgaacgcttctccgagcttcatataatctgtaggacggtcaagcgtcgtctgtgaaaatctcttgccgtagaacaatctctgccactgacgtaccataccgagaacgttattgttgataacaagctcaactacaggtatattgtgctttgacagcgttacaagctcgtttaagttcatatggaagcttccgtcgcctgcaatatttacgaccgtcttgtcggggttgccgcactttgcaccgatagccgcaccaagtccgtagcccatagtgccaagaccgccgcttgtgataagctggtgagggtgcttatatgcgtaatactgagccgcccacatctgcgactgacctacctctgttgcgataagcgcctcgccgcctgtcagcttgtcaagcgtttctataagatgctgaggggtaagagtaagctcgtctgtgcctttctgcctgcactcgtactgcttctcccacgtctttattttgcccatccagccgctgtgcgactgctgagggattagctttatcagctttttcataacatcggtgctgtcgccgataacctgatgataaacctttatgttcttgtttatttcagcagggtcaatgtctatatgaagtacctttgcatcgggggcgaaggtctgcggattacctattactctgtctgagaatcttgtgccgataccgatgaacaggtcgcagttctttattgcctctgctgccgtctttgttccgtgcataccgagcatacccatatatctgctgtcggtttcgtcaaagctgccctgacccataagcgaagatgatacaggagcgtcaataagctcagcaaaagcctttaatgtctttgctccatcctcgccgtagatgccgccgcctgtataaaggaacggacgttcagcgttctttatcagctccgccgcctttgctatacagccgtcctgatgcatagtaacatttaccgtatacggctttaagggcttgtttacgaactcagccttctgcgccgttatatccttgggaacatcgacaaggacaggaccctttcttccgcttcctgctatgtagaaagcctcacgcagtgtatctgccagcttgtttacatcctttactatgaagttatgctttgttatcggcattgtgatgcctgttatatcaacttcctggaagctgtcaagtcctaaaagcgaacaagcaacgttgcccgtaatggccaccataggcacactgtccatataagccgttgcgatacctgttacaaggtttgtcgcacccggacccgacgttgctataacaacgcccgtcctgcctgtagaacgtgcgtagccgtcagccgcatggcttgcgccctgctcgtgtgccgtcagaacgtggtgtattttgtcactgtaattgtataagctgtcgtagatgttcagaactgcgccgcccggatagccgaaaacggtgtcaacgccctgctctatcagacattcgcagattatatctgcacccgtcagatttctcatttctttcattcctttttctttacactcagattatttataataacggataaaaaatcctatcgttttattttaacactatacagcgtttttgtcaatggcgaaaccgcattataacatgattgcgtgtgccgaaggcacagcggcggaacgccgcagttttgccgaaagcaaaaccaatcaatgttaaaatgttctcaggcactgcgaagcagtaagcacgcagttatgcgtgctaaaatccgacttttcggattttgagtctggggttattataacatgattgcgtgtgccgaaggcacagcggcggaacgccgcagttttgccaaaagcaaaaccaatcaatgttaaaatgttctcagacactgcgaagcagtaagcacgcagttatgcgtgctaaaatccgacttttcggattttgagtctggggttattataacacaataaaaggacaccgtgaggtgtcctttcgcaataatcttaatgtatctccacaccggtgaagtaatgctgtaagatctgcttatatgtgtagccgttttcagcaagagcctttgcaccgtactgtgacaatcccacgccgtgaccgtgaccgtaggtcgtaaagatgaacttgtcgctgttcttgtcgtatttcagatcaaaagccgcacttttcagcgaataaccgagtaccgtttctcttatcattctgccgtctatcgtcttgccgtttgcctttgtcataccgccgacagaaattgatgttacccagccgtgttccctgttatcaagtcttgagtttatcttgaaccattttgacgggtcgcctgtgagcgctattccgagtgtattctgaacagcattctttatgtaatccgaagaatagctgtcggtactgccccagttagggtcggtcgtcttgtcaagaggacaatcaacgcttctgagatacggataatcaacgccccatacattttcggcgctgttggtatagccgcatgaggacgcaaagaacacactttgtatcatctcgccgttatagtagatcgcttcacccagcacctcgtcaaccagcttgtatatcctgtcatatacgtcggttttaagtgctgtcgtggggctgacgcccatttcgttgttctttttgatataggtgtattccgctactgcctgtgcttttaccgcttcatcggggaactcgttccatatctcaccgactaccgccctcgcaattatctctcttgcacctgccgtgtaatatgtaccggtcacctgatcgtataccgataactgctcctcactgctgttatcgggcgtcggcgtcggcgcagatgttgtttcagccgttgtggtttccggtacggcagtcgttgccgctgcggtggttacggcagttgttgtttcggggattataacggtattatccgccgcaggtgcgggtgtgcgtttttttaccgtagttgtagatgtggtcgtttccgccttggtggttgctgtagtctgtacctttacatcggcaagtgtaggttttttgtcgtcttgcagcttaattgttgtagtttcgggagttttttcggtttcggcagatgttgtcacttcagggatagatacctctatctctctttcattgtctgcgcttacatgaacaacctgaactattccgaacaggtaaatgtatacgcaggatataacgagagcgagcagtatctttcctattgatgccttctgcattaaattcctcctttatgttacagtttccgctttctttttatcagtcggagctttccgtcttgaacgaactatccttcttgaagccttctatccacgcaggattccagtaccttccgctccattccttgccgtaatagtaaagctctcttatcgtccggcactgcttcgtgtcggggttacgcttgaagctttttatctgctcgtctgtgaacgaatccgactcgccgtcacgaacctttctcgcaacaacaacgatacgcatatcgtaaagacctacctcgaactcgcaggtggacagcgtaaggaacttatcgccgtatttcatatcaacgccggtgaagaattcgctcctgtcaaggcattcggacgtgaaataattgaattcatccctgtttgcaaaattcagtaaggcgggataattgaacacgtcgccgtattcctccctcgtattgataagcattacagagaatatcttgtattttgccttttcgtacagcgtattgaactcgattacaggatgctctttcagaaactcaagactcttgtcaaggtcaactcgtctgtactcggttatttcggcaaagaagttttcggtacgcaggttatgaccgtaaaggatcgtatttgcggacgtttcgcccgtattcttgaattcgttctcataatccgcaaaaatagtaccgttcttactgtaattgccgtaaaaatccttttcaagatagtcggtattgtttttgccctgtactacaggatagtttacatttataccctttatgctcagccagccgacaaaatcgttgtttatcgcataaaaaggcgcatattcggtgtttatggctttttcgggaagctcggctatttcctctgcggtcggctcgtggtttcccagctgtaatatgctgctctgatactcgtttctctgcctttcaggctcgaacatatatttatcaataattataagcactgccacgcaaagagcgactatcgaaacaaggaaaactatctttcggataatctcgcctacgctgtcgcctttccacgggataagacccttgacaatggctaatgcggcattttcctttttctttttcttatttttcttcttatctgtggtcgatactacgaccgatttataatcaggcatcttctaaccttccttttgctgtgataattaccataggaatactatatcaactgctcttcttcggcttatagccttttaaaagcgcaggatcccagttccttccgccccacgaaccgccgtatacgctgtaccagtaatcataataaagcggatcgtaattgatgattgtcttggatacatccaccgtaggatcttctccctcacgcactctccttgcaaaaagcacatatcttatatccttgctctttccgaaaggaaaatcgcaggttgacagtgcaatcacctcatcgccgtatttcagatcgacctgcggtgtatatataaaactgcggtcaaggacctttgcatagtaatctataaattcttttttattcttgaaagtatatgcagccgtatagtagaatacttcaccgtctgctttttcgacattgacctgcatcatcgcaaatatcttatacaggcccttttcatatattgtgtcaaactgtatgacaggatgctcgtcatacatctctctgccgtagtagagaacatcaaacttgtttacatcacggaaaaaagttccgtttgacatattgtgaccgtacagcaggatattcggtgaacggtaatcactgccgatatgtgcgcaataatccgccgtaacacaccccgaaaagctgtattccttattgaagtcgtgcgtcagatagtacatattcttatcgtacacttctccgtagtcaatcggctttttcgggtcgaaccctttgacgtgcataacaggataatcgacattggtgccttctattttcagccagcctgccatatcgtgatttttttcatacatctcacggtattcaggcaatattgacggctttttcttttccttagcgaccggctctgcaggtatatcgacatcaagctcgcaggtataatccagcatattcggcggcaaaggcggctgagtcagcttcattatcagcattacgccgacagccgcaagccataccgcacacgcaccgagtgccgcccacagcaccttgccgcttatgaccggctgtttttccgtttttgtttcactctgttcttccaaagccacaccgcctcgcacaacgtcaggcgacaatatcaataatcatatccgtcgccgttgttataatcatatattccgtcactgtcgtttatgtcgtcaataaacgtgtaaccgtccctttcagcgtcttccgctgtatagctgagcagctttcttctgtcccagttgctctgcgaccagtcatatccgccgccgatattatcatatacccactgccaacgctttacataagtgtttaccttcgccttgcttacatcgacataggtgctttcgcccggacgtacctttcttgcaaatatcgcaagacgcacattatccatatccgagcggaacggccagtagcatgtagaaagggtcagtatatcgtcgccgtactctatatctacatctgtgaaaatatcgcttctgtccataagatcaattataaaatggttgaagtcgtcacgggaagtaaaatcgtgcttgttattgtagttatagtacacttcaccgtattcttcatagatattgaaaagccctatgccgaatatcttccattcagcttcttcgtaaagggtattgaacgttatggtcggatgatccttgtagaactgcattgacggcgcatcatagctgtcataaagcgttctccagtattcgctgaggcacgagaagaatgtgccgacagccatattgtgaccgtaaagcaccatattgcccgaatttccgtccggagaaaccacacagttgcagtccatcattacagaaccgctcttgctcttttccctgtagaaatcgtgcgtaaggtagtagtcgttatcttttccttttacaacaggataatcaatcgccgtgccgtctattttgaggtagcctaccgtatcgggatttatttcaagcagcttcttgaatgagggaagtatttccttgcttgcaccgccgctgtttccgtcgggaatatatatgttcgatattccctgacttctccactggtcacggaacatcataaatatgtccgaaacaagcggtatagccgtggcaagaaatacaatcagtgcgattataaacaccagttttctgatgaccgccgccgcactgtcgcctttccacgggataatgcccttgataagccttttccaaaaacccggcttttttgcagccacaccgttgcggcgtggatacttttccatatatgttgtcatttatgctccttatatttaacgtgaccgggcacagcgtcagtctgtcttatccgggaaggaatagttgtcacgctttgcgtcttccgcatcgtagcttaacagctttcttctgtcccatgtgctttggaaccagtcatatcctccgcttaccttgtcgtatacccactgccaacgccttacataaggatttcccacagccttttccacatcaacgctgtcgctttcacctttccttatcttccttgcgaatatcgcaagtcttactgtgtcaccactgccctcgtaaggccagcagcacgttgaaagcgtaagaatatcatcgccgtattttaaatcgacatcggtgaaaatatcgcttctgtccattatatttatgatataatcgttgaaatcgtcttcggaagtgaaatcgagcttctgattatattcatacacttctcctcttgactcggcaacattgaataggccgaagccgaaaaccttccactccgcctgctcgtataatgtatcgaatcttataacgggatgctctttgtagaaagacttgctcggctcgtcatacgaatcgtacattgtacgccagtattcgttcagcggtgcaaagaatgtgcctaccgccatattgtgaccgtacagcaccagattgcccgagtgaccgtcagccgtcactttgttgcggtaatccatcattaccgtaccgctgcggctttcgttcttataaaagtcatgggtaaggtaatagtcgttgtcggttccctttacaacgggataatccacaagagtgccgtctatctttatatatcccactgtgtcgggatttatttccagcagcttcttgaacgagggaagtatatccttgttatcttcgggaacatccgtattggcatcaagctgatacatcttcgaaatatccttgcttacctgctcgtccttgtacatagaaagtatatccgcaagaagcggtatagctgtcgccagaaaaactataaatgccactataaatatgatttttcttattataagccccgcattgtcgcctttccacgggataatgcctcttgcaaggcgataaaagaagttaggcttcttctctgtttttgctgtcgcatcagcgtttgcttcttcggctaattcagcacttttttcttcaagcgcctcctgaccgtccgacatttcatcggcacctgaaagctcgtctatcgtgctttcatcatcgaccggtatatgttcggcggcggtatcggcttcatccgcactgactgcggcctgctcgtctgacatctcattttcgccctctggcgtaacgcctaccgagttttcttcaagcgccgctgcgtttgctgcctttctgtcaatatctgcgattatctcatcaacagacataccgcctgtatcattttcaaatttgttatcgctttccataacagtctccttgcttgtgtgttttctcttgctctgtttatatattttcggcaacccactgcaaagcggtaagcaccgtgttttttcttatatattctcttgcattttcgtcttttgcaagcattgggtcggtaaaagcaagccgtgcctgcgtatttcctgccacgctcagcccgatatatacagtaccgacaggcttgccaggctcagctcccgtaggacctgctatgccggtgaccgatattcctatattgcttcctgccgtctttcttaccccttcagccatagccgctgcggtttcggcactgaccacaccgtatttatctattattgcggcaggtacgcctataaaccgctcctttgcgcttatggcataggtgcagatgctcatatccattacggctgaagaaccgcttacggaagttattgcggcactgataagaccgcccgtacagctctccgcacaggctattttctttcccttgctaactaataattgtactacatttccggcggttttgtcaatatcgagctgaagctcggtgtgccgcaagccgtgcttctgcacggcaaaatccgcttcggcggattttaagtctgaggttattataccataattacggtaaaatgcaagagcccagagaatgatgttgtccgtatataaacagcaaagcggagcaaatacaaggtctgctccgccgtattctgaattattcgtctgcaccgccgggcaatgctgtctgttcgcttgcaagtcttgcaaactcctccttgatgctcggagcgttctttgtcagctttttgatagtaagctgttcttcagccttgttatttgcaagacggagattgttttcggaagacagaagtgcgtcctttgccttttgcaaatgtataatagtcttgtctatctcatcaatcgcagtcttgaacttatcgctggcaagctgataatttcttgaaaacgccgttttgaagtcggttatatttttctcgaaattagtaaggtcaacctgctgagcctttgccatagcaagctcacgcttatattcaaggctgtttcttgcggcgtttctcagcagagagataagcggaataaagaactgcggacggataacgtacatcttggggtacttatacgaaacatctacaatgcctgcattatagaactcgttgtcggcttcgagcattgaaacgagaacggcatactcacagcccttttcatttctgtccttgtcaagctccttgaagaaatcctcgttcttatgctttgtggcggtggtgtccatctcattcttcatctcgaacataattgagatgaattctatgccgtcctctgacgattctctgaaaatgaaatcgcccttgctgccgctccttgcatcgttatccttttcaaaataggcattgggaaatgccgacattctgagagaattgaactgcgtcaggcaatgctgttcaagggtttcgcccaccattttcgttgacagtcttgccttgaagtccttgtactgctctatcagctcgtccttgtttttaagctcaatagcgtacttttcttctatcgccctgcatctgagctctgcctcgttatccttgctctgaagcttgctgttaagctcgtttatttcgttatccttttttgcaatggcaagtgcgttttcactgcttaccttgtcaatagccgcctgctgtaagctctgcgcctgctgaagctgtaattcaagctgttttataaggctctccttgtcgctgatagccttctgtgccttgctgctttcctcgttgaatcttttttcacgctcactgacagcatttgcaacggcaagctgtttttcgctttccatgctttcaagccttgcttcaagctcggttatccttttttccttatccgtaatatcgtccgacttttccgaaagagccgattccagcttcttttcatactccatctcgagtattttaagctcgctgttcttcgccttttcaagctcctctgctctgcgtgccgcttctttttcgaattccttatctcttacctgctgaacgatctgtgaataaccgctgtcatccacctgaaagacctcattacatttcgggcatcttatttcctgcatatttccttagtcctttcgtgaaaagatttataattcaagtctgcatacaaggcatgcgactctttcgtcctctatcgttacctctttcattccgagtgaggtgaaataattataattggtttcaaactttacgtttgtcctgtcaagtaaaacaatatcggcaagcggtgcggattcgtctgtcggcacatcacggtcatttatcgtataaagctctttttgcttatacagcggagcgataaagaacgtgttcgctgtgatgctctcgttttcgttgtcgggaagctgttcaagataggatatgactgcaccgtgtgcctcatagtcgttatcatagaaattgttcaggtagcctgtcattgttgacaggaacataaccgcacaggcaataagcgaaaacacagtaaagcatcttgccctgttatatgacagctccgacatattcattatgaaaagccagataacaagaacgcacgagccgaaaacgtactggaaataaatcgagtgctgatacggataggtcggcataagatttaccagtacaaacggtatcagtaatatataacgtgctatcttcctgcttacaagcggtataccgccgagtacgccgagcgtctgcactgtaaaggtcagcttttcgcctgtgaacaggtttgacagaatgtagcccggatttgtaaacgccgtaactataagtgacgtaataagcgcaccgcctcggtaaatatagtccttgtaccgccattccataatcccaagcccgctgttattgagataagcgcagactgcaaaggaataaacgcaggccgctccgaaaatcacagcaccgagcgctcttgtcttttcactgcggtctgacagtataagataaagcccgatcaccgcaacatatacggcggcatcttcctttacggtaagagtgagcaatgcaaagacaagcatcggtacagtcttttcgcgttcaacagcccatatcagccacagcaggaacgccggaagcatacagttttcgtgaatatcgtagctgcagccgcctgtgaatgccggatataaagcatatatcgctgaaaaaagcgaggaatgtataagcgaaaaaccgtattttcttgcgataaggaacaccgggataattccgcttgtaacgaatattccctgcaatatctgtaatgttaccgggtgcggaaaaagcatatagaacggcagcatcagataatacgcaggagaaaaatgcacagcaaagtgtgacagctcataattacgttcgactgttgtgacagctccaagcccgtccttcatattctcgaacatctgcgcgaatatcccaaaatcaaacgcaggggtagacagcttgtaataccgcattgccattgcaagtgcggtgaacacaagcataaatacggcggacagtgcaagaaccgctatccagcatttctttgtgaatttcggaagccttatcctttgctttcctacagtataccatacagcgagggctataaacaggacagctccgagaaaaaagtcaatattcgtacctttttcacggaacatgactacagcataagcaactgtaaactgtgcggtcgatataagcaatgcggcgcagtcggttttcatctctctgagctttgggataaaacgcaatacggtaagtaagccgtagaatactgcgaaaaatatgataagcaacagatgcggagcttcgcctgcgtattctttgtcaaataccttgcttatcggtcttaaaggcaatatcaatatgagcgaacaaagccacgcagaaataaaacgcataaggtattcgccgccgtgttcgcttgccttgaagcgtgtaaaaaatttgttcataaaaaacctcattctcagtcacctgcaagaaatttattgttgtgaagctgggagcgcagcttcaccccctgctttttcagaatatcgaccttgagcgcaacaagattacggtcggtgcagagtgccgccgcagttttgtcaatatcgtagccgcaatttatgcaatcgtaaagctcttcatctgatataagaaactgtgccgcaaagagatttgcttcatactccatagaacgatcgcacatatcgaatatgtcatattcggcaaagccgccgctgtcgtctgccttatccctgtggagcctgtcgtgaccgatctcgtgcatcaggacgatttttttcatactgtcgcaaagatcacgctttataaagataaacgggtttttcagtatcagcttgtatgcgcctttctgctttgaaaaatccctttcgagaacctctatatcaagctcccgtgcgagccttttcggagagcacctgccataaatggctatcagctcatcagccttgttgaccgcctcgttaaaacagcttaacattcgtgctctttccgctttgacacatattttctgttcttctcttttgctatccagtaggcatcctgtatggctttcatcatctcgtccatgtcatcctggtcaagctctccgcctgcgaaaagtcctgttacctcctgcatcagcgctttcgcctgctgtgcgcctgtagcgccgtacttttcgtttgcgtttatgtagaattcttcgttctcggtaagcagataattaatgtcaacaccgagtatctcagccatttttccgtatatttcacgctgtttggggtagctttcacccttttcatagtttgttatggttctcagagatacaccgagcatatccgcaaactgctgctgtgtaaggccttttgcacggcgctctttctttactttatcacagaatttcataattactcctttacttgcagtatgctacggcgtctgcctgaaatttaagcccgttttctccgccgaaatgggcaaactcggtctgtattgatttacggacaggatatttgccgccgaaacgctcctttatcaccttttccatgacgggaatatcccatatatccctgaacaggcaatccatctgcacgacgttttcaagtgtaagtctgacaagtgcaagacgcttttccatctcgtcaaatgcgccgtttacctgctgttcgatacttccgccgacatttcctacacagtaattgagaaaacagaaatcgcctgctttgataattccgcaatgcgcccattcttcgttgacatcataacgttcaatcataatcgtatcctccgtaaaattcaaaaacatgcaaatacattgcattttcctcttgacaaacgcaaaataattgcgtataatcttgatcagaaatttagttgcatatttatgataccatagattgcgtatcgtgtcaagcaaaacagataagaggcgacaaaatggaacgtgatatacttcactgcgatatgaacaatttctttgcgtcggttgaatgcaggctgaatccggaacttaagaaatatcctgtggcggtgtgtggttcggtcgaggagcggcacggaatagtgcttgcgaaaaacgagcttgcaaaggcgcagggagtaaagacggcggaaacggtggcatcggcaaaatcaaagtgcagggggcttgttatcgtaccgccgcactttgaggaatatctcaggtacagcaggcttgcaaggaagatatacgagcggtatacagatcttatcgagcctttcggaatggacgaatgctggcttgatataagcggtacgagaaggctgttcggcgcaccagaaaaggtagcggacgagataaggcgtaccgtaaaggaggagcttgggcttaccatatcggtcggggtatcgttcaacaaggtgtttgcaaagctcggaagcgatatgaaaaagccggatgcggtgacggtgataccgagagaaacgttccgtgagaagatatggaatcttccgctcagcgatatgataggggcaggcagagcgactaccgcaaagctgaacgattacgggatatatacactgggtgagcttgcacagtgcgacgctcagtggataacaaaggtgcttggcaagaacggatatatgctaagatgctacgctaacggaacggataactcgcaggttatgcctgctgatttttcgatgcccgcaaaaagcgtggggcacggtgtgacgaccacagcggatataacacggtgcgaggacgcaaagccgttgcttcttgagctggctcaggatatagggaaaaggctgacgattcaaaacaagtatgcgactaaggtttgtgtgaacgcaaggtcgagcattctcagaaacaggaagtggcagacggagcttccgacagcgacacgctcaccgatgataattgcggatacggcatacaggctgttctgcgacaattacgattgggtaaatcctgtgcggtcgcttacggtaaccgcattttctcttgtggacggcggtgcggtgatacagaacagctttttcaacgatacgataaggcttgaaaaaatggaaaaggcagatggttgtatcagggatatacgcaaaagattcggggagggaatgatcaagaatgccgtgctgctgacagggcttgccgtgccgaaatcaaaggcagtggtttcgcttccgggcaatatgctgaataaatagaaagcccgtcacgcaaagcgtgacgggcatagtattcggttacgggatcagtctacaagctcagggtcgaatgtttcgtgccacggaagtccccacttgttcagtgcatccataaacggatcgggatcgaattcctcgatgttgtagacgccgggcttcttccacttgcctgtcattaccatcattgctcctatcatagcaggaacgccggtcgtgtagctgatagcctgcgagccgacctccttgtagcattcctgatgatcgcagcagttgtaaaccttgtagtgtacttccttgccgtccttcttgcctatgcagatacagccgatattggtcttgccgactgttctgggaccgagcgatgcagggtcgggtaaaactgccttaaggaactggagcggtactatctctctgccctcgtacataatgggcttgatagatgtcataccgacattttcgaggcacttcagatgtgtgaggtagctctgtccgaatgtcataaagaaacggatacgcttgatacccttgatattgagtgcgagcgattcaagttcctcatggtgcagaaggtacatatccttcttgccgacctgctcaaagtcgtactctctctttatctccataggctcggtttctacccacttgccgtcctcgatatagctgccctttgcggatacctcacggatatttatctcggggttgaagtttgtcgcaaacgggtaaccgtggtcgccgccattgcagtcgagaatatcaatataattaatctcgtcaaagtaatgcttctgggcataggcgcagaatacaccggttacaccgggatcgaatccgcttccgagaagtgcggtgatgccagccttttcaaacttttctctgtatgcccactgatacttgtactcaaacttagccgtgtcgggatgctcgtagtttgccgtatcaacatagtctgtctttgtttcaaggcaggcgtccattattgtaaggtcctgataaggaagcgcaacgtttatgacaatgtcgggcttttccttatttataagctcaacaagctgaggaacgctgtctgcgtcaacctgtgcggtcgttacctttgtctttgtacccttttcctctacctgctttttcagcgcatcgcactttgactttgtacggctggcaatgcagatctcagtgaaaacctcgctgttctgacagcacttatggactactactccggcaacaccgccggcacctattatcaatgcttttcccatttttctttcctttccgttctgcctgagggcagacgtcacatagtggttacaaatagattatacactatcgtgtgtaaaaaaacaagcaaatatttatatactgcatacaagcacaccgtaatcaaacggagagagctttatcgtcttttcttcgctctcgtgaggctttctgagaaatttcgggtcggtatattcgtccttcatatagtcgtcgagcttaaacgtcttaggatatttcgacttgttcaggaatataacggctgcctcacggttgagcttgtcaattcttgcaaatacgcattcctcaggtgtacagcttaaaaacttcatttcgccctgagcgaacgccttgcttgcctttcttatcacggcaagctgttttgtgaagtctatcatatcaagattttccttgccccacggatagcaacgtctgttgaacgggtccttatagccctcaagacctgcttcatcgccgtaatatatgcatggcacaccgggcaggaaaaattgcagtaccatagcgcatttaagcagtgaaaggccgtaaacgtactgttcgggcgaaaggtagcgttcagcctgccattctctgtcgtgccagcctacatcctcaccggcaagtcttgtcaagatacgctcggtatcgtgagttgacaggaagttcatcagcatatcggcactgggcttggggtaatgctcaagtatcgtcattacgccgtcctcaaagcctcttgcatcgccgtacttgcagtaatttatgatagcctccttgaaaggatagttcataacgctgtcaagctgaccgcctatgagataacgtctgcggacaccgtagctctccttgttggacgcatcctcccatacctcgccgtagatgaccttatcgtcgcccttggcttttaccgccttgttgagattgtcaaggaattcatcgggaagctcatcggcaacatcaagtcgccagcctcttgcgcccttgtctatccagcgctgtaatataccgttttcaccgcagatatattctgtgtagtcggggttgttctcatttacattgggaagtgtggtaatgccccaccatgattcataatcgaaaggatagcgtgagaagcagtaccagtttttatatttgctgtcgggatctctgtatgcgccctcgtgatctccgtatctgccgaacttgttgaaatagatgctgtctgcgcccgtatgcgagaacacgccgtcaagaataatgtctataccgtatgttttagcctgtttgcacagatgttcaaagtcctcgtccgtgccgagcataggatcgatatgctcatagcaggcggtcgaatagcgatgattttcgtgcgactcgaaaacagggttgagataaatgcaggtaacgcctaaactctgaagataagggagcttgctttctatgcctttgaaatctcctgcaaaataatcgttgttgcggataattcctctgtcatccggacggaagaacggggtatcctcccagttttcgtggattattctgtctgtaggaacgttttcgtgcttttctccgcttcggcagaatctgtcgggaaatatctgatacataattccgccctttatccagtcgggagccgccatatccttgtcaaaaacagtaagctggaacagctcgccgttatcaagaacaccgagccttgctccgctgcgctttacatatctcctgttgccgtctatcatcaaagagaaataatagtggtgcagacctttatgcaaggggttgaaattacaggtaaacacgttgcattcggtggtcgtatcggtaatgtcaagaggtatgaagcgttccttttcgccgggacggaacattacaagagtagggtcgctgacgtgccattccttcgggaaacgcagggagaatgtgctgggctgatactgtcgtattgctccgaatgggcttttatagtttaagtcgaagcagtcgaatatcggagtatccattaaaaaacattcctttcggattaaagtcggattaaaatcggagggtggttatatatacccgaaaaagtccgttggttgcaacggactttttttattatctcgggctactgtctgttaaattaacttccagatatcacgggcatagtctgtaacggcacggtcagccgagaatatgcctgcagatgcgatatttataagcgacatcttgttccagaggcacttatccttataggtttcgcttgcctttgcctgtgttcctctgtagctgtcgaaatcggcaaagcacatatatctgtctgcgtgacgcagtgaatttgctacttcctcgaatgttgcaccgtttatacccttgtacatcttttcgagaacactcttgataactgcgtgtgagttgtatatcttttcggggttatatccctcagccttgagctgatttacctcgggagttgacataccgaagatgaagatgttgtcattgcctaccgcttcgtgtatctcaacgtttgcaccgtcataggtacccattgtaagagcgccgttgagcatcagcttcatattgcctgtaccggaagcctctgttcctgcgagagaaatctgctctgaaatttcacttgcgggcataagaatctctgacagtgttaccttgtaatcttcaaggaatacaacagcgagcttttcgttgagcttagggttcttcttaagctcctcgcctatgcaccagatcatcttgattatctgcttagccatataatagccgggcgccgcctttgaagcgaagatataggtcttgggtacaaagtccgcatcgggattgttgagcagataaatgtagtctgcgataatgttcatagcgttaagctgctgacgcttgtattcgtgcagacgctttacctgtacatcgaaaataccgttgcagttgagcttagtgcctgtggtgttgtatacatactttgcgaaagcctgcttgttagccagcttcacagcggctaatttatcaagcaccgacttatccgttgcaaacttcttgaaatctgcgagctttgacgcatccttcttgaagccgtcgcctatgcactcggtaagaaggtttgtaagtccctgattgcttgcgagtaaccaacggcggtatgcgataccgtttgtaacattcttgaaggcatcgggattaacagtgtactggtcgtggaatacgctgtccttgatgatttcggagtgaagcttagaaacgccgtttacagagctgcttgccgcacagcagaggttagccatctttacacggttgtcaagaatgatggacattcttgttaccttctcgctgtcgccgccggtcacttccataagatgagcgcaataacggttgtttatttcaactatgatagcgtagattctggggagtattctctgcataagatcgacatcccacgtttcaagcgcttctgccataaccgtatggtttgtataatcgaatgtgtttgtgatgatgttccacgccttatcccagtcataaccgcagtcatcgagcagtattctcataagctcggggatagcgagtgtggggtgtgtatcatttatatggatagctaccttttcgtgaaggttttcaagagtaccgtaaacgttcatatgacgcattacaatatcgcctacggaagcggcgctcataaaatactgctgacgcagacgcagagccttaccctcaaggtgattatcgttggggtaaagtacctttgtcaatgagtgtgcgatattatttgcaccgatagcctttgcgtagtcgccctgattgaacatattcatatcaaacgacatactctcggcactccaaagacggagctttgaaacgcccttgctgtcatagcccgatacatacatatcatagggtactgcgtttactgtcttatagttaacgtgatttacgctgtggtagttctgctcccacttctcgtagatctcgccgtcaaaatgaacctctatagcctgatcgggtacgggtacgagccacgctctgccgccgggcagccagtcatcgggaagctctgtctgccagccatctatgattttctgcttgaagataccgtattcgtagaggatagagtagcctgttgctgggaatgcgcaggttgcaagtccgtcaaggtagcaggcggcaagtctgccaagaccgccgttaccgagtcccgcatcgggttcttcctcatagatatgttcaatctttacatcgagcttcttaagtgcctttgccacttcgtcctgcataccgaggttgtagaggtttgtctttaacgaacgtcccataaggaattccattgaaagataatagacctgctttctgccctttgagttgcagtcggtcatgaacatcgagcgcttttccttaaggtagtttaccactatctttgataaagccttgtaaatctgggtgtgatttgcttctgcgggggatactctgaagtcgtactccagcacctccgtcagcttacgggttatttcattttctgtaaacggtgaagtcatataaatttttccctttcttccggtccgattttcttacagtctaattatacaacatacagtatccttattcaaggctgaataaaatattttgtaaataataaggtgaaattgcactaaaaccgcttgccgattttatgcagtttcacaataaaacttttcctattgaggatttatttactgataattgacaaaatgcgtgttacatacacgtcacgcttttatcttaagcgctttgaaaatgtcgttcttgtccttgattttggataatatcatcagcttgtcgcctatctcaagcgtggtatgaccccttgggattatcagctcggtttcattgcggataatagaaataatgttgagcgtcagcggtatttccatttccataagcggaacgttctgaagcgtgaaactgttatcaagaactatctcgaaaacgcctgcatttcctgcgccgagaggaagaagctcctttatcttgccgctgtctatctcacgctcaagctgacctgtaatgttatcggtagagcttacaactatatctacgccaagcttcttcagcgcctcaacgtttttggggttgtttacctttgctatggtctttttcacctgatagagcctttttgcaagctggcaggcaacaaggttatcctcgtcacgtcctgtcacggcaataacgctgtcggcatcggcaactcccgcctgttcaagcacggaaacgcttgtgccgtcaccctttattacggttatgttaaggtcgtttgcaaacttctggcaggcgtccttttccttttcaacaacggatacatcgtatcctttttcaataagaactttggtcagatagtagcctatctttccgccgcctattataagcgagtgcattttacagatcctttctgttgtttatgtcagatggcttttgagaatatcagcttgtcgccctctctcataacaacgttataattattcactatttccatcgtgctgtctgccctgattatcgcatacagcgtttcgttctcctcatattctatgtcaacgggggtcatgccgataaactccttaggtatctccattgtagtgaaacgcaccatatgcgagccgaagctgacgtatttttcttccagcataggctttatcgcagagcatatcgcttcaactgtgagctttgtcgggcagaccgtttcaagtccgaaatgggcgaatatatctcctctttcggggtcaaggatacggctgacgaccttctttactccgtaaacctcctttgcaagctgtgacaccattatgttggtgttgtcatcgtccgtaacggcgcatacgacatcacagctttcaatgcccgcctttttgagattatcctgatctatcggcactccgcataaaagactgcccttgaaatcaggctcaagcattttatctgcttccgccgccgtccttgctattaccgaaacgtctatgccctcatcgcacagcgtgtttgcaagacgtgaacctaccttaccgcaaccgactaccagtacgttcattaaaaattcaactcctctccggcacgcaggtactgcaacctgtcaccgagtatatccttcattgttacatagccttttcttcctgtgttatggcaggtgtatatactgcctgtgcgaagccctgacagctcatctgccgactttgctatgtgactttgctgtacggtctgttttccgagcctgtttgtataggcaaagcagccgactacagacaaaaccggagcgtcccacagccctttcgccgtatttatcatacctgcgatgcccgtatacgcaccgcctgttatcagcacaaagccgtcacgtcttctgccggggaaacatacggcaaagcattctcccgaaaaatcgtccggcacataaaagccctttttccttatataaaaatgcctgtcggcttcggcggccttatccttcttttctgcggcgacaagatagaagtccttgcatacctctgtgaagcgttcaaaacggaacgtgttgtatctgtcgcttctgtagaacgattgaggaagtccgcttcgtactctgagcagtttttccttcacggcacaatcagccgcttcgtcctctcttataaaaatgcgtatatttctgttctttcgcaccgctgtttcaacgccgcccgtgcaatcatcggtatttacggggattataagcgtatccgccttatccgcaggtataccaagacgctctgcgttgctgagatacagagcagacgctcccgtgccgaaaagaattatgttcctgccgtgttcgatataaaggcatattccgtgctcggaaaacagctttgaatcggctgtttcatcgtcggacagagatactatcctcaaaagcgtcattcctttctctgcaatcgtaatcttattaatatatattatcacatatccgtcttaacttcaagcatataaagccgcagaacaaaaaaatgacggcagaatgttacttctgccggtaaaattcaaataaaacgaaacaaacttaagtaaggaataaaaatgaaaatcagatattcaactgttgccggtagcaaaaaggcaaacagcgaataagcaaaaaattatcagctcagtatctgaataagccgctcgataagcatacctatctgaggctttgagaactgttcgtccgcacctacggaaagtcccttctgatacatctgctcgtttatgagcgaggagaacaggaaaacgggtatctttttaagtgtggggtcggattttatgagctttgtaaggtggtgtccgtccatctggggcatctcaatatcggttataactgcggctacgcaatttgtaacatcgccgttgtagcccgaaaactgagatatgtagtcccacgcctcttttccgttggggaaagagcggatctccttaaagcctatatccgagagactgtttactatcatcttgttgaggaactgcgaatcctcgactattacgatatgcttttcagctgtcactgccgtagcctttgcattttcggcacccttgagatcaagtcctgccgccttgtttatatcgcttactatcttctcaaagtcaaggataacaagaatctttccgtcgacctttgctataccggtagctatgccggtagtcgaatcgcccgaaacctgagggggcttttcgatagctgtccagcctatacgctgtatgccctgcactgccgtaacgtgaaagcctacatccattccgttgaactcgcagattatgaataatcctcttgcgttctcaggcttttcggtgcctaacaccttatgtaagtcgataacggtaatcagcttgtcacggggcataaacacaccctctatctcatcgggtgcctgaggcatcgggacaagctcctgttccatcattatttcacggaccttggcaatgtttatgccataggaatttccgcatacattaaattctaaaagctccagctcgttagtaccgctttcaagcagtatgccggtatcatttgcactgtaagctgccataatatacaccttccgttgccattttaatcttaaactgatttttattatacaccatatccacaaaaaagtaaatagatgagtttgatttttagttaaaaacaaccaagttttgaggttggatttgtgattttgcacaagacgaagcaatagccgaatttgtaaaaaaagtctgtttttataaaaatagagcaaattctctatccctataagaacgctttgtgggctttgcgtcctgcaaagcctttgggcgttctatctcggcatccttgccaaaccccaaaccccttcccctcgggaaggggctgaatgtggggctgccgccccaccaagcaaggacgcttgcagtcagtcgcacacagtcgctgcacgatgcagcgacaccaacgactgacaacccgcattggggctacgccccaaaccccgtattattaagaatataggtttatcgacagtctgtgccatccgatacgttcggacggctctgtgcaaagccttatatcagcctataaattcctttataagcgaattttcggggactgcctccggcggaacctcttttatcagcgacaggaatctgggtaactcgctgtagcggttgacctgtcttatacattcgtcaaaatcgttgtcgcagagcttcgcaagcacgcttcggtataccgaaagctcatacgggaagaatgtatctatatcgaaatccgcaaggtgcttatacggcattatataaaggctttcgccacgctgtacgctggggaactgttctatcgtcctgtgataatcccttcctctgaacagcttgtcacgggagagcctgcggataaggcgtatctttgacgggtggagaagtccgcccttttcatcggctattcttgtacggacgctgacatagataaacgttgcgctgtcgtgcatcttgcccgtaacatcgggattgagcgcatggatgccctctattataactaccgtgttgccgtcgcatcgtattgcgttgccgtgctgtcttgaattatcggcaaaattgaatttaggcagtcttacctcgccgcctgccgccagagtacgcagatcttttttcagaagctcgcaatcgacccttgcaggcgcttcaaagtctaccctgccgttttcatcgggcggtataactcccggcacgaaataatcatccatagatatgactatcgccttaataccctttttcacaagcgcatccgctatgcgatatgccgttgtggttttgcccgaaccggacggccccgacaaaagcaccagcggcttttgtttgtggcactgcgctatgctgtctgccgccgccgctattttatccgagtactgcttttcggaggttccgataaacgtatcaatatcttccgcacggcgattaagctcaccgagcgtaattatctttatctgctttttgtcctgctcagtatgtaacaaaaaaacaccttccgttgtgataataaatttagtgatgaacagaaatatcataccacaacggaaggcttatttcaagcgttaattataaatcgtcggcatcctgcacgggtttttcgtaaatattgtcgcatacgccggtatagcttccgtcgggatcaaaatccgaacctctcatcgccgttactccgagcgcccttctcattatccttgcggtgtcgctgtaacccgtgtttttccttttctgcaacgattcatcacgtttaaaatccattattcttctcctttcggctgtcggaaaatatccgacaataatattatcttcatcacgataaaaaataattaagcaattttttcaataaacgttgtgaaaaatttgtgaaaggttgctccaagcctttattttgcttgcaaaagaagtcggtttatgttatacttaatctgcatatctgtatgcagatacaagaaaattacagaggtatcataatgggaacagcttcaaacgaagaaattatatacggtaaaaatgcggtcacggaggctctcaaagccgaaaagccgatagacaccgtctttgtgcttaaaggtgcgcaggggatgaatcagatcatcgcacttgccaaaaagcagggcatagtcgtaaaggacgcaggcgaggataagctgaaagccttgtgcggcgacaagcacggcggcgttgcggcggcattatcggcagtttcatactgcacggtcgaggatattctcgcaaatgccgaaagcaagggcaagccgccttttataattatatgtgacgagatacaggatccgcataatcttggtgcgataatccgtacagccgaggcggcaggtgcagacggagttattattccgaaaagacgcagtgctaccgtcaatcctaccgttttcaaaacatcggcaggtgcggcggcatggataaagatagcaagggtatcaaatcttgttgataccataaaaacgctcaaaaagcacggagtctgggtgtacggtgcggaggcggacggaactcccatagacaaggcagatctgtcgggtgctctggcactggtcatcggaagcgaaggcttcggactcggaaaactcgtaagagaaaactgtgacgttgtgctgtcgctccccatgttcggcaaggtaaattcgctcaacgcttcggtctgcgcaggcatactgatgtacgaggcggtcaaatacagataaaggcacgaccggaaaataagaaacgaaaggacgctcatgatatggctgattattcaatagacgatattctggcagagcttgacgcaaagaaaagcggcgactcggacaataccgtcagatcatacggagatgatacgccaccacgtcatcacgacataagcgcaaccgcaataatagaaggacttgacggaagcgaggacggcgtatatctgcgtgaaaaggacggcgacacggaaaatgttgacgcagaatatataaacgaagcgcaggacggctctaaggaagtatcaaaagcaacgtcttatgagagcaggaaagataacggcagtacggacaactcggatatagacaaaataaccggcgaacagagcgatgtcgataaagtgcttggcgaaaccgataattttatgatagcggacgcaagcagtgagatagatattgacgagcataaagcaaaggctttggcggaaaacgaaaaagccgtgcaggcaaagccggcagaaaccgaaaaagctcccgagcctgttcacgagatccgcaaggagatcgtcagcgacgaggaaaaacgcagaatgatgcttgaaaaggagcgtgagaactccgaccccgacgatatgctggcgcttgttaatcctcttgaggtcaaggaaaaggtaaacgagcaggtaaaggaaaaggagcttgtttccgttgcggagctgagcggtatgtacgcaggcaacacgcagggtatagcgggcgacgatctgaaagccattgcaccgcaaaaaacctctcttgccgaaaaaataagcgataccgcagacgtttcggaaaaagcggtttcgaatacgaaaagcgacgacgctcccgtaaaggaatatcacggaaagaaatcgaccgataatcttatagagaagctgaacaggaatcttgcgcagcaacgcaaggaaaatgtcaaggcataccgcacgataacgctcaacacaataaacggcgacagggccacacttccgcatccgctgaacatagactatcagaagcagataatcgaggcaaccggcgctattccgacagaaaatcccgctgtggaggaggaaaagcaggctgagcttgcggcggcaaaaaagcacaagctgaaggactttgtgcttgaggacgaggtacccgaagccgaagaacaggcagagcctgaggaagaattcgaggactatgacagcacaggtcagatatgggcggatctctgtgcaagccacaaggggcttaagataaggctcggtatgcttacggtcataacgatgataagcgtcattatcgccgtaatgaacgatttcagcctgttcgcaaagctgggactcggctctgcgttcaatttcataaacggaacgaccggcgatgtaaactcgctgatatacatttatcttgtgcttggcgtactcggcattgcaatatgctcgacagcaataagcaacggcgctgtaaaactggtgaccggaaaagccgactgcgaatcggtatgcgcttttacatcggtactgtcgctgatcggcggagttatctcgcttgttgacgtacagacgttcaagctcggtcactcgttcatatatctttcaaccgcactggtcggtcttatgttcaacacaatcggaaagatatatatgatttcccgtgcaaagcgtaacttcaaattcatatcgggcgacagccagaaatattatgcgcaggtaatcgacggtgaggaacgtgcctccgcacttacaagagcggcaggcgaaaagattcctgtgattgcggcaatgcgtaaaaccgaatttctgacggactttctgaaatcgagctactgcgacgacgaggcggacagaatgtcgataaagctgataatagcctcgcttgttgcgggacttgtggcaggaatactggcgttcataaatccgtttggcagtgaatttgccacatcgggagccgaaaatccgctttactgggcaatctctgcggctattgccaccatattggcagtaacgccgttctcgcttttgttcgttgtgaacagacctctttcccgtgcctcaaaaaagctcagcgaatgcaatgcggcactgctgggatatgatgcggcaatcgaattttccgatgtaaacacggtaatgactgacgcaaagacgctgttccccgcaggaagcgtacagattaaaaagctgaagcgctggcagaagaagaactcaatcatcaagaccagcgttgacgaggctatacttatggcggcaagccttgcgatacacacagacggtatactgtcatatccgttctatgatatgactcttggcaacaaggagcttctcaagaaggtcgataactgcatttacgaggataactgcggcgttacgggctggataggaacaaagcgtgttatgctcggcggcagggcgcttatggaaatgcacaacatagatctgccgaacaagaagaatgaacgcaaatactgtccggaaggtcttgagcctgtatatcttgcggtaagcggtgatatagtcgcaatgttcgttgtgggcatgacggcaaatcctgaaatacagtcaacgctgaaggcacttcagtcaagaggcataacggtgcttgtccatactacagattctcttgtaacggcagaaagccttgcggatatattcgagcttgacccatcgctcgtaaaggtgcttcctcacgaggcacacgaggaatacagcgaaagcacgaagtacacctcaagaggaaacggcggactttcctgctcgggtacgttcacctcgtttgcaagagcaattatggcggcaaagaatcttgtccgtgatttctcgctgtcaaaggcgattatgctcggttcgtccgcactcggacttcttctggtgcttgtaatggtactgctaagggaaatgaccctgcttacacccagtgttatcacactttataatactgttgcggtgctcgcaatgatggctgtacagaatgtacggaaatattgagatcggatttgaattaaaaagctgtgacgaaatgtgtgtttcgccgcagctttttttgttgcttttttgttatcgtatagcacgattcgatgccgatatacctctttacccgacagccgaacacgctttagttacattttacaaaaatttttcttcattttcggtacataaaaacaaaaaaattttaaaaaacactggaaaagtagaatcaaatctgttataatacttattgtatggctgagaagtctgtaattctgccggtttccgcagaaaaggaaaattcagacaaacggccggaataataatttaggaggaacccccaatggcacataagtattgctacctcttctcagagggtaatgctacaatgagagagcttctcggcggtaagggcgcaaaccttgcagaaatgaccaacatcggtcttcccgtaccccagggcttcacaatttcaacagaggcttgtacaaagtactacgatgacggccgtaagatcaacgatgagatcatggctgaaatcaacgaatacatcgtaaagatggaaggtatcacaggcaagaagttcggtgataaggaaaatcccctgctcgtatctgtacgttcaggtgcaagagcttctatgcccggtatgatggatactatccttaacctcggtcttaacgaggacgttgttgcagtaatggctgaaaagtcaaacaacgaaagatgggcttgggactgctacagaagatttatccagatgtactccgacgtagttatggaagtcggcaagaagtacttcgaagagcttatcgacaagatgaaggctgaaaagggcgttacacaggacgttgagcttgatgctaacgacttaaaggagcttgcaggtcagttcaaggctgaatacaaggctaagatcggtgaagatttcccctctgatcctaaggaacagctgatgggcgctatcaaggcagtattccgttcatgggacaaccccagagctaacgtatacagacgtgacaacgatattccttactcatggggtacagccgtaaacgtacagtctatggcattcggtaacatgggtgacgactgcggtacaggtgttgcattcactcgtgaccctgctacaggcgctaagggtctgttcggtgagttcttaacaaacgcacagggcgaagacgttgttgcaggtgttcgtacacctatgcacattcaggaaatggaacagaagttccctgaggctttcaaggagttcacagaagtttgcaagactcttgaagaccactacagagatatgcaggatatggagttcacagttgaacacggtaagctctatatgctccagacaagaaacggtaagagaacagctcaggctgctctgaagatcgcttgtgacctcgttgacgaaggcatgagaacagaagaagaagctgttgctatgatcgatccccgtaaccttgatacacttcttcacccccagttcgacgcaaaggcactcaaggccgctacacctatcggtaagggtctcggcgcttctcccggagctgcttgcggtaagatcgtattcacagctgaagacgctgtagagtgggctgatagaggcgaaaaggtagttctggttcgtcttgaaacatcacctgaggatattacaggtatgaaggctgctcagggtatcctgacagttcgtggcggtatgacatcacacgcagccgttgttgctcgtggtatgggtgagtgctgcgtttccggttgctctgcaatcaatatggatgaagctaacaagaagtttgagcttggcggcaagacattcgttgaaggcgatgtaatctctatcgacggtacaacaggtaacatctatgacggtgctatcgctactgttgacgctcagattgcaggcgaattcggcagaatcatggcttgggctgacaagtacagagttcttaaggtaagaacaaacgctgatactcccgctgacgctaagaaggcaagagaactcggtgctgaaggtatcggtctttgccgtactgagcatatgttcttcgaagctgacagaatcgccgctttccgtgagatgatctgctcagatacagttgaagaaagagaagctgcactcgctaagatcgagcctatgcagcaggctgacttcgaggctctttacgaagcacttgaaggttgccccgtaacaatcagattccttgatcctcctctgcacgaattcgttcctacagaagaagctgacatcgaggctctcgctaaggctcagggcaagtctgttgaaacaatcaagaacatcatcgcatctctccacgagttcaaccccatgatgggtcacagaggatgccgtcttgcagtaacatatcctgaaatcgctaagatgcagactaaggctgttatcaaggctgcattaaacgttaagaagaatcaccccgactggacaatcgttcctgaaatcatgattcctctggttggcgatgttaaggagctcaagtacgttaagaacttcgttgttgaaacagctgacgctgttatcaaggaagccggcgctgacctcaagtatgaagttggtacaatgatcgagatccccagagctgctcttacagctgacgaaatcgctaaggaagctgagttcttctgcttcggtacaaacgaccttacacagatgacatacggcttctctcgtgatgacgcaggcaagttccttaacgcttactatgacgctaagatcttcgagaacgatcccttcgctaagctcgaccagacaggcgttggcaagctgatggaaatggctatcaagctcggtaaggctacacgtcccgatatgcacatcggtatctgcggcgaacacggcggtgatccctcatctgttgagttctgccacaagattggtctgacatatgtttcatgctcacccttccgtgtaccgatcgcaagacttgcagcagctcaggcagctatcgctgacaagaagtaattaaggattccccttaaattaacctataaataatgtaacggtcacgttcccgaaagagaatgtgaccgttatttttattgtttgttgcaaaaaagccgataggctgtgaaataagttcacggtctatcggctttagtttgtagaaaaagtctattgtttaatgtgcttctgctatatcattcagcttaggccacgatagcaagctaccgatagtgctatctgtcggacagcacttctcgggttcgctattccatttaataacgttgctgctattcacgcgggagacaaccaaagggactagggagagtctgagcctcgcttacgcaaggctcgtgcactccgctaaagctccgctggactgccgcccctaaccctatcccttaggttttctccctcgtggctccctctttccttacccacacccgtaccccgctggggtgttggacaaactcgaataatcacccgaacattgtatgtcctgttaatgcggggacgcttaacgctacacgtccgcaggttagtacatatatctcaggttagtagcgtttttttgaagagtcaatgtcagtgcagttgcactgatacactcacgaaaatattaactccttgtcggtacggaaagtgttagcggcggtgttggtaatacatttcattatactgttttaataatcggcttttgttttgtcgcttatcacttgccaaactcatcatctacagcagaaagcgctgcggcaattaccttatccatatcataatacttatactgtccgagcctgccgccgaagattacatcgggacgggtagcggcgagggccttgtacttttcgtaaagagcattgttagcttcgtcgtttatcggatagtaaggctcaatgcccggctgccattcggctgaatattcacggctgataaccgtcttttcctgcttgccgaattcaaaatgcttatgctcgataattcttgtgtaaggcacttctctgtcggtatagtttactactgcatcaccctgatagttatcggtgtcaagtatctcgttttcaaaccgtaccgagcggtaaccgagtgcgccgtatctgtaaccgaaaaattcgtctatctgtcctgtgaaaacggtcttttcggctatatcggggttttccttgataaattcgaaatagtcggtgtctgtcttaacgtctgagcctgcgagcattttttctattatctgagtatatccgcctatcgctatgccctgatagcggtcattgaaatagttgttgtcataggtgaatctgagcggcagacgctttattatgaacgcaggaagctcggtgcagggtctgccccactgcttttgcgtgtagccctttatcagcttttcgtaaacgtccgttccgaccagcttcagcgcctgttcttcgaggttctgcgactcgcctatgttaagatttgctatctgaccggcaattatcgcctttgcttcggcgggcgtctttattccccacattttgctgaaggtgttcatattgaacggcagattgtaaagctcgtccttgtaggacgctattggggaattgatgaagttgttgaaatcggcaaagcggttcacatattcccatattgctttgtctgacgtgtggaatatatgtgcgccgtatttgtggacgtttatcccctcgatattctcggtgtaaatgttgcctgcaatgtgatttcgcttgtcgataacaaggcacttcttgccacgctgtgttgcttcataggcaaaaaccgagccgaaaagccctgctccgactatcaggtaatcaaactttgacatagctcctcctttttatagcgtaaaatcagaattactttatcctgtccataatcatccctaccacctgctctgccgtggtgttaaggcaatctatcgttatatctgcgtagcggttgtaatacacctcacgctcggcaattatttccgctaccgtttcacccggacggcaggctatgcctctcgtctttatattcgtaagacggcggataagctcctgctcgtcaactctgagatatacgcagatgccgttttctttgagatgtgccatacctgcggtcgaaaataccgcagagccgcctgttgcgattatcgcttttttatcgtttattgacagcagtgcctgttcttccgcctgcttgaagccgtcaagtccacgctcgtcgattatgttctggagctttgttccctgctgtttttgaataacaaggtcagcatccacaaaatcatatcccatagactttgcaagcagtacgccgacagtgcttttgcctgcgccgggcattccgataagaattatgtttttcatttttgtgtccttctcttttgttctttgtatcagccgttatcggctgtcattactttctcatagtagtaccagttatcgccgagcgatgaagtttcattgtcggaaatatcctttgcagaatagataagctgttttgtgttgcctgtgttgaagctgaaatgtactgcattatcctgcttttctacaccgtaacagtaagtatggcacaatacatcaagctcctccgtcagcttatcataaagcggctcgccgttttcatcagccgatatgaccgacttttcaaaaagtccgccgtgagcggctgtaatcttatagtcggcaatatcggtacttgtctttactatcatgtccagtatagacgaatacttggatttcacctgaagtatctcacgcttttcgcactcggtgatacctgctctcagacaaatatccctcaaaaagaacgagcctatcagcagtacaaacacaccgacaattacaacggctgttataactttacgcttgacgcttttcttctcagccattattctcaccttcttcggtcacattctctttatcaatagactgcattgccgcaagtgtatctgcaagcagtgcaagcggtccgccgtgtttatccgtgccgtttacacggaagttaggcttgtctgtggcaatgttcagcatcatatccttgccgaattttcctcctaccgccgaaacacgttccatcgttttcttatcggtcttttcgggatagaatatcataacgtcgccgctctggattatttcggtcaggtgcatcttctgagcaatccttctcagctttgcaacctcaataagtccctcgaccgctctcggcacatcgccgtaacggtcaataagctcatcggtcacatcataagcgtcctcgtcattttctatcatcgctatctttctgtagcagtcaacacgctgtgcctgattagagatatacttttcggggataaacgcatcaattcttatatcaataaggcactccggagtaatttcgggggctttgccctgctgttctaaaatcgcctcgttgagcagttttatatacatatcatagccgacagacgcaagatgtcccgactggctctgaccgagaaccgagcctgcgcctcttatttcaaggtctttcatagctatcctgaatcccgaaccgaagcgtgtaaactctcttattgcgtcaagtcgcttggtggcaatctcgctgagcaccttgccccgtctgaaagtgaaatatgcatatgcacggcggtttgtacgtccgacacggcctctgagctggtggagctgggcaagtcccatacaatccgcattctcaatgataagcgtgttgcagttaggtacatctacaccggtttcgataagcgttgtgcagacaagcacatctatctcgccttcgataagccttctccatacatcgagaagctcttcctcgctcattcttccgtgtgcaattccgatatttgcttcgggtaccatagaatgaatatctgcggcgcaggaatatatgctttcaatgcggttgtggacatagtaaacctgtccgttgcggcgaagctccttatttatcgcctgcgctataactcctctgtcgtgctcgacaacgtatgtggttatcgggtgacggtcgccgggcggagtttcaatgacactcatatcccttattccagacatcgccatatttagcgttctgggaatgggggttgcagataacgtcagaacatctacgtttgtgaacgcttctttcagcttttccttatcgtttacgccgaaacgctgttcttcgtctataataacaagtcctaaatccttgaacttaacatcgtcctgcacaagcctgtgtgtgcctactacaaggtcaagctcgccttcttccagcttcttcagaattatcttctgttcctttgctgtgcggaaacgtgacaacagctcaactcttatatcaaagccctccatacgttttaaaaccgtctggtagtgctgccacgcaagaacggtagtcggcacaagtatagcgcactgcttaccgtcacctatacacttgaatgcggcacggagtgcgacctccgtctttccgaatcctacatctccgcagagaagtctctccataggggcggtacgcatcatatcgtgctttatttcctctatacagcggagctgatcgtccgtttcaacatagctgaaatgatcctcgaatatatgctgctgctcggtatcgggggagaatgcaaatccctttgctttcatacggcgtgaatacagctcgataagctccttcgccatctcctgtgttgccgcttttgcctttgtctttgcctttttccaggtatctgtgccaagcttgttcagccttaccgtatccgcatctccgcttcctatataacgtgaaatgaggtcaagctgggtaacgggaacataaagcacatccgtacctgcgtattttatctttatataatcctttgaaaccttgtctgctgtgagcttctgaacgccctcgaatacgcctataccgtatgagccgtgtaccacaagatctccctgagaaatatcgctgagcgaacgtatctgtgcgccctttttgaatttcttcttaggtgtagaggtttttgatgatgaagcgcttgtacgggtgagtacggctattttttcttccggatattcaaagcctgccgataatattccctcgactaccgtaattctgccgaggtagaatttcttcgggtttttggcataatcagccttgtagcctttatcgtgcagatcctccgcaagtatctttgccgctttgtccgtgccgccgaaaatcacgcaggaatagccgttcctgctgtaattgtcaagctcctcgaaaagcattttatactctccgctccatgcggaaagctgtatcgaatccaccttcagaatatcgctgaggtcgattcctccgcctcttatgaacgtatccatataaagccgcacattattctttaccgtgtcctgatattctgctttgctcatcaggtacctgtcaagtcccttgcacagaactccgtcctcggtaagcagcttaagatcctcaaggtgagccgagatagctccctttgccgcctctgacgcagtaaaggattcgctgactataagagtggacgcataatcaaaaatactgcccggctctttatagcaaagcggaaaataacggttaagacagcatacggaaataccgtcacgcagtcttgctatatcacgtcttatacgctttgccgcttcatcgttcttctttttgttcttttcggtcttttcaagaagcgtctgcagcgtccccgaaagaacgccctcctcgaaaatcgtttctccgcagggtgttatgctgacactctttaccgtatctattcttctttgcgtatcaaggtcgaatgaagccaccgtgtcgatttcatcgccccacagctctatcctgacaggataatcactgctgacagggtaaatgtcggcaagcgagcctctgaacgagaactgtcccttaccctctatcatatcacagcgtgtatagcctgcgctgacaagcgtctttgcaagctcgtcgagctttatctcatcgcctgctttaagcgtaacggtgtgcttttccagtacgtctttgggaacggtaagctgtaccgccgcttcagacgaggatattatcagccttgccttgcccgaaagcgctgcagacagcgtttcgatacgcttatactcgtactcctgcgactgtgcctcagtatcggcaagggtcagatccgacgcaggaaactgatatgcggcagtatcaccgcacattgtgtttatatcctctgtgagctttgccgcagatgcctcgctctcggttatgacaagtaccggtgagggaagcttttcgtagcataaggccgccaggaagtgtgccttgtgtatatgcgaaagccccgtgaccagtaagggcacgggttcatcgcttaaaatatgtgcgactgactttttgtactcggtcagcgtgtcagccatatttttaagaagttccatattgtctgtctttcttatgaattgtacttattcattgcggcatcaatcttgcccgcaattatcagctttgccgcctctgcggcattatcgagcgatttttcgagattttcgccgtcttccttcttaaagcctgataatacccagtcggcaagcggaaaatcaggatgcggctttgcgcctacgcctatctttatacgggggaaagcgtcgctgtttgtgtgcagaattatgctctttatcccgttatgaccgccgtcactgccttttctgcgtatccttgttctgccgacatcaagcgaaatatcatcgtacatcacaagtatattctgagggggtatcttatagaagctcatagcctcgcctaccgcctcgccgctgttgttcataaaggttgacggtttcattataatgcagtgcctgccctctatcgcacaatcggctatgagggatttgaacttcagcttttttatctgtacgccgagtttttccgcaagggtatccgccgccataaagcctgcgttgtgccttgtgttctcatactgagtgccgggattaccaagccccactatgagatattcgacagcgccctgcggtgtaggctctctgcctgcggctatcttatcaaatatatcggataatgacatttttatttgtcctttgcatttgctgttaccgacggctttctgagataagctgttgcgagcttattcataagacgtgcggattttttatttgcgggctttttcattctccacgtccagtttcctccgacagtcgagggaacgttcatacgtcctctgccgtctatgccgagaatgtcctgcatcggaattatcgcaagtgcggcagggcttgcataaacgcttcttatgaagctgacgttcttatgctccagaaaatttgcgtttatgtagctctttgccatctttgcggctttcgcatctgctgatttaagccagcccattatagtatcgttatcgtgtgtgcctgtatacgctacgcagttatttacatagttatggcacaggtgaatactgtccttgccttcgctgttgaagccgaactgtaaaactctcataccggggaagcccgtatcgctgagaagcttttttacgctgtcgaatatatcgcccagatcctccgctatgatattgacatcgcccagcttttccctgaccgtatcgaacagcttcataccggggccttttttccactcgccgtattcggctgttgttgcatcggcaggaatagcataataagtgtcaaacgcacggaagtggtctattctcaccatatcatacagcttcattgcgtggtctattcttgacagccaccagttatagccgtcacgctccatagcgtcccagtcatacagcggatttccccacagctgtcctgtgggtgagaaataatcgggcggtactcctgcaacaagagtaggtcttagcgaaatatctatcgtgaacaatttcgggtttacccacacgtccgcactgtccattgcggcatatatcggaatgtcgcctattatggatatgccgttcttgttggcatatgctttcagcttgttccactgggtaaagaacatatactgtacgaaacggtgaaatttgatgtcctctatatgctcttccttgaatgcggcaagcacttcgggctttctgaagcgcaactccttgtcccatgtcatccacgaacgcagttcgttatgctgctttatcgccataaaaagcgcatagtcctcaagccaccagctctgctcctgaataaaggcaagataggaaacgtcctccttgaacgagaaaaacgccttacggagaagctcctttttctgtgcgattaccttttcataatctactgtggacgggtcctcgccgtattctctgccctttatgtcatcgggtgcaagaagccccagctctacaagctcccacaggtctataagcagtgggtttcctgcaaatgccgacggtgactgatagtgtgagtcggcatagcctgtcgggtgtatcggaagtacctgccagtatttctgccctgccgctttcagccagttcacaaactcaaaggcaggttttccgagtgttcctatgccctcgtttgcagggaggcttgttatatgaagtaatactccgctgctgcgtttaagttccataatatcgcctttcggttcttgttcttacttttcgtcattcatacttgttctgaacggggcaacggggatgccgttcttgccgtacagcgttacatcgccgtaatttgtccagaggtaacgtacatacgcaggcttctttacttcatctgcgtagacgcttatcgttccgtcctcgtctataactgcgcaggcaggcttgtattccttatctgcgcctgcaacctcaaagccggttatgccgttgtcgccctttatatcaaagccgctctctgcgtggtcaaagctgataacagctctgtcgcctgttacgatcatattcttgtaaatagggccgaatgcctccgtttcattatcgccgtaaacgtggtgcatagcctgcaggtaaagtctgtgacctaccggtaccttgttcttggggtgtatctcattgaattctccgcaatcgagaataaccgcaatacccgtattctttaccgtcttgaaggtacgcatctgcgcctctcttataaggcaccagtgcttccagtcggggtcggctttatagcggtgcatcgggagctgtacaaacatgaacggaagctcgtcatcgccccaatcgtctctccagagctgaataagcgccttgaacagcttgaaataagttttcggtctgttgtcgtccgtttcgccctgataatagataacgcccttgatagtatacgggcatacacgctttaccatactgtcataaagcgctgttgcgtggaagggatttaatggcgtcatagggccgggatacttgcttacaccgcagtaagcctgacactcgtcccacgttccgtcgggatgtgcgctgtagaactctaccgacttcttctgccactcttcctcatatttcacatagtcaagatattccttgtccatttcctctcttgacctgcctgctaccgcattgtcgaaatcgtcaaggtatgccttgaggtctgtatccttttcgagagattcacggctcatccagtagcttgcgcttgtaccgccccagttacagccgattattccgacagtaacgccaagccttgcggcaagctcctttgcgtagaaatacgcaactgcgctccacgctcttgcgctttcgctgtcaaaacagctccagcctgtgttttcttcgtcacggaagaacttttcatccatattgcagtttttctgcgtgtagtaataacggacgttttcggtcttatcgttagcaagaaaatccttgccgcccatgcagttctgaagctcaagctccatattgctctgaccgcctgcgagccatacctcgcctatcataacgttaccgaatacgatagtttcttcgccgttgcttatcttcatctcataagggccgcctgctttcatcgcaggaagtgtaacacaccacttttcatcggctacctctgttaccgctttgtttccgcatatcgaaactattacgctttcgccgtttttgcccgtgccgaatactcttacgttcttctctctctgaagcaccatattgctgctgaataccgcagccgctttgaacttagccattgtttatgtttttcctttccattttgacttttatacgatttctgccggttttaacggcaggaatttttctgtcgcttttttcctgcagtgcaggatatttttcctttaatagcgatgaataaagttcctcgtccttttcttcggacagcgtgtatttctttacccatctgtattcgccgtccgctttcttctcaaaccttaccgtgacctttacggagtgcttattgcaatgcactacagccatatagttcatcgggcttagccatataagcctgcttttcagcgttgcgggtttaccgcagacaggacagatatagcggttaagctcggataatctcggcactgcgttcatacgggcggtctttaccgtaccctccgaggtctgtctgaggctcaggaagggattgctgtgaacataatctatctttttctgcagctctatttcgctcggtatgtcgtttatcttagtaagaaccagtgcggtatagtacgcatcgtttattgcgctgtggtagtcaagctcctgctgtacaccggttatctcaacggcagattgaagtgttatctgcgctctgtctatcccgtactgccttgtcatcaaaggctgaaggttgaaccattcgggaagccagccggtgtccctttcgtagaactcgcactgctttacaagcgtaggtatgtcatcgggtccccacgttactataataacgtccttcccgaatttttcgagccattctctgaagctcttaagcaccactgtaagatcgtgggcgttcttaaggtcattttttgtaatacccgtcagcttctttatcctgcctttaagctcggtataatatctcggtcttacatattccgaaaagaaatcctcgcttacgataccgtccgtcacggcaactgcgcctatctgtatgatttccacctgtagaactcttgtgcctgctatacgcattttttctctgcataccggctggctccattccaggtcaagtacgatatatgtcacctgtgtgcctcacctcctgtataaacactcatagccccgcaaaagcaatgcggggcattatggttatatcgctacttcgattttttcgtcgaaatcgtgatatttatagtctttcagcgtaaagctgtttttagtgaatttatagaaatcggttatatcctctacaaccatttcgggtgcgggataaggctctttttctataatgcgttttactgcgtcgatatgtctgtcgtagatatgtgcgtccgctatgacgtgtacaagctcgcctgccttaagtcccgacgcttttgcgaacattatcagaagtgcggcatactggcacacgttccagttgttcgcagtaagcatatcctgtgaacgctgattgagaatagcgttcagcgtatctcccgtcacgttgaaggtcatactgtaggcgcacggcgcaagtcccatctcgtgcagatccttatgattgtacatattggtcattatacggcggctcgcagggttgtgcgaaagatcgtacagcactctgtccacctggtcgaactcaccctcgggatagatgctcttctgtccgagctgccagccgtaagcctgaacatattgaggctgtcgataccgctcatattgtagatagaaacacctgcgcttgaagcgtatgtctttacgttttggcgtgtgcgtaaagcgagcttgcgatattattttcatagtcgttgaatatctcacagccgatgccggtagcggtgagttgtcccacttcgcctgcaatcgtactgtaaataagctgtttttcctctttgccgtccgacttctgtgcaatattctcatctatgccgttaaaacagaattttatcctttcggtaaggagtgacagataatcctctaccgcatttatccgccctttgtcctccgccgatttatcgggagcaaagctcatattcagattatccacttatctcacttcccttttcactgtcaagatatacgccgtacagcgttgcataagcgtcaccgcttacttcgccgcatatctttatttttatctttctgcttctgagcggtattacaggagcgacagctatttcttcgccattccccttttcactgcaaagctcatataccttcctccattctccgccgtcagtgcttatatatgccgacagctcaagcgtttcgttgtcctgctttttgtgatacagcgacattctcagctttttatatattctgaatatgcttcccctgccaagctcgccgctgaccgcagagaattcgctcctgtcactgtccgtataaccgctgtcgtttccgacaagcgttacaagcctcatctttttattgctgtcacgggtaacggcatacagcctgccgtttatctcgtgcgccgagattacatccgaaagccgcctcgtgtaccacgccgagtagcgcttgtcataataatacaccgttttgtcagccgcacacataacaacatatcttccgtttgccgtcatcaccgccgtatcggtaatatcatcacccagctttgcgtcgatcctcaccgatgcagagccgttaaagctgaatatcccctcaggcgccttataataaagcagtccgtccgatatgcacagcgagccgtcactgcccttctgaacgcctctcagctttacggtgcttagcgtaaagtttgacgctcttgtgccgtagacaatatgaacgacattttctttaaagaacagtacgcctcccccgtacacgcaaactccggtgaaatccccgtcagagcctaccgttgccgcccatgcgtcagttgagatgccgtcatagcttccccactccgtagcacttccgagctttgaacagtatatttcacgatttgccgacgaacacccccacagcctgttgttatgctctgttataaaatccatcttcggtatcggacagcttaagaccgcattctttatattaggcactatgaatttgtccatcttccgcttttccgtataaaaatagtaggtatcgctgtatgcactcgtgtcgaagttgaccgacacacacccgtccatactgtagctttcctttcccaccgagcttatcactacagacaggtactgtttctttccgccgtattcataatctatcctgaccatatcgccaacgctgtagcttgacagcgctacgttttcctcaggcacatcaagatacaacagcttgtatatagaaaccgtaggccgtgtctggttctggttatattcgaacagtgtgcctgaaagcgagggcttcgccgtatactgcacgcttgcaggcgtgtctgcggtatttacaagcacctcgtccggcattatcagtatgtatgctcccagtgacacaagctgtttttcccctgcgctgagatttaccgccgttttcactcccgaaatatatataccgtccgcctttgtgtatactatctctccgttttttatggtataccccgttataccgtcagccaatgccttgtacgaaaacggctttaccgttttaagcgcaggaaaagcggtaaaatccataccgtacagctcctgccagtatccaagcggcgtaccgttcgagcgatcgataccgccgaactttacagcactttccgtaccacccgttatttctcttaccgccaagttcttcctcctatcccgtgatttcggttctcacgcacgaaatatgcctgctgttccagaaacggcagcagctttcatacagagcgtcaaacagagcgttgtcatttgcgtatctctcatactccgcatggtaaaaatctataagcgagcaaagataaagaacgtatatctcatcgtgcggagcctttatgaaaagctccgttgtaccgtcgctcatgatcttttccgtatcggtaaacccaattccctcatgctcgtgcgtaacatacagatcctcatatattctgctttcaagctcataaagccactttctcttgtcctctgcggcaatctcgttcggtcgcagtgcgtcaaccgtttcaatgacttcctttaccgtcatcacttgccctcctgcactatcagcgactgcttccagccttcatcacggtagtattccgctctctttctctgaagctcagctctgtccagttccttttttatgaacaacggcaccatcaccgtttcacctctgcgtataagataattgttgcagttcaccgatacaaacacatccgagttgtacttgtcgttgtccttgaacagccttaccgccacaagctcagttaaattttctttcatatatttctcctttgcaatattattccccttaccctcccgcactgccgttgctgtcaccataccctgcagtgaccctgtgccgcttattccgattgtcctttaccggctttaatttgcgctcgtcttttccgaataaacaggagaacagctctctattctcaccatatactcgtccgtaagtatctcggctgtgcgtaccgccttccagcccacgctcgctctctggttcagaggatcgtcgccgtagccgagctgctttactatgtgctgaagaccgccgccggcaacgtccgtcaccgcataggcgtgcgctcctataaccagagtagagaacaccgcaagcgccttattttcgtaatatgtcgaggctgtgacctgtccgcccgccgaaacgcttgccttctgatagctgtcgcccgacttcgtataatagtcctttccctcaaggaaatttgcgtcggaggtcagctgatagaactgcggacagctttcatcggcaaatatcttcgcctccgtgctttttacaaatctcacattgccgagcgagcctatctcccccttgaatatactttcagggtcggcatatttatgcacatcgacccactccgcacttctcataaggtcataggcggcataagggtgaattatcgcaacatagctctccccgtctattccgtctgcattcatgctctcaagctgtgcggcggcacggaataccgtatccaccgataaaacgcagtccttgccgagctcatctcttgacagcacctcgctcccgtccttgccgcaggcatatataacattcgttcctgcgttaactatctctcttgttatcgtgtcaagcgttcttcccgactgactgccgagcagctttgttgactgcactacattgttgtcgattgcggtaagttccagcatatccgacagcttgatatagtcgccgtactgattcactgttgccgtcttagctgttaccgacagcatatttcccgcaggtgtaacgccctcgacaagcggcgttgtcgcctttgcaagcgagctgtactttctcagttctatcgtcttgccgttattcttgggtatcggatatttgtctgcaaagcggtcatgcaccagcttaggctccgccatatctatcagagtgttctcatagaacgttttcatctcggcggacagacttgcctgtcctgttgtctgcacatcgaacagatttaatttaacttctctcatcttcatatagatttcctttcccgacggctgataccgtcatctttctattttcttatcgttttttcttatcgtttctgccgcaaaacttttccccgtgcggctgcggcttttttaaattcccgcctgccctcccgttgcaatattaatatctcaccaccttccttctcattcataaacgatcaaagcaccactctttcccctctctccgtccgtctgataagctccttccgctcatttttagacaggcttttctcgcttttcgtaaactctcccgcaggtgacagcgcaccttccttcattctgccgcttttacagaacgcaccgcttctcataagttcagatgccgcatattccattgcggcggtaaaaagctcgtccttatgcacgataagataagcctcctcaagccccacgcccttatagcacagcgaaaagaatcttctgtcactcatttcttttgcaaggtcaaactgaggatatgtctgctttacctcctcgctttccttttgccaccgctccagcctgtactccatatcgtttcttctgcaccgctcgaagttcctctcggataccgcattttctattccgtcatagtcgcatttatccgctccgcaaaactgcgccacaaggctcaatatccgttctgcccttgccgccctctcacgctttgacttaagcaccgcctgcctgaaaagctccgccttatcctcgtttcgctctccctcggctttatccggtttattgttttcgttcaggccttcatcactcttttgctccttgacttcttcgcttgtttcagcgttttccgccgcctgcacattctctgtcgcttccatatttacctctcacctctgcagcaggatacatattccggatagttttcctccagcatatcaaaccccttgcatatcccgtcaaccgccgtgttcagcccgtcgtcatccgtcacatagcttatgaccgcctgaccgcttctcagcgtaacatcaataatatcggtatcccccgtgtcctcgctgtcaaaaacattctgcgctatcgtctgtgcaagcgttgtcattgccgcacatacaagcgtagcctctgccgacccgctgttttcgttcgcacagtgtcccgtgatataaatatccctgccaagacccgacttgtctattcttactcttgtcatatcttcacctcgttcattcctgcgttatcccttattacacgctcaatttcttcttttccctcaaagtccatcatcgcaagacagcccagtgcctgcactgccgtttccggattgaaaaatccaagctgaaaaaggtgctttgcaagttcattctgcgaagctttggaaaacggcgatttcttcgatgccgtgcatactatatcaaaaacaggcttctttgtcccaagctgcaccccgaaaagctccctgctctgctcctttatggcagagttgtcaaaagcgtcatatcccccggttatcctgaagctcctcggcgtattataaaactgccttatcagttctattatcagatagcacacctgctggaacgcaaaatacgttccctttatcatatccctcgacagcttgcttcctgcctcctgtaaagccgcaatggcacttgccgccgtaacgccgtttgaaaccgacccctgagaaaaatccctgtttccgctcgtttccttcagttcgtctattttaaaactcagtgcattcatcaccgagctgtcaagcggctctgcctttatctcccttatatcctcttcaccaagatttcccgcaacgtgaacgaatctgttttttaagtcggcaaattcggcttcgttcaccgcactgttctgtcggataaaatatctctttctgctcatcatcaccgtatgctcaagaacgacctgcgacagcttatctatatacatctgtgcgtcacgcataacatctatgtagccgaatccgcacggagttccctcctgcacaaacagcgtatccataacaaatggataacggctgtgtttatagaatccgtcggcacagctttcatcgtcctcgctcgaatatatcaccctgtcgccgcagaatttacagtagcagagctgttttctgccgtttatcgttttcttgtagtaccagtcaatgacttcgaccttcgcactgtcgtccgtcttatcctccgttttgtacttttccacgtttccggtaccgcccgcaacgctttcggtatcttcccccaaaagttcagggtacatcagattcagccgttcacggtcaacaagcgtcacatagaaaaggtttgcgctctcctcaatatcctttatgcccggctcccagaacagattcagaatatctgcgtttcttatcgctatatcccccataccgccgtcagcgtcagggtcccatacaacagccgtacacatactgccgttcttgagcttgtaccaccagccgtcgctgtacagtttttcgtagccacagcgttcaagtattgcaggaagtatcagcgacaactgctttgcgacctcctcgtcgcttttttctctcggaagcaccgtaggctcaggtatattgtccatagcgtcagcgtgcttatttgccaacgagttgaacagccacgccgatgccggcataggccttgtatcgtccttgtcacagcctatttcaccccagtgccttaatttccaccactgctcgtttgacacgattctcttgtcgagtaccgccttcccctccttatactttgcaagcgtctgccttgccttacgcacctgctccttaccgattttcttcatatttctcctttcatatcacatcatatagaacgattccgctctttcgggctttctctgttcgagaggatcgtcacctgccggaatctccccacgctttaccggtgcggcgataggatgctccataaggacatacctgcattcgtcatatatgtgatcctccatcgttgtgtcaatatcctccacgttcttttcgtcatacataagcgcaggaatagttctgataaactctctgcaggtgttgaagcaatagaacatagcctccccgtcactgttgaatgccagcctgttgtggtactgcatcttacccgatattcttgcgttgtcccccggcgaccatattataaagtaaggcggccgtgccataaggtctgcgacgctttccccacggcttttatcgaatattgaagggtctgcgaccccgtacacatttctccctcttatattcggatcgtcacgctctatttttctgatattctctgcaattgccgacggctcaagccttatgccctcattcgccttatccgtacaaccgtagtattctcttatcctgtagatgcaccctttagtatccaccgcataccaccctaccgaaaacggccttgtatacccgaaatcaaatcccctcactatctcccagtggcgaggtatctcaaacggcgctatgacgtgcgtccatcttctgtcgcaataatgctccgggtcatctctccattcggtgaaaacctgcccagtaaagctgttccaatccccgtacagaagcgcctttctctcggcggtcggaagcatagacaggctcgcaagatattccggatcgtttcgcaacagctccttattgtcaaatacgctcgccgggatgaacactctcgattttcttatgattatctccgccccgtcgggctttttcaccttatgttcttctattatcggtttcatcggctcgccagccgttataaacctttgctttacccacgaatgacccggaccgcccggattcgccgtggctctgatatacaccctcgtgccttttccgcccggtctgtttctcgaaaacatataactgtattcatcaaaggaaaactgcgtcagttcatcgaaccccacaaagtcataatgcttgccctgatagttaagcctgtctttcttatgctgcatcgccccgaaatagattttagccccggatggaaaactccagcagtgcttggtcttgttgtaccttgccgcaggatatgcacctttataaagcgtctgcgacctgtcctcaagctccgtcagctgcggatacgttttcctgaaaattatccccctgtagcaagccttatccgcctgcctgagtgcctccgctaaaagtgcgtcagacttacctccgccggcggcacccccgtacaaagcctcatactctcccctttgcataaactccgcctgcctttcctgcggcgaccataccaccctccttccgccttttacatcattatctttcatctcagcaacacctcccgtttttctgtaaatctatcgccatccccacttgcccaccattccaacttcccaccatccccacaaccctcacaaaatactcgccaaccctttgcccctcgccaccacccttgcctttcaatgaacgctctgcctgtttcgcatccgcactatcccacccacttttcgtagggcgagcgtctatgtgtgcttatacgctttcgcatccgcaccattcttcgcctcacaccaacatccttgcctccctgtcaaaggtgaggtgctgtcgcccgaaaaaattcgggcgactaccggagggattgccgcatcgaccctctccatccccacaaccctctcaaaaccacatccgtccctcgcccctcgccaccgcacttggctcccttgtcaaagggagctggattgcgacaaggctatttcttactataaattgcaacattctgcgatttcatcaacattaatatcatctctgccctatctgtcgcaagactgagggattgtcacacaccctctctccaccccaacccttccaaatccgcactatcacacccacttttcgtagggcgaatgtttgtgtgtgcttatacggtttcacatctgcactatcccttgccccgcgctaaacttgcctcccttgtcaaaggtgaggtgctgtcgcccgaaaaaattcaggcgactaccggaggaattgccgcaccaaacctcaccatccccacaaccctctcaaaaccacatccatccctcgcccctcgccaccacccgtgccttttaatgaacgctctgcctgtttcgcattcgcactatccaacccacttttcgtagggcgagtgtctgtgtgtgcttatacggtttcacatctgcactatcccttgccccgcgctaaacttgcctcccttgtcaaaggtgaggtgctgtcgcccgaaaaaattcgggcgactaccggagggattgccgcaccaaccctctccatccccacaaccctctcaaaaccacatccatccctcgccccgcaccatgtccttgcctcccttgtcaaaggtgaggtgctgtcgcccgaaaaaattcgggcgactaccggagggattgccgcatcgaccctctccatccccacaaccctctcaaaaccccatcccccctcatcaaaactcaccatcattctccgttctcgcctcgggtatcaccacaactcctccttcgttttcctcatcgtcaaccacgccgccgtcccactcgtaaccgcatctgttcttcagccagaagatctgcgccgttgtgcttggcatcacctgcttttcaaccgttttgacaacacccagcttaccgtcctttccgacctgccttgtgatttccgtctgcgtgtatcctattgcacgcttcagcaatgcctcctcgacctgcttttttctctcctcgtcaccgtcttgtccgtcactttgatataatctccttatttcatcgtgcgtcagcttccagtttctcagcgttgtgcgatgtatcccgagcaattccgctgtctgcacatcgctgtacccaagctcgatacagtggctgattttatcaagaatttcctgcgtgatctctatgccccttcttctttccgtgtatatctcccctttcctgaccgttttcgccttgattataacaattcgtcataatcgtacacgtcgtcgctccactctccgcaatactccacatcgtacccgcaggcaggacagctccgctcggtttcatatgcagccgttccctgatattctccacggtactgaagcgtccgtgtcaactcattgctgtcatacgttcctccgcatattaagcatctgtacatatatcccctccgtttttctgattttttcttcattttcgaaatcgtgtacgttttttagtacacaaaatacgctataatagcctttaaaggaattatcaagcgaatcaaaaatgataaccgtgaaagctgttgcaactttccgttgtcataatgatagcacacgcaagggcatttgtcaactgtttgtagcataaattcatcattttcgtcaaactgtaacaatctttgacaacactttgtttcctttattgacaattcaacacaatgttgttataattatctcagacaacagaacgtcaatatgaaaggatgaaccttaaatgagcacaaactccggcacagtttcaggcgcattttccgaaaggataaaacagcttcgtaaagcaaaaggtgcgtcgcaggcgcaggtagccgaatatctcggcgtaaccaagcaggcatacagcctttacgaaacaggaaagcgtgagccgccgttcgccacgttattgaaaatagccgaatatttcggcacagacacagacacacttcttatgagcggcgataccgcaagggtatccgacccccgccttaaattcgcacttttcggtgaaaccgaaatagacgacgatgtactcgacgatgtaaaacgtcttgctatgctccagcttgagcttcgccgcagcaaagaaaaggacggaaagaagtaaaccgatgcaatgctctgaagggagggcaatgataattggaacagcttataaaaaccgcacaggataacgatatacttattgtagatatgcgtatgaagggcaaacagggcgctatgagccaatgcaccgacggtatgtgcattatcgccatagaccctcataaagtgaaaagtatagccgaccgaaaagaaaaaaccgttcacgagctcgggcactgcatgaccggcgccttctatgacgcaagctgtcccgtcatcccccgcggcagatgtgaacgccgtgctacagcgtgggctgtgacccacacgttcaccagaagaacgcttatcaaagcgatcagaagcggccttacagagctttggcaattagccgattacttcaacgtgaccgagcattttatgaaagatgccctgacctactacgagctttacaacggcgaataagcataacaaaaaagctcccttatgcgaaaaaacgcataagggagcttttcgctcctaaaaacatatctgccgccctattaaacccccacaaacaaaaacgccgatgattttctcatcggcgtaatttatcagaatctcccggcatccgcaccgcctcagcccttatcggctttctgtcacagcaccgtccgtcttacgaaacatattccttcttcactataaggtctgatgttgtgggattcggcacaggatcgataatattatcaatatacgttaccccgtaaacaagataatccatcgccagcacctgcatatcgtcaagcgttgctcccgcacccactcttgcaaggccgtccttgtcacggatttcaccctcgaatatcttcgccttgcctttctttacatagtcataaagagtatccgctatagtgagcgtttccttcttgcaggcggcagaataaggtgtcagcttcacaaacgcttcactgaagcctccgacataaacctccgccataaagttatcgtttatgcaggttctcaccgtgtccgtgataaacgtagcccagttgagataataccctacaagcccgtatttcggagccgaataagccatatcgtttgtaaagcctatcgacctcattccgatcgaatcgcagtagtacatacagtaatcattcgactgatacgagaatataacatcacagcccttgccctcaagcgtatttaccgcagtttccgtctgtgctttggtttccgcatagattatttcgacatccgtttcacgttccttgtatatctgctgtatgccgaggataaatgcgtttataacgccgttcgagcagtacataagatcgtctgcgactattcctatcttgtgagatgaagaattccacgccgctaccgttccgcagatgaatgcaggttgatacagcttcggtcggaacgttgtaaggttcgtgagcgatgccgtgccgccgtagctcagtatgtatacgtccttatcctttttcgcatagctgagcgccgagtttgcaaaaacgtgcgatgccgatactatgatactgcagccctcgtttttgagcgcttttacggcattttcaaactgcgacaccgcaacgccgtcaacataacaggtttcaagaccgagcgccgtttcaatatccttacggcttttctcaaacataaatgtcatgttgtcccttgaaatttcttcattgtatacatatccgaccttggcggatgtatcaagcgaatagtcaggtgccgatgagctttcacccgagcttgcaccgtcgcccgagcaggcgcatagcgtcagtaccgccgacaaggcaagcgccagtatttttatatatcttgatagctttttcaacttaaatctacctccggaaaaatcagaaaagacagcaataaaatacgattttatagctatctcattatatcggatataattataacacattttcacaaaaaattcaccctctttttcgaaaatttgttttgattttttgaaaatttgtgatatacttatatagtcacagcagtacgttatgcaatttacacaaatatcctactgcacattttaaggaaggatctaataaaaatgaagaaaagaacagcggcgacagccgcaatactcgcctgtacaatgatgttctccggctgcagcgacagcattcttacatcaggtactgacagcggcacaacaagcgttgaaaacatctggacggcaaaagacgacgacatagtggcatgggccacctcagactcactttcggatgaagaaaaggaatattatcaggtcaaattcaaggatttctatcccgagtattccttcaccatagcaaattacggacttgacgaaacaaattccgcttatgcctcctatgctcaggcgtacagaaagaatataatagatatgctgaccaacgaaaagctgatactcagaaaagccaaggagctgggactcgatcagcttaccgaagaagaaatggctgaggtcgaaaaggcctatacaaagaatctcagcgactggtacgcctcatttgagaaaaaggcgcagaccgcactcggcataagcgccgatgatacctccggcacagatgacagtgccaacgatgaaaagattctcgaaaaggaaaaagaacttttcaatgaatatatcgcaggcttcggtcttaccgaggatacattcctgatgtggcagaccaacacggcaatacagaaaaaagtcaacgactaccttcttaaagatattaccgtatccgactctgaggtcgatgattatatcacaaagctcacggcagaggctaagcaggcgtacgaaaagagcgcttcaagctatgccgccgactccgagtacaaaaaggtatggatacccaaagacgcacgttatatcaaatatatagccgtaggcattgcatcatccgattatgccgagataaatgccgcaagaaacgagagcggcgcagatgacgcagagattgacaagaagcgtgacgaaaagttagctgagataaaggaaaaggctgatgccgcacttaaaaaggctacagcagagggcgcagactttgacgcagtggtaaaggaatacagcagtgcatattccgaatctaccaaaggcgaacagatactcgtgctgaactcaaagggacttatttccgatgcgctttacgatgcagttttcgcccttgaaaagccgggcgatataagcggacttatccccaccgacagcggatattatatcgtaaagtatgtaagcgatgcaaaggttaccgacagcgacttaagcgattacaggaagactgtaaagaaagagcttttaacctcacgtcagagcgaaaagaccaacgctatacttgaggaatggcgcagtgccgtaaattacgaatatgattacgaaaagctgaacatcaccaaggaagaaaaaacatcgtctgatgcttccgcttcttctgctgacagtaaagccgataatgaaacctcctccgcagcatcctccggtaccacaacatcggaataatatgcagataattgaccgctccgtaacaggagcggttttttaaaggagaacaatatgccactatgtacactttgcccacgcaactgccgtatagaccgcagtaaaacaacaggcgcctgctccgtaaaaggacttaaaacagccaaagcgtcactccacttcggcgaagagccgtgcatttccggaacggacggcaggggcgcaggaactatattcttttccggctgttcgctgaaatgcatattctgccagaatatgcccataagccgtgacggctgcggcaaggaaataacaccggaaaggctcggtgaaataatgcttgagcttcaggaaaaaggtgcgcataatatcgaccttgtaacgcccactcattatgccgatattatagccgatgtactgaaaagcataaagtcacagcttcatataccggtagtttataactgtggcggatacgaaaaggtcgaaacgctgaaaatgcttgacgggctgattgacatttacctgcccgatttcaagtatgcttctcccgacctttcccgtgaatattcctccgcacccgactacccttccgttgcggtaaaggcaattgcggaaatgtacaggcagacaggaaaggtacagtttgatgaaaacggtatgatgaaaaagggcgttcttgtccgccacctcgtacttcccggttgccgtcacgacagtatgaaggtacttgatatgattaaagccaccgttcctgtaagcgatataaggataagccttatgcgccagtacacaccttgcggaaaagcccttgaaataaaaaatctttcaagaagacttaccacttttgaatataactcggttaccgattacgccgctcagcttggctttgacggctacacgcaggataaagaaagtgcgaccttcgagtatactcccgaatgggattttgaaggcatataaaaacaaatccgacaggaacaccctgtcggatttcactctgttgaaaagccgattattattaaattcgcactgttaaacatatcaccaacaccgcctaaaacactttccgtaccgacaaagcattaataatttcgtgagtacatcattacaactgcacgacaataacctttttaaaaaaatgcactatccctcgaaaatcgccaacacccttgcctcccctcgaaaaaggggaggtggcacggctggtaaaagttaggcttttatcaatacaaagttcagaaaatctgtctttaatatctctcaaacaaatccgagccgtgacggtggggattgttttcccatagcaccatcattacgctgttaccctctaacatttaaaaggggtgagcttctgtttctcggtcaagccgagccaactatggttgggattgtgattgcttagaagtttttttctaattgctttggttctttccctctttcatattgataagtgctgtccgacaaacagaactatcggtagcttgttatcatagataaatatcagaagatataatagaagtacattaaaaattttttccacaaactaaaatccgacaggaacaccctgtcggatttcactttatctatgcttttctgcgataatacaccgcttcaagcccggcttttcctgcagtcaggacatcgctcatataattatcccccatatgaacgatcctcttgccgccgtactcttttttaattatccgatacagccctccgtccgattttccgcacccgtattcgcacgaaacgaacagcttttcataaccgctaaacccgttgtcgcaaagcagctttgagataacgccttcggtaagatacatatctgtcgtgataatgaccgtttttccgcaggagattaccctgccgtacacatcaagcatgaacgggtcggcacggcaaactgaaaattcctcattgcattcggctttcacggcttcttcgacagcatcgtccgcaagccctgctttcacggctataatgcggtaaatatcatttatgcacggctctttcttttcttttcttgcttcattttcactgtcggccctgattttgccgaaattttctatgccaagcgttctgcccgtattgtcgaaaacctcttttcgtgaaacactgcggaaaatcagcgtatcgaaaatatcaaacgatactacatctgctttacacaaaagctccgccgtttcctcagccgacagcgagtattctccgaatttcctgtcgggaaaatgaaacacgctgtacttaagatataacagcaatgcgtacccccacgccgctgcgggcattatcccgtgaagcctgctgtgagatgaaacgaaggaaaaataacggttctgtacggaagcgttgccgcttatcagcttgtcgtatatcttctgttttccgctcaccttgtttcaccgcctgttattcttcctgttttcctatttcgtcccttgtgacagtagcctcgtgattgtagaatttcttcagctgttctaccgatatatagtcgcccgtcagctctccgctttcgttgataagatatttaccgttccacatagccgtccacagccacattgcgttatcccttgccattatgtcagggtccggatatacggcacactccgtgagtgccagcatacgcttgttaagcgacagcgaatccgttgcatacatcgccgcaagatgagcggtatcggtattgtcatatacgtcacagccgactatatcaacataatcgtcaccggggaacatcagagggtcaatatccgccgtgtatatccacagcaggtttgacagcccgtacagttcgtcaaatcgtctgtgcatagtctgccacagccatttataagtcttgctgttcttttcccaccagtacagccccgcactgcttgcagggagcggtcggaaaagcaccgtaacaccgctgtccttgagaacggaaagctgttttgctattgcgtccatatccgacagcacagcatagcattcctccgatattgtttcgtcctcaagaagctgtgccagcgattcctcattcattaccgccagatcctcatagtcgcttacagctgcaccgatgtcaaatgtgctttcgtcacggtagaaggtagtctttcctatgggcgtataccagtaccatgcgtatgacactataccgccgtttttcgcccattcctgtgaaagctgaatatccgtgttgtttttcaccagcttcgcaccgcttgccgtatagtatcttaaatcactcgctcttatcgcaggaaaccgtcccgtgttctttacgattgcgtcaatttcggtattcgtgttaggcgttacggcctgcgccgtaagcgttttcctgccgtaaatgcttttgagataatccataagttcaatacggtcggtgtttacatccttgcccgagatccacgttcctgcctgcgagtaacgcttttcgtccgctttttccgtgttctttacagttatcttgtctaaagaaacgctgttttttaccgtctggagagttatcctgtgcattccctgcgtaagatatacaggacataacgagtggctctcaaacgtatcgctctgtactatgttatacgctccgtacagctcgccgttcatacgtttatagcttccgttttcgctgtttatctgcttgtcgccgtcaacaataagagtgatgcttccgccgtcgtctgacagtgcggttatcgcaatatcgtaaaactgtgtcgaaggcacttccatatcaaacgataccgatttgtaagcgcccactgtgatatatccctcgccgctgtactttctgtcatccgagatcagctttgttccttccgtcttttccgcttcaagaacatagctgaaatttgatttgttgattttgtattctttggttttattttcggtcacaataatcgcctgcggtacagacgtttccccgtttgacgaggtatccgcactgtcgtctgaagccactgatgaatagtcgatttccgaacagccggcaagcattatgacggcaagcgtgagtgccgtaagtttcctgatatgcaagtcagtcctcctgctttattaccacaatgtcgcccgactgtatcttgtcggtaaactttgcacttttcccgtttaccgtaatcacaagcctgcgtgtgggattttcaatatcaatattcgctctttcaaacaggtctataagcatatacggagttttgctctccttttcgggaagatcggtcggaacgccgttgaagattacggatacaaaattcccctgctccgctgtctgtatatcctcagccgtttgtgctcccgatgcgctctcagcggcaacggcggcttgtaccgcttcagaagacgaacctttatcaaagcccagtatatccccgtcacaaagaacgtagctttcgggcttctcctcgccgtttacatatacggttgcggtctgcgtatctccgccgtactgcataaggaacgctccgagcgttcttgcgtcgtgtatctctatattgtcaagcggctgtatctcatagtccttgccgacttcttttccgtttgcgtaggcacgttttccggctaccgcattttcaccgcagaatatgacgcttacccttgaaatatcgtccgcataatcacggataaatgcgtgtgcgttttcgccgttcaccgcaggcgtaagcgttatgctgtcgccctgctttatctttgttgtaagtgcggcaggcttgtcgtttacagtgattaccgcaggaataaacgcagtgcctttgagcatcttcgtttcgccgttaagggtgaacttaagtcctgcgccgctgtggcccattatctgagaggttttgaagcctgccgagccgagaagctcaaatacgctgagcgactttgtatcgaacacccttacctgctcgccgtttagcgtcacggtcgagaaatcatacgccatattggtgcaggcagtgaccgcaatgccgacaggagttacatactcaggacccagcttcctgtcgcccacatcaacgtttttcataaattcctgaccgcctacagcgacccttccgtgatctattccgagcttgtccgcaagtgcgtccgcaaggccgttagccatacttccgccacctataaggaacattgcggcagggctctgaccgtttgcgtcacataccgcctgacttatcacatccgcaaggctgtcaacggacggactgcatttctcgaagaaatcagccttggatattgtctgctccctgccgaaaatgtcacggtatgtaatgctgtccgtgtcgccgctcgcctgtattttcatgcactccgccatattgaaatcaacgaagaatttccttacaatatcctcgcttatctcatcgcctgcgactgttgccatcgcataggctactatagcgccgtcacgggctatcgcaatatcagacgtacctgcgcctatatccacgagagcaatattgataagccgtatctccggcgggattatcacgttcattgcggcgataggctcgagcgtcatgctctttaccttaagacccgtcttgtccgtagcggcatacagaccctccactacgacctcgggcagaaatgcaccgataagctctatagtgaccttgtcgcccttatgcccctcaaggtttaccattgcgtaatcgtcaaggtaataatgcactaccgagtgacccacgcagtagaatacagcgtcctcgttgctgtacttctcgtctatccctttctgcgccttctgtatcgtttcgcactccattgtgcgtaccatatccgctgtgatagtgttcttatccgaaacgtcaaaatccatcgacacacggtaggtcttgagcgcacggcctgcggcggctacagaaacctctgtcaacctgatggagtttctctgctcaagcgtttcctttacggtgcgtgctacctttgctacctgctcaatatcctctacctgtccgtctatcattgcacgcttcaggtgcggaacgctctcggtatcggtcacacggaaggtttcgccgtccataaagcccagcacgcctacgaccgtccttgtgcctatatcaagtgcaaaaaccgtatctccctgtggtttcagcgtctttttagcagatgctgacggcttctttgccgtagttttctttgctgtggctgatttagctgtggtctttttattttcgcttgtattttttgcggcagattcttcttttctcggtctgcctctccttttaggtgccggcattttatttactccctttcattaaaaatatcactgattgtaccataaatcccgtaaacccgtgtaggtttacatagcttttttgatttttcggttttccgtattttgatttttgctgataccgattttttatcggagcttcgataatataattactgctgattataattataattaaatttacggaataattcaaccttttttctgttttttatcgcaaaaaaattgaaaatatcgtcagaatatgttagaataataactgatatgggatatttgcttatccaaatgcgaaaaggacagacgcactaagaaggagagtatatggaaatttcagattttgccgaagaaatgacaacgccgatacacgattttcttgtaaagaacagcgaaagtcatacgatacgctgttatatgccggggcataagggaacggaggatccgcttgacattaccgaaattgacggagcggacagcctttacgacaccgacacaaacggcggaaagggcataatagcgcaaagcgagaaaaacgcatcaaagctgttcggcagtaagagaacgctgtactcctgctcgggaagtacgcttgctatacagacaatgctcacccttgcaaagctgaggggcaacggcaaggatcacgttatcgccggcagatattcgcaccgcagctttataaattcctgcgtcctgctggggcttattccgtcctggatatatcccgaagaatatctcagcgccgccgttactcccgaaagcatagaggcaaaaatcaattcaagaacgcttgcggtatttattaattcaattgattattacggcggtatgagcaatatttccgctatagcggaggtgtgccattcgcacggtatacctttactggttgacaacgcacacggcgcatatctgaaatttgctcctgtcgatctgcaccctatgacgctcggtgcggatatgtgtgcggacagcgcccacaagacgcttcccgtgcttacgggcggagcgtatctgcatatagcaaacgagaaatactgcgctatggcgaaggaggcgatggctctcacggcgacctcaagcccaagctatcttatccttgacagccttgacagatgcaaccgtacaatagccgagaaaccctttcatatagcggaaatatgcaacaaggtaacggcgctgaagcggcactgtgccgatatgggatatgtgctgagccaaagcgattatatgaaggtgacattcgattgtgcggcggtgcattcgaccggctttgctatggctgagatgctgaaggaattcggcatagagtgcgaatatgcggacgaataccgctgtgtactgctgttcggaagcggctcgacggatgtcgattttgagacgataaagacggtgctgagggcgaatacgccaaggtcggttttcgtaaggaacctgccctcgccgcctgtccatatcaggacacagaccgcctgctcaccggcgaaggcgtacttctcgggaaaggtgagactgcctgtgatgatgacggtcggcaaggtgtgcgcaggtgcggttgcgccgtgtccgccggggatcccgcttataatgccgggcgaggtggtcacgatagacgccgcaagggcacttcgtgacaagggaatagcagatattccgatagttgtctgacgaaaaaaacaggcataaatcacaggtgatgaaaaacgatgaatgagttttgcgaaaaacaggccgtgaaaccgcttgcagtgtacgtttacggacaatatgcagaaaaccgtcacgttgatgatttatgctgaaggtgagcttttcgcaaaaacggatatttctgtggcaaaaaatcaagcccgtatcaaaagtttgcggtgaagtttatgcgttttgcctttactttatacagaaaatgtgttataattatttcgaaattcaaactcacaaggatagcccgatacagaaaggacggtaatctttatgaaattaatatatgcaatcgtaaataatgatgatgctcattcagtttcatcatcacttacaaaatctggctttcaggccaccaagcttgcctcgaccggaggatttttaatgtcaggtaacacgacatttcttatctgctctgaggacgacaagatagacgagataatcgagattatcaaggatcattcgcacaagagaaagcagtttgttccttccgccgcatcatacggcgtaggaagctacaccagctttcctgtcgaggtatttgtcggcggtgcgactatcttcgtgacgaacatagagagatttgagaaagtctgatgtctgcaagcaatgcaagctgtgacagcataaagctgttcggcaaacaacgtgagactgctctgctggcggaaacagccgaaagcgacaggcttccccacggaataatgctgacgggtgaaaaaggcataggcaagcgcaccttcgcaaagtggtgcgctatgctgtatctgtgccgtgaacccgaaaacaatatgccgtgcggcagatgcaggagctgtcggaatatcataacgggcgaacacgcagacgttatctatgccaagggcgaaaagtacagcaaggaaagcgtgcgtgataatgtatgctttgcttcaacgctccccaatgacagcgacacccgtgttttcatctatgaggactgcgaggaaatgacggaggagcagcagaaccttctgctcaaggcgatagaagagccgtcaaaatataaccgttacattttcacctgctcaaacacctcgcagatacttgaaacgataaagtcgaggctcgtgtgcataccggtatcggacatgacggcggaagaatgcatttcctgtcttgaatacaacggttatgacagcgacacggcgaaacgggcggtagagctgtacgggacaaatccgggcagaatacgggatatactctctgacgaaaagcgcataaagctgtatgatacagccaaaaaggtgacagaggcattatcgaagaaggacgaatattcggccgcagctgcaatgaccgcctgcacgacaagggaggatctgtacggggtaataacgatactgtacgagaatgtgaccgagtcgctgagagcgcttgaaaccggcggcgagcctttgctatgtctgactaaggcaaggctgtatgccttgtacgaggtgctgaacgcctttgcgcttatggacggaactaatataaatgtaaagctgatgcaggcatatatacctgcaaagctgtttgctgttttacaataggcaaataagaaagggtaaaaatgactgaaattataggagtcagattcaaggatgtcgggaagatatactacttttccccaaataaaaatacggtcaagtgcggaagtcacgttatagtggaaaccgcaagaggcgttgagtgcggcgaggtcgttatagcgaaccgtgagattgaggacgacaaggtggtacagccgctcaagagcataatccgcatagctaccgacaaggatcttgaaacgcagaagaagaaccgtgaaaaagagcaggagataatgaaggtctttgctcagaaaatagccgagcataagctggaaatgaagcctattgatattgactgtacctttgacggaagcaagatattattttatttcacagctgaaagcagagtggatttcagagagcttgtaaaggatcttgcatcggtttaccgtacaagaatagagctgcgtcagattggtgtgcgtgacgaggcgaagatgctcggcggacttggaatctgtggcagaccgttctgctgcaagacttttctcggagaatttcagccggtgtctataaagatggcaaaggagcaatcgctgtcgctgaatcccacaaagatttcaggcacctgcggacgacttatgtgctgtcttaaatatgagcagaactgctatgaggaacttcttgcgataactcctaaggtcggcgctcttgtggaaacagccgagggcagaggcatcgttgaggatgcaaacctgctgacaggcgtactcaaggtaaagctcgacaagaatcccgatgccgccgctacggcattcaagagggaggatgtaaagctgatcaaggacggcaaaataagaatcaagaaggaagaattccaggcactcaaggggcttgaggactaaggcggcggcgagtcgccgctgacaattccgccttttatggcgtttgcaattggcaatcggtagcgatacggcggggttacaacaaagcaataatcaataaaagcggttacagtgatatgctgtgaccgctttttttgcggcgggtcgccgctgactgttctccgttctatttgattgagctttgcttagcttacgttaccggcgataatagttgaaagtgggaaattaaaagttttagtcaacctttttcaaaaggttgcagatttttaaggcggagccttaaatcgctttccgcagaaagcgaaatttcttaatataaagcgattttttgaagggtcagggaaactttttgcaagataaaaagtttccctgaacttataaattattgctttgtcattctcaaaaaaggtgcctgtggcacgttttttgaaactcaatctttttgttgtatatcggtttatttgggtacagttgtttgcgggtatggtaagggttagtgcgaggcaaagggtggtgtagcaatccctcaatagttggctgagcaaagctcagcaacagaagctcacctttactcaagggagccaagaatatagtgcatggcaagggatagtgcggagtggcggtcacggtggggtgatgtgggtgctgttaaagaattatggctatactaccggacaccattttgacgagtgctgagaattgaatataaagaatccgctgtttattgcaaatggcggatttttgtgttttttgggggaaagtttggtgcgaagcgagggatgtatgttcttttaagatggctgtggaaatggcaaggtttggtgcaacgggaggggcaagcaaggcaaggatgccttaagcgtgtgtgcccaaagtttcgcaaggatgcgaaacaaataaagcacacacagacgctcaccctacgaaaagcgagtgggatagtgcaaatgcaaaaccatataagcacacagacgattgcagtacgaaaagtgattgagatagtgcggaaaatctcattgatggtgcggatggagagcaatccctcagtcttgcgacagatagggttgagtgaatattaacgttgataaaatcacaaaatgttgcaatttataataagaaatagccttgtcgcaatccagctccctttgacaagggagccaagtgtgatagtgcagagcaagggatagtgcggagtggcggtcacggcagggtgatgtgggcgctgttaaagaattatggctttactaccggacaccattttaacaagtgctgagaattgaatataaagaatccgctgtttactctaatggcggatttttgtgttttttgggggaaagtttggtgcgaagcgagggatgtatgttcttttaagatggctgtggaaatggcaaggtttggtgcaacgggaggggcaagcaaggcaaggatgccttaagcgtgtgtgcccaaagtttcgcaaggatgcgaaacaaataaagcacacacagacgctcaccctacgaaaagcgagtgggatagtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccaaagtttcgcaaggatgcgaaacaaataaagcacacacagacgctcaccctacgaaaagcgagtgggatagtgcggaaaatctaattgatggtgcggatggagagcaatccctcagtcttgacggcagaaaagtttgcaatataaaaagggtgggcatatcgcaagcagaaagcaacaaagcaacagtttgtgccttgccttcaatccacctccctttgacaagggaggcaagggtgttagcaattttcgagggatagtgcggttttgggagggttggtgcggggcgtgggatagtgcggaaaaggcggtcgccaaacagcgaccgccttaaatttgtgtcatatttgtgtcatacttgtgtcatacaatgctgaatacgttaaatgtatccggggcgatatagagcgatatgcgcattctgcactgctctgccttcaactctaatatgttcataattatattatccgcttgccattatagattactttggtcgggaaagaaaaacaggttacttcaaaaagagtattgttagccgtatttttaaaaacaatcgctatatattcctcgtaaccgtcatcatcaatatcaatgccattgtccgtttcatagtctgtatcatattctgcagatatctgtacaccatcttgaaatgtcaaataatacacaccttcagcgtgtttatgaacgaaattataaaggaagtcaaaggcttcggtttcatgtggattgatcattatgcttctccttttggatgagccggaacaacatgcgttccggcctttgaataattaataattcctatggttgtggggtattctttaccggtgctttgatcaacgtatactccaataatagtgccaaaatcaactcgctctttagtatcactcacggcttttcctttatttgaatgtactactatgagtttttgtagttgctctttagttatggtaatcttgcttcgacccggagtatagttgttgtgcccttgaatatgtttaccttgtcttccgtcatgtattgttttaggataattatcaaaattaggtttagtctgctttgctgataatttctcctcatttgcctttgctttggcggccatatctccgttatcaagcgtgagctgcgaagaaccgcttgtaccgtgtgcaagccccgaattgccgtggttcatgataccaccgcctttcgagatgtatgccgttctagatataaggtcatattgcgatcctttaatgtattattgggtataacaatctcaatatctctttcgatagcataagagaatgtatcaagtgtagcgtcgttggtactacatacatcataagcaatgattgttttaagatttgtgagcttttcaactgtcaatctgatattagctcttaacctcagattttcggcaggatcgcccatatgtccttttgtgctgatagccactactgaacaatcgccatatccatcaagtgcaaaattcacgctttcctcagtaggaaaagttatgttcggtattacaactgcaccgatttcaaaaatgaaccaaagtccgataattcgccctttgaacagccgatagttattctcaatcttgtgaatatctcccagctccgaaaaatcggggataataacatacttaacgtctttgaaacgctccttaaaatatgtcaagcgttcttcgacattgtagtaaatagcccaataaagaccgaatttaccgtcaaaatcctcatcgaactgaaagaacgctacggcagtatgctctgtcttatgataaaaactcgtctggctatacagagctatataatcaggaagcactgatacattgcaattgatagcaggcaaatccataccaccgcaggacaccgttctgtttgtcagcgtaagatagttcagattgagcagacgtattaaattgttgttttttttcaaaattactcctttctcctgtcaacaggaaaacagatgataaattcgtataatctgccacttgacaaaggagagggagttatgatataattaatttgtttaagtttatgattacatcataacaccctaaagcgcattggcttgttgttaccggcaacttgtcaatgcgtttttcctttgtcttgatcgttgtccatcggaatcaccttacctttcgatgtcatcgttattttttcttatcttgatttaccctatacttagcagatgcttctgttacagggtatttttccataattgctttggctttcatgccgactgtagcattatacggaatggtcaactctccgcaaagtgcctttgcctgccattcaacactgtaatacgcagggatttgttcatcttttgttagagtacgggttgaaataggtgtataaccaagataaaacaatatcacatgacatatttcatgacaaatgaaacacagaaaagctctgttattatcataacaagcaccatcatagactgtttgtttaatctcaatcataaatccaccttcaggcttaggatagcaccaggcaaatacatcagcaggcagtttatcatcttcaagtacagaatactccgttccttcaaatataatgcaagtctgttcgaggatttcaaggacaggaaatagttcagattcgttcagctcaaaaatttttctaacatatttgcttaaatgcctgatagcgattctgctgagtggttttgtcatataatccattagttcttatcactccttttcagtagtgccaatattttttcagctgtatcctcatcgattccatcgaatgaacgtgcaaactgcaacgccacatctctctgataggtttccgacttggataaagtaatcttaacctgatttcttgagttttcagccgcattcttcatatctgcgatttcatcgtcagaaagagcgtaatgctcagcgatgatgtcaaaccattcgttggggacattttttctaccgttttcaaccgccgataaaaaaggagtagagacaccgagcagtttagcaacatcacccatgacctcgtgatgccgaacacgaagaactctcatgaactcgccaaattttgtgtatgtcatcctgatacacctccttacctgacattgtatcacaagattgtatatttgtcaagtatattttttaatcttttttgggttaactcgaacttaatgtaatttaaccgttattgatagatttgcgattgtcaaacggtagtaaaacgacagtgttgcacaaagcataagataaatggaatattggcggttgcggtggggtgctgtgggcgtgataaggcggcggatttaatgtagttttacaataccgtttgcaataaagccgccgatgaactgctcatcggcggctttcgtatacgatttttatgcgaacacggtgaaattttcgttttcggcaacgggctttccgtcgggggtgtcgctgtactctatgcggtaatctatcccgtgctctctcagcatatcaaaaagcggagcgtacatatcgagaatacgtcctgcgttttttgcattcagccatatacggctgttttcttcgcattcgggcggtgtcggcagtgaatcaagcacgggcatcatacgctttaatatcttctgctcacggtttgtgagaatgcgcctgtgaaatatcatcttcataaaggcgactatatcgtattcacgttctttatgcggcacaaacacacggatatatcttgcgtaaggctcgccgttcacacggtggtcatacagcatatccggacgttttctgcgggtaacctcaagggcggtttcttcctgccattttgcaacggcatcgtgtgcgcctgtcagcagaacagcgggaacggctctgtcgtgccatatctccggacgggtatactgcggatgctcaagcaaaccgttataatggctctctatgctgtaggcatcgctgttgggaagcactccgtcctgaagccttgctatcgcatcggtcagtataagtgcaggaagctcgccgccggtcagaacgtaatctcctacagaaatttcctccgcattcagctcatcaagcactctctggtcaacgccttcataatgtccgcaaagtattataaggctgtcctctgcggcaagctcttttacaatatcctgcgtcagcactctgccctgcggcgacatatatatcacacggggagaatccgactcctgctttattgcggttatgcagtcatatataggctgtgcctgcataaccatacccgtgccgccgccgtatgccttgtcatcgacacggttgtgcttatttccggcatagtcacggatattgtgacaatgtatatctatatgacctgcttttcttcctctgccgactatgctttccgacaggtacgattcgcacatatcgggaaagagggtagctatatcaatccttatcatagtttctccgtttattcttcgtcaaacaagccgtcaagcggtcttataacaagatagccgtcatctatattcttttcgagcagaacctcagggatcgcagggaacataagctccttgccgtcgggggtcttaatctcgtatacgtccgccgcaccgtgctggtatatgtctgtgaccttgccgtaaaccttgccggtatctgcgtcacggacttcaagaccgataagatcctgaatgaagtttacgccctcgggcagttctacatcgtcacgatccatatacagcattttgccgactatcgtcttagcctcgtcaacattatctataccgccgagcttaagcacggcgagagttttatgcggacgtgccttttcgacctcaagctcctgcttgtcctttcccaaaaacagcctgtcaaagctgcatataacatcggcgctgtcgcagtaatactgtactctgacttcgccgccaagtccttgtgtcgctactatcttacctatctcaagaaactgttttctcatactatcctctctctgtcctcacttgctcattatttcaagaatgtctgcgggcttacgggcgatatactttgcgccgttgtcacgaagctccttttcggtgcgaaagccccacaaaactccgcaggatgtgaaccctgcatttagggcggtttgcatatcgactccgctgtcgcctatgtacagcacctcgcagggctgtacgcccagcttttccgctacgtcaagtgcaccgtcggggcagggcttcgcctttatcctgtcgtcaagtcctcttatataatcgaacacgccgccgcctaaaaaatgcggaacgacctgctgtgctatatcgtgtgccttgttggttatgacaccgagcttcatacccttttcacgggcggaacgtaaaagctcgggtatgccgtcataggcggcggtcttatcctcgctgtgagcggaataatactccataaacatagcgagcgcctgctccttatactcctgcctgtcgggcggcaggcaacgctctatcagcttaggtatgccgtttccgacaaaatatttgtattcttctatcgtgtgagtaggaaatcctaatttgcataaaatgtgatttgcgctgtcgcccagatcgtcaattgtattcaaaagcgtaccgtcaaggtcgaaaataagtgctttacagctcatagaaatacctcttttcttgctactgtctataaatattatatagctttaccctgtttatgtcaaccgagccaacaaattaaattgtgggatttgcacaaaaagttattgattaaatgcctttattatgctaaaatcggtacatacggcaagatgtgtcgtaaacaggctttgcataaaacatcaagaaaggaaaaagttatgagcacaaaaatgtacataaacggaagtgacagaaaggggcatataaacccggagatctacggtcatttttcggagcatctgggcagatgtatctacaacggcatctatgtcggggaggacagcagtattccgaatactaacggtatcagaaacgatattgttgaggcgtttaagaatattaagatgcctgttctgcgttggccgggcggatgctttgcggacgagtatcactggaaggacggcataggcgaaaagtcacagcgcaagaagatggtaaatacccactggggcggagtgaccgaggacaacagcttcggcacgcacgaattcttcaatttctgcgagatggtaggctgtgagccgtatctgacgggcaatctcggctcgggtactgtgcgggaaatgtcagagtggatagaatatatcacctcggacaacgattcgcctatgacgcagttaagaaagaagaacggcagggaaaagccgtggaagctgaagtatctcggagtgggaaacgaaaactggggctgcggaggaaatatgtcggctgagcagtattccgcactttacaagcagtatcagacatattgcaggaactacggggcaaatcagctttacaaggtcgcctgcggaccgaatggggatgattataactggacgaaggttataacagagaatatcacgccgtggcatatgaatgcgttgagcctgcactactatactgtgcctaagggacaatgggaagataagggcaacgctaccggatttaccgacgaggaatattacataacgcttgaaaaaacgtggtatatggaaacgcttgtaaagcgccactgcgatattcttaatataaataatcccgaaaataacataaaactggttgtagatgagtggggaacgtggtataatgtagaggaaggcactaacccgggatttttattccagcagaatacgatgcgtgacgctatggtggcatcgatcaatctgaacattttcaacagccactgcgacagaatctctatggcaaatcttgcgcaggcggtaaacgttcttcaggcgcttatccttacggaaggcgaaaaaatgatactgacacctacatatcatgtgttcgatctgtataagaaccaccagaacgcagagctgtgctacagcagtatagaggacgaaaagcaggagggatataatcttcccattatttcgcagagcgtatcggtaaacagcgacaacgaaatgactttaacggtttcaaactgctcgcttacggaatgcaggacgatagaagcggatatacgcggattcagttttgactctgtaagggcaaggatactgagtgcagagagcaatgctcacaacacctttgatgagccggaaaacgttacaatcacggaatttgacaagataacaaagatcgacagcggaataacattcacgcttccgccctgcagtgttgttgaaataattctttcatgaacgtctgcaaaagatgtctgctgagccgtatgagtgccgaagcgtttcagaatatcaaagagaatatagaacttattcccgacgagaaaaaagctgatgaagcgctgtacaaaaaacgtcttgaaatatgtacggagtgcgactgccttattaacggtatgtgcagtaaatgcggttgttttgtggagatgagggcagctttcgctatcaaccgatgtccgcacgaagacaagctctggtaagcgaaaggaaaaatgttatggctaatatgaaaaaactcgagcgtgattacggcgaaattctgtggaccggcaaaaagtgcataatgggtatgcctatctcatttacaagatatatacttacgtcaagcgtattatatacgaaggtgggatttctcaatatcaaggaggacgagatcgagctttacaagatagtagacaagactatgaagctgtcgctggggcagaggatggtcggatgcggtactatcgtggtaacgtcaagggattgcgatactccgaacaaggagcttaaatccgtcaaaaagccgagagaggtaaagaagattcttgacgaggcggtaaagctggagcgtgacaagtatatggtaagaggcagagatatggtcggcgcaaacctgcacggtcacggcgatatgggcgaggacaatctgcacagcgaagattttgacgaaatggcggatatgtaattggacaagatcaaggaaatatttaaaatggctctgcacccgtcgcagtggaaggagcttttcacaagataccgtgagataataatgtatgttatcttcggggcacttacaacgcttgtgtcgatagtgacatactttataatccgctgtatattcccgagtgaagaaagtgtacctctgtttttaaaatggacgtacaggctcaatttcagcggaggggattcttcaactgtattgcccaacatcatatcgtggatagtgtcggtgacatttgcgtatatcacgaacaggatatgggtatttcaaagcaaggtaaagggctttgcaaaaaacacccttcaggctctgtcgttctatgcggcaaggctattcacgctgtttgttgaccttataataatgttcctgcttgtaaatcttccgggcatcgagaacgggctttatgagttctgtgcgaaggtgttctcgaacattgttgtgctggtgctgaattatgttttcagcaaggtgtttgtgttcagaaaagagaagaaaaaaaattaacggcgggaaacgaaacaaagccgatatatcagaaataaaccgtatgcactttatcggggcatacggtttttgcttgttgaaaaagttttttgtctgatgcggctatgctatattgttcagttctgactatgataataagctaccgatagttctttttgtcggatagcacttctcgggttcgctatttgaataaatgcacctgtcaatattgacgagggaaagaaccaaagcaattaggaaaacaacttctaagcaattacaatccccaccatagttggttcggcttgactgagaaatagaagctcaccctttttcgagggaggcaagtttagagcgaagcaaagggattattgtccttttgcaatggttgtggggatgaaaatgttcggtgcaacgggaggggcaagcaaggcacggatgcctgaaatgaacgcccaaagtttcgcaaggatgcgaaaccaacagagcgttcataaagaggcacggatgcctgaaatgaacgccaaaagttttaagcatggatgcttaaagtcagccacgcaaagccgttgcacgatgcaacggcactaatggctgacgaggcatggaagcttagctcagctgggagagcatctgccttacaagcagagggtcataggttcgagccctatagtttccaccacctttcaaggcgaaagccttgactcctacggcctggtagttcagttggttagaacgccgccctgtcacggcggaggtcgtgggttcgagtcccatccaggtcgccattttttggctttccaaaagctacgcctctgtagctcagtcggtagagcagaggactgaaaatcctcgtgtcgttggttcgattccgaccggaggcaccataagaaacgcaatagcgtttcttatataagcggatttagctcatctggtagagcgccaccttgccaaggtggaggtagcgagttcgagcctcgtaatccgctccaattttttttggcgctatagccaagtggtaaggcattggtctgcaacaccatgatccccagttcaaatctgggtggcgcctccatcaaaaagaaaagcacttgcaatttgcaggtgcttttttgtgtgtaaaattcacattcagaattctgaaagctgtactttttatgtacaggcattatgctaaaatgtttatgtctatagaatatgaatagaatgcacacaaggaggagtattatatggaagaagaaaatgagcttcttgacgatgaagaattcgcagatggtgatatcattgagtttttaagaggacttatgaaagaatgctcatgtacggtagagaagcacaaagcaaaacaaagccagccagccctgccactattccaaagtcatgggaacgcaatagaaaaattcatagctgcatgctatacttaattagcatttgaacatatcaagctgacacagcaatctctttgcttgccgttaatgcgcgtctaccaatagtccgcagaaagcaagagtagcgtaaaggtataaaaatttcaaacttctttgtaacgaaattccgatttctccgtctaacctatgaagctgaaggaggtgatgacaagtatggactatgaaaagctctataaagcctactatttacaggtatactcgtatactatttctcttgccaaaaatcgtgagatagcagaggaaatcacgcagaacacattctataaggctgtttctacaacatcacaattcaaaggtaagtccgatgaattgacatggctctgctccatagcaaaaaatctttaccatgatgaaatgcgaagccgtcagcgagtagctgatgtgagtgaaatcaatgacttgccatcaaatgaaaatgttgagaactcagttgcagattctgacatggcgttccgcatacatctcgttcttcaccgtttagaggaaccatacaaagaagtctttcagcttcgcgtattcggggaactctcttttgcacaaatcgccgcaatttttggaaaaacagaatcatgggcgagagttacttatcatcgtgcaaagctaaaaattcaagaaaggatggatgaaaagcatgagtaaacaatgcgatattgttcgagatattcttccgctgtatgttgacggtgcttgcagcgaagcaagcgcagagatggtaaaagagcatttgaacgcctgtgctgactgtaacgcaatttatcagaaattgctttctcacacgaacgaagatgttcttcacgaagaaagcgaaagcgttattatgcgccatgaggcaaaagaaaagcagagaggcagaaaaaagataacgattgctgttctcgtttccatcgctctttgtatcattgcaatttttacagctctctttctgttacctataaacattgcttatgagcctgtcaaaatcgacttcccatttgaggttgaagatgtcgaaagcgttgaaatgtaccactatgacggagtgcctgcatcagcagaaaagaaagtagttgttgctgaaagtgatataaagaccctgtatgataagttcaagggcttatccttaaaagacaaaacaactgaggaaactgccggagcggatgtgaccggctttagatttaacctctcagatggaacaagctacgatttgatttacgcctgctatggagttaaaaacggcgaattgaagtcagaatcaggcggttttaagtatttcacaagtgcggatataggctcttattggaacaatttgaataaggagcttgaagcaactcctatcaatgagagtgaattgccgtgagcagatagcaaacccagccgagcctgtcaacggtcaagatgaacggcggaaatgcgccgccgttgacagcccctctccctatctcttaggttctctccctcgtgactccctctttccttacccatacccacaccccgtcggggtgttggcgaaactcgtaaaactccctgaacattgtacatcctgtcaatccagggacgcttaacgctacacgtccgtaggttagtacatatatctcgggttattggcgtttttttgaaaggtcaatgtcagtgcagttgcactgatatactcacgaaaatattaatgccttgtcggtacggaaaatgtttccggcggtgttggcggtgcatttagatatacggctttaataaacggtttttcgacagactgacgcacggcgcaatcttaacggttgcgccgtgcgtttttatatctttactgtttcaggaaacgaagctctcgcttttttcgttcaatattaccgtgccttctccgccgtcaacggtcaggctgtcgcctgtgcgtacatcgttcagcaaatcccagccaagtcctacgataaccggaatatcgaggctctttgcgagaatcgcagaatgcgaatcggacgagccgaaagccgtcagaaagccctgcgcgttgttttcacagaactgtattatttcactggggaggaagtcctccgtgcagattattttgtttgcgcctgttgcaaaatcctttgcgcttttttgctttctgccggaaagaatggaaacgagcctgtcggatatatcgtgaatgtcggcagaacgagctttcatataatcgtcatccattgcggcgaagatttttgaaaagttgtaggatgtaagcgatactgcgtattcggcgttgacacactgggtagagattatgcttctgacggcatcgctgaaatcgtcgtcaagcgtcagaaccatatgtatatcgaatattttcgcaagctgttttccgaccttgctcactgctgtgtcacgcagctcgtgcagctgttcaagagctgtctgctgtgccgcagcgaaccgacctgcttcatcctctgcactcggcgtatgtatgcagcttacggtggtgatttttctttcaaatttgaatgcctgtccgcttactgtaaatgcgttcaggcttttaccgcttaatactttcatatctacgcctcccttcaaaagaaatcgggtacggtaaagtgcggtttcagcagcattttggactaagtttgttgaaaatgctcaattattttttaatcttgcttttattatagtacaattttatcaaaaaatcaatagaaaaaaaggaaaaaataagctgttttggtgaattttttgttaagggaagtgaagggtgggattaaaaaagcggtacattttcggtgtaccgttttgggttgcagaaaaagtctattgcttgatgtacttctgttatatcgttcagcttcggctacgatagtaggctaccgatagtgctgtttgtcggacagcacttctcgggttcgctattccatttaataacgttgctgctattcacgagggagacaaccaaagggactagggtgagggactgccgcccctaaccctatcccttaggttttctccctcttggctccctctttccttacccatacccccaccccgtcggggtgttggctaaactcgaataaccacctgaacattgtatatcctgtcgatgcagggacgcttaacgctacacgtccgcaggttagtacatatatctcaggttagtagcgtttttttgaagggtcaatgttagagcagttgtacagatacactcacgaaaatattaattccttgtcagcacggaaagtgttttcggcggtgttggcaatatatttcactgtgtgatttaataattattggtttttcgacagattaagcggtacattttcggtgtaccgcttttttggggaaggctgtggattttacacgggatgtgatttaaactatttatcgaacatacatcttttgagagcggcaattatcttctgatattcatcggtcgcacgggtcataagctctgcggccttttctatattgcctgaacgcagttcttctgtgacaagggagaacgcagagtacattttagtgaacccgaggtttgccgagatacctttcattgtgtgggcggccttgaaggcggtttcggtatcacggttttcaatcgcacgcagaagccttatgtaatgcaggtcgagcataaattcctttaccgcattatatattatattttcatcgcagccaagacgtgaaagcagatcgtcatagctttcgcctgcaagaaggtagcattctctcagcgtgagatcctttttgccggtgtatccggaaattacgcttttcagctttgacgagtctacgggcttcgacagatgctcgttcattcctgcactgcgtgacttttccttgtcatcggtgaaagcgtttgccgtaagtgcgattataggaacggtggcaacatctgcacgttccattgaacgtatcgcctttgctgcggtgatgccgtctgttcccggcatcattatatccatcagcactgcgtctatgctgtattcttcggatagctcgaaaatctcgattgcttctttgccgttccacgcttttatgacggtggcaccctcgtttgtgaggaggaattcggttatttccatattcagcctgttatcctctgcgagcagtattgtaagtccttcgagcgagatttctccgacggtgaccttgctcctgtcggtgcattcgcacgaattatccgtttcaaacggcaggcttactgtgaagcaggtgccgatgttcttgcggcttacgcaatcgatcttaccgttcatattttcggtaagccttttggcaatagcaagaccgagtcccgtaccctgatagaaggttctggcttgatcgttttcctgcataaacggctcgaacattaccttcataaagttttcgcccatacctatgccgttgtccttacacgttatatttataacaaccgtatcgggaattttttcgtcaaactcggattcgctgacggaaacctttacatagcctccgtttttgccgtattttatggcattgcctatgatattcataagaatacgcttgacgtgcagagggcttcctatcagcctgttgtgaaggttttcgcaatactcgaaggtaagcgtgatgttctttcgctgaaggttatgcccgttaaggacggcaatctcgtcaaacatctcataaaggtcgaagggaatatgctcaaggtaggtttcgcccgattcgagcttgcccatatcaagtacatcgtttacaagctcaagcagatagcctgacgcagtacggatattttctctgcactctgcctgtctttcggcatcgtcggcgttcttgtcggcaatctccgtcattcccattataacgtttatcggtgttcttatatcgtggctcattctgcgtaaaaagtcgctcttggcggcattcgcacgtcttgcttcttcggcagacttcagcagcttttcgttgtatttttcctctgtaatatgactttcatgcaggtgccttatgcttattaccctgtaaataagacttgcggcaaggaagaatattatataaatcgatgtgaaaatagaggtggctgtccagctgccgatataaacctcctttgcgggatagtaaacgtagacgtagtagcttctgcatttatccataccgccgtaataagcgccgtaagggtcggttatccttacgaaatcggcgtcattggtgcttttttctgcaaagctgtttatcacggggcattcggaaactgttttacccttgtataaattgttgtttgtggctataaccttactgccgtctgtcagtatgatatggccgttcattgcaaggttgaagccggaaaacagagaatcgagagtcagctgaccgttatcgatagtttcttttgattgcttaagataagcgaatacgattccatttttatcttttctggtgaccgccgcaaagtcgtagcaataatcactttcgctgtctgcgtcatacggcaatgagaaaagtctgtccgagtaggtctttgaggtatcgaccgcaacgcttgtcagctttttctgctttatgtaatcctgccacacgttatagcctgtatcatcggtgtaatactcgttttcgggtgtgccgttttcgtcaagcacgataactccggtgatgctgagatctgccacgaattctttgagtctttcgatggagcaatcgttgaaattcgcaatgtcacggcttatttcctgcgtcttgtcgattatcctgaaaaggctctttgcaaggtcggacgcagttatttcttcatagcggatacactggtttctgatatattctattgtgcggtcggtcacgttttttgcattcgttgtattaatatatgaaaaaacggagaaaatccctgccgccagaattgctccgatgacggttataataaagaccagcttgcgataatgctttttgtgctgtaatttattcaagggttatacctccgagtgcggtattcgggtcaagtccgtattttacggcaatcttcgccagtgtgccgtcatttttcatatcatagagcgttgctctcagcttttcgggaagtgcggagtcgttgtcctttgcaaaggcgatgcccagctttgacagcagaaggctttcgtcaagcaatctgtatttattgtccgactcgtttatgaaaacacggagcatatactcgtggcctgcgacagcatcaacataattcttacgcagggcggcaaaaatgtattcggttctgacaaagcagtaaagtccgcttacctgcggaatatcgtcactcttttgtgagagcatttcttctggcttggagcttgactgcacggcaactctttttccgctgaggtcggacagagcgtagatattgctgtcggctctgacggctacagcttgtctgctgttcatataaggtcctacccatcggtacttgtcttctctgccgttcatcgaaaagcatccccacaggcaatcgaccttgccgtcagtgagcatttcatccttttcatcccagacaatgtttttaaactgcgccttgtagcccattctgagaaatgcctcgcttgcaatctccacgtctatgcctgcaggattgccgtttttgtcgctgaagttgtacggctcgtattcgtcactgcctataattatctcaggcagagcgtctgacgatacagcgcttttatcggagcagccgcttaatatgaaagccgagcttaaaactgcggctgcggcgcattttatgaatatttttaccggtgtcttgaaatcaaatcttttcataactgaaaaacggtctgccaacagaccgcctaacccttcttgttttatagaatacgcttaagataaccttctatcgacagttatcttataatactatggaaattttatcagaattctgagaatatgtcaagataaatttgtaataatattacggaaaatgtaaataaaagtcatagagaaatgtcggaaatctatactgattacaaaagaaaatgcttttacacagccgtttcagactatgtaaaagcattattcgttgtgatataagacagtgggctgtgtaaaggcattctgaaactgcccttacgtcttactgtgcggatgattcggacttattgcccgcctctacttttgcagtatccttaccgtctgccttatcttctgtcttttccttgccccagctgtcgaacatatcaattaccttgttgtatgtttcgtagcatacagagggtaatttgcccttgccgccgtaagccttttctgcaagaccgaagccctttataaaagcgtccttgagagaatcggcgtacttgctgtcgttgcctgcgagattctttgcaaattcaaacatacgcttggctgtagcttctgctccccagtaatcagcgctgttttccttgtcggtcacatcttcgctttcgaacttctttcctgttgcttcttctatctggctcttaagcgcatcggaaagctctatctgctttgcgtttttatttgttttgcttgatgcctggtgagagattatagtttcgactacgcttgcaaggtggtctgcctttgactgtgcgacagttctgaactgtgacctgtctgcgttgtcaacctcttttttctgtgccgatttctttgtatatgcgggtgtgaaggtgtcctcgctctttacatatttgtcggcgttatcggcagtgagggtgctttttgccttctctgttgatgtctgtacgcttgtctttggtgctgtctgagctgtgacagccgcctgttctgctacctttgctatttccatatcagttagtcctttcctgattattaatctaattgtgaaaccgtattgtaagctgtaaccgacatacaatattccttataatttatatcggcaggaaaaaagaaaaattaagtttttcaaaaaatttgcgaaacagtattgacaaatcgggctgaagtggttatactgttaatataacgcataaacagttagcaatttccgtgtaaaatttaccggatgttgcttattcatggcttttgtgttatacttgaataaatgcgacagacggcaaggacggcgtttatcgcagaatacaggaaggaaacgaatactgatatgtcgctcgaagtaaacggaatatccaagcaatacggtaatttcacggcacttcatccgctcagctttacgcttagcgagccgggtgtatatgccttgctcggaacaaacggcgcaggcaagaccaccgctataagaataatactcggtatgctcagccgcaacagcggcgaggtactgtggaacggtaaggcattatcgcctgtcacggaaaaagtcggatacctggcggaagaacgtgggctttatccgaaatacaagataagcgaacagctgacctattttgcaaagctgagaggtatgcgcagtgcggatattgaaaagtcgcttgcgtactggttcaagcggcttgagctaagcggctatgagaataagaaagcggagcagctttcaaagggtaatcagcagaaggtacagcttgtagcggcacttgtcgcagaccctgagcttatcatacttgatgagccgctgagcggacttgatcctgttaacgccgatcttttcaagagcgttataaacgagcagatagagaagaaaaagtatataatcatgtcctgccaccagatgcccgtaatagaagaattctgcaaggatattacgatacttcatcacggtacggcggtattgcagggcgaccttaacaagataaagaaaagctacggcagagtgaacctgtcggtaaagtgtgacggcgatgtactgccgcttgccgcacagtgcggtcttgtacccgaaacgataactcccgataagctcacgtttaaaatacagtcggaggagcaggcaaaatcgcttcttaaaatgattgttgacagcggaatgccgcttgtgcgttatgagcttcgagagccgagcctgcatgaaatatttgttgagaatatagaaagagccgacaaagaggcaggaaggagtgacgaggcgtgaaaacaggtacatacggttggaaaagcgtatttgcttttactttcagacagacggcaaagtcaaaggcgttcaaggtaagctcggtaatcatcattgtgcttgtttttgcaattgcacttcttgcgggagttctccctgcgcttatcggaagccgttcaacatcggatgacggggatataacgggtgacggggaagcgcttgtcggcacggtatattttgccgatactacgggaataacaacgggcaaggattatgagggctttttatccgggcttggcgtaaaaatcaatgattgcggcaaggacgcagatattcagtcgcttaccgaaagggttaagggtgaaaacaagtccctgcttatagttatcagggaaaacaaaatcgggtatgatatttacgcatcacgtccggatgatgaatcggtgtcatcgggtacggcgaacagcttcggtgaaacctttaaaagcgtttttgacagcgtaagattgtcaagggcagggcttaccgatgatcagattgcggctgccaacaagacggtttctgtataccagtcggttgcgggagagcctaccgaaaatgacttcggctttgtggtgaaaatggtactgcctatgctgtcctctatcgtactgtttatgcttatctttatttacggtcagatggttgcacagtcgatagcgcaggaaaagacatcgaaggtaatggagcttctgctgacatctgtaaggccgcttgctattattatcggcaagatacttgctatgggctcgcttgcgctgatacagtttatgatgatcattgtatcgggcgtactcggaatcgttgtttcaacgcctttgtcatcgtcaatcataggctcgtctgaagaaacgggagctgttacaagtcagcttatgaatgaagtaggaaaagcactcggcggattctcgcctgttgtaattttgcttattatagttgtgttcatagtgggatttatattctttgcgcttatcgcagggcttataggcgctacggtcagcagaatggaggaccttaatgccgcaatgcagcctatgtcgataataggtgtactcggcttctatcttgcttatttcccgtccacgatgggcggagaggcaaacacgatggcacttgtatcatactatctgccgatttcctcgccgttctcgatcccctcggcactgctgacaggggcgatagatatacctcaggcgcttcttgctgtactggtactgtgtgtgttcgtggtgcttatggcactgctggttgcccgtgtgtatgagcagataatactgcacacaggcaacagacttaagttaggcgatattttaggactggtaaagagcaagtgatttcccgaaagaaaagtaaaatatgtatagcgtgaaaaatctgataaaagtaatgtcatattttgccaccgccgtgatttttattacggcggtatcgctgtttgctatgcaggacgatgacggcagggcttatgcggctgatgcggtagcgtcaataagtgtgacaccgttacaatccgttcttgatatttcggacaggcgcactgtctaccgttatgacgacagtacgggtaaatacaggcggataagctattatgacgtttacgattatgataaaataaagctgacggtagactacggcggttacagcagaagctatacaggaagcgaaattaccgcactgaccgctacgctcggagctccgcttgtcatttcggacgggcagagtgaaagtgtgtgggggaacggtcggcataccgtaacatatacgctcggcacgaaaagcgcaaaagcggttttcacagtagcggcaacaaggataaagtcgctgtcggtcactccgatgtatactatcaatgcaatctgtaacgtgaagggcgattacagggtggccgctgacgagagcggcaacatatcgcaacgctttgaatatgacctcgcaggatatgactacaacgtaaaaataatctacacggacggtacgacggtcagatgtaccgccgccgatttaaagcagataacggggtatgagcctaagttttcgcaaggggataaggtactctctgtgggtgctaacgtgggttattgcactgtaggcggagttacggcaaagttttcgttcaacgttatcgaaaatccggtaaagagcgtatcgctgtatatgaccggaggtgcggattcgcttacagcgggaaatgacggatattatgcgaagaaaagcgacggcagtacatatttcagatttatttacaatgaaacgaaaatcagggcgaaggtcgtttatacaaacggaagtacggcggattatcctataggcgagctttgcgccaagctgcacggtcggcttgaaataagcgatatgcaaaacgctcggccgtgggcggcgggtactgtcacactgcctgcaaaaataaacggtataagtacgtcgcttacgctgaaagtaacaggagcgatacctccctacaatgtgggcggtcttgcctgtgacggttcttcggacgattcgctgacggtttcgtgggataccgatccgtctgcagacggctacacagccgagatatacaagggcggtcgatgggtatcgcttccgtcgtcgagcagcggaaataaggtgagagcatcggcacacgctttacagggcggatcgaagtataagttcagagtgagggcatacagaaggtcggaaagcgacacaatgtacagcgactacgcttacgtatccgcatatacattgccttcggccgtttcgggacttaaggcgggtaacaactcggcttcttctgtcagcctcagctggagcaaatcttcttatgcggacggctatactgccgaaatatataagggcggacagtggacaaagctcactgtatcatccggcggaaattcagcgtcatgcactgcatcctcgttacagagcggagcaaagtataagttcaggttaagagcatataaaaatgcggacggtaaaattctgtacagcgattatgcttatatttccgcctatactctgataaacgaaaccgtaaaattctataaggcagaggctacaaagaacactgtaacgataagctggtacaaaggttcttatgacgcatatacagcggaggtctataaggacggacggtggacgaagctcactgtgactgtcggcaacggtacggcaaaatgcacagcaaccgcacttcagagcggatcggcgtacaagttcagaataaagggttataagaaaagcggtgaagatacgctttacagcatatacagctatatttcggtaaacacactgaaataagataaacggaaaggatttttaagatggaaattattgtagcggtagatgaaaactacgggataggcaaggacggcgacctgctcgcacatctttcgccggatctgaaaaggctgaaggctatgacggtcggaaacataatagttatgggaagcaagacctatatgagctttccgaagcgaccccttccggatagggagaaccttataatcacgcatcacccggaaaattatcccggaattaagtgctttaccggtgtgggcaagtttttagagtattcgaaaacggcggataagccgatattcgtgcttggcggaggaagcatatatgaacagcttctgccttattgcgaaaaggcgcatataacaaaaatcattcacagctttgaggcggatacgttcttccctgatcttgataataatccggaatgggagaaggaaaacgaggaggaaatcgtcaccggtgagaaatacccgtttaagtatgtgacgtatgtccgcagaaaaaaataaatctttttgcaggaagctgtgattttgtgtcacaagcaccgctttctctatatcttgttgctgttgcttcaagaagtacaatatgttgaaaagtaacaataaatatcatcttcagcccttgtttcaagggctgttttttgtgcaaaatatactaaattcaaaaactgcatttagatacttttttggagcaaatgataaaatttccacttgaaatttcttgctgtgggctgtataatataaatgtacactttttgacactttggtggggctttggacacttatttttcattgaaattcaacttttctgaaaaaatgtgcggggtcgcacctcttcggcgtatctttttgtgaaaggagggacaggctcgtgataggcgaattcaaatctacacttgatgcaaagggcagaatgaacataccgcttaaactccgtgaagaaatgggaaacgatcttgtccttgcgaaaacaataggtacagcctgcataaaggtgtattcaaaagaggactggcagaagctggttgccagaataaatgaacttccgcaggtgaaaactcaaagtataaaacgattcttattcggcagtgcttatgagatttcggcggacaagcagggaagagtttctgttcctcagccgctcagagagtacgcaacgctgaccgctgatgttgtggtagtcggacttgaaggtactgcggaaatatgggataaagcttcgtgggtaaagttcaacgagaacacaaacaacgaagatctgacagagcttgctcttgagcttggaatataaacgagaggaaatatgagcgaaaaaccaattcatatacccgttttgctgagtgaaacgatagaatcgcttgatataaagcccgacggtatttatgttgactgcacgacaggctttgcgggacattcgtccgagatagcaaagcgtcttacgacgggcaggcttatcggctttgaccgtgatcccgacgctgtaaaggcggcggaggaaaagctgaaggattatccgcacacgcttatcaacaggaaattttcgacgtttgacgaaagtcttgacgaaatcggagtcggcaaggttgacggggtgctgatggatctcggagtttcatcatatcagcttgatacggctgagagaggattttcctatcacgaggacgcacctcttgatatgagaatgagcaagagcgggctgagcgcctatgatgttgttaacgaatacagcaaggaacagctggaaaagatactttttgaatacggcgaggagaaattcgcacacggtatagtaagcggtatacttaaagcgagagaaaccgcaccgataaagacaacgctggagcttgcggagatagtaaaaaggaacgtaccgctgaaggtccgcaaggagaagaatccttgcaaaaagacctttcaggcgataagaatagaagtaaacggtgagcttgacgagctgaaaaaaggaatgtcggaggcttttgaaagactttcgcaaggaggacggctcgcaatcatcaccttccattcgatagaggacaggatagtaaaaaatacattcagagaatattgcacaggctgtacctgtccgccggattttcccgtttgcgtatgcggaaaaaagccgagaggcagaacggtttacagaaagccgataaccgcaagcgaagaagaacttgaggtgaacaaccgttcaaggagtgcaaaactcagagtaatagagaaactttaataagggggaataataatgacaacaccgcacaacagaacaagtacggcttatgatatgtccttgttcgacacgtcaaaaagaaaagaacagcagattcccgaaaagaaaccggagcttaaggtcgctacgtcttccgttgcaaaatcgggcagacctgtggcagtggcagtaataggcgcagttttcctcgcagtgtttgtaatgttcttatacagcaaggccgcactcagcgaggtcaatctgaagataagcaacgaaacgcaggcgttatcggacgcacagagcataaataccgcactgagcaatcagctcagcggatcggtttcgcttgagaatgtggaacaatacgcagtaagcgaactcggtatgcagaaggtcagcgcatcgcaggaaagatacgttgagatgaataccggaaatatgaccgaaacagcgaagaatgataatggtaatatctttgtcgctgttcaggactggttcaacgggattttagaatatctcggattttagggcatataaatgaacaagcagggctcctttccacgttgatacggttgtgtttacgaggaaaggataatgcttttttatcgaaagtaattttaattgcttgaatcaccggcggcttttgccgttatctcattttaccggcaaggagaaatctatggacttaaagctcacgcaaggcatgaaaaaacgcatactggcaattctgatgatattgtgcatagttgtcaccggcattgtcagcggtgtgctgttcaaggtttcggtcattgacagcaaggaactgtctgcgatggctaccgatcagcaacagagcagttttgacataaaggcgaaacgtggaacgatatatgaccgcaacaacaaggtgctggctcaaagcactactgtgtgggatgttatcatatcaccgggcgacattgaaaaaaacgagcctgagaaccgtgagtttatatgcaagggtataagcgacatacttggcgttaaatatgaaacgctgacggaagcgtgcaaggacacttcttcacgctattatgtggtcaagaagaaggtggaccgcagtaccgttgaaaaaatcaacaactttgtgctgaaaaacaaccttaaccgttattccgtttacactgttgaaaacagcgagaggagctatcctaacggaactcttgcggcaagcgttctgggatttgtaaacgagaatgaagaaggctacggcatcgaggcatactacaattcgtatcttaagggtacggacggcagagttatcacaacgacagacgctcacggaaacgcaatgccttatgactattccgcacgctattcggcaaaggacggcaacagccttgtgctgactattgacgaaacgcttcagtattatcttgaaaagaatcttgaaatcacggtttcacagcataagctggcgaaccgcagtacgggaattattatgaatgcgaaaacgggcgctattgtggcaatggcgacatcacccggattcgatccgaatgatccatcaaatgtttactttgaaagcgacaagctgacgcttgccaagatgtcggcggacaagaagaccgaggaagaaatacttgctaaaaagcaggagatatggggaaagcagtggcagaacaaggcagtcagcgaactgtatatcccgggttcggtattcaagatgtttacctgcgcttcggcacttgaggaggaagtcgtttcgcttgacagcacatttgaatgctcgggcattgctgatgttgcgggaacgaagatcagatgctggaacgttggcggccacggcgtatcaaatcttacagaagcgatgattcgctcatgcaaccctgcatttataaagataggtcagcttctcggagtggagaagttcagcaaatatttcgaggcattcggctttaccgaaaagacgggaatagatctgccgggcgaggcagattcgctgtatgtcaaggaatcggatatgggaatagttgagctttccagctcggccttcggtcagacgaccaaggttacgcccatacagatggttacagcggcggcggctgtcgtaaacggcggtaagctcgtcacaccctatgttgtggataagataatagacagcgacggaaatgtcgtgaagtctgcacagacggtggtaagacgtcaggtaataagtgaagaaacaagcgcaacgatgcgtaagatacttgaggacgttgtaaccgcaaacggcggcggtaacgcatatatgagcggctatcgcataggcggcaagagcggtacttcagagaagatagacgactataacagcggaaagacaccggaactgagatatgttgcgacattctgtgccatagtgccgatagacgaccccgaatatgttatgcttgtcgtatgcgacgagcctacatcgggatatatctacggaagtgctattgcggcgcccgtagtatcggctgtgttcaaggaaggccttgaatatatgggaatatatcctcagtatacggctgacgagcttgcacagcaggatgttactgttccgtgggtcggaggatataacagtataagagcggaggcacagcttacagccgcaggacttaaagcagagtacataggcagtacggacggtacagaggtaacaggtcaggtgccgtcggcaggtacggttatgccgagcggaagcacggtaatgctgtatatgggagatattccgttatcggattacagaatgtctactgtgccgaatgtaataggaatgacggtcgaagaagcaaacaaggcgctgagcgaggcaggactcaacataagtattaccggtgcggcaacaggaagcgaagcaaaggcggtaagccagagcgttaattccggactggtggtatacagaggatctgttatagaggttaatttccttgtaaacaacgaaacgggctgatgatttcggctattcgatctttctgacaggagtgggtattatcaggctgtatgaaatttgtcccgaagccgaaaaggcaggggttgaaaatgcggttgtaacgggtgttaccgacaacaccgcagaggtaaagcagggcagtatatttgtctgtgtaaagggtgcaaggtttgacggtcacagcgctgcggctgaaatgctttcaaagggtgctgttatgatagtcaccgaccacgatataaagtgcggaaaacagcttgttacagataacacgaggctgtgccttgcaaggcttctgaactgcttttacggtaagccttcggagaagctcggactgcttgcggtcacgggaacgaacggcaagaccactacggcgcattttgtaaagcatattcttaccacgctcggtaagaagtgcggatgtgtaggcacggcgggaaacgatacctgttcgggcgagcttaagccgtcacagcacggcactcctaccgtaccgagagcgactgttctgtattcgtggcttggggaaatggtgagtaacggcgcagattactgcgttatggaggcaagctcgcaggctctcgaccagtaccgtataggcgatgaaaggatagcggtcgcaggatttacgaatcttacccgtgatcaccttgattatcacggtacgatggaaaattattttcaggcaaaacgacgtgttttcacaatgtgcaaaaccgctgtaataaatattgacgacgaatacggcaaaaggcttgcacaggagttttctgatattgcagtaacctacagcgccgaaggcaatgccgattatcatgcggaatttatcaggatgaatgcaacgggatgctcgtatatgcttgtaaacgagcgtgagaaaaccgcttgccgtgttgatatgaatatgacggggctgtataacgttcagaactcgctgtgtgccatagcgatggtgacggctctcggatttgatatgacggaatgtgcaaaggcactttcggatcttgacggtgttgacggcagaatgaacgttgtctacagaggcgattttaccgtaataacagactatgctcataccgacgacgcgcttataaaggtgctgtcaacgcttaaacctttgacgaagggcagacttatctgtgtgttcggtgcggcaggcgacagggacaaggaaaagcgtccgatgatggcaaaggcggctgaggataacgcagatattctcgttatcacctccgataatccggctcacgagaatcccgatgaaataatcagggaggtaatgacgggcataagcggtaaaaagccgtgcagatgtatcacagacagacgtgaagctatagcctatgcgcttgataccgcccgtaaggacgatgttataatcctttgcggcaagggtcacgaaacctatcagataatcggcgacgagtatctgccgttttccgagaaggaaatagttaaagatataatgataaggaaggaaaactgatttatgaatattcccgctaccgttataaccgcagtgctttgcttcggaattaccgcactgctcggatttgtggcaatacctgcactgagaaagctgaaattcggtcagacgatacttgatataggtcctgcctggcataagtcgaaaaacggcacgcctacaatgggcggcgttatgttcatagcaggcgttgttatctcgtttgcggcaggcattgcgataatgtgggcaagcggtgcgataaatatggacgatgtaggctcgcagaagcttgcaaaggctatatcggctgttgtgatggctcttatgttcggttttgtcggatttgtagacgatcttataaaggtaaagaagaagcagaacgagggtctgaagcccatgcagaagataataatgcaggtgcttatcatcgccgcattctttacctctcacgttatcgcaggagatacctctactgttatcaatttcccgtttttaggacaggtggatttcggaatcttctactatatagtaatgggactcggaatactgtatcttgtaaatgcggtcaatcttacagacggaattgacgggctttgctcatcggtaacgcttgtttactgcggtgcgtatgtgcttatctgctcgcttgtaggtatgggggagatgggacttgttgcggcggcggcaggcgccggctgtcttggctttatggtgtggaatcttcatcctgcgaaggtaatgatgggcgacaccggctcaatgttcttaggcggtatagttaccgctgtcggaataggcacgggaacggaattcgtaatggtcatctgctgtgcggtgtatatctgggaagcactttcggttatgatacagatgacttactataagctgacaaagggtaagcgccttttcaagatgacacctatacatcacagctttgaaatgagcggctggaaagagggcaagatcgtaatggtgttctcggctatcgaactgtttgcctgcgtagtcggagtgttacttcagtatttcggcaactgattaaaatatatcgaaagggggattgtccgtgtcggataaaaaaggtctgagctatgagcagcgaaaagcaatgtatgagcagaatatccgtgacacagacggaaagcgacacattgacaagctgcgtgacgatacacataacagcaacgcaaataataacggaagtaaaaagaatgatccctcaaaaagacacagagcagaaagaatacagcttactccgcccgtaagggaaacaataccggagcaaaaggctgaacctgctccggaaaagagaatcagaaaagaaaagaagcacaaaagcggaagattcaaaaagtggtggaaaaatattcccgccgcaccggtaatggaatatgttccgaacgcaaagcggggaagattcgatatgccgctgttcactgtagtgataatactgcttgttatgggtattattatgatgtcctccgcaagctacgcttacgctttacaggaggaaggcaacagctttgcctacgcacaaaaacagcttgttgcggcggtggtcggatttgtcgtgatgataattttgtcacgcatagattatcgtatgtgggcaaggccgttcaaaatgatcggcaaaaataaggattttgacaacggcaacggtcttaatcctgcaatggtgtttttcggattcagcgttatacttatgatactggttatcttcaagggcgacgctgttgcggatgctaagagatggataactatagcgggcgtgcagatacagccgtcggagcttttgaaaatagcatctatcctgcttgtagcatatctccttcagagaaattacgaacgcaggaaggaaagaatactcggctgtctgctgtatctttgccttatgggcattatatgtgtgctttgttatgagcaaagacacgtttccgctatgataatcttctgcgtgctgatatacgcaatgatgatagtcggtgagtgcaacgcaaagggtctgatcctgcttgccgtgcttgccgtagtcggagtgcttataatgtactacgttgtacagtgggactatataacggaaagagtgcagggctggcttgatcctttctcggatatgggaaaatcgacttatcagacttcgcagtcgcttataactataggttcgggcaacctgttcggactgggactcggaaactcaaggcagaaatattactacctgcccgaaagccagaacgactttgttttctcgataatatgcgaggagcttggattcttcggcggtatgacggtaattcttctgtttgtgctttttgaggtgagaggatttttcattgcggcaagggcaaaggataagttcggctcgctggtggcattcggaattactttacagataggtctgcaggctatccttaatatagcggttgcctgcaatgcgataccgaacaccggtatttcgctcccgttcttcagctacggcagaagcgcattgctgacacagctggcggaggtagggatactgctcagtatatccaaagacgcaaacacctgatttactgcttgtgaaaggaaaagaatatgaatgttgcatttgccgcaggcggtacgggcggacatataaacccggcgcttgccatagcggataagctgaaggaagtatttcccgatacaaatatactgtttatcggctctcccgacgggcttgaagcaaagctcgtcaaaaaggcgggatatgattttgcatcggtaaaaatggcaggtatccagcgtaagctgacaccgcataatataaagctgaatgtgcaggctgtgcattattatctcagcgcaggaaagcgtattaaaaagatatttgacgatttttcgcccgaccttgttatcggaacgggcggatatgtcacaggtacggtgctgaaaacggcgataaaatgcggaatcaagacggctctgcacgagagcaattcgctccccggagtatcggtaaagatgcttgcgccgaaggctgaccttgtgatgctcggtacggaagacgcaaaaaagcatcttggagaatgcaaaaaatgcgtggtaacgggaaatccgctgagaaacaatattccgatagaggaaaagtctgcggcaaggaaaaggctcggtcttcccgattgtctgactatactttcagcgggaggaagccagggcgcttcacggcttaatgaggcggttgtacagctgcttgcttatgagcagaaaaagggtaatataaatcacatacacggctacggaaagcacggcagggatacattcatgcaaagccttgaggataacggggtggacgcaggaaatccccacttcatcataaaggaatatattgacaatatgtatacctgtatgtgtgcaagcgaccttattataacaagagccggagcgatgacgctgacggaaataacggcgataggcagggcatctgtgcttataccgtatccgtatgcggctgaaaatcaccagtattacaatgcgcttacactgcagaatgcaaacgcaggcaggataattgacgataaggagcttacaggcagtgtgcttatcgacactgtgaacaggcttgcggacgatcccgagcttctaaggctgatgagcgaaaatgccgcaaagctgtcaaagcgtgatgcggcaggcataatactccgtgagataacggagcttatgggaataaagtaaagatttcaccttattatcctcagtagcataatatgaagaaaagctatgagagggtgataatttggataaacagaagctgataataaacggcggccgcaaaatcgagggcgaactttcgctccacggtgcgaagaatgcggcactgccgatacttgcggcaacggtgctgataaaagacggggaaagtgtaatacataactgtcccagacttaccgatgttgatgcggcactgcgtatactttcgcatataggtgtaaaatgcaggcgcagcggcagtaccgttatatcggacgcttgtgctataggcaactgtgagataccggtaaggctgatgcgtgaaatgcgttcttcgatagtttttctcggctcggtgcttggcaggacggggcattgcagaatgtcatatcccggagggtgcgaactgggaccgagacctatagacctgcacctgtcggcacttcgcagtatgggtgcggtgattgaggaaacgcacggttttcttgactgctcggcacctaaagggcttaatggcacggaaatatcgctttcgttcccatcggttggtgctacagagaatattatgcttgcggctgtgaccgcaaacggtgttactgtggtggacggtgcggcgaaagagcctgagataaccgaccttgcgggatttatgacggcctgcggagcgcaaataagcggtgcaggcactgacaggatagttatcagaggcaaggaaaagctctgcggagcggagcatagcgtaatgcccgacaggatagcggcggtgacttatatgtgctgtgcggctgtcacaggcggtgagcttatcttgagcggtgcggatattgggcatatcggggctgtcgtaccggtttttaaggaaatgggatgcagggtatattcattcggcaaggacagcatttatatcaaagcgccggaaaggctgaaggccccgcatactataaggacgatgccgtatccgtattttccgacagacgcacaggcgccgcttatggctgtatgcactgtggcggacggaactgcggtgtttgtggaaaatatattcgataaccgctatcgtcatgtgagcgagcttcttcgtatgggggctaaaatcaagacggagggcagagttgctgtggtgcagggagtacgacgtctttctgcggcggagctggtttctccagatctcagaggaggggcggcactggttattgcggctctgtgtgcggaaggaacatcgacaataggcggtatatcgcatatcgacagaggatatgaagcaatagagaaatcgctttacagcgtgggagcagacatcagaagaatttaaaagaaggaggtgcgaaaatggctgacacaataaaaagagataaaagcggtatgtggacagaaatgccgccttcggcaaagaaccgcaagcctgacgtaagacagccgatacccgcacccgtaccggaaaacaataacagcaacagcaaagcaggaaaaaagagcgataagaaaaaagcggacaaaaaagcggtaaagcaggcgaaaaagaaaaaggatacaagaaaacagcctgcggcttataacaggcaggagcggacggataacaaaacagcccgtcccgatagctgtgacagcccgatgccgagctttttaagcgagaatacacgcaccgatattcctgtagtgaagcctgtggatatacaaaacagggtactgcgcaacaagccccgttcaaagtcggacaggaaagaaaagaaacgcaggaagcgcctttcggcgtacattgtatattatgtgatattcggtattctggcggcagtaatactggcggtgctttcgacaaccgtactgttcaatctgtcaaagtacaggataacaggtgacacggtgtataccgaacagcagataatagacgccgcaggggtaaacacgggagataatctgatacttatggatgtgggtgcggtaagacagcggcttatcgacaagctcccttatgtagacaaggtcgaggtcagacgtaatatattcacctgtgcgcttgaaattaatctgaatcctgcaaccgcaatagcgaatgtaaagaaaaacaacgtttattatctcgtaagcgagaacggcagaataatgaacgccgaccttaaaacgccagataagaaatgcgttgtggtgacgggcttcgatcctgaatatgcttcatcgggagattttctgtcggttacagatgagggtagcagaaatatgctgagcaagctgttaagggcggtcaagacatatgacggaatcgacgatgaggacgaatatgaggcacagcagaaatacgaaaatgtatttatgcttatcgggctttgcaaggatgtaggaataagcgatcacatcacaacgatagatattacaagtatatacagcatcaaactcacttatgacaacaagctgacgcttgaacttggcgatgtcacagacgccgcacttaaactgacggtggcgaagaatcttatcgaaaagggcgagtttgacggtgaaaagggaactcttattctttcgcagctcagcgaaaacgcatataatatgaaggtcacattcagacccgattatgaagacacaagcagtaaggacgatacgagcaaggatgataatacttccggcggcgataattcacagacagaatccgttcccgaaacaacggcaccacccgaaaccgaaatgccgcctgaaactgaaccgccatcagaagctgagcctgaaactgaaccgccgtcagaagctgaatcagaaacggaaccgccatcagaaactgattcggaaacagaacctcagcccgatcccgaaccggataccacaccggaaaccgaatctgaatctgttaccgaaacctcgcttgatgaatattatgaataaattaacgttataattcggcgaaacaggggctaaaacccaagatattgtggtaattttaaagcgttattcaaattatgatgatattttttagcaaaacgcttgcaattacaatacgaatctgttaaaatattatagtagacagttttatctgtaaataaaacggaggaatgcaaaaatgagctttgaattcgatgaagaagagtttgagcgtgacgtcaagataaaagttgtaggcgttggcggcggcggcggaaacgcagtagagaacatggtcagaaacaacgtcgaaggcgttgactttatcatagtaaacacggatgtagcggcacttaaggctaaggacggcagtgctatggagcgtgtgcagataggcagaaagactaccaagggtcgtggtgcgggcggaaagcctcccgttgcggctgaatctgcaaaggaaaacagcgatgatattgaggaagcactgaacggtgcatctcttgtatttgttgccgcaggtatgggcggcggtacaggcacaggtgcggctcccgttatcgcagagattgcaaagaagaaaggtatacttactgtcggcgtagttacaaagccctttgaatttgaaagagagtacaagatgaatcttgctctccagggcattgcggagctgagaaagtacgttgacgcacttataatcgtgcctaaccagaaactgctttccattaaggaaaagaacatttctatcaaggcggcttatgcaatggtggataatgtgctttatcaggctgtaaagggtatttcggatcttatcacacacgatggctttatcaacatagactttgaggacgtaagatctactcttgagggtgcaggcgacgcacatatggctataggtcacggctcaggtgatacgagagctgaggaggctgtagctgaggttgttaacagcccgctgcttgaaacatccatcaagaatgcaggaaagctgcttgttaatcttactatgtctgaggatacacctcttgatgacgctgaaaaggtaatgcagttacttacacagtcggcttcaaaggatgttcaggttatacacggtgttgactttgacagcgatcttaaggatgagatggttattaccgttatcgctacctgctttaaggacagcgagggtcattctatgattacatctgatgaggctgtagcaaagacagttctcgcttctactcccacagaggatacaggctcggaaaaatcagcggatagctctttctcggaatctcttattttccccgaaacacctgcaaatgcaggggagtccggtgatgacgatcctttcacggagctttcggcacttctgaacaacagaggtaactgataattaagttaatatgattgctctcgtctttatgtcgggagcaatttttgtgtatgataatgaattgatgatacaagcggtttactgacgaaaaaatccactgcccgaaagcagtggattttcgtttttacatatcggtttaagccgtcttattcgcttctcagtgcgaggacgggatctttcttagccgcataatgcgagggaataagtcctgcgataagggtaaggagcatactgataattaccagtattactgcgccctgccacggcagtacgcacatacctgagatacctgtgaggttgtacactatagcgtttgcggggataagcagaagcagagttactccgataccgattgcgcctgcggcaaagccgacaataagcgtttctgcgttgaacacacgggaaatatctctcttgcttgcgcccatagcacgaagtatgccgatctcctttgtacgctcaagtacggaaatgtaggtgataatgcctatcattatagatgatacgacaagcgagatcgctacaaaggcgataaggataacgcttattgcgtcgattatcgttgataccgaggtcatcatcagtccgacaatatccgtatactcaatcttgaggttttcgttgccgtcggctttgactttatcgttataagtgctgatgatttcttcgattttttcttttgcgtcaaagtccttcggatagatgcttatcatactcggctcgtcaagagaagcaacaccgagaagcgtcatattaccgtcataggtagcttcggattcggtgctcatctgttttgcgaaagcgtctgctatctgctgttcggtcatgcccatctgctgtgcctgctgaagctgtgacataatttcagcctgctgttcctcgggcagtgttgcaatatatgcctttatatcttccattgtgacagcctttttgtcctcgtcctttgcaaattccttgccggtgaaaatatctgtgtcgggagagtttctctgctcctttacaacctcgctgtcatttaccttgtttacaagatactctgtaagctcgtgagtgtagcctattgctgatgaagagcttgacgaaataatgctgttctcttcgggctttataatgccgacaacctttataggctcggcgtcctcgacaacctttgtcatataaatcttgtcatcgctcttgtctgtccagataccgttttccttttcgtagaattcggggtttgtcacaagtctgaattcaagtccgagaagttcatcgtaggtgtaggtctgtaatttgcttgtgaagtcgaccttttcgttattgttgctcatagcgctttttactgcactgacaagctcgtcactgtccataagtcccatacagtaaaggctgtagtcggaaatctcgttatccttgtttaccattacgacaacttcattgtaagcgctcggcattcttcctgcaagcaccttatactgctcgtttaacagcttatcattgtcaagaagctctgtccaggtgtcatagcttgcgcttacaacgttgctcataagctgtgagtcgtacattgcgttagtcatacccatatcttcaaacagggtagcggggtttacctgaattatgcctttatccttatcgtttctgaaaatattgagcggagtggaatagctgtactttatatcgctgacataatcgtttatttcttttccgtcattttcaagataggatttaaagctctttaaatcattggatttaagctgggtgagcatggaatttaccatactgcccattatattgtttgaatgtatcttgccgtcatcggtgccgtcgctcttgttttccttcatcattgacgtcatcatagaggtcatatccatagagttgcgtgaaatggatatggggtagcttgcgagcgtttcctcctcgaccgattttatataaagctgtgcgccgctcgatattgacaggataagcgctatgcctataatacctatgcttcccgcaaaagaggtcataaacgttctgccctttttggtcataagattattaaggctgagcgacagagcggtaaggtaggacattgacggcttcttcgccttctttcccttgccctttttattttcaataggctcaacaatgttccggtcataagggtttgtgtcatcgactaccttaccgtcaagaagtcttattattctgtttgaatatttttcggcaagctcggggttatgcgttaccataattatcagcttatctttggatatttcctttaaaagctccattatctgaacgctggtttcgctgtcaagcgcacctgtcggctcatcggcaagcagtatatcggggtcgtttacaagcgctcttgcgatggcaactctctgcatctgaccgcccgacatctgattgggcttctttttcagctggtcgccaagtccgaccttaacaagcgcttcctttgctctttgtcttctttcggcttttgacacgcctgacagagtcagtgcaagctcgacatttgaaagcaccgtctggtgcggtatcagattatagctctggaatacgaatccgatcgagtgattacggtatgtatcccaatctgcgcttttgaattcctttgtggattttccgccgatgataaggtcgccgtcggtgtatctgtcaagaccgcctataatgtttaaaagcgtggtcttgccacatcccgactgaccgagtacagacacgaactcgctttctcggaagtcaatgctgacgcctctgagtgcgtggaccttttcgtttccgattttgtaatcctttgttatgtttttcagttgtagcatcgttttgtccttttcgcttagtttaaataatgggtataagattattttatatcctgtatcaaacaatatatcggcttattttaagcctgctgtgttaacggtatttaaacttttctttttcttatcttctttctcggtttctttgttttcaatggggagatagacggtgaactgcgttcccttgttaagttcgcttttaacacgaatccttcctccgcacagctcaacgatacgctttaccatagcaagacccagcccgttgccgcctgttgcgtgtgagctgtcgccctgatagaatttctcgaaaatacgttctgtagtggctttgtccattcctatgccgttatcggtgacacgcacacggatttcattgctgttcttcgggtttatgtcaaggcgtatctcgatagtaccgccgtcctgagtgtattttatagcgttgcctatgacgttcagccatacttgcttcagcatttcgctgttgccgtaatagttaagctcgcaaagctcggggattacctcctgattttttgcgccccactggctttgtaactgcagaacgcatctgcgaagctcctcgtcaagagagaactccttcttatcggtgattatctcctggttttccagcttgttcagcataaggatattgctcgacatatttatgagccgttgcgattcatttatgattatgtcgatatattcatcctcctgctcctttgtaagaccgccttttttaagctgttttgcaaagccgtatacggaaaccataggagttttgaattcgtgcgagaagtcgtttatgaagtcgtttctgaaaagctcggtattgccaagctcctttaccattatgttgaaattctcctgtatatgtgaaagctcgctgtttccgttttcctcaagtcttaccgaaaaatcgcccttagaaaccttgagcagaccctccttgagatcgtttagcggacggagaagtatgcctgacagcatcgcagacagtatactgccgataattacgcacgagcatagcattatcaggggcataagcataggcactacctcaatatgcttcatcagaccgaaagcactgaggacattatagatcatcacgcagataatgcctgcagctaccattatgaaaaatacgaacaacacaacataagcgtttatcgagcgtaaacgcttttcttcatcgcttattctcttgtgcattttattcctccgttttaagtcaatgctgtttcagcacagccttgtagccgagccctctgacagtcactatctcgaaatcctcgttgtcacggaaacgctcacgcagacggttgatatgtacgtcaatcgttctttcatcggtttcggtttccatatcccacagctcgtccataagctgacggcgtgtgaatattttgttctgatagctgagcaatttgaacagcagcataaattccttgttgggaagctcgtgcgtgacgccgccgcaggtaactgtaagcgcatcatagtcaagcacggtattgcctgcgtggagcttatgctcgttggcaatattactgcggcgcaggagtgcggatatgcgaaggagcatttcctcatcatcaacgggctttaccatataatcgtccgttcctgcacggaatcccgcaattttatctgccgaggtttctcgtgcggtcaccataagaacgggggtgttgcaaccgccctcacgaagcgttttaacaaattcgtagccgtccatacggggcatcattacgtcaagcaggataagatcaacgtgctgtctgtcgagtatgtcaagtgcgtctatgccgtcaacggcaggtaccggctcgtagccgttctgcttaagcactgtacacatcagttttcttgtgtttgtatcatcttccgcaaccattatatgaaacatattatttcctccgtttctttaaccggtgttaattacttatattatattttccttcatttaaccgaatataaaccgcctgccgcttgccgatataaacaaatacgcccttgccgcagattgtttctgcattatgcaaaggcatatttatatcagcttgtagaaaaagtacgcttttaataaaatagattaagttttcaatccctatccccaaacccctttccctcgtgaaaggctgtgtatgcttggttggctctgcatcgtgcagatcctttgggcatacacgcccggcgtccgtgcaatttatttcgtaaaattgtaattataacgaaataaagcgtattacggacaaattcgatatagctatccgtcttgacatatcggcacggttttgatataataaaaacattcagaaaggcaggtgaatgatatgaaaataaccatcaaccgtaacgagagtatctgtcattcacatttatgcttttgatatagcaattgtgcaatgataaaattcaaagtgttctcgttatcgggaacactgtttttatataaggagttattatgaacaaattgaattttatcaaagcggataaaccggattgtagcaacgcaacagacagtgaaaaaataactgtcactgtaagagaatttatcacaactacgcttgctgaaaaaatcgcaacagcattatggaacaagcctgaatgggctgacagtatcgtcagattcaattatgataacaagatcaaaagcgattgcttcaatgttatcgctctgaatgaaacaggtgatgttgtaggcagtatagcttttagggaaacgctgattaaatagcccagcagagttgtcgtaacacgggttgcaagccaatattgatgaaaaagttaccttttcaaggtaagtgataaaatctctgacaaagtaaactcacacggaacttgccgctttggaattctataaaataacactgctccgcctttcaattcaaatacgaagacgggtttttatacactttgacaaaatcaaatttacaagaacaaataaattgtgcaacgttacaaatgtggcatttttactagaattatgtgttgatttttagtaaataaactgataaaattacaattataaattatcttttaatgtaagtaacaactttaaattactgcaattaaaagtcaacttcaattgaacaggagaaaaaagcaatgaaaaatctaaagatttccaagaagataatctgcacgtttgcagttgtgcttctgctgacatttattctgggtgttgtttccctggtatcaacaaacaacatagcttctacgtctgacaattacgtcaatatatctattcccgcattgtcaaatcttgaaagcgccagacgttacatcagaatattccagggtaatattctgaaagccacctgtactgataatcaggctgatttagacaagctcgttgaagacataagcagcgaccggtcagcgttcttcgactatctcgacagctttcttgaatatgacccacagttttcagatgaagtcgaaaatatccacactgtcatggacgacgcagcttctattcgtgagagaatagtagaagcaagcgcaaaattcagctatgagggcaatcaggaagcgtattctatatatctgaacgaatacgagcctaacctcacgaaaattacgggcattctggaaaaccttacaaccgaactcaaagaagcaattaccacaagatacaataatgcacagactaccaaaacaatcaatattgtcataataattgcagtagttgtggcggctgcaatacttgtggttgctctcacagtcgttctcacaaaggcaatagtcacgccaatcattcagattaaagattccatgaaccttatcgcaaacggtctgctcaaagaagctgacggcactatcacataccgatccaaggacgagctgggtgtacttgctcatgcagcaaggaaggtcatcagattcttccaggacgtgctgcccagcatttcagatgtgtgcaggaattacggcaacggaaatttcaactgtacctgcgagaattacgatagctacgttggcgaaaccagcgagatccgcgacagcctgatgtatatacgcgataatctttccgttgccctttcaaatgttgaccaggcttccgaccagcttttaagcggcacagaagaagtctcatcaggcgctcaggctcttgctcagggggcaacgcagcaggcagcatctatccaggagctttctgaaaatattgcgtctatttccgaatctatcaaggctaattcttcggacgcagcggaagcaagtgataaagcaaatgccgcaggagcggccgtccaggaagtcaatgccatgatgtcagagcttgtaagagccatgaacgagatcaacgaattctccagcgaaaccaagaaaatcgtcaagactatcgaggatatcgcattccagacaaacattctttcactcaatgccgcagttgaggcagcaagagccggcgcagccggaaagggctttgcagtagttgctgaagaagtcagaaaccttgcaggaaaatctgctgaagcagctcagaatacgactcggatcatcgaaagcactgttaactccatcgtcagcggaaataagctctgcgccgaagttgctgaaaagatgaacaaggtcggcgaaacagccggcaaggttacggccataaacaacaagattgccgattcttccaagaaagccgctgactccatcgtcaaggttacaatcggagttgaccagatatcaaatgtcgttcagaacaactctgctacatctgaacagtctgctgccgcttccgaagagctcagcagccaggctaatatgctcaaggcgttggttaagagtttctcgctttatagcgattcctcaaatgcaggaacacatcctgctgtaaactcctgaaagtctaatttatacataaaaggctccgacaactgagttgccagagccttttttagaaattccatatgtctattataataagtttgagatgaaacgaatctatactagggacgcgctgaataaagcgaagcgtaacaaaatcagacctgtgagtatactcatgtgagcgggtcgattttgttttattcaacgtttccctaatttaaaatcattatcaacagcggataaatactcacttgcgtaattttttatcgcaaaaagggacatcgcagacccgacttcatataatagatgggtacgcgggatttctgtactacgacaaaaatggaatgccgctggtcgcaatgcactgggaacaccgattaaagcatatggtgaatcggtacaacgagatttaccgcctgcaaatgccaagcataacgccgcacgtctgccgccacacctattgcagcaatatggcgaaatccggcatgaaaccgaaaacgctgcaataccttatgggacacagcgacatcggtgttactttgaatacttacacacatctcggacttgaggacgctcaggacgaactcggtcggatagccgagattgaaaatgcccgcagggagatggataagcttggcggggagaaaacgcaggaaatgttcagagtgatgggataaaatagttatgggcgtacagagatgtacgcccatttgccataaatccaggaaatccagaactgctcatgggtactatgcaaacccagaaaaatatgctataatataatcatctgcaaaatccttagtagtaaacccgcagatttttactactatctgactactacacacatccgcaatttgccccgatttgccgtgtttctgtgaaatcaaccgcaaatccgtaaaatctgccagtacgcaaaatgcggcaaaataacgcaatacaaagccttctgaaaggaatttaccgatgtacaaaatactatttgtctgccacggcaacatctgccgttcacctatggcggaatttgtaatgaaggatatagtcgcaaaggcagggaagtccgatgaattcgtcatcgcttcgtgtgcgaccagtaccgaggaaatcggcaatcctgtgcattacggcactaaaagaaagctggcggaggtcggaatatcctgcgataaaaagagggcagtacagcttacaaagtcagattatgacaggtatgattacataatcgctatggacgagatgaatatacgcaatataatgcgtatcatcagaagcgatcccgaaaacaaggtaagtctgctgttgtcacacgcagggatagacggaagcattgcggatccttggtacacggggaactttgacgatacctacagagatgtactgctcggatgcaagggattattcagagaagtaacaagtgaataaaatatgccgccgcagttttaatcaaacagcggcggtcgttttaattattatagtgctaatttcgtaaaatttaagttatagcgaaattacttgctattcttatcctcattctgcttcaaatcgggttcgggcagatcgttttttatatccattaccggatttgagtttatagcgtcacggagctgagtatttaccacatgggtataaatctgggtggtattgaggttttcgtgtccgaggacctctttaagcacacggacatcaacaccattctgatacataagcgtagccgccgtatgacgcagtttatgaacggaaattcctttaccggcaagtccgcaggctttaaggcggtcgtcgattatctgttcgacacggcggtttgtgatgcggttgccacgtttgcttataaacagagctttttccttagggtctgcaacggattttcttgcttcggtgtacttggtaacagcatcgacgcattgctcgttgagatagacgatacgttccttgttgcctttgcccagaaccttcacggaaagatattttacatcaggttgtgacgggtctatgttttcgacaaaatcattcacgtttattccgacaagctcgctcagacgcataccgcagttgaggaacattataatcatcgcatagtcacggtaatccatccagcttgaaaactccttgaagccctcgtgcagaagctgaccgcattcctgcaacgtgaggtgcttgggcagtgcgtttttaggcgaaggaagctccaggttcagcatcgggcttgccgcaaaccacgccttgttatttgtgaggaatttatagaactgccgcagagatacagccttgcgtgagcgagcctttgcctgattggaacgttcacttacagtaaagctgagaaactccatagcgtccgtaagggtcacagcctttatgtatttatcgtcaaggtctgagatttttatctcggagaaatcctcatttgcatcaaccagcttgttcttgaccttgagaaaacgcataaacatacgcaagtcggtataatagttcaacgcagtaagctgtgaacggtttttgattgtcgtaagataattcaggtattcggtaaggcaagccggtgcgtccgatgtagcttgtctgaaatctatgttatatgccatttttgtgcgcctttcgttttttaccgcttctaatttcgtaaaattttcattttacgaaattaaccgtatttttttaacagtaaaattataacaatcggttaaattaaatattaattttacgaaattctgtgttaatttttactatctctattatacatttcttctatcagcttttcaagtttttctatcttctccgaaagaatttcaaggtctgattttttcttacgaactctgacaagtgtgtacaacatacgtttcctacgaaaattaacatagaaatcacaatcataaatcggttttttcctgtgccaaagaaaataacatttatcgcaacggtgcggtatcatatctttagaccgtatctttttatccttaacacacatatcagaagccaaactataacgataaccgacacagtgcggacataatttgttgtaacaataataacaaatacaattacggcattccttcggcggtatcataaaatactttggatcataaccgttcaacggatgcttataaaacttgttataatactcagccataaatcaatcacctacttttgaactttaaaattataaaatgtataaaatcaaaaaataaacattgaaaaacaaaaaataaaatacaaaataaaaaacgaacaatcatataaaaatctccaacagtagctttgttaataatcaattaaacccattctatttctccgtaatctatatcaggcactttatcccattcgttttttctgtcttcaggattaaggcactgtctatcatatttgaatccaagattaagcataggactatattcttttttattcacagcgttataatcggtattaatataacgtacttcagtatcacgaattatatttttactcgaccagtagtatttaccaaagattttgtcattgtctttagtaatatacttagtaatgtagtaacccactcttgcccgctctccatcaagaagaattgcagtagaaaatccatacttccaatcagatatattatagacagttttcaaaccatcagtaaatataccgaaacgttgtaaatcatcaactttccaatccttaccgtgataaatttttctgcccgaatcaacgagctgaaagcaatcgttaattaaagcatgagcatgaatacctcccgaatcgtgatgatattctggtatcaaaatatattgaagtccttttcgctgtacttgatgtgataaccaattacgcaatactttcataacagcttttggagaccgtctatcaatttcatcactttcacggagagtaagagtaacaaagtatttaaacgggttttgatagataatatcataaactttatcttttgcacgtttataactgtctgtacggttctcatttctttcttttctcctctgctcttctctttcgtcaattgtctgtttaagctgttgattagctatataaaaatcatcctcgacattatctctgtcgggctttaaatatccgtcactatatcccaacttatcagcaatattatcttctttattgtctgtttccttttctgctcttttgccgtacacccattgagaacagtatgtaatatttgtactaccgtccttatatatcttgatttttgtgttatactcacaagacatagtatgtactcccttttttattttggcgacgttctgtggctaatatcaagtaatatagtagggcggtcgagcgccccgaaggggcgctgctccccccctactatagccacttaagatatacgcttagcgttcctctgcgttctgtgtcggtctttcttttccatagcaacaccgacaccgacaccgacaccctgattagcaagaatcgtagaatcatcttcatattccattttcatcatttcatcaacaagttcagaagtatcgtaaagattacgaagcttattcgtctgcaaatgaacatcaactccgacaggaatacacttaatcataggattttgataagtacgttcatattctacagcgtcataggctgtacaagtggttattcttgtaaacgggtctgagaaccgagaacggcacactctgacagtagcagtaatatctcgtaattgtttatcgaggaattgccaccgctgaactgtaccgaatataaccatatgacgcttacggcactggcaaagatgctgaaatagtatcttcggcaatgcgttcttgttcataaagtcacgagaattaaacagtgttccgatttcatcaatcaaaacaatacaattttcgggagcgttcaaaatatcgtcaacggtatgtaatggcaatatcgttgtatgctcagggaagtttgtaagcttgatatttgtaagcaccgttacttgtttgtaacgacggcataatttatatgcagtgtataccatactggaagttttaccaccgccaaattttgcgacccaaatatgcaagccaaatttgcgaaatataaggtactcacgatgataaaagtataagaacacatcttttaaaaacatcgctaaaaacagcggtaaacgcacgatatgagcaagtagctttttaagcaaaataaatataaccatctatgtatttctccattcttgaaagttaactttcaaaattacaacattccacgaatgttagcaagtcggaatgtacctttgaacaagaaaagcactattccaagaccgattgataaccgtactatgttatcaaaaaatgtagctatggtatcaggagtttgccaaccaaaccattgaagcaacgtatttacaatatcagccattattatgtatcctttctataaaatcagcaaatgctttttcttcttcaggtgtcggtatatcgttttcatagccatacatacagcttgaatcataacaacaaccgcttaaatcatcataagtttcaacccaatcaggataatcaataacaccataaggacaactttcacaacgctttaaaacagcgtcaatacaacgctttggtttttcattcatataatcacctcttagaaatcaaaagcacaatactgaagaacagcaaaagaccaaacgataacagcaatagcgattcggtaagcgtaaggcttgttaaagcctttgcgaacactgcaccgttactgccaattgtagcaagaaatttcatagtatatctccttaatcatacacttttttaataatagctataaccaatgaaaaaatagcaaacgctatcataaagtgtaaaagcggtatattcatattaccgccgaaatcaataggggtattaagcaaattaatcaaacgtccgattatatcagcaataaaagaaaatgctgctccgaatgcttgtcttccccaccaactttcgtcccaatacataacatcacctacctaaaatgcgaaggacaataacaatagataaaccaccgattataactgcaagaataccagcaggaataatattcatacaagcctgaaaaaaagagcctaaagaacttgcagaagattgcaaactaccgaaaatatcatcaatctttaagcctgaataataatcgtacttagttgtattaatgacatcacctttcgaaataaaactatctttattaacaggctcgacagaaggagtattatttttaatatcctctatcataccatcgtaattatcgttataatcatagatctttgagccataaccgctattacctttgttaaatgtctgcttgcttgtaaaataagttgtatcaagaacaagccctgtattattatctattatttctgctttataaataagacactgaagaatatccgaataatcagaaaggcaaattgtatataccttattatcaccaatggtagaaaaatccatctcaggagaagacaatacaaacgcttgattatatattaaattgttaggaaatttaatattcaaagctgtgcgtaaataaggtgttaaatcgtgtatcttaacaccatgcagagcatacatagcaacaattctttcaattaaatcttttgtagcggaatcagaatcagcaggggtattttcacgcaagttaaagacttttttaacatcttctttagcagattcagaataagataatttaagagaataactgtgcttattgccgttatcgtgtacataataggtaaaaaggggatattgctgaccctcagaagtaaaatccttaaaccataaaggtatagttgtactatcttcaggctcaaatgaagcacaagtaacaaattcagctttaggtgctgtcaaagtatctattccgatataatcagatgaactgaaaatagtatctaagtcagaccagttattattgcgattcttgttctgaagaaaacgagattgattagatacaagaacatacttaatatcggaagggagaatattagtagcgtaagtattagacttataatcataaaaatctacgctaaattcagtaggattaagaacccattcttttttagacttgtcgtaatcatatctaacataaacaagaccgtcaccactggaagcctgcttaataacagttttataattcttataagattctccgttatcgcttgctaaactatttggataaaaattagtaccgggataaaaaattgtaccaccgttactactagttgcagtataaacatcaatatatccgtaacaattccaagacgaattagatttataataatatgtaacattattttttataactataggtataacgcaaaagccataaccaaacgtattataattttgtacgaaatcataaaaagataattctgtacctaaatcaatacaaggatagccgtcatatttaccagtaatagtaaaagagcctgtttttatatctttattagtagtttcggcacttgcagtaaatgacagcataactgatgatagcccaagaataaaaacaagcgcaacagcgaatgcgacaaaacgcataacaggaagatttcttattttttccatatataaaaatcctttctacaaaaaaataaggggaacggggttagccgttccccaaagggaatagattcggttagcaaaccgaacgcagtcttgcaaatgcgccgatacctactgatataagcgaacctgcgaggaaaagaacaagtacaggctgacttgttatctgtgtaaagcaagtacccataagagtaaatacatcgcctacagcctttgttaatgtctccatcactgttgttgcagctccttccatattgtaattatctcctttcgtttatgttaagcctttttatcggctttaacagcgttaatgaactgaacctttccgtactggtcataatatacattgatattctgaccgataagggcagatataacatcattgttgaccgcagtaccgaatacttctttaagtgtttcgggggtattcttgattttgacggtttcggcgattgagccgttagcccaatgagtacaattgccgttctcgtcatatgtgggcttgatttctcgtgtgcaataaagatacaagttattataacttatctcctgtccgtcttttttgaatactccgtttttggtttctgctccgataactatcatgttatcctctctttctctccgataacctcggtagcgggtttgaaagttaactttcaaaattcttattttttatgtaatcggctctttgccgttactatccataaagggcgatatgtcttgtacactcttccaagcttcacaactcttgcactttacgtttgcaatcacgaggacgaccgatatttacttactcggcaggctaccgaggattttaccgtcttttccttgacaagagtaattttgaaaacaagactaagcaaataacacacaaatgtgttttgctgatataagaataacacacttatgtgtttttgtcaacacaaaaatgtgttaatttataattataacacaaatttgtgttataatcacaaaaaaaggaggtgtaaattgtggaaattttactaaatagaataagggatttaaggcaagataaggatttaacacaagcacaattagcaaatattttaaaaatacacacaacaacatacgcaagatgggaacaaaacaatatgcaaatgaaatttccagacataataaaaatagcaaaattttataatgtatcaatagattacatagcaggattgacaaacgataaaaggaaatactggtaaggagatatatacaatggaacttttcataattataggagcaacaatagtcataggtctaataatagcaatcgcagaaaaaaagcgaaatttagaccaacataatgcaataatcaattcaaatcaaaattcagatgaaattataaagagattagatataattatcaatcaacaaaaatacttaattcagcttgaacaacaaaagctgtataatagccaaccgcaaaattataacaacagcggatttgataattggcaataaaaaagccctctcggatatattccgagggggttttattatatgttctttttctatataactgctctgctctttttttacgctgactttataggagattagtcagcgtaagaggaaacgtaattattttaattcgggagagaactcccgaacctacctcgaccgcacaactggagatgtgcggtaaggggtatttttttatttcaatttggggctttgccccaaaccctactttttgtctcgcaagataggcgagccaaaaagggagagggttgcgaccctcgatgtttcccttttcggttgccttacgcttaaaagtactcgataggcatcaaaagtaaaggggcttttgcggcataatccgctttttttatttaaaatgcacctaacggtgcgaccaaggaatgcggttattccacagtccccttgactttatcagccgtatcgagtatgagaaatgcgtaaggcaaccgaaaagggaaacatctcacccggggttcgtaaggaccgaaagggaaacatccctttcggctcggcggggcgggcgggaaagaaaaggctacagcggctaacagccgatagcatagcggacgggcggacgcaatggaaaggactggtaatgaaatgaaaataacatacaaattaaaatacgctgtgcaagaagcacagcgtaatggatacatggcggtaacgtcaaaggcacaaaacggtgaaatacgaatagtgccgataatggaaatacttagaaaacctatcgggtcagccgtcgggcaagacagccgatacaacatcaaatatagccttgaaccgataaaagcgattggatttaaggcgctgatgaaaagatttaaataagctaaacaagtagcgttccgcccatacgctattataccacaagtaaaaatgaattgtcaagcaaaagattttgaaagttaattttcaaaacataaaaaataaaaatgagaggttaaaacaatgccaagaaaaagaaatataacaacaatgtcggaaatgggcgcaggacttatgcaagcgtttaacgcaatcaacagccatttttacagcggcgaactggaaaaaccgataatcaccgttaaagagggcaaaaaaaagaacgcttacggatggatagaaacgtctaagaactggatacagggaaaaacggaacgttacgaaataaacatatcgtgcgattacatcggtgaacgaaccgtagcggaaacaatatcaacactaatgcacgaaatggcacatttgtacaacattcagaacgaaatcaaagacacgtccagagcgggcatttaccacaacacgaaatttaaagaaaccgccgaagcacacggactacagataagctacaacgagcatatcggatggagcttaacaaggcttacaccggaaacagaaaaatgggttgatgaaaatataaacatcaaaggctttagtgtgtacaagctgacaaaagaaaagataagcaagggaacggcgaagcccaagcaatcaatgcgaaagcttgtttgcccttgttgcggattgatagtcagagttacaaaaccgaacgtaaagctattgtgcgtagaatgcaacgaagaattaaaagaagaataaaaatcaaaatgcccctacggtatgaccgtaggggttcgctatttaggggaaattcgcaatgccccagactgcccaactttttaggcataaaaaagttcctccgaaaattgatagtgcgaatttcagcgataacaaatatttacaatgcagtttgtcaaattttcattttacgaaattaaccgtatttttttaacagtaaaattataacaatcggttaaattaaatattaattttacgaaattctgtgttaatttttactatctctattatacatttcttctatcagcttttcaagtttttctatcttctccgaaagaatttcaaggtctgattttttcttacgaactctgacaagtgtgtacaacatacgtttcctacgaaaattaacatagaaatcacaatcataaatcggttttttcctgtgccaaagaaaataacatttatcgcaacggtgcggtatcatatctttagaccgtatctttttatccttaacacacatatcagaagccaaactataacgataaccgacacagtgcggacataatttgttgtaacaataataacaaatacaattacggcattccttcggcggtatcataaaatactttggatcataaccgttcaacggatgcttataaaacttgttataatactcagccataaatcaatcacctacttttgaactttaaaattataaaatgtataaaatcaaaaaataaacattgaaaaacaaaaaataaaatacaaaataaaaaacgaacaatcatataaaaatctccaacagtagctttgttaataatcaattaaacccattctatttctccgtaatctatatcaggcactttatcccattcgttttttctgtcttcaggattaaggcactgtctatcatatttgaatccaagattaagcataggactatattcttttttattcacagcgttataatcggtattaatataacgtacttcagtatcacgaattatatttttactcgaccagtagtatttaccaaagattttgtcattgtctttagtaatatacttagtaatgtagtaacccactcttgcccgctctccatcaagaagaattgcagtagaaaatccatacttccaatcagatatattatagacagttttcaaaccatcagtaaatataccgaaacgttgtaaatcatcaactttccaatccttaccgtgataaatttttctgcccgaatcaacgagctgaaagcaatcgttaattaaagcatgagcatgaatacctcccgaatcgtgatgatattctggtatcaaaatatattgaagtccttttcgctgtacttgatgtgataaccaattacgcaatactttcataacagcttttggagaccgtctatcaatttcatcactttcacggagagtaagagtaacaaagtatttaaacgggttttgatagataatatcataaactttatcttttgcacgtttataactgtctgtacggttctcatttctttcttttctcctctgctcttctctttcgtcaattgtctgtttaagctgttgattagctatataaaaatcatcctcgacattatctctgtcgggctttaaatatccgtcactatatcccaacttatcagcaatattatcttctttattgtctgtttccttttctgctcttttgccgtacacccattgagaacagtatgtaatatttgtactaccgtccttatatatcttgatttttgtgttatactcacaagacatagtatgtactcccttttttattttggcgacgttctgtggctaatatcaagtaatatagtagggcggtcgagcgccccgaaggggcgctgctccccccctactatagccacttaagatatacgcttagcgttcctctgcgttctgtgtcggtctttcttttccatagcaacaccgacaccgacaccgacaccctgattagcaagaatcgtagaatcatcttcatattccattttcatcatttcatcaacaagttcagaagtatcgtaaagattacgaagcttattcgtctgcaaatgaacatcaactccgacaggaatacacttaatcataggattttgataagtacgttcatattctacagcgtcataggctgtacaagtggttattcttgtaaacgggtctgagaaccgagaacggcacactctgacagtagcagtaatatctcgtaattgtttatcgaggaattgccaccgctgaactgtaccgaatataaccatatgacgcttacggcactggcaaagatgctgaaatagtatcttcggcaatgcgttcttgttcataaagtcacgagaattaaacagtgttccgatttcatcaatcaaaacaatacaattttcgggagcgttcaaaatatcgtcaacggtatgtaatggcaatatcgttgtatgctcagggaagtttgtaagcttgatatttgtaagcaccgttacttgtttgtaacgacggcataatttatatgcagtgtataccatactggaagttttaccaccgccaaattttgcgacccaaatatgcaagccaaatttgcgaaatataaggtactcacgatgataaaagtataagaacacatcttttaaaaacatcgctaaaaacagcggtaaacgcacgatatgagcaagtagctttttaagcaaaataaatataaccatctatgtatttctccattcttgaaagttaactttcaaaattacaacattccacgaatgttagcaagtcggaatgtacctttgaacaagaaaagcactattccaagaccgattgataaccgtactatgttatcaaaaaatgtagctatggtatcaggagtttgccaaccaaaccattgaagcaacgtatttacaatatcagccattattatgtatcctttctataaaatcagcaaatgctttttcttcttcaggtgtcggtatatcgttttcatagccatacatacagcttgaatcataacaacaaccgcttaaatcatcataagtttcaacccaatcaggataatcaataacaccataaggacaactttcacaacgctttaaaacagcgtcaatacaacgctttggtttttcattcatataatcacctcttagaaatcaaaagcacaatactgaagaacagcaaaagaccaaacgataacagcaatagcgattcggtaagcgtaaggcttgttaaagcctttgcgaacactgcaccgttactgccaattgtagcaagaaatttcatagtatatctccttaatcatacacttttttaataatagctataaccaatgaaaaaatagcaaacgctatcataaagtgtaaaagcggtatattcatattaccgccgaaatcaataggggtattaagcaaattaatcaaacgtccgattatatcagcaataaaagaaaatgctgctccgaatgcttgtcttccccaccaactttcgtcccaatacataacatcacctacctaaaatgcgaaggacaataacaatagataaaccaccgattataactgcaagaataccagcaggaataatattcatacaagcctgaaaaaaagagcctaaagaacttgcagaagattgcaaactaccgaaaatatcatcaatctttaagcctgaataataatcgtacttagttgtattaatgacatcacctttcgaaataaaactatctttattaacaggctcgacagaaggagtattatttttaatatcctctatcataccatcgtaattatcgttataatcatagatctttgagccataaccgctattacctttgttaaatgtctgcttgcttgtaaaataagttgtatcaagaacaagccctgtattattatctattatttctgctttataaataagacactgaagaatatccgaataatcagaaaggcaaattgtatataccttattatcaccaatggtagaaaaatccatctcaggagaagacaatacaaacgcttgattatatattaaattgttaggaaatttaatattcaaagctgtgcgtaaataaggtgttaaatcgtgtatcttaacaccatgcagagcatacatagcaacaattctttcaattaaatcttttgtagcggaatcagaatcagcaggggtattttcacgcaagttaaagacttttttaacatcttctttagcagattcagaataagataatttaagagaataactgtgcttattgccgttatcgtgtacataataggtaaaaaggggatattgctgaccctcagaagtaaaatccttaaaccataaaggtatagttgtactatcttcaggctcaaatgaagcacaagtaacaaattcagctttaggtgctgtcaaagtatctattccgatataatcagatgaactgaaaatagtatctaagtcagaccagttattattgcgattcttgttctgaagaaaacgagattgattagatacaagaacatacttaatatcggaagggagaatattagtagcgtaagtattagacttataatcataaaaatctacgctaaattcagtaggattaagaacccattcttttttagacttgtcgtaatcatatctaacataaacaagaccgtcaccactggaagcctgcttaataacagttttataattcttataagattctccgttatcgcttgctaaactatttggataaaaattagtaccgggataaaaaattgtaccaccgttactactagttgcagtataaacatcaatatatccgtaacaattccaagacgaattagatttataataatatgtaacattattttttataactataggtataacgcaaaagccataaccaaacgtattataattttgtacgaaatcataaaaagataattctgtacctaaatcaatacaaggatagccgtcatatttaccagtaatagtaaaagagcctgtttttatatctttattagtagtttcggcacttgcagtaaatgacagcataactgatgatagcccaagaataaaaacaagcgcaacagcgaatgcgacaaaacgcataacaggaagatttcttattttttccatatataaaaatcctttctacaaaaaaataaggggaacggggttagccgttccccaaagggaatagattcggttagcaaaccgaacgcagtcttgcaaatgcgccgatacctactgatataagcgaacctgcgaggaaaagaacaagtacaggctgacttgttatctgtgtaaagcaagtacccataagagtaaatacatcgcctacagcctttgttaatgtctccatcactgttgttgcagctccttccatattgtaattatctcctttcgtttatgttaagcctttttatcggctttaacagcgttaatgaactgaacctttccgtactggtcataatatacattgatattctgaccgataagggcagatataacatcattgttgaccgcagtaccgaatacttctttaagtgtttcgggggtattcttgattttgacggtttcggcgattgagccgttagcccaatgagtacaattgccgttctcgtcatatgtgggcttgatttctcgtgtgcaataaagatacaagttattataacttatctcctgtccgtcttttttgaatactccgtttttggtttctgctccgataactatcatgttatcctctctttctctccgataacctcggtagcgggtttgaaagttaactttcaaaattcttattttttatgtaatcggctctttgccgttactatccataaagggcgatatgtcttgtacactcttccaagcttcacaactcttgcactttacgtttgcaatcacgaggacgaccgatatttacttactcggcaggctaccgaggattttaccgtcttttccttgacaagagtaattttgaaaacaagactaagcaaataacacacaaatgtgttttgctgatataagaataacacacttatgtgtttttgtcaacacaaaaatgtgttaatttataattataacacaaatttgtgttataatcacaaaaaaaggaggtgtaaattgtggaaattttactaaatagaataagggatttaaggcaagataaggatttaacacaagcacaattagcaaatattttaaaaatacacacaacaacatacgcaagatgggaacaaaacaatatgcaaatgaaatttccagacataataaaaatagcaaaattttataatgtatcaatagattacatagcaggattgacaaacgataaaaggaaatactggtaaggagatatatacaatggaacttttcataattataggagcaacaatagtcataggtctaataatagcaatcgcagaaaaaaagcgaaatttagaccaacataatgcaataatcaattcaaatcaaaattcagatgaaattataaagagattagatataattatcaatcaacaaaaatacttaattcagcttgaacaacaaaagctgtataatagccaaccgcaaaattataacaacagcggatttgataattggcaataaaaaagccctctcggatatattccgagggggttttattatatgttctttttctatataactgctctgctctttttttacgctgactttataggagattagtcagcgtaagaggaaacgtaattattttaattcgggagagaactcccgaacctacctcgaccgcacaactggagatgtgcggtaaggggtatttttttatttcaatttggggctttgccccaaaccctactttttgtctcgcaagataggcgagccaaaaagggagagggttgcgaccctcgatgtttcccttttcggttgccttacgcttaaaagtactcgataggcatcaaaagtaaaggggcttttgcggcataatccgctttttttatttaaaatgcacctaacggtgcgaccaaggaatgcggttattccacagtccccttgactttatcagccgtatcgagtatgagaaatgcgtaaggcaaccgaaaagggaaacatctcacccggggttcgtaaggaccgaaagggaaacatccctttcggctcggcggggcgggcgggaaagaaaaggctacagcggctaacagccgatagcatagcggacgggcggacgcaatggaaaggactggtaatgaaatgaaaataacatacaaattaaaatacgctgtgcaagaagcacagcgtaatggatacatggcggtaacgtcaaaggcacaaaacggtgaaatacgaatagtgccgataatggaaatacttagaaaacctatcgggtcagccgtcgggcaagacagccgatacaacatcaaatatagccttgaaccgataaaagcgattggatttaaggcgctgatgaaaagatttaaataagctaaacaagtagcgttccgcccatacgctattataccacaagtaaaaatgaattgtcaagcaaaagattttgaaagttaattttcaaaacataaaaaataaaaatgagaggttaaaacaatgccaagaaaaagaaatataacaacaatgtcggaaatgggcgcaggacttatgcaagcgtttaacgcaatcaacagccatttttacagcggcgaactggaaaaaccgataatcaccgttaaagagggcaaaaaaaagaacgcttacggatggatagaaacgtctaagaactggatacagggaaaaacggaacgttacgaaataaacatatcgtgcgattacatcggtgaacgaaccgtagcggaaacaatatcaacactaatgcacgaaatggcacatttgtacaacattcagaacgaaatcaaagacacgtccagagcgggcatttaccacaacacgaaatttaaagaaaccgccgaagcacacggactacagataagctacaacgagcatatcggatggagcttaacaaggcttacaccggaaacagaaaaatgggttgatgaaaatataaacatcaaaggctttagtgtgtacaagctgacaaaagaaaagataagcaagggaacggcgaagcccaagcaatcaatgcgaaagcttgtttgcccttgttgcggattgatagtcagagttacaaaaccgaacgtaaagctattgtgcgtagaatgcaacgaagaattaaaagaagaataaaaatcaaaatgcccctacggtatgaccgtaggggttcgctatttaggggaaattcgcaatgccccagactgcccaactttttaggcataaaaaagttcctccgaaaattgatagtgcgaatttcagcgataacaaatatttacaatgcagtttgtcaaattttcattttacgaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgaaaattgatagtgcgaatttcagcgataacaaatatttacaatgcagtttgtcaaattttcattttacgaaattgaccgtaatttattaacagtaaaattataacattcgcttaaaccaaatattaattttacgaaattgcgtgtaaaattctgttatactgctccgttgactattatactataaaatcctgcccaattcaagatttattgcgaaatacaaagctgatggataacgttgacgtaaatacgagcaatagcaattacggatgagttacagctataaatctgctgtgcttcaaacggtcggtcaaaggctgaagcattctcagcaagttcaatttgcatacttttgatacagttatcatacgattaaagaagctgaccgaaaaaaatacgctgtgcaagaagcacagcgcaacggatatgtggtgggtaacgtcaaaggcacaaaacggcgaaatacgaatagtgccaatcttagaaatacttagaaagcctatcggaacagcggtcggggaagacagccgttataacatcagatacagccaagaacctgtaaaagccatcggatttaaggcactgatgaaaagatacaaataaactaagaataagcgtaccacctgtatgttattataacgcaaataaaataaattgtcaagaaaaatattttgaaagttaactttcaaaaaagtaaaagaaatacggcaatcgaatcgaaagctgtatgtaaaaaaaatcccgccgttataaaacagcgggataaattctttaaaactacgattaagccttgttgattgatccgaagagttccatcttttccttaactgtagccttgatagcctcaaagccgggtgcgaggagctttctgggatcgaagcccttaccctgaagatccttgccttcttcgatgtactttcttgttgcttcctggaatgcaagctggcactctgtgttaacgttgatcttggaaacgccgagtgaaatagccttcttgatcatgtctgcagggatacctgtaccgccgtgcagtacgagaggcatattgccaaccttctccttaactgctgccagtgtttcaaatgaaagaccgggccagtttgcagggtacttgccgtgaatgttgccgatacctgcagcgagcattgtaacgccgagatcagcgatagccttgcactcgttgggatcagcgcattcgcccatacctataacgccgtcttcttcaccgccgatagagcccacctcagcctcaagagagataccaagtatatcgcaagtgtttacgagagctgttgtcttttcgatgttctcagcgataggatagtgagaaccgtcaaacattatagaagagaaacctgcgttgatgcaagccttagcaccttcgaaagtaccgtggtcaaggtggagagctacgggtactgtgatgttcagttcttcgatcatgccctttaccatgcctacaacggtcttataaccgcacatatacttgcctgcgccctcagaaacacctaagataacaggtgagttgcactcctgtgctgtaagaaggatagcctttgtccattcaaggttgtttatgttgaactggcctacggcgtacttgccctcaagagccttgttcagcatttcttttgcagaaactaacatttattttctcctttgattcttattccggcggaaaccgcctttgaatttattatactacatttaacctgtaaatgcaagtattaattgacaaaaaaagagccgcttctcagcggctcggtatgtattacttcttgaaatccttaaccagctcggcaaggcactctgaacagatgttcttgcccttgaactgctggatgtcgcttgcgttgttgcagaatgagcaagcaggcatatacttcttaagaataatctggtcgtcctcaacatagatttcaagtgaatccttgatgccgatgtcgagtgttcttctcagctctatcggaataacaattcttccgagctcgtcaacttttcttacaattcctgtagatttcatgattctttctccttgttgtttttacttgatctttccttttcgggcaggaaaaccgtcatttcttcctgcttcgattatattttaccaaatctttttacaattgtcaaatgtggattttatatagctgtaattcacttccattcatagcaggaaaagaaattgaacgttattcaaattgctaaatcgttacaaatccctttattatcgtatttgtaaatagtttcaaattttctgtccggaaaaagcaaaatgtattattctaattgaaatgataaaattattgtaaaattcagcacaatgcacatataacgatgtttttttacacattttgtagtgcaatattcgacttttcactttaaaaggagttatcatgagctatgtaatttttgtaattatatccctgtcttttgttttttcggcttgtaacggaacgatgaacgatttatctgttgcggcgctcacctcctgcaaggatgccgtgacgctgtgtatttcgttatgtggtacaatctgtctgtggagcggtattatgaatgtcgcaggtaaatccggcatcgtttcggggctttcgggattgctttcgaaaccgctgtcacttctcttccctgatataagcaggaaaggcagtgcgatgcaatatataatactaaatttcatttcaaatctgcttggactcggaaatgcctctactccgctcggtataaaggcgatgcaggagcttaaagaggagcagaaagcaaaaaagaacgctacaaggagtatgattatgcttgttgtgctgaatacggcaagcgttcagcttttcccttctaccgttattgcactccgtgcatcctatgcaagcgaatcccctgccgatatactgccgtgcgtatgggtcgtatcggtcttatcgctgacactgtccgtgctgtcggtgtttgtttttgaaaaaatcagcaataaaagaaggaagaatgtgaaatgagcggttacagcgattatatagtaccgctgataatccttgcggtgattgttgccggtataataaagaaaacggatatattcgatgcgtttgtcgagggagccgcagagggtcttaaaacaacatcggcaattctcccctcgctcatttgccttatgacctgcataggaatgttcagagcatcgggcgcaatggaactgcttgtacagcttgtaagcccgataacgtcatttttcggctttcctgacgaatgtacgccgcttatatttatccgtccgctttccgggagcggtgcgttatctgtttatgacggcataatttccgaaaacagcccggacagttttatcggcagaatagcttccactatgatggggtcaacggaaaccaccttctacactgtcgctgtatatttttcggcggcgaaggttaagaaaacacgttacgccatacctgcggcgctgataggagatatggcaggatggatactttcctccatagccgtaaggcttataatgaaataaaaaagcacggagaaaagcctccgtgcttcagtctgtatatcagtcttttacaatatcacacacatccgctcttgtgacctttataagatcgtcgggagcaaggataatctgtgtgccgagctttcctccgctgactataatcttgtcaaagtcctttatagtgctgtgataaactgtcttgtactgcttcttcatacctatgggggtacatccgcctcggatatatcccgtaactgcgttaatatccttgacgtgtaccatttctattgatttctcgcctaccgcctttgccgctttcttcatatcaagctcaagtgctatcggaattgcaaatacataataattcttggattttccttccgtaacaagcgtcttgaatgtgctttcgtaaggctgtccgagcatatccgctatatgtacgccgtcgatgaattcatcacactcgtatgtgttgacctcgtaatttattttattcttgtcaagtatacgcattacgttggttttgttctctttttcctttgccatatcaattctcctttacatctgagagaattttaacgcatttcacataaaaagtcaagcgttcagtcaagcaatgcacttatagccggaaaaggctgtacgctgcgtttcaatatgccgtgtatataggcaatgcagatgccgtaatttgttatcggaacgcctgcgtctttcgcacaggctatgcggtacttcatttcacgttcggaaagagtgcatccgccgcagtgtactatcagcttataacggcttaaatcttcggggaaagtgcctcccgatgaaaattcgaattcaagctgtttgccggtgtatttgtttatccatgcagggagctttatcgtgccgatgtcgccgcattgcctgtggtgagtgcatccctccgagataagtatcctgtcgccgtcaccaagcttgtcaagcgctgtaacgccgtgtacgttcgtttcaaggtcgcccttataacgtgccataagtatcgagaatgatgtaagcatcacatcgtccgggacttcctgcgaaactcttgaaaatacctgactgtcagtgataacgattttcggcttttccgataattttgaaagggtggcagtaagctctgtttcacgacagacagcggatattgctccagcctcaagcacatctcttatcgtctgctgctgagggagtatgagtctgcctttcggagcggctttatctataggaacaaccagtacggctatatcgcccggattcagcagatctccgcagatgcacatcttttcgtcttttacatcgagccttgagccgataagttctttcagctcgtaaatgtttgtgccgttcagtgcgtcggtgtagattgtgccatcggttttcgggggaacggtatcaagcagaccgcacttgttcattacgataatgtacggtatgttctgctttttcagcctttcgagtatggcactgtcaaagtcggatatgccctttgtgctgtcaaccacaagcagagcaatatctgtcttgaacagtatctgataactctttctcacacgcaggcttccgaggtcgccctcatcgtcaagtcccggagtatcggttatcataacgggacccagcggcaaaagttccattgcctttgaaacagggtcggtcgttgttcccgcagtatctgaaaccacagcaagctcctgccctgttatagcgtttataaggctggatttgcctgcgttgcgtctgccgaaaattccgatgtgtatgcgctctccgctcggtgttgaatttaaactcaccggttgctcctttctcagtcggtttctcagaacctgaaatctctctgaccgtgaataatgttgtcgatatactcggtcgcctttgctcttaccttttcattcgggatggtcttaagctctcttgcgataagctcctcgccgatttttcttgtatcctccgatgcgtagtcgacaaggtattccttaagcgtcataagggcattcgggtgacagcagttctgtatctgacctgccttgcacagactcatgaagcggtcgcctgttcttccctcacggtagcaggctgtacagaacgacgggatgtatccgagcctcatcagccagtttactacctcgtcaagacttctgttatccgatacatcaaactgtgccgagttttcttcttccggctcaggctctgcataaccgccgacgcttgttcttgagccaccgcttatctgcgagataccaagatgcagaactctttcccttgacttctggctttctcttgtggaaacgatcattccggtatagggaacggcaattctcagacaggcaactatttttgcaaacgtatcatccgtgatgccgttatcgaattcatcgggatctatatcatcggcacgtcttactctcggaactgagatagtgtgaggacctacgccgtgtacggcttcaagatgctctgcgtgcatcagaagtcccgcaaattcatatctgtaaagctcaagtccgaacaatgcgccgatgcctacatcgtcaattccgccctccattgctctgtccatagcctctgtgtgataagcgtaattgtgcttgggtcctgtcgggtgcaggcgctcatagctctccttgtgataggtttcctggaacagaatatatgtgccgatgcccgcctctttcagctttctgtagtcttctaccgtcgtagcggcaatgtttacgtttactctgcgtatagcaccgttcttgtgcttgatggagtaaatagtcttgatacattcgagtatgtattcaagagggttgttcacagggtcttcgcctgcctctatggcaagtcttttgtgacccatatcctgtaaagcgataacctcctgccttacctcgtcctgcgtcagctttttacggcagatatgcttgttctttgcgtggtaagggcagtaaaggcaaccgttcacgcagtagtttgaaagatacagcggagcgaacattacgattctgttaccgtaaaagtccttcttaatctgctctgcgagcttgtatatctcctcgttcttttcgggaatgtcgcagtcgagcagaacctctgcctctctgtgcgaaagcccttttctgagctttgctttttcaagaatgctgtcgataagctcggcgttatgcttgttttcttcggcatatctcagcgtttcttcgatttcctcgtggttgatgaattcctctgctttcagagatttgggatcgtaattatacatatttatttcctttcgttaaaagaggcgtggtcgccccttgattcgactattctgtagcctgcgccctcaacacgtttttgcaggcacattctgcactgtgcggattcgtcgcctgtgcagattttgttgtcatacagcagatatttttttcttacgtctgtcggtgacagatttggcattacaacgttagcgccggctttaagtgcaagctctctgcctgtcggatgaatcgttcctatcgcagtagtcgcaggaagcagtacatcgggcagtgcgagccgcacaagacccagcataaacagcgtaagctcagccgtaccctgcggcttatcggcaaaaggcgttgcgtggtgcggtataaaagggcctatccccaccatttcgggcttcagttcttccaaaaacagcatatcgtcggcaagattttcagccgtctgataaggagagcctaccataaagcctgcccctgtctgatagccgatttttttaagcgttctaagacaatcctgtctgtgctttgccgaaagaccgggcggatggagctttgaataatgctcgtaatcggcggtttcgtggcgcaacaggtatctgtccgcaccgctttcaaaatatctgcggtagctttcttcgcttttttcgcctatcgaaagcgttacagcgcaatcgggaaaatcacgctttatcgaacagacaatatcacatatcatatcatcactgtaataaggatcttctccgccctgaagtacaaacgttctgaagccaagctcatagcctgttttacagcaatcaagtatctgctccttgctgagcctgtagcgctctgcctgcttgttactgcaccgtattccgcaataataacagtcgtttttacagtagtcggtaaattctatcagacctctgatataaacgtccttgccgtaatatttttcacggacactgcccgacagctcaaagagataatcacgcactgcgtccctgttttcgataagcgatacatattcgcctttttcaaggtggtgtgtgctgtacagctttgataccagttctttaagttcttcggttttgctcaatcgtccgcctccttttcctttgaacaatctgcaggaagcttctgatagatagtcttagaggtaacgcccttcaatgcgccgagcttacccgataaggtatttatcacatcctgcggtgcgtcaatggcaacgctgatgatagaaacgcctgccttttcataaggtactcccatcctgccgataatgtaatgagcgcactcgtgcagatattcgttcagccttgttacagaggaaggatcggatacgactattcctataagcgctactctgctatcacaattcatttaatcacctttttcccgtttaaaataaaaatgagccgtgcaaggcacagctctatcttaaaatcgtaaaatcgtaaaaatagtaaaacaaaaaccgccttgcttttctgtcagaataatctttcagatcagtcaggtttataaaattgtagatattttgccgttcggtgaaagaagcaaatctcgcaccttacggtttctttatctattataacgcagaatgcggataaagtcaatatcggtacggctttatccgcatttcgcactaaaagttaaggcaataccgcataattattgtcatgcgattgcgcagtcagatttttcgtcagattgtataataaatcgagtgccggcaggctggcgcctgtcaagcgaaatttgtgcaagatggcggaaaatatgcaagcttagcgtgcggcaaaggcgatagccgttaattgtgcggtgttgccttaaatgctatttatgcactctgccaaatatcagtcgtgtctggggcttgcactgatgtgctgaatagcctgaataacggcaacgtcaagatcgaccgatggctgactttcaagctcctgctttatgcgtgtgaaaacctgtccgtttactgtgctgacatatttcggaggaaggcggttgagggaaaacgctttcatatcctcaaggcagacctcgcatttacagcagttgtaatctttgagcagttccgaaagtctttcgtcaacgtagtgttccatcatatttataagcataatacgtttcctttcgcattgataaagagatttgaatccttttttacattttatcacattttccccgtgcagtcaatagaattatgataatttgcacatatttaaatatactccgtaaattttttacgttgacggctgtgttatattgacaaaccgccttgtcgagtgtataatataaaagaatgtaaactaaaatatgacaataggctgataacgtgctttacgtttggcttgatatacagacccggcggtatgccgtattttaagcaatacagcccgtttactcaaaaacgaaaggaaaaagcattttacatgggattacttacaaaaatattcggtaactattccgaaaaagaaatcaagagaataattccgataaaggataaggttcttgagcttgaatcgaaatattctccgatgaccgacagcgagcttaaggcgcagacacctgcactgaaggaaagacttgaaaacggtgaaacactcgatgatattctccccgacgcattcgccgtatgccgtgaggctatgtggagagttctcggcataaagccttatcccgtacagatactcggcggtattattcttttccagggacgtattgcagagatgagaacaggtgaaggtaagaccttcgttgccgcacttccctcttatcttgttgcactcagcggcaagggcgtacacgttgtaacggtaaacgactaccttgcaaagcgtgacggtgaaatgataggccgtgtacacagattcttaggccttaccgtaggacttatacttcacgatatgaaaaacgacgacagaagaaagtcgtataactgcgatgtaacatacggtacaaacaacgaattcggctttgactatctgcgtgacaatatgtgtattcacaagcaggataaggtacagcgtgaattcaacttcgctattgtcgatgaggtcgactcgatacttattgatgaagcgagaactcctcttatcatttcgggacccggagataagtcaaccgacctttatcagaaggcaaacagacttgcgttacagttaaagccctttactgtaatcgatcttgacagcaaggaagatcaggatcagtttgacggcgactacatcatagacgaaaaggcaaagaacgctacacttacccagcgtggcgttaaaaaagcggaagcatatttcggcgtagaaaaccttatggatgccgaaaatatgacgcttttacaccatgtcaaccaggctatcaaggcggtaggtgtaatgaagcgtgacgttgactatgttgtaaaggacggcgaaatagtaatcgttgatgaatttaccggacgtcttatgttcggacgtagattcaacgagggattgcaccaggctattgaggcaaaggaaggcgtaaaggttaagaacgagagcaagacgctcgctactattacattccagaactttttcagactgtacgataagctgtccggtatgacaggtacggctatgacagaagaagccgaattcagacagatttatgcccttgacgttatagagatacctaccaacaagcccattgcaagaatcgaccacgaggatcaggtatataagaacgaagaaggcaagtacaaggcggtaatccgtcagattgaagaatgccacgcaaagggtcagcctgtactggtcggcactatcacgattgagaaatcagaacttctctcctctatgcttaagaagaaaggcataaagcacgaggtgctgaacgcaaagaaccacgagcgtgaagctgaaatcgttgcacaggcaggtaagaagggtgcggttactatcgcaaccaacatggcaggtcgtggtacggatattatgctcggcggtaacgcagagtatctcgcaaaagcgagaatgagaaaagaaggcatggatgaggctctcataaacgaggctacaggctttgccgaaacagataacgaagatattctcaacgcaagagaaacatatatcaagtctatccctataagaacgctttgtgggctttgcgtcctgcaaagcctttgggcgttctatctcggcatccttgccgaaaccccaaacccctttccctgggaaaggggctatattactggggctaccgcccctagaccctgtcgggggctacgcccctgcgaccccatttttatataatcaagaggtttatcgacagtctgaagcctgagaggaattttcctctcaggcttttgcgttattaaaaatatcttgcgctgtcttttctgtaagcgctcggacttttgccggtgtagttgcggaagcatctgctgaaataaagcacgtccgaaaaccccagcttatccgctattttgcctatgctcataagcgtggagcagagcagtctgcaagcctcgtccattcttaccgagttatgatactgctgcatcgtcacacccttttctttcttgaacagatgcgccatatacttataactcagatagaatcgcttttcgatattttcagagctgaaaggcacaccgatattgtccgacagataacggcataacctgtcgctcagcgtaagattgtttgaaaatccctgtgcgcttacggcaagcgaggataacagcagaaacaaccgctgattgataaaccatttcttgtacgcatcgtccgattgagcatattcgataaatgttttcagttccttttcaaagcgggcggaaacattgtgaagaaatttcggcagggtaagaatgctttcggctgtagcgtcataagcaccgagcggagaagcgtccggataaaacggcgaagcattacaatccgcacttattctgaaatgcagaaatatccactttgtacccttctgtatttttttcttgccgaagtggtgtacgccgtttttgagtatcagcagtttgccggcgtttacctcatagtccgtatcaccttcggtaacgtagatacacccgtcaattacatatatcagtacgcaaaaatccggcactctgtcggtgtgaataaagctctctgaggcggcaaacagaccgcatccgcacagctgtggcagagaattattagcaataattatctcgttcatgaacattctccatgtttttatccgttttatctattttaatagcttgctgataagattataatacatatcagagagtaagtcaagcgcaagctcggagaatggagaattgttatgataacacaggagaatataaaggttacagcctataagtcggacggtttcataggaaaataccagaagctgataagggatacggtaattccttaccagtacagcgtattatgcgatgaagcacccgacacggaaaagagccacgttgtgaagaactttgaaaatgccgcaaaggcgcttcacggggaagatgtcggtgacggcttttacggtatggtgttccaggacagcgatgcggcaaaatggatagaagcggcggcatattcgctcgcactctatcccgatgaacagctttcggctaccgtagatgaactgattgacaaaatcgccgccgcacaggacgaggacggttatcttgatacatatttcacgataaaggacagggataagcgctggcagaacctgctcgaaggtcacgagctttactgctcgggtcatatgatggaggccgcctgtgcctattatgaagcaacaggcaagaaaaagctgcttgacgttatggagaagaatgcggagcatatttataagcactttataaccgaacataacgagggtgtacccggtcaccctgagatcgagcttgctcttatgaaaatgtatcgtacaacaggcaacaagaagtggcttctgttagccgagcattttataaataagcgtggagaagaccctcacttctatgaaaaggaagcggcaaagcgtgactggtcagtgtggggaaacaatcatatggcgcacgactatcagcagagcggcaagcctgtaagagcacagagcgacgctacgggtcacgcagtaagagcggtatatctttataccggtatggcacagctttccgcaaaatgcggcgataacgccctgtatgacgcttgcaaaaggctgtgggaaagcatcacacgcagaagaatgtacgttacaggcggtataggctctaccgtcattggagaagcgttcagcgttgactatgaccttccgcccgataccgcctatgcagaaacctgtgcttctatcggccttatgttctttgcaaacgcaatgctcaaaaatgagcttataggcgaatatgccgatgtaatggaaaccgcattctataacactgttctcggtggaatgcagcttgacggaaagcgctttttctatgtaaatcctcttgaagttgtacccggaatatccggagtatcgccaactcatcgccacgacctgccggtaagaccgaagtggtatgcctgcgcctgctgtcctcccaacgtagcaaggcttataacctcattcggttgttatgcttacggagaaaacaacgatatgagtttctgccatctttatgcagacggagaggttaagttcgaaaacggtatggagcttatatgccgcacagattatccgtatgatatgaccgtaaattattcggttgtaaagggaggcaggctggctgtaagaatacccggctggagtgataccttcacccttgttcagaacggcgaaaaacttgatataaagcaaatcaacggctatgttatacttgcagtgaaggacggggacgaggtacagcttacgctttcggatactcctaactttgtatatccttccgtaaagatacctgctgtaagcggtatggcggcaataagaagaggcccgcttgtatattgctttgaagatgcggataacggcaatgtgctgtctttagcccttaaacgtggcggtaaaatcacggtatgcgagccggacacggataatcctgacggaattacaaggctgaaagtcgaggcggtaaggtttgaagacaacaataagctctacagctttgatgaacctaaaacgaccgatactcttgccgtagccgttccttattatacatggggcaacaggggagagaacgcaatgagagtgttcatgccgctttattgatagtaaaaatgtaaaaagaaacaccgtatggaagtaaaaatccatacggtgtgttttatatccgtttagacaggacagcttatcagtccatatcccagttatgccatacgttctgtacgtcatcgttgtcttcgagagtttcaagcagaagacccatcttctttatctgttcctcatcggtaagagtggtgtatgtagagggaacctgctctgcttctgcggaaactacggtataacccatatctctcagtgcatttgcaacattttcaacttccttgggatcggttgtaatctcaacacagccgtcctcaaagctgaagtcatctccgcctgcttcaagaatgtcttccatagccttatcttcgtcaatggtgccttcttcgttatcaagaacgataatgccctttaagttgaacatgaacgatacacagccgcttgtacccatattgccgccgaacttgtcaaagtagtgacggatttcgcctgctgttctgtttctgttgtcggtaaggcagtcaacgataacggcaacaccgttaggaccgtagccctcgtatacgcagttttcgtaatcgttcttttctccgccgcctacagccttctttataagtctgtcgatattatcgttggggatattgtttgactttgccttctgtataagtgtagcgagcttggcgttgttgttgggatctccgccgccttccttgatggcaacgattatctcacggctgatcttggtaaataccttagctcttgcgccgtccttttcgcctttttttctcttgatggtgctccattttgagtgtcctgacatatcactttttcctttctgttatatcaattgatctctttgaaaccttttccgagtacctctttggcacttgtgattatcataaaagccgattcatcgacttcttttacataacgtttgactttaacatagtcgttctttcttaccgcacagcatattacctgtttttcatcgccgctgtatgcgccttttccgctgaggaatgtaacgcctttgccggcggtcattatcttctgagcaatctcttcggatttgtcgctgaatataagcagcatcttgccctcgtagcttccgtatacgataatatcgatcattttggaagaaacaaagattgcaatgatggcatacagtgcagattcaatctttccgaaaacacaggttgcaaatacaataaccgcaaaatctgtggcaaatgttatagcccctatgctgatatgcggaaaacgcttatatatcagacggttcagaatatccgtgccgccgctcgtaccttcacgggagtagcaaagaccgagtcctgcgccgataagcagtccgccgaatatggcggcaagcatttcatcgccctcatagtggggaagataagcaaacacatagtctgtcgcaacagtaatggttataatcgaaagcagcgttttgaacatcagccttctgccaagaaatataaagcctataacaataagcggaacgtttacaatgaagtacagaacaccctcgctcagtcccgtgagatgagccacggcaacgcatattcccgatgcgccgcccggtgctatatcgtttggagcggtaaaagtcttaaggccgcatgaaaatataaagcccgaaataataatgactgctatatcgatcagcgtgcgttttgttgttgccttcattgtaatccttctctcgtgagttatgtacgctcgcttgtatatatcttttcaaaaagctctttgattctgtcattctgtcccgtaaggtacaaatatccgaaaagagcctccattcctgttgctctgcggtaatccttaggattggatgagcgtggaacgttatttcctgtggcgtttctgccacgcttgaatatctctgtttcttcttcggtaagcagttcggcaattatatcatatgcgtaggactgaaatcctgcatttacatattgcacagcttttttgtggagcttgtcaacaggcattgtgccgagctttactatctgctcacggacatatacctcatagacgctgtcaccgaagaaagcaagtgtaagccctccgagagctttcgcctcggcaggtgtcataatttcatacatcatctcagatacctgaattcaaagtcgtagatagaaacggtatcgtcttcctgcacgcccatttcctcaagtttatcaataattccgctgaaacgcagaactctctggaaatactgaaggctctcgtagtcctccatattcaccatcgaaagcacaggaaccataaacggcgcatcgacaatatatatgccgtcctgctttgtgatagtaaactccttcttcttaagctcctgctcgtcaagctctcttgctgtaagcggttgcgcctcgaatcttatcggaggcggcagcttgtcaagctcgcctgcaatatactcgataacctgcgcagtgcccttcgtggttgccgcactgcactcaaagcagggaagacccttgtcctcaatgtactttctgaattttgctatctgctcctcgcttgcaaggtcgcacttgttcataactactatctgaggccgctcggaaatttcttccgagaaattcttaagctcgtagtttatcttctcaaagtcatcttcgggatctctgccctcaatgcccgaaacgtctacaacgtgaactataagtctgcatctttcaacgtgtcttaagaacgaatgtccaagaccgattccctcgcttgcaccttcgataagtccgggaatatcagccattacgaatgacttttcaccgactgtaacaaccccaagcacgggtgttatagtagtaaagtggtagtttgcaatcttcggctttgcggcgcttacaacgcttatgaatgtcgatttgccgacattcgggaaaccgacaagtcccacatccgcaagcagctttaattcaagcgttacgttgaactcttcgccgggataaccgggctttgcaaatctgggtatctgacgtgtgggagtggcaaagttcatattgcccttgccgcctctgccgccctttgcaacaacaacaggctcgttgtcggaaatatctgcaagtattcttcctgtgtcgctgtcctttacaagcgtacctctcggtacacggataacggtaggctctgcacttttacctgtacagcgtcttgcaccgccgttttcgccgtttggcgcaatatattttttcttgtatctgaagtcgataagcgttgacaggttatcatcggctacaaaaactatatccgagcctttacctccgtcgccgccgtccggaccgcccgcattcacatatttttctctgtgaaacgatacggcgccgttgccgccgttgccggcttttatataaatctttacaatatcaacaaacatttttacctcacttttgccgacagggtagtcttatctgcatatattctgcaccgaatcgcacagaaaatgcaaatccgtttaatacacaaaaaaggcgggaaatatacccgccttgattgatttgagattagtcagcgtaaacgctaacctgcttgcgatctttgccgaggcgttcaaactttaccttgccgcttgtaagagcgaataatgtatcgtcagaaccacgacctacgttgttacctgcgtgaatgtgtgtgcctctctgacgaacgagaatgttgcctgcgagaacgtactgaccgtctgcacgcttaacaccgagtctcttggattcgctgtcacgaccgttctttgtagaacccataccttttttatgagcaaagtgctgtaagctgattttaatcatatctgttttcctttcatcgtgtgtaatcaacactgttcggtgcggacatctatatgcccgtattcttcttcaagaattgtaagatgcgtgtaaaaggattttatcattgtgcaggcatcgtctacataaggagccttaagcctgaactttgcgtagccttcattatccggacgaatgtccatatctgcggccacactgaaaaaatccgtaatcgtatttaccgtaagcataagcgcacttgatacgcctgcacagattatatcgtttccgctttcggcataacccgaatgaccttttacggtaaatccgataaatttttcaccctttacggcgaatacagccttaatcataagacttaagcgttgatagcttcgatcttgatcttgctgtagggctgtctgtgacccatcttgcgcttgctgctcttcttaggcttgtaagtaaatactgtaaccttcttagccttaccgttcttgatgagagaagcctttacgcttgcaccgtcaacataaggagcgccaactactgcaccgtcgtccttaccaaccatgataaccttgtcgattgtgaactcgccttcaacgtcgagcttttcaacgaagatctcatcgccttctttaacctgatactgctttccgcctgtttcaattattgcgtacattttttcaaacctttcttgcccttaggcatcttgtaaaattctcgctgcttgaggtgaaaccgctcggttgagccgttttcttaaataccctgcacatgcggcgatatcattatatcaaaaagaaaccgctttgtcaagcgttttcttccgatttttataaactgagccgaagcacagcagatttgtgcttcgatttaacttattatacgttgaatctgaacagtacaacgtcgccgtcacgcataacatagtccttgccttcaagacggacaagccccttttcctttgccgccgccatactgccgcaagccataagatcgtcaaacgaaacgatttccgctctgataaatcccttttcaaagtcggtgtgaatctttcctgccgcctgaggagctttagtgccgtttgttatagtccatgcacggacctcctgaacgcctgcggtaagataagatataagaccaagcaggctgtagccctgctttattatacggttaagaccggattccttaagaccgagttcggacaggaacatttccttatcctcagccgacatatcggcaatttcagcctcaatctgtgcgcagataggaagcacaacgctgttttcagcctttgctatctcgcaaactgctctgtactgctcgttcttttcaatatcgcctgtgaaatctgattctgagagatttgcggcatatattacaggcttgttcgacagcaggggagaagcctttaccatttcaagttcggattcggtataaggatacgatcttgcagatttaccttcttcgaggtgagcgagcagcttttcgaggaattcaacctcggaagcaaggctcttgtcgcccttcatctgcttcttttctctgtcaattctgcgctggattatttctatatccgagaagataagctcaaggttaattgtttctatatctcttgcggcacctattttgccgtcaacgtgaatgatattgtcatcttcgaagcaacgtacaacgtgaacgatagcatcaacctcacggatgttcgacaagaacttgttgccgaggccttcacccttggatgcgcccttcacaagacctgcaatgtcaacgaattcgagagttgcgggtgtgaatttttcggggttgtacatcttagcgagtgcgtcaagacgttcatcgggaacggatactattcccacatttggctcaattgtgcagaaagggtagtttgcagattctgctcctgcgtttgtaagtgcattgaataaggtacttttgcctacgttcggcagaccgaccattccaagtttcatttatgtgtcaacctttctttaagcggtaaccgctgtcataatccaatacagtataacactaattccgatttttttcaagtagtaaacgataatttattgacttgaaggtaaaagtcctgtataatataaacagtttcaaggaggtggtcttttgcccgatatatataagcacggctacgacaatttcaaaaaaattacggttttgtttattcttcagataatactcggcgtgctgccggtcgtactactggtgatctatataggcttttcactgtattcaaatgttgtactgggctatacgttcatagttataatggctatagcggcggcactgaatttctctataacaaaacgctataacgtactgctttccggttttaagggtgaaaaatcgcttatgaaaaccgtgaagaagctcggaagcgagtataccgtatttgcaaacgtacctgtgcgttacaagaaaaacagaagcgagatagatttgcttgtaatgtgcgacaggtacattattataatagaagtaaaaaaccattccggttatatttacggtaatcacaaggacgaaacgtggacgcagagaaaaatctaccgtgacggcaaaaccaccgaaaccattatgacaagtccgatacgtcagatgcgccgtcagcgtgacatcattaaatccatactccgtgcaaacgaccttgatcagtgggtcgatacggtgctttatttttccgctccgaccgttcatctttatctcgatctcagcgacagcgacaatgtctgctccagcgaaaaagagcttctcgaatttctgaggacgtacgtttccccgaaatctatggatccggaaaaacttgaaaaaataaaagtgctgttcaaagaaatgtgcgtttcgaaatgatatttgacggcaaaattccgaaatcgctatttcgggattttctctttatattttgagtaaacgtttactaagctatgttttaatttacagtaaaattattgcagtaaaatgtcgcttaactgtggaaaatagctaaaatgttgtacaatatgcacaaatcaaagcaaacatcttataaatttctcacaatttttgcgtttctacacaaaaaacagcttgtgaacgattgacaaattggtaaatttgcgatataataaagccatcgtaagacacatgattaagtgcttacgaggttttagttttttagttgtctcctttcttttgttctacacattatacattatttgatttgagagcgtgagtttgtcacgctcaatttttttgtctttttattcatattgcggaaatattagtgtgttatcgtcaaatatgagatatatagctgataacgggttcagttatatttaacgttaaatcccgccgtttcgctatccgcagcatagaagtattgttatcgcaggcggaatctgagcgccgcatcggctgataaaaatgcagtgaatcccgactaacattcaatcccgccgttttgctaaccgtagcaaagaagtaaagttatcgtaggcggaatctggagcgccgcatcggctgataaaatgcagtgaatcccgactaacattcaatcccgccgtttcgctatccgtagcgtagaagtatcgttatcgtaggcggaacagtcagcggcgacccgccgtatgaatattttgtgaaaagtgtggaatttgagtttaaaatatggtatactataaaacagtgtttaaggcaacaccgcacaattaacggctatcgcctttgccgcacgcttgcttgcgtattttccgtcatctcgcacaaatttcgcttgacaggcgtcagcctgcccgcactcaatttatacaatctgacgaaaaatctgactgcgcatcgcacgacaataattatgcggtgttgccttaaaaccgagaaaggaatgaacagatgaacaatataataaaccgcaggaaaatagccgacggcgtatacttcagcagtattaccgataaacgctataagaagaatcttatatcggtggctttctctactcagctcagcgaggataccgctacagaaaacgtaatcgtccccgttttgctgacaaagtgcaattcaaagcttccgacatataaagcgttcaacaataaaatgtcaaggctgtatgcgtcaggcataggcggaacggctggcagacagtacgatctgcagacaatttcgttcggcgcttattatcttgacgacatttacgctctttctggagaaaaaatgaccgggataatgacggatatccttatagattgccttacgtcgcccgtaacggaaaacggcgtattctcagaaaaattcgttgagcttgaaaagaaaaccgtcatagataacatcgaaacggctatcaatgataagcgttcctacgcaatagaacgtgcaatgaaaaccatctgtaagggcgagcctgcaagcgtatgctcatacggcacagtagaaaaggcaaagctgataacttccgacagtgcatataaagcatatcgccgtatgcttgaaacaatgccgtgcgaaattatctgcacaggctgcagcgactttgatggagtagcggagaagtttgccgccgcatttgaaaaaatcggcagacacgatattgagaacacaacgatagctttaagccccgtaaaaactcagacggaggaggttaccgaaagactgacggtaaatcagagcaagctcgttctcggcttcaagtcgcattccgatgacgatgccgcacttgtacttttacagaaaatcttcggcggtacaacgtcatcaaagctgttccgcaacgtcagagaaaaaatgtcgctgtgctactattgctcggctgcaaggaacgaccttaagggcattatgcttgtaaacagcggtgtcgaaaacgagaatatcgaaaagacaaaagaagccgttatcgaccagcttgaagaaatcaagaacggcaatttcacaaacgaggatataaactttgcggaaatggctataaagaacgatttcaagagcgtagccgacagtgcgggaaatgtcagcaactggtactttgattgcatcaggaagaacgatatagtaactcccgaagaaaagctcggccgttacctcggcgtatcaaaggaacgtataatcgccgccgcaaaatctatggtacttgacagcgtctatgtacttacaggcaacgaaaattgagaaaaggagctgtcataatggagaaaatcactaacgcacgaatcaaggaagaatatctcagaataaagcataagagcggcgctacgatccttttgtatcccatgaagggctattcgaccgcttatgcactgtttgctaccaagtacggctcggtggatacaacattcaagacaaacgaggaccccgattttgtaacagttcccgaaggcattgctcattaccttgaacacaagctgtttgagaatgacgagtgcgacgcatttgatctgtacgcaaagacgggtgcaaacgcaaacgcatataccagctttgataagacggcatacctgttcagctgttcacagaaattcgaggagaatctgcgtatattgctcggctttgtgcaggagccttattttaccgacgctaccgttgcaaaagaacagggaatcatcggacaggaaatcagaatgtacgaggacgataccggttggagagtatttttcaactgcttgcaggcaatgtacgaaaagaaccccgtaagaattgatattgccggcactatcgaaagcatagcaaagatagataaggatctgctttaccgttgctacaacacattctataacctcaataatatggtcatcgccgttgcaggtaattttgatgttgacaaaacgcttgagatatgcgatgagctgctgaagccgtcaaaggatcacggacttcaggttatcgttcccgatgaaccgcttacggttcacgaaaagagaaacgtgcagaagctgtcctgcgctatcccgttgttcaatatcggctggaaattccctgcatattcgggaaaggaacagcttgaaaaatatatcgtctataatatccttatggagctttgccttggcaggacttcagacttctataacaggatgtacgaagacggattgctaaacgatgcgttcaatgtcggcgtattctgcggcagaggatttttcagtgtaatcgcagacggtgaatctacagatcccgacaaggtgctttcagagatagaaaaggagcttttccgtcttagaaaagaaggccttgacgaagacgagttcatcactatccgtaacaagacttacggcgagcttgtggcaggcttcaataatgtcgaatctgttgcaaatgcgatgatttcccaggaaataaatgacgtgggaatttatgacggtatagaaattacggcaaataccacatttgccgatataaaatcggctcttgacgattttgacattgagaataattcaatttcgataatcgagcctgccgatgaaaattaagtgaggatttttaacatgagcggtttattaaacattctgaccgaatcggtgaacgaagtaccgagaattgaatttcccaatctgtttgataagtctattatcgtaaacagagtagcgttcaatctgttcggtattgacatctactggtacggagttattattgcggtaggcgtgattcttgcgtttatttacgctatgcacaagtgcaagcagttcgggcttatccccgaccacgttttcgacgtagcctttgtagccataattttcggctttatcggtgcaagagcctactactgtattttcattgataccgatataaatttctttgacctgcgtcacggaggacttgcgatatacggcggtattattgcggcagcgattgcggcggcgattacctgcgttatccataaggtaaaccttcccgcaatgttcgatgtcggcggtctcggacttcttataggtcagtgcataggcagatggggcaactttgtaaatcaggaggcttacggcgctcctactgcaggctcgctcccgtggggcatgacaggtacaactattataaacgatcccgtggttgttgcaaaacaggcagagcttgatgcggccggaaacggactgtttgcacttgttcacccgtgtttcctttacgagagcctgtggtgccttattgggtttatcgcacttcatttctactcaaagaagctgaaaacctttgacggtgagattttcctgctgtatataatatggtacggcttaggtcgcttctggatagaggcactgcgtacagacagcctgttcatcggacctttcaaggtatcccagatagtagccggcggttgtgttatagtcggacttgcattgttcatactcggcaagattttcaagacgaagaaacgtggctatgtaatgtataaggacagcgaagcgtgcaaggaaaagaacgaagcatattatgcccgtcagaagatgcttgaagaaaaggctaaggctaagaaggctatgaagcaggcaggcgaagaagcaccgagcataatagtcgataacgaagcttccgataacgaggaaacatcggctgataccgaaaagaaagaagaaaagacggagaaatccgaaagcgacgaagaaaatacccctgataaaacggaggaagaataatgaatcttattgacggaaaagcagtatctgcaagcgttaaagagcagattcgtgccgagatagagcgtgacaagctcgatataggtcttgctgtaataatagtaggcaacaatcaggcaagccgtgtttatgtgaacaacaagaaaaaagcctgcgaggcatgcggaataaagtcatacgagtacgcactgcccgaagatacaacgcaggacgagcttatggagcttatcgacacactgaacaaggacgataaggtaaacggcatactctgccagttaccccttccgaagcaccttgacgaagaaaaggtcatcgaggctatttcaccgctcaaggacgttgacgcattcaatgctgttaatgtcggaaagataatgataggaaattactcgttccttccctgtacccccgcaggcgttatggagcttattcacagcacgggcgtatcggtcgagggtaaggagtgcgttgttatcggcagatcgaatatagtaggtaagcctatggctatgcttttactccacgagaacgcaacagtaaccgtatgccattcgagaacaaagaatctcacagaggtttgccgcagagcagatatattagtcagcgcagtaggcagagcggactttgttacagccgatatggtaaaggacggcgcagtggttattgatgtcggtatgaacagaaacgcagacaataagctctgcggcgatgtgaagttcgatgaagtcgcaccgaaatgctcatacataacacctgttcccggcggagtaggccctatgacgatagcaatgctgatgaagaatacgcttatggctaagcgtatacagtcaaaagtatgaataagcaggtaaaaaatccgtttaaaaaagcagggcagggcggaaacaagcgttttcttataaatgccgcaattcttgccgcaggctgtctgcttgttatattcagaatgcagacgtggggcattgcacaggtgatagttcttatactgtttgcggcactcgccgcattccaggtggtgctttatttcaagttgaagtgaaattgcgctgtcagccctaaaaaacataaaaatttaataaactcctattgacaaacttatcataatgtgttatgattatagtacctcattaggggtttatttttttgtgcatttttttaattcacaataaaccctgccgaagaaaaagtctgaggcaaagagggaggctaaagcccagaagggcaaaaaaataggaggtgccgaaagtgagagttaaaattacccttgcgtgtactgagtgcaaacagcgcaactacaacaccaagaagaacaagaagaacgatcctgacagaattgaaatgaacaagtactgcaggttctgcaagaagcatactccacacaaggaaactaagtaaggaggtttatgatggctaaagatgcaagcttgactaaagaagcagcgaaagcgaaaaaggctaacgaaaagaacagcaagaaggccgctctttccaaaaagcccaagaaatccatcgtaaagtacttcaaggatttaaaatccgagttcaaaaaggttgtgtggccaagcaagaagacagtattcaacaacacggttgttgtactggttaccctggtagtatcgggtatctgtgtttggggccttgatactctgttcgctactctgttaagattagcgctcaacatgagttcagcaggctaagtattttcaagtaggagggactaaagaatgtctgaggcaaaatggtatattctccatacctattccggttacgaaaacaaggttgccggcaacattatgaaggtcgttgaaaacaacaacctgcaccatttaatcgaagaagttatggttcctaccgaaacagtggttgaggaacacgacggcaagacgaagacttatgaaagcaagctcttcccgagttacgtttacgttaagatgatactgaccgatgagtcgtggtacatctgccgtaacacgagaggctgcacaggtttcgtaggccccggatcaaagcccataccgctgacagacgaagaggtaaagaacctcggcgttacgacaaaggtcgcagagatttcatttgcagtaggcgatacgataaagattgtatctggttctcttgaaggtttcgaaggaacggttgattcaatcgacgaggagaacggtactgcacaggttacggtttccatgttcggaagacctacaccggcaacggtagaaatatccgctgtccagaaagtagaaatttaagttctaattgttattttggaggttgagtaaaatggctcagaaggttacaggatttataaaattacaaattcctgccggtaaagcaacgccggctcccccggttggtcctgcattaggtcagcacggtgtaaacattatggcgtttacaaaggaattcaacgagcgtacaaagaatgacgcaggtcttattatccctgttgttatcacagtttacgccgacagaagcttttcatttattacaaagactccgcctgctgccgttcttatcaagaaggcttgcggaattgaaacagcatcaggtgttcccaacaagaacaaggttgccaagatcactaaggctcaggttcagcagattgctgaaaccaagatgcgtgacttaaatgcaggttctatcgaagctgctatgtctatgatcgccggcacagctcgttcaatgggtattgaagtagttgactaattaagacggtgggaggataatttccgttataccacaaggaggataatgaatgaaacaaggtaagaaatacgttgacagcgtaaagctgatcgacagcactaaagcatacgattcaagcgaagctctcgacttagtttgccagactgcaaaggctaagttcgatgaaacagttgagcttcacgttagactcggtgttgactcacgtcacgctgatcagcaggtaagaggtgcagttgtactgcccaacggtacaggtaagactgttcgtacactggttttcgctaagggcgaaaagatccaggctgctatcgacgcaggttctgatttcgttgctgacgatgatacagttaagaagattaacgacggttggatggacttcgacgttgtaatcgcaactcccgatatgatgggtgttgtaggacgtttaggtaaggttctcggtccccgtggccttatgcctaaccccaaggcaggtacagttactcctgatgttgctaaggcaatttcagaagctaaggcaggtaagattgaataccgtcttgacaagtccaacataatccactgccccataggcaaggcatcattcggtaaggagaagctcgagcagaacttcaacacactgatggacgctatagttaaggctaagccctccgctgcaaagggtgcatatctgaagagctgcacagtttcttcaacaatgggccccggcgttaaggtaagcacagctaagtacggtgtttaattaacacgattacgactaacgatacaacacaagtaaagccgatgagaaatcatcggcttttttgtgttgtcatatttcaatcccgattttgccggctattctcattatcgcctcaatgtgcatgataataaggtgcctttgtaaaaaattgccaccgaatattccatcgggggcagtcagtttgtagaaaattctgtttttgcaaaaaagtgcttgttctaaatccctatccccaaacccctttccccgggaaaggggctgaatgtggggctgccgccctcaccccgcttggggctacgccccaaaccccaatttttaataattaagaggtttatcgacagtcttattgcccccgaatattacatcgggggcagtatgattacttgttcattatttcaagattctttttaataagctcgcatctctgctttacgcagtcaaccgagcggagcggatcggacggggtgttgaatgtataatccatcagcttgtcaatagttgtagctgcaacgtgaagtcttgtatcggaagaagcgtagtagatatatacatcgttgttttcggtaacaaccgcaccgtttgtaaagcatacgttcgatacatcgcctacacgctctgatttatgcggagcgatgaacagacctgagggtgacgcaatcaactttgacgggtcgtttaaatcggtagcgaatacataaattacatatctcagacctgccgcagtgttacggacaccgtgagcaatgtgtatccagcccttaggcgtcttgatcggaacagcgcctgcaccgttcttgacctctgtgatagtgtggtactgtctgggcgaaataacaacttcctctgtgcagatgacgggattgttgatatcctcgcacagaccgaagcatacaccgccgccggagcctgtctgaatgaaatcgtcctgaggacgtgtatagaaagcatactttccatcaacaaattcggggtgaagaactacgtttctctgctggggcgattttgactttaagttaggtaaacgctcccatgtctttaagtccttggtacgaacgatacctgcctgagctacagcggcggaaaggtcgttgctgtccttgtccttgctctctgagcagaatacaccgtaaatccagccatcctcatgctgagtaagacgcatatcatatacgtttgtttcttccttttccgtatcgggaagtaaaacagggtagtcgtggaaacggaagccctctgtaggcttgtcgctctctgcaacggcaaagaacgactttctgtcgttaccttcaactcttgctacaagataatacttgccgttcatataaagcgcacccgagttcagtacagcgttgatgccaagacgctccataaagtaagagtttgtctttgggtccatatcatacttccagaagtaaggcgcatgatcggctgtcagaacgggattcacatatctgtcatatatgccgttatagcagtcggcaacggcattctttctgttgataagacgctcgtaatcgtctatcactctcttcttgttatcttcaaataagctcatttattaagtacttttcctttcggtttagttgtgttagctagcggaaatagcctttgatatgattatacaacagccaaacggaaaatgcaatactttttcttaaatttacttaaagaaatttcgattttaagtaaattatttgttttcggctttttctgacgtttccgacaccgccgcataggtataatccgaaatattcgacttgaatatcgttatgtatatgccggctgcgcacacacagaagaacagaatgtttacgaacattgcaatttctgccgctgtatcgctgtaggtcagagtcgagcttaactgcattacagctatcagcagatttataacctctgcaagtataaacgatacagccgccgcaggtcttgcaccttttttctttgcggcacagatgttggtggctatcgccataccgatatttatgcacagtatgataaagattatcagcactgtgataaacattatcgccgattcgggcagagcgaaatcatcaggctttttagggtttgttataaagaatatagaacgcagaagatttctcaggtacagcggatacaaagccgcagtgataaccgcattagcatacagtgcgattacgcttgctgtcagaaacaacttgcccttatgcagttctttctgctgacgttcgaaaaactcctgttccagcttttctttctgctcttttgtgagtgcatcatcggaaatgattatgtcctgctttttcaatttgccctccgtagaaatgtatgtatcttattcggtaactgtttcaggctctttttcttcttcctcgcattctgctttcactgcagattcgcctttaagaaggtcacgaatctcggtgagaagctctatctgaggatcgggcttcggctcttctttaggcgcttccgctttctttctcttgaatgcgccgagtacctttatcagtatgaataccgacagtgcgatgagtaaaaagctgataacggaattgataaatgcgccgtagcctatagcgacctcaggctcgataatctccgtaccctctttaacagccgccttgagtacgattttaagatcggagaagtctatctgacctgtaatcataccgagcgcaggcataagaatgttgtttacaagcgaggtaactattgctgtgaatgccgcaccgacaatcatacctactgccatatccattacgttgcccttggatatgaagtccttgaattcgcttatgaacttgatttttccgaccttttcaacaccctgacctaccgccttgaatgcctttgcatcacgaatgtccttgtgctgtgttttcttttctgttgacatttcaatatttctcctttattattcggctttatcgccgtttgatgcgtcctcgtaaaccttgataagctcaaagtcaatctgtcctaagttaacgtttgcgttgatacactttacacgcaccttatcgcctatagtatacatagtgccggctacaccgtcataaagagcgatgccgttccttacctcgaagtagttttccgacagtgagcgtacatctattttgccctctaccgtgttcggaagctcaacgaaaagtccgctgccgataacgcccgaaatgatgccgtcaaattcttctcctatgtgctttttcatatattcagccgcatagaagtcctcacagcttctttccgccgctactgcggaaagctctgtctttgttgcctgagccgccgctttgacagagaattcgccgtatttctttttcagcttgtccgcaccttttcttgaaacatagtcggtcaggatacggtggatagaaaggtcggcgtaacgtcttatcggggaagtgaaatgtgcgtattccttcattacaagtccgaagtgaccgatgggctgttcggaatactttgccttagccatagtacgcagtacgattctgttgatgattatattcttaggatcatctgctgtttcttcaagcagcttggcgaagtttttcgcttcagccttttcgtttattccgagcggatttacgccgagtgcctcgagggtggttttcagcgattctatcttttctgcgggcggattttcatgcacacggtaaacaaagggaatttcctttttcatacctaccttagcggccgagttattcgccatcagcataaattcctctataatgccctccgaaacaccctgtattctcggcttaatgtcaatacagatgccgttttcgtcacagatgaccttgctttcgcttgactttatatcgggagcgcctctgtccttacgtttctttataagtatctgtgcaagctcgttcataacgggtatgcagtcgatgacatccttgtattttctctttatctgtgcgtttgcggtgccgtcaagtatagagtttacctcgctgtaaacgccttgtacacgggaacggatgaccgtttttgcaaacttgtatttcttcactgtacccttgtccgaaatttccataaggcaggagaatgcgagcctgtccactccgggattaagagaacatataccgttgctgagttccttcgggagcataggtattaccttgtcggcaatataaacgcttgtgcctctttcaaaagcgtcattgtcaagaggcgagccttcggtaacatagtggctgacatcggcgatatgaacgccgagcttataaccgccttctgtccgttcaatgcttatcgcatcgtcaatatccttcgtatctgcgccgtctatggtgaatatgggcaggtcacgcaggtcaagccttttagctgtctgcttttcgtcaataacggcatttacatactgctttgcctgattgagtgcttcctcagagaaatcgaccggtatattgttctggataagataagcctcggtggcggattttgcgtattcgcttgagccaagcacccttactatatcaacgatatgctcggagtgatgctcgccacgctttcttatggagaaaagcaccttgtcgccttcttttatctgctccttgactttaagaatggtgaggggaggacagccgagcgaatcgggcagaactttaagcatcattccctcttttacgataactccgccgaacagctcctccgatacgtcaagcaccgcaagcacctcggcggtcgcacttctttgttctgtcttagcggctatctcacgggcgatgaccgtatcgccgggaacagcgcccttcagctttccgccgcttacaaagcaatcctcacctgttgagagatttgtaacaaagccgaatgtgcgtgacagcgtcgcaacctttcctgtgaatacggtgcgtatatcgcttatataatacaggtcgcttttggctttgaatatagtcctctgacgtatcattgactttgctgtgtttttcagcttatcaagatattttttcggcaattcgttcttgtttgctatctgctttaatgtcattcccccgccgttttcaaacaatgtggcgataataagtgtttctaaattcaaaatgttttcctttctctgtgcggtttttcgttaccgctgttcttaacttcttcatttcctttaatctttattattataatacatttcacgctttttttcaataggtaagaagcgttttatctcaactgtcactgtatactcgaagcagtcatagacaaagatttaaaatccctgccgcctgaacaaaaggtacaaatgcaacgggataatatctgaacaatatcgaaaaggcaatcgagataagaaacgcaacaatacgttttgtgtcacttgtcgatagggcggcaaatcttcagagcttccttgttaccaaaaacaaggacggcgaagcaagttttaaataaccccttgacaaaacgcagaaacaggcatataatataaaagtaatctgtttcagggcggagtgaaattctccaccggtggtaaagtccacgagcgcaaagtatttgtgccgattcggtgaaattccgaaaccgacggtatagtccggatgaaagaatcagaaatgcttgaccgcaaatccttaatttaagcggtacgacacttttgagataaggtaaagccccgaaaatacggggcttttattttttggcgaacagctgaaagtcacctttggagcagatatagaaaggatgatttttatgcagacacaaacaacaaatccaagcggaaacaaggcacatatcgtattcgatgtgagaaagctcgttttcacggcgctccttgcggctatttcttcggtgctgatgctgttcagtatcaaggtaccgctgatgccgagctttatctcgtttgatttttcggatttcccggcggtaatggcttcgctcacaatgggacccatagcaggcgttttcgtatgccttgtaaagaatatcatcaacctgttttcgagtatgacaggcggtgtaggagaactttcaaactttattcttagctgttgccttgtcataccggcaggcattataggcagaaagataaatacttataaaggcgctgtaatcggctgtgttgtcggaagcgttgtaatggctctgctcagcatagtatccaactatttccttgtatatccgatatacgagaatattatgcctatcgaggcaatcatcaatatgtacaaggagataaacccgaatgtaaacggccttcttgaatgccttatcgtgttcaactgcccgttcacactgataaagggtcttgttgcgtcggtactgtgtatgccgctttataaggtgttaagaccggtgttcaactcatattacagaaagtgattacagatggataaatcggcgtaaagccgttaagaatgccctgtgatgcggttgcgtcacagggctttttcgtatgtcggggtacattattcctcgtttattgcgttatggataaatctgcatatcgggtacagtgagcggaagccttcaagaatgagcggttgcagtttattcgtgaaaaccgtttcattttcgtatgtaaagctcgcagtacagcttatggattttcggttgtaccagccgtcaagcaggggagaaacctcgccttttttccgcttgtagaagtcgccctcaagggtgaaaattttcttcttgtcaaatgcacggacaagcccggaaaacgtttcggggtcggaatctatcgcatttctgagcctttgcattgagcctgctgaggcgctccacatacccattccgtagccccagccctcgcaggaaagttcaaagtagaacgcaggtgcgacccaccagtccttgcgtgtttccttgaaagtaaaccagtagttatcacggtacgggtaggcgtgaggaaaacgtgcgtcctttactatccttgaaacagagcttacggtttcatagcctatctcactgtaaaaatcgcagaaaagctcatcacagagcgatttcatgggctttgcgagattttgcctgtattcgtctttatgagtttcgtaccagtttttatcattattcagccgtattccccacaggaaatctatagccgatctgtcaaaaccttcaaacataatattaatcctttcatattgtttaaagtatattttacactgtttacgggcaaaatgcaagtggtaataaacggacgtaaagggcatacaattattgtgaaatacgttgttaaacggcttagcaatgcgaaaggtgataatatgaagcgtaataataaatggctcgatcttgtgctttatatactgtcggcagaggtcatcggaatgtcatcgggactgcttgcaggcagttttaatgaattcttccaaaagtataacaaaccgccgttgatgccgccgtcgtgggtgtttccggtggtgtgggtgatactgtatgcagtaatgggggtatcggcgcatctgatacattacagtgatgcggcggtgagtgtgaaaagaaaattgctgacgatatactgggttcagctgatagtgaatttcctatggagcataatattcgtgcactttgagctattgtggcttgctgcggcggatatagtgcttctgcttgttctgatagggataatgatactcggattcggtaaagtaaatcgcattgcaggcgatataaacataccgtattttttgtgggtggcatttgcgacttatcttaacgtagcgacaatatttgtaaattgatgcataaacctgtaaaatcgcattgtcaagccaaaatttcaatatataaaaaatgcaccggctgttgcagagtcggtgtattttgcttttgatttaattaataagcagaatttgtttttcaatataaattatattgacattattcctatataatggtatactattcgtatgatgtcagatgacttcctgatatgtggtgttgtaatgattttaaattttgcatggacaatttgccttgttgaattgtattgattataggtatagtaacaaactcaataagcacttctaaggttttggcaagttaaaaatccattgtagaaaggaagaaacattatgaaaaacaaaaaactggttgcaataattataacagcggcacttacgctcacagcgtgtcagagcagtaaggcaaatataggaacgtctaccgaagtaccgggagattcgacaagtgcagaagagactacagtattaacgtcatcggttgaaacaagcaaggttagcacggaagaaaacaggggtgaaactctcagtaacgaagacaagagaagaatagagctttttaagagagcaagtacagtaaaacgagatgacagtgaaggggctatactaaaaaaaatgggcgatggatacacagtaatcggttcaggcatatctcgttatttatataaaatctatccgtgggaatattttaaggttggaaacggattgggagattttttggcatattttaatttaaaatctgaagaggttgaactcaatggaaatataagtcgttttcctaaggaaatttcagataagttaaaccaattgaattcggagagtacgcttgaaaatgttgaagaactctttggaaatccttcggaaagtgataatatgcttgcgtatgaatttacaacaggagaaaaaggcattgaatattttggagaagatacggtttggatatatttcggatacaccgacaaattaaaagtgtatattccaaacagtataatatatgttaatcgtattggaaatcatgattatatggaaaagaatgatagcgaagaataaaaccgattgtaacatatgcaagtggtgaaatttgaaacactgccgcggtgtaaagccgtggcgagtgtcttatacgaaatgagaaagtaaggttagtagtagagagagtgaatgccgacgcaacagatatgccggaaacgcttggtaatttaggtctttttacaatgtcaacaattgcaaaagatccagtattaaaagcacttataacattgattggcgtaggagtaaatttacctgaagatcctttcgatgttgccttagtagttgctgattacttgagtgatagtgttattcctctatctgacatcgtttcatcaataaaaagaataaatcgaccgaaagatcccaaaaaaattgagagtggtgactatagaattgtgatatcgtattatccagatatttatagcagcgattgcatatatggaagatattattttgcaaaagggtataagtgttctctgaaagatgaaggctatttccattattggggtgaaagtagccctttgggaagatttttagaagatactccattgatcagtataaactagtttaatgcgatagaggtgtcgaaaattgaataatttatttgaaaactggaatgatacagcaagttggacaacggacggctcactgcaatacgatgaaagaaaccatgtgctgtattttgacaagacaaaggttacggaaaagttgtccgatgtaaacgaagactatgatgttgcggcagtgcggacgtttgaaatacctgacggcagtcatggattttatttttcggtgacggtaggaaacagctcgccgctgtttgataacaacggcggacgtatagacgttgaattttatgacgcaaacggtgtaaagacggtaggagattattcaactttttacatatataatgcggagaatttcatcgaggcttatctgggcgatgacaaacctgcacctatcccggaagacgcaaaaagtatggttataaaagcgtacggggtttccgatacaaaaacgatagaattctatatgaaggattttaaactgtcgttttcggacagtgaggactgtatggaaacattcgctaatgtttatccgacgtttttcagcagaaaggttgataattctccgataagaataagctcgggctcgcagatcatgactatagtcagctttgcggcaataatcgcgggtgttgcgatcgtgacggtgctgcttgcaagagcggacagaagaaaacggaaaacgggaaagtaaggggtgagtatgaaaaaatatgcggtaattatgattgctctgcttataatgctgatcggcggttgcagtgccggcaataaatcgcttgctgacggctcgtctgaaaacagcgttatatataacagcagtgcgtccgaagacgatgttaagtatacttatgtctgcgctcagtacatatattacaacacagccgatgaattgatgaaagcgtgcgatatagtaatgtcgggcaaggttacgggaatatcattcacggtaagggatggcagaacgaatgacgaggctaccgggaatacgtctgaaagcgacaaggaaatctgtacggtttatacggtcgaaaaggaatctgcatataaaaatacagtcggtaacgaatcagacagtattgacatttatgttaacggcggttttaaggataaatacattgacgaacagctaaaggtactcggcggcagcagaacgataaccgtttataacagacctgagattgaaatcggtaaatcatatttattcttattgcgcatccgtgataacaaagaggcttttttagtaattcccgagcagggatttattgatattgaaaaagaacgtaacaacagcacggctgatgatttctcggtaaacgaaataattaacaagtatttctttacagaaaacaatacggatagctaaagcaaataaccaaatcatacagataaattgtaaaaggagaaaaatatgaaaaagttaaatttaatgattattgttactgtgttttccgtgatattattttgctcttgtgctcaaaacaatgatgttatggcatctgtaaacggaattgacataaagaaatccgattatgaagtacgtctgaaaagcaatgaagttatgtcggagctcttaatcgaagatataaataattccgatatcggaagcgaagaaaaaaatgccaagataacggagataaaagaaaagtgctcaacagataaagaaacaataataaacagtatgatagaaaccgcttttattgattctaaatatgattctattacgcatgagcaggcaaaaagtgaaatagaaaagcaaatgtcaaaccttgacgcttatgccgatgaatatcctcaggtagccgcaaacggtaaaattatggacgagtatatcaaacgaatgggaatcacaaaagaagaatatttagatttagccgcagacagctatatctcatacgttaataagcaaaaagcaaaagaagaatttgctaaagaaaaagatatcggtgacgatgttcttgacaaagagtttgaagcatatatcaagcaggaaatatccaaaacccttgctgtgtactataagtaagcagaaaaaatattatcattgcagaaagccacgctgaaccccggatttgagttactgaacaaagaaatatctgcgttttttcattttgctgtaattataagtacaaaaattattttttggaaaagcggacaaacagaggcactcggttgtaataaacgtcggtgaatataaagtaaggcacagccacggggtaaaagccgtggcgagtgtcttatacgaaatgagaaagtaacgctgttttaactttatacggaaatttccggtatgtcggcaaaaatacaacggtgttctgacaggcactttgccggttccgatttgcgtatgccgtatacagaggtgaaaattaatggcacttatagattttcttgtgaaagtattatgcgaaagtcctgacgataaaccaaagaggggttcttttccgagaagatatatacataaagatgttttcaagtcggatcatgcactgatatgtcctttcagaacaattcctgatgaaccgggactttatatgaagttcttgtattatctgagcgaggggctcgaaaaatacggggctaaagcttctgatgttgaatatcacgcacagaaaacaggcgcatatattctaatggactgtgaacctttgcccgaaaacaatacacttactctcagcggagcgtattcaacgataatgaacagcgatcgcaatgatgaaactttcaaaaaaatagccgaaagcgttgactatgcgacaatgaaaactctcggcggaaaatacgagctgaccaatgttgcaattcgtaacggattctattcgagaatatgggaagtgtatcgcaacgatcttgaatgggagaacagagatgacataaaaaggctttgcgaagagcagaagtgttgtccttttgttacagctgaatacaaagacagtgtcgaaccttgtcttgtgatgatatacagcgatcctataagattgcagacaggtacgccgcaatatttcaaagagagctttcagcaatatgttgacaataaaatgccgcacgacaaagtgaaagtaagatttgacacgttgatatggtcggaaatacatgacaataacaagttactgacatacgatcctgctagctggttctttttcaacgggtgtaagtttaaggattgattttgtgataaacggacataaaggagacactcagtagtaataaaagttggtgaataaaaagtaagacacagccgcagcggaaaagctgcggcaggtgtcttttgcaatattgttgacaggagttgtctgcgttgcgttaacagcggcaacaggtcacgattacggtaatgtatcaaaacggctgacaggttcggaaggtcagccgttttttgtgtgataaaacgtttgttgaaattccgtgctgtttgtggtatacttaatctgtattaaattctgatattcagaatgtggagaacggagaagaaaatatggcggaaactgcgatagaaacggcggttcaggcacttattgattatgctgtggcaaagtcgctcattacggaagacgatgagatatgcgtcagaaattatctgatggatatgctgaagctggaaaaatgggaaaaaccgtctgtgaaggagtacggctcggttgacgagatacttgacgagatagtggattttgctgtggaaaaggagattattccgcaatcgaatgcgtggagggatctttttgacacacgcataatgggcgtgttcacaggaatgcctcacgaggtgaacgcaaagttcaaggagaagtatgcaaagagtccgaaggaggctaccgattggtattatgcttacagcgaggataccaattatgtaagaaaaggaagaatagcaaaggatatacgctggaagtacgacagtgaatacggacagcttgatattacgataaaccgctcaaagcccgaaaaagatccgagagatattgcggcggcaagaaatgctgcgaaggtttcttatccggcttgtatgctttgtatggaaaatacgggatttgcaggtacgcttacacatcccgcaagacagaatctgcgaccgatacctatgacgatacacggtgataaatggggattccagtattcgccttacggatattacaacgagcattgcatagtctttaacagcgagcatataccgatgaagattgacgcagaggttttcggcaagctgtttgatataacggatatgttaccgcactattttgtcggctcgaatgccgatctgcccatagtcggaggctctattctttcacacgagcattttcagggcggtcattatacgtttgcaatggagaacgcaccgatagaatatgagtttgctatgagcggctttgacagcgtaaaggcaggtattgtaaagtggccgatgtcagttataaggctcagtggcaaggacagggcagagcttgaaaaggcttgcgacaagatacttgttgcgtggagggcatacagcgatgaaagcgtaggtatatacgcatttaccgacggcgttccgcataatactatcactcctatcgctaggcggcacggcgatgaatatgaatgcgaccttgtacttagaaacaatataacgagcgaggaacggccgcttggcatattccacccgaatccttcgctccatcacataaagaaagaaaatatcggtcttatcgaggttatgggtcttgcggtacttcctgcaaggctggcaaacgagataaaagcactcggtgatgcgcttgtaaacaagactgatctttcgggcgatgaaaagctgtcgggtcacgcacagtggatgaacgagctgtacgcaaagtaccctgctgtgaatgccgatgatgcggaaaatatcattaagcgtgagattggcgcagtatttgagcaggtgttgcttgatgcaggcgtttataaacgcaatgatgagggtaaagccgcatttttaaggtttattgacagtgtgaagtaaagattgaattgctgtccggtgtaaaaaccgggcagttcaggctgtcgaaaaacctatataatttctaaaaatggggtcgcaggggctaccgcccccgacagggtctaggggcggtagccccagtaaaatccccctttcccggggaaagggggcagggggataggggtagtgagttagaggcatacgagatttcgcggagtgactggagttcagacgtgtgctcttccgatctacggaggtaattatggatataatgcctgattttgaccttatcgacagggaatatgcgtatgacggggagcttggcgcactttattctgaggctcagactacgttcagagtatggagcccgacggcacagagagccgtgctgaagctgtatttcagcgcaaaggcaaatctgccgcattccgttactgaaatgagcagggacaaaggcgtttgggaggttaccgtacccggcgacctgcacggaatgtactatacctatgaattcacctttgacggctcgacccgtgaaacgatagatatttacgcacgctcagcaggtgcaaacggcatcaggggaatggtggtcaatctcttgcgtacagatcctgccggctgggacagcgaccgtcctgttacacttgaaagctacacggacgcagtgatatatgagcttcacgtccgtgatttctcctccgataaaagtgcaaatttccgccttcgaggaaagttcggcgcattctgcgagaacagggtgacgaacggcttcagtgacactgtcggacttgactacattgcttcacttggtgttacgcatattcatctgcttccggtgtttgacttccagacgatagacgagaacgaccccgaggcaggcttcaactggggatacgatccgctcaactacaacattcccgagggaagctacactaccgatccaaacaacggcacagacagggtaagacagttcaaggagcttatccacgcagtacatcaaaagggaatgggtgtgataatggacgtggtttacaaccacacctacagcacggaagattcaccgtttgcaaagaccttccccggatactactaccgtcataacaaggacggaagtctttcgaacggttctgcgtgcggaaacgaatttgcgagcgaacgtgctatggcgagccgctttatcgtggacagcctttgctatctggcaaaggaatacaagctggatggatttcgtttcgaccttatgggtctgcttgatattcaaactctgaatacagcggccgagaagctgcgcaggataaatccttccataatactttacggcgagggttggacaggtgggaaaagcccgctgcccgagagacttcgtgcaatgaaaaagaacgcagtaaagctgccgcagtacgctatgttttcggatgatttccgtgacggtgttaaaggctctgtatttgaggacgaggagtgcggttatgtaaacgggaacgcatcggagctgtcggagatgatgaagtcggtaatatccggcggaatctaccgtatggatgtacagagaaaacgttctgaatgctggacggatactcctcagcaggttgtgaactatgttgaggcacacgataatcttactctctttgacaagctgagaatttctatgccggaggcttcggggcatgagcgtgtatcggtagataagctggcggctgctcttgtgtttctttcggagggaattcctttcatgcaggcagggcaggagatactgcgcagtaaaccgtcgcctgacggaggatttgttcacgacagctacaattctcccgacagcgtgaacagcattaagtggaacgatgttaccattcaccgtagtgttatggaatactaccgtgggcttatcgcaatacggaagcgctttccggaattcagactgcgtactgcgcacgatattcgcagtcgtctggaatatgaagatctcagcggcggtgcattggcggtgcattacggcgataggttgatactggtgataaatccgggagaaacggtgctgaaatacgatccgggtcgctctgcggaaatttacgcagacagcagaaaggcggacgctcagccgctttatcggactaaaggcgcatttgccgtgaagccgcatagtattatgctggcaggactgaattaaggcgacttcgcacaaagacatttattgatttttaaacattaagaaaaaaacagaatataaaacgcacaaaaccccgtcacagaaacgctctgtgacggggtttattatatgcctgaatagccgaaacgccttatttcaagcggttttcgggcataaaaaatccaccgtaattctatcaaaattacggtggacttatgtctatgggctacgaaaaagatattttcggcagttttgcgtatgacttcgaactctcgcaaaaacttatattcggttaatcatatatgcgacttttattttattattcgggaataagaacatccccgccggagattaccacgtcagatgcggaaatggcactgtcaatggtattcgattcgtcaatttcgccttcgtatgttatctgaacattttctcccactcggatagctccgctttctgcataacgggagatgcgcagatcattcagaaggattttgtacgtgattccgtcatcgggattggcgcagagaatggaatcgtctaacagaatatactcatcggttatctccgtaatcttaccgacaatggtattctgatacggctcatactctgcttcggtggaattctcttttgcatatttgataatcttactggctgcatcttctccgatattgaagaggtattggtaattaaaagcgtttgtccacagatagccatctacagtaacatacatggcacctttatatacgccgagagtttcagatgtgatcgtaaaactgtaatactctctatcatgtgcaacccatttctcatcctcaacaaatggtgcattttcgcatccggcaagaacttcccacacgtaatcatcgttattcaatacaaagtggttcttgttcgggccatcaccattctcagaaaaagtgttcaattcaatcactttcgaaagatccatcaaatcgaacaattcacccaaagtgctcggaggcgcatacttgtcatttttgaagacataatacttgccctccattttcacggcaacaaactgactctgtgcggcatccttcagcttatatacctcaaattcttcggtgtacttcttaccgctattgatctcgtcatatcctaccacggtgtggttaccaatgatttcgccaacgtgcgaagccgatacctcgcgtcctctgccaaggtattcaatgccatcatatttcagttccgtgtatttttcatatactgtctgatatttccacggccaaataattacagattcacccgtctggatgaagtctttatatttatctgttgtacctccatcaccgccaaataacgacggaaggatcgccgtacctgcgatgacgagtaacgcaaagcaagccgctatggaaccccatttgagccaagggctacgcttggctttcgttttactttctgctgcggcagtgatgagatcatcatctatatgcccgacagcatttgccgttctcggtattttcatatttcaacgccctccttaatgagatagtcccttagtttgtttcgggtgtagaacaacatatttttgaccttacttttggtaaacccaaagcgctctgcaatttctccgatagaatcgaagtagaaatatttccggataaagacatttcgcacgtcctccttttgtgtgtgcaggaagtggctgaccagtttgcctacgtcctcgtcactcacgtcgggggcataccgatcatccggcagtaccgattccagttcatccagggacaacattacatccgctgaccgtttttcacgcttcataaactccaaccgcttcagagacaggtttctcgcaatcttacagacaaaggacataaaattactcggtcttgtaggcggaattgcattccacactcccacgtatgtatcgttgacacattcttccgaatcctcgtgattgttcagaatgttataggcaatactgtggcagagcttgccgtactttgcatccgtttccttgattgcctgctcatcccgttcaaagtagagttctatgattctcagatcatccatgttgttcacctcccttgtcagacctaaaagcgctttcacccattaagtacgttttttccggcgttggtcttataattaataaaaagtcgtgaatctttttatcaaataaaaatgattgtttttctaactatatcatatttccacatttctttcaattcctacagaaaatgtcgtaaaattatttcaatgcattcaatataggagttgaaaatatgagaacatacacccaagaagaaaagcaagcggtcattgaccgtgttataatgtatcgcaaagtgaaaggagatattatgactacctcaaaaattccaacagcaacaacaataccactggaaccgattgaaaacgaacatttttttgcggtggttatcccggaacaaaactcacgatggcaaagcaatgtgctgtggatatttagagttggatgcggtgtagctttgatggcatcttctcatagaagtaatgatccaactcccgtacttactgttgatggtatcagaacaagagacattatgggcgagtttgaccacatcaaagaagaactgctgggcatgagataattccatgctttattccgatgaaaaattaaattatcagaactcagcggtttaacgaatacccccagcagttcaacgattactcggctgtttaacgattacagcagcgcagaaagccacaattcctataaaacgcacaaaaccccgtcacagaaacgttatgtgacggggtttattatatgcctaaatagctgaaacgccttatttcaagcggttttcgggcatagaaaaatccaccgtaattctatcaaaattacggtggaatttatggcggagaggaagggattcgaacccttgtggggttgcccccaaacggttttcaagaccgcctcgttatgaccacttcgatacctctccgtatcgtgctatgatattatagcacggatttttagttttgtcaacacttttttcggatttttttaaaattcctgcgtttttgtccgtaatacagttttcgggctgaacggcactgagtcagagtttgatattaccgccgaacattttaacaaaatcgggtgcttttgctttgaagcattttccgtcaagataggaaagacagccggcatcggtagtgaatttaaactgcagctcataactgcacagcgtctgatatttgaagccgtactttttgttcagcttgttgttcccgtattttccgtcaccgagcagagcgtgaccgatatacgcaaggtgcgctcttatctgatgcgtcctgcctgtgagcagatcgacctttaacagcgagttttcgccgttgtacgctatgaccttgtactttgtctttatcgtgagattgctttttgtctttttgtcgctgatttttaccgtgttggtgtcgctgttcttttcaagatatgcggtaagcgttgcgctgtcgggagttaccttaccacaggcaatgcacagatacagctttgtaagctctctgtcccttatcttctgattgagtattctgagcgattcggcatttttcgccgcaattactataccgcaggtgttgcggtctatgcggttgcacagcgccggagcaaacgaaagctcgttttccggatgatattcgcccttgcgataaagatagctcttgatgcggtttataagtgtgtcgctgtcgccgctttcgtcctcgtggactaccattccgacgggcttatccacaagcagaatgttttcgtcctcgtagacaatgtctatcttatcgcttaccgcagtgaaatcatccggatccgactttgctttcggtatcagcatttcatcggggataaacagctttattatgtcgttttccgcaatatgcgtgtcgggcttgcatttcttgccgtttagctttatgcagttcttacgggcaagcttacaaatttgcccctgacccagcggaaacgatttagacaaaaagcggtcaatacgctgaccgctgtcattttttgttacctttatttctttcatcggtggctcacttctgtattcttgaaaagccgtactgcgagaaatgctctatcgccttgttgaagtaatcacccgagctttgacaagccgttgcaacatcggtgagtttcgcttttgctatctcccacttttcctgcattacctcgttatcatcggcttcaagccagagctggttttcccagataccgtatttaagattgattatatatgcctttttcatacttctcctttttattcctgccgaatttttcgtttcagaaaagcagttgaatacgggaggggcgagcccactcacctataattttgacggttcgccgtgattacagctttccgccctttgttccgccgagcttgccgcctgtaaatccgtcaagaatgttggtgtcaaagctgaatgtcagcgccttgttttcacgttcacgctttaatgcgagtgaaatcatctcgtctaaaagctcggaatacttcacaccgacaggctcccacagatagaacgcaaggctgcccggtatcgtgttgatttcattcagataaacgttgccgttgtccatatctatcataaagtcaattcttgacgtacccgatgcaccaagactcctgaacgcctttaccgcaagggtgcgtatctgctctcttgttttatcggatatatcggcaggtatctttctcttgagcgttgccataccgcttgacttgccgcccttatcgcctgcgatatacttatcctcatagcttaatatctcatcggtgtttacaggctcttcgcattccgatgcgtgagcggtagcatagtcgccgcataccgagcagttgatttccttgaggtttgttatagcaggctcgacaagcagctttgaagcataggtgaatgcgttgtcaagcgcttcgtcaagctgttcgtcattgtgcgctatcataattcctacgcttgagccgagatttatcggctttactataagcggatatgctatcttagccttaatatccgcctttacagcgtctgcgtcctttgcgtagtcgcttatatggattaccgttccgtcaaggacgggtatgccgttatccttgaatacggttttcataacatacttatccatacctacagcagatgatattacatcacagccgacataaggaacgccgattgtctgtaaatatccctggaatacgccgtcctcaacgttcgtgccgtgtactatagggaacgcaacgtctatcgttgcatatacgttgttgccgaacttctttccgggataaagcacaagctgtacctttccgccgtcgtttacaagtatcaccctccggctttccttgagaagcgacttcagatttctgtacgatgcgatgtttcctatcttttctccgacatacatttcattgttctttgtaatgtatacgggtgtcacctcgtacttatccttgtttatggaattgcaagcctgaagtgcggatatgatggatacctcatgctcaacgctttttcctccgaaaaatacacctactctgattttcatgttcttatcctttctttatgtcaattaagtattatctgtgcttgtttgcgagctttccgtcctgtagctgagatctctcaggtcaatattcactcggacataatcgccgtatgaaagtacaacgctctttgctttttcgggaactatgtagcagacatagccgtccgagccgatccctgcggagagagtcactgaagtgctgaagctctttccttcgttaaagccccacgctctgtcgcagcctatatcgccgtcatagatgcaattaaggtcattggaaagccactgcttttcatcggttgtgttcttgactttcaggtggaacgcaacatacatatagcccttatccgctccgccgtacataatatccgttctgaaaacctcatcgcagataaagctgtattcggcagtctgagcggtttcgttgaagtttacacgctgtacctcctgagttgctgaggattcttcagcgacgctttcttctatgtaaccgtagtcggcgttgtcaaaattgtcagcgatcattgagaaaattccgccgaatatagaaataatgatacctattaccgtaggcgcaaagatcattattataattacagtcgtaatcgtctttgctatcttctgtgcggaggcattctgagagctgcttacattgctctgtgaaggctgttgtgaggcattatactcattctgacgcatctcttgtctgcgtctgtattcttcttctttccttttcttttcctcacggtattcctttacacttgcattgttgtcaaacggtgcgccgcaatgtgtacagcagttttcgtgttctacatcaagctttgctccgcagtaatcgcaaaatacgtccataatatctcccttgttttaaacttttgctttaaacacaatatcaataattatccggcagatcgttttcaagaagaactatcttcttttctccgcctgtctttatattttcaacctttgcaagagcctcgttcagattctttgcaacgtatgtcttttcttcggggtatccctttgctttaagtccgtcaactatcggcactgcctgacgttcacctactgcgataacaaagtcgcaaatttcagccgcctgttctccgaaacgcttgttaagctcgtattccttttcgccaagctccaccattcccggcgaaacaagtatcttaaagccgtcgaatacggcgagcgtatcaagagccgcctttgcgcctgtaggatttgaattgaaagcgtcgtctattatcgtcttgtttgtacccttgattatctgcaatctgtgcggaacgcattcaagacgcttgacaggcataacaaggtctgcaaacggaacgccgagcgtatttgcaacggctatcgcaccgactatattctgtacgttgtggctgccgatgagctttgtcgcaaactgcttttcttcattaccgttgtgaaccgtgaactgtgtgccgttctcactgacggaaatattgtccgcataataatccgtgccgccgccgagcgaataggtcaccttgttcttgttgcactcgtgctttgctatatattcgttatcgtaattgaggaatataatgccgtccttgtcgggaaggctgtcggcaagctcaaattttgtctttattatattgtcgattgacttgaatgtttcgagatgctgagggcctattgacgtgataattccgtgcttcggctttactatatcgcagatttccttgatttcaccgacattcttagcgcccatttcgcacaggaatatttcgtgcgttgcgttaagctgtccacgcaccacctttacaacacccatagtcgtgttgtagctttcgggggtcataagcacgttgtactttgcgccgagcagcttttcaagatagaactttgtacttgtttttccgtagcttcctgtaagtcctactacggtaaggtcgggaagaccgtttattatacgctttgcgtcattgatataatgcctgtttatcattgcttcaacaggcttattgataaggtttgcaatcattgccataacaagcgttaaaatctgtacgcacattgttattgcaagcgaagcgtaacccattccgagcgtcaggaatacaagcaggatcaaaagtacataaaggataacagatgtcacagtcattctcattactctgggagtgaacaccagctttttctttgcctttttcggcgcagagaacacaatgttaaggaacagaaaagccgccgctataaagcaggtggacgcatttgtttcgccgcatataataaatgtaagtatcgcacctatcgtaaacacatggcgcattatgacatcttttatattctttcctatccacttgaactgctcatcggcgtgatatgagttcagctggaacatatgcatatagtgtataaaattaagtccgcacgatgcaccgagtgccataccaagtacggcaacggcgattaaacgtaaaatatccaaaataaattctccgttctgttttatttaatgtcaaggaatgatgccaatactcttgagaatgtgtaccaaccctcaagaaaagcatagtgtcccgcaccttcgatagtaacaagtccgctgtcttttataagctcactcattttaaccccgtcagacaggggagtagcgtcgtccttatcgccccatataagcagggtagactgctttatttcgggcaggagataagtcagatcctcgtttactacctttacaagcgttgccctcattacaggcgatgccgcaagataatctgcactgcctcgcttgttcctcatattttcaacggcattgggaaatagctttttcataggtgcggtgctcattaccgccttgcccattttatatgtccgtgtcctgatttttgaggatacgctctgtttcggctttattcccgcactgtccgtaagaattatcttttcgggtgtcagcatgggcttttcacgggtaacagcctttattataactctgccgccgaagctgtgtccgagtacaacggtaggtacgattccgagctttttgcagaatgtgccgatgaagtcaacataatcgtcaacgcaccacggctttttcggctcgtcgctttcaccgaagccagccatatcgggcgcaaccactctcatatgaggcgacagcatatcgacaatatttttgaacagcgtaatattactgccccagccgtgaagtaggagaattacccctctgccgttatcttcgccctcatcaatatagtttattcttaaatcgtttatatcaataaacaaggtcgttcttacctttcggtttgattaaaattaaacatcggacggaattttcacacactccgccattgtttattatattatttttacgctgtgatgtcaagaaaaataactgtaaagtgtttctgtgcgtctgacgggatttgtaatcgcaatgcgataaaaaatccgccgtctgccatcaggcaaacagcggaagaaatatattatcgttaaattcggtaaaaacggcattttaccggctatattgccgtcattcgtctacattcttgagagcgtcggcaagaggcactttctttatctttcttgtaagggcaagtgcgataacggcgaatgagccgatgccgataagagcggtttttgcatataccgaaacaaaagatctgtagggaagccagcccggataatcacgcatgaatattacgaacagctgaccgagcagatagtctgacagcggtatggtgataagcagtgcgacaaccgttacaatagcggtggttgcaatatatatgccgtttatctcactgttcctgtatccgagtatctttgccatagaaatggactgtgcgttcttttcgattattatcttggacagcagatagattatcagcacatacattataacaccgaaaacgacaaagatattcatcatattgcccatcgaccttgtaagctgacgtgatacctttgtaagatcgtcaaccgttatctcggtcgcaatataaaggtcgtctatatcgctaatttccgactttgagaaatagcccgtgaaatagtctttatcgcagtcgaacttttcattgaatgcgtccttgtccataaataccgtaagcgttgacgggtagtagtaaattccgcccaccctgaacttgtattcctttgagccgaactgttcccttagcgttatttcgtcgcctggtttgataccgtgtttttctgagtaggcatttgaaatgtaaacctcgttgtcaccgagcggcaagtcaacgtatctgctgtttttagcaatgccgtaaacggttatttcctcgcttttgagcgcaccctcgatagttttgagagttgttgcggaaaacttttcagcgtccttgttttccgtttcaacctgagccttcagaagatactggtgatctgcaagcagattggaggttatctcctgctgatagttgtcaagcacaggacctaaaacaagtccgaacatcacaaggacgttaccaagcaacgcaccgatgatcatcataatgtagttaggcatattctggaacagcacacgcagtctgaaacgcttcataatgccgattttggtgttaagcctgaacgcctttttcttctttttccgtgaaaggtcgtgacggataaactgaagcggcgacaggctcagctttcttgtcagcatcaacaggtcgataatgaatacgattattatcgggattatagttgtgcttataaatgcctgcggattccacagcgtaacgtaggtcggcaggctgtagcttccgtaatatgcgcttgccgcatagtcctttaaaaccgtgtagccgagtatgtttccgacaaccgcacctgcaaatacaaccagcataggaagggtaaggtagtgccttactatctcccactttgtatagccggtagcacggagcgtacctataacgcctgcttcctttgcgatggtgtttgacgtggttatcgcaaagatgaatgcgatgatcaccacgatcatataaaggaacatctgtacaaagactgtatcgcccttaatatcatcgcccgtgaagattatcgcctgatttgtatattcgggaatgtagccggtgaccgcattcatatatttcggagcttctgaggacagcttgtcaagaaagtcttccgacagcttctttgcctcagtattatcggcgggacgctcggcatatttccacgaatagacataatgcagcttatcctccggatatgtaccgaatgtatcggctgtcactatcgcaacaccgaattttatcgaatcgaacatcatatccgacggacttgaaaacagtgcgctgtagtccgacagtgcgacaagtccgcatatcctgtattctttgccgtgaagcgtcagcttgtcaccgacttttaggctgttgttgtcagcatacattctgtcgatggcaatttcgctgtcgcttgacggaaattcgccgtccataaggcattcaaggtttatatcggtacgctttttgaatatacgcagtgtgctgtcaacttcctttgtcggaaattcaacatagaagttttcgtatatcttagcgtcataactgtcgctgccctcaacagcctttataagctcatcatcggcctttgcataaagctcgaaattaccgtcctctatattgtacttttcaaagctctcatcataagccgttgccatacttccgcccgcaacactccagcccgatacaaaagataccgaaagcgccatgaataaaaagattacaatatatttgccaagttcgtttttgaattcgctcggcagacgtttaacaagaggatttctcatcgttatcccccttaccagtcaagatcttctgcggcaatcttgttttcattgatataattctttcttatcatgccgtcacgcagctttattaccctgtccgccatatttttgatagcgtcattgtgggttaccattacgaccgtattgccgaacttcttgtttacatcgcttatcagcttgagtatatcctttgaggtcttgtagtcaagcgcaccggtaggctcgtcgcaaagcagaatatcgggatttttgattatcgctctgcctattgccgttctctgctgctgaccacccgaaagctgattgggcaatttgtgccgatgctcgtaaagaccgagcgttttcagtatttcatccgtgtcaagcggattgtcgctcagatatgcgcctatttcaacattctccttgatgttgaggttgggtataagattgtattgctggaagatatatccgaggtgcttcctgcggtacagcgtcagccttttctcgttcatatctgcggttttttcgccgtttatggcaatatatccgctgtcggcactgtcgatacctcctatgatattcagaagggtggacttgcccgagccggacggaccgagcagtacgcatatttctcctttttcgatttcggcatcaattccgttcagcacttcaacacggctgtcgccctcaccgaagtgctttcttatctctttgacagtaagaaacattttacatttttcctttcatattgctccgttcacacagattgtacagcactgcttaattagcgataactaaccatattatatattactaacttaattagctacaactaactcaagtgctccacaaccgtctttttcacgaatatctccaaaaactattttatcacaataaaaccgtgtagtcaacaagtcagatgcttaaatattaacgattttcagttttcatttacttgcgtttttggatatatagtagaaaaacagttgtgtaaacgttttaatcttttatgcgggaatttgataaacggacatttttatttctcgctgtttaagtctgctataaatatacactctgcagcggctgtaaagtcgggaggtgtttttaatttgaaaaccgcttgcttttgtgctatactttatatcaccttgtttttggtttataaagaaaggaaaagatatgacctacgttatgagcgacctgcacggtatgtatgatagattcatcgcaatgctggaaaagattgatttctcagacagcgatgaactgtttattataggcgatataatcgaccgtggggaacgccctgtcgatatactggaatatgttatggacaagccgaacatcactgtgcttctcggaaatcacgaggtgatggcaagggatttcctgcgtaggttgaccgctgaaattaccgatggaaatacagcttcttttgataatgattttatggttgaacttgctatatataaacataacggcggtattccgactataaaccggctccttgcattgccgccggacaagcaacagagtgtacttgatttcatcgatagcctttatgcttatgaagcgatagatgtaggagatagtacatttgttcttgtacacgcaggacttggaaatttccgaaaagacaagaagatatccgagtactctctttacgaactgcttgaactgcgtcccgactatgaacggcaatattttgacgatgacagcatttacatcgtttcgggacatactcctacaaagttgataagcggcaagtgggaaatatatcactctcacaataatatagtaatcgactgcggagctgcttttggcggaagacttgcgtgtctcagacttgaagatatggctgaattctatgtgtgatagtattatcggcatcgaaacagccgcttgataccaaaacggataagtgatataatgatattatcaaacagcccttacggacggaaaagaggaaaagatgaaaatagcggtaacttatgaaaacggacagatttttcagcatttcggccatacggaaatgttcaaggtgtacgaggtcgaggataacagcgtcaaaagcgaaagcattatccccacgctcggcagcggacacggagcgcttgcaggcttccttaagctgaacaatgtcgatacgcttatctgcggaggaataggcgagggagcaaagaatgcgcttgccgatgcaggaatcaagctgtacggcggtgttacaggcgatgcagacagtgcggtaaaggctctgctttcgggaacgcttgagtttaacccggcggtgcattgctcacaccatgacggcggtcataatcacggcgagggtcacacctgcggtgaacacggctgcaagcattgagtaaaaccataatcgtataagtaaaaccgctgtccgtttataagcgaacagcggttttctgcatcttttttctgtatcttacggtatcattactgatacattatatcgtccttgttgaatttctgcgtatatccgaaatagtagccgagatgcgttgctgccggtatacctgcatagcacagcatatagatgaacggcacgaatatatccatagaatcaattgtgttttcgggaactatcatcagcgacaggggatagacaagaccgtctattatcctgtgtacgaatgtcatatcgaaataccatccgcacagcttgtcaagaagcaggagcagtgacggtacgaacattatcgccataaggattatgccgataagcacccatttgctttccttgggcggctctgccttgtgaagtctgacatatttctgctctctgtcgccgtcacggtatcctgccgtgaacatcagcgaatagaatataataagcgtaagtatgaatactatcaccttgaaaaactcaaaattcataaacggcgctgtcgaaacagtaacgatagtgcagagaagatttccgaacaccataaataaaagtcccgataaaagcagtttgaaaaacggttgtctgcctgatttactgtaatagtccataattattctccttgcatggtcgaactgccgacctctgtatcatttaccttattgcctgtcagaatgttcttcagcacttcttttgcacgtttttgatattcttccgattttgagtagcttaccataccgggttcttcacgccttactgagaacgcaagcgtatcagggcaggaattttcccactttgcgtcatacacaaatcccgtatccttaagatccaccctgagcttgccgttatattcgggcatttcgagagccttgcctatatcgctgaacatattttcatacgtcagcgctatcgtattctcgtcggggtcgtagtcctccgttgacgtttcgccggtaagcagatcggcgtcgcatatatacagctcagcaacgccacgctctatttcaccgtagaatttggctgtgtttgactggacatactgcatattgccggactttgtgagatctatgctgtaaaccgcaacgtgaacatatccgttgccgtcaaagtcgggacagtatttttcaagcgcaagctcaatatcgttgaccttctgataaagacccggagcttttgacgtatccgataccgcaagtataacggtcagatcgggctgttcacgggtgaccgcctgatatacaaggaaaaatcctacagccgcaaaaaatgcgcctaccgcaacaaaccatttattgcggaagaaaaagttgtcgattttcttggcaacagtctgcttttcgggctgttcgtgaacatcctgctctataactttgctctcgctgataattccttgcttcagcttgagaagctctcttttttcatcactttcttttgacatcggaaacccttcctgaatttcgttttctgaagttcatcataattttagttctgcttgtaatatacgccgtcatacagattctttacaaactgcatggcattgcgttcactttcatcgtccgtacagcgtaccgcaacatagatttccgttgagtagatctgcattcttttgccgtatgccgtgtttttgagatttataagataaccgctctcgccggttatttcggacagatcgctgaatatctgctgtccgtaggcgttattgaagctgttataagtgtccttaagctcgctctccttgccgataaatacctgacatttaccgttttttatctggtcgaaaagatccacgtcaccgagatattgatccggtacacactgatctatggttacattatgctcgccgtttttatcaaagtccggcgtataagccgacattccttcttcaaatcccgtgcggacagacatagcgtaattcccgaggctgtaaattgtaatatccggctttttctttacaaagaactctgcatagataaccgctgcgagcgctatcagcaaaataccgacaactatcataaccttatggtaccaaagaaaattcttcgttttttctcccggagtctgcgccattcgcacatcatagccggtttcttttatattgctgtccttttcgtcaacaagcccctgcttcagcttgagaagctctctgcggtccttgtcgccgttatcgtaattttctgccatccgtatgcctccgtaaccgaccgtgtgaaactgattgattgtataattaaaatatgaatataatatgaacgttaccgtaaacgccgcatttattcagtatagcacattaaagacgatttttcaagaacagcccgtcagaaagtaatagcctgttattctgaataaatatgacatatttcttaagaattttgaattaaaggttgacaattggaattatatttagtataatgtaaacgatttctttaatggtaattattttggcagattttgcgaaaggatttaaagatgaaaaaattaacggcaatattcatgagtgctgttatgtgctttttgtttgcaggctgcagcaatgaaacggcacagaacagtgacggacaggtatcgacagacagcgtaagctcagcagcggttgagattcctaagcccgacggcttcaaggttgacggaacaaagctgatagacggttacggcgaagaatttgtaatgcgtggagtaaaccatgcttatacctggtttaagagcgatatagacactgcgcttgagggtatagaatatgtcggctcaaatacggttcgtcttgtactctccgacggcgatcagtgggataaggtcacaagagccgagcttaagagccttatcaggaaatgcaagaagaaaaaccttatagccgtacttgaaatacatgacggcgcaggtaaggatgaggtttcctatcttgaacacgctgtggattactggatagaaatgaaggatctgcttagcgagaacaaggcttacgctatcgtcaatatagctaacgagtggtacggaacatataacgatcttgaaacgtggcgtgacgcttatatcaatgccgtaaagaaactgcgtgacgcaggaatagagaatacactgatagtcgacagtgcaggctggggacagtgtgcagacagcgttctcaaatacggaaacgaaatattgaaggctgacaaggatgcaaacacgatgtttgcggtacatatgtatggtacggcaggtaagaatgaagaaactgtaaagaacacgatagatacagctataaagaacaacatctgcctgcttatcggcgagttcggctggaagcattctgacggtaatgtggcttatgatactatcatgcagtattcgacagagaagaatatcggataccttgcttggtcgtggaagggtaacagcgatgatgtaagctatcttgacatttctcgtgactgggcaggtgtcgatctcactaccgagtggggcaagccgctcgttgaaggcgagtacggcataaagaaaacatcaaagacttgttccgtttatacaaagtacgcttcagatgatacaagcagtgacgatgaagctgcagaataatatcgcggtataaaacggttatagaaaatatacgcagaaaaattattcgcagagcggtttttaaaagctctgcgaattaatttttacagcatttttcagggaaaatcataaggagaaaatatgacccacactgtaacagccggcgacagaaaaattacctatgagctaacacggaaaaaggtaaagaatataaacctcaggataaagcccgacggcacagttcacgtttcggcgtcaaccgctgttacaatagctgtgatcgaacgttttataaggaaaagagccgattttatactcggtgcaatagataaattcaatgcaaaaaacgagaacagaaaaaccctttttgtcagcggcgaaaagctgtcgcttctcggtacacagcatatcctgtatgtaaaaaaaggcatcagaaattatgctgcggattctgacggaaatataacgctgtacgttaccgacaccgatgattatgagctgaaatacaagacatacataacgtggctcaggtcgcagtgtctgcctcttatgacacttctttgcaaaagagcatatgacgagcattacggaaagctgggtatagattttcccacaataaaggtcaaggatatgcgttcacgctggggaagttgtataccgtctaagaagatacttacgttcaatgttcatcttatggaatatcctctgccggcggcggaatatgtcgttgcccacgagttcacacactttttgcaggcaaatcacagtgcaaggttctacgcagagcttgcaaggtatatgcctgattacaagcagagggaaaggctgcttaaataagcagaaacaaaaacagcaggaaatcgctcctgctgtctttttatttactttcttataaacagtacacccagcgtattgggtccgcagtgactgcataccgtacagcctgcctcggtttcgagtatctcctcgaatttgccaagcttcttcaccgttttgtgtgcaatatcgattatttccttgtcgcttggcgaatgcgtgatgaatatacgcttgtaatcaatatcatctctgcccgaaagacgctcggtgatgtatttttctatacaagcggcatatttgcctctgtattttttgccgacgctcatctttccgtccttgacctcaatgcacggacggagtgaaagcagatttgcacccagtgccgcaagtgcagaacatcttccgccctttctcagaaagtcgagcttttcaattacaaagctggcttcaactttggatgtgagggcgttcatcgcctttacaatatcctcagggctttcgccagcctgtgccatttctgccgcacgaagcacgaccagaccactgcctgtggaaagattacggctgtcgatgatataaacattgtcgaagttttctgccgcaatgcaggcattctgatagcagcttgaaaaatccgcacttatatcaacgtggataactgcgtcatattccttgctcagcggagtaaacgcatcaatataatccgcaacgtttactgcggcggtagaggtcagcgcaccgcctgccttaacgtgttcaaaaatatccgacggagttatctcaaccccgtccttataggactttccgtcttttacaatataaagcggaagaatttcaatgtcatactttttaacaagctcctctgatagatcgcatgtgctgtcggctgttatcttgatattcatagacacattcctttcgttaaaacgtttttataaattatatcatattttgtgacaaacggcaatagtttttgtgcaatttaatgcgttgtaggataatcttattatccgggatattttgcaaaaaatccgttcatttgatttttccgccgatataaaaatgtcagccgcagataagacaagcggctgacaaggattatttacgttttttatgcaatggcgagtgccgatacaccgaatttgcttgcttttccttcaagacccttaggtacgatctttacggtatgttcgcctgcactgtcgaagctcttaagctccgcacactcgacatagttgccccagccgcctgtaaaatcggcgttcagggtagtgacaagctcatcgtcgatataaacatcggcggtacagcctgcctttgtgtacttctgataaagaatgccgatagattttgcgtttactttgaatgtaagcgaggttgcgcttatatccgcatcgcttgtacccttgaagagccagaatccgtcaaaaccgccgaactgctgttcataatttccaaatgcgcctgttgcggtcacatctgtagcagatgaaggctgtatcagcgagccgttttcgataggtgcgtctgttgcgggagttgtgaaatcgctctcactgccgcttatattgtcaacgtccttgtcaacatctgaaatatatgcctgaagaagctgtgatactatcttatggccgggtacgttggggtgaatattatcgtccgaaatatccttccatacaatatcgccgtgctttatagtatcgagaatcgtgtttctgtatgaaatcatcggcaggtcataatgctttactatttctgcgtgctgatcctggaagctcgtaccgtcttcctgagtagttgcaattgtgattattgcagggtttgttgatgatttccagatagtcctgagcagaccgtcatacgatttcttgttacgctcggtgttttctgtagtatcgtttacagaaaattcaacgaatacaaggtcggggttctttgagagcagatcgtttgctactctgtgtacacctatatatgagcctgtagcgccgattcctgcgttgacataattgatcttggcattcgaataggtcttctgtaaccagtcagccgtgagctttgcataacaaagatcgttgccggcacttgtaccctgcgtgatagagccgccgatgaagcctaccgttacttcttcgccgtttttcagtttctttattacgtttgcaagtcttaccttgttgccctcgttaagacgtgacatatctatcatatgctgagtaaggtcgccgtcaagggtgtactttgtatagtttgcttccaagtctttggattcctcctgtgagctttcgtctttgctttcatcttccgaagatgcgtctgcagatgtctgtgtacttgtgtccgagctttccgcaaccgatgaagcggaggtgctgtcgctgctgcttgtcgcattgcctgcacagcctgttacggatacggcaagcgccgttgcgataagtaccgcaagtattcttttcttcatattactgcctttcatttaagttctgttaagcgattttaggtaatcacttacacaaatatatcactatttttaccgaatgtcaagaataataggcaaaatttactgagcaatttttacataattcggttgaaaatattccactgatatgttaaaataaatataaaccgatttaatttcggcactatgataaatttaagcgaggaattaaaatatgacgaacagaaagattgtaagcccgtccgacagggcgttttcgtatatgggaaggattgacttttcaaagcccgacagcccgttgtttatttatgcgggcagtatggtcagcacaaagtttaccggcacttcggtaggtatgatgatttttccgcaccttatatataaggttacctggataggcgttatcgttgacggcattcagtacaaattcgaactgaaccattccgacactccggtatatataccgataatcgacggacttgacgagggagagcataccattaccatatataaaagaacagccggctcacaccattatttcaacttctgcggacttatgatagatgagaatgcggaggtaagagcggaaaaccacgaatatgatatgaatatcgaggtttacggcgacagcgtttcggcaggcgaggtggtagaggcagtaaactattgcgagcatgccgaccccgagcatatcaaccagttcgacaacagctggtttgcatattctcttcagcttgcaagaaagctgaacgcccgtatcaactgcaacgcacagggcggaatttcgctcatcaacggcgcaggctattttgataattatatcggtatggaaacagtatataagcagatgggctatgagcctcactttgagcttaccgaatgggatttttcacgctacactcccgattatgttataatcgcattgggtcagaatgacgcaaaccccgaccctaagcgtatttacgaaaaagaataccgtgaaaagtggaagaccgtatataaaaatatggtgcttgaccttaacgaaaaatacggcggcaaggcaaggtttatcgttataaccactgtgcttatgcacgagcctacatgggacgatgctcttgacgaaatagtaaacgagcttgcaatggataatgtaaaacgttttaaattcagaagaaacggtgcggcaacgcccggacatccccgtatccccgagcagacagagatggctgacgagctgtacggctttataaccggatgggaaaactgattgtcaatctgcacaaaaagataggttgaaacaaggcacaattcataaaatcggcacaaatctattgaaaacttttgggaattgtgctattattaaaaaagtaaaataaaatgttaggagtatctgttatggctattaatgtgcctaaggaatatgaagttcccctttatcttttccatcagggaaagaacgccgaagcatataagttgttcggctctcattttgccgaaaaagacggcgtgagcggtgttgttttcagagtatgggcaccaaaggcggctgatgtcagcgtcgtaggcgatttcaatcactggaaccgtgaagaaagctatatgaaaaaaatcagcgacggcggtatctgggagctttttatccccggactcaagaagtttgataattacaaatacagcataaagaccgaaagaggacagataaagctgaaggccgatccctacggctatcatatggaaacacgtcctaataccgcttcaaaggtgtatgatatttccggctacaactggaaagattcaaagtggatggatgagaaaaagacgaaggacgtataccgttctcctatgaatatatacgaggtacacctcaactcctggtttacaaagaccgatgaggaggagctgttcagctatatgcagcttgcggaaaagctcgttccttatgttaaggaaatgggttatacccatatcgagatgatgcctatagccgagttcccgtttgacggttcgtggggataccagcagataggctattacgctcccacatcacgtttcggcactccctctgattttatggaatttgtagattactgccacactcacggagtgggcgtgatacttgactgggtaccggcacatttccctaaggatgcggcgggactttacgagtttgacggcgattactgctacgaatattccgaccccaacaagcgtgagcattataactggggtacaagagttttcgactggggcaagcccgaggtacagtcgttccttatttcaaacgctaactactggctttccgaatatcatatagacggtctgcgtgtcgatgcggtagcttctatgctttaccttgactatgacaggcagggcggagcgtggacgcccaacaagaacggcggaaacgagaatcttgaggctgtcgatttccttcagaacctcaactcctgccttttctcacggcaccccggacttctgatgatagcggaagaatcgaccgcttggcctatggttacaaagcctgtcgatattggcggtcttggcttcaacttcaagtggaatatgggctggatgaacgatatgctttcgtatatgtcaatgagccccgagtacagacagtacaaccatgacaagctgaccttctcgttctattacgcattctccgaaaactacatactgccgatttcacacgatgaggtggtttacggcaagtgttcaatgcttgacaagatgagcggaccgagagaaaagcgtttcgcatctctcagaacgttccttgcatatatgacagcacaccccggtaagaagctgatgttcatgggtcaggaattcgcacagttcaaggaatggaattacaagacaggtcttgactgggatattctgaaattccccgagcattcacagtatcagtcgttcgtaaaggctatgaacaagttctatctcgataacaagcctttatgggagattgattatgattggagcggcttcagctggatttcaaacgatgacaacaagaacagcgtcatagtattcagacgtattgcgtcaaacggtgacgagcttatcgcagtatgcaacttccttccgacagaacacgagcagtacagcttcggcgttccttattatgccgattataaggaagtgttcacaacagacgataagaagttcggcggcgacagtgacggcaacgcttcatataccgcacagtgcgaaggtatgcacggacttgagtattctataacaatgaagataccggcaatgtccgcagtattcctcaagcccgtcaacaagcgcagccccgaaagcgacaagccaaagcccgaaaaggcggaaaaacctgcaaaaaccgcagagaaaaaggctgaaacacaggtacagaaaacggtacagaaaaccgccgcaaagtccggagcttccgcaaagaaacctgcggcaaagaagacaaacacggcgaaccgtaagaaaaacggcaaagctaagaaataaataacggaggaacttatttatgaaacatgtaaaaaaggaatgtgtggcaatgttgctcgcaggcggtcagggaagcagactttacgccctgacaaaggatatggcaaagcctgccgttccttacggcggcaaatacagaatcattgattttccgctttcaaactgcgtaaacagcggtattgacacagtaggcgtacttacacagtatcagcctctggtgcttaacgaatatatcggcaacggtcacccatggggacttgacagagttcacggcggcgttcatgtactgcccccttatgaatcgtcatcgggtaagtcgtggtatgagggtacggcaaacgctatttaccagaatatcagctttatcgacagatacaaccccgactatgttgcagtgctttctggcgaccacatctacaagatgaactataacaagatgctcgaattccacaaggcacataaggcggacgctactatagcagttcttgaagtgccgtgggaggaagcaccccgtttcggcataatgagcgcagacgagaacgatgtgatttacgaatttgcggagaagcccgcacagcctaaatcgaaccttgcctcaatgggtgtttacatattctcttggcagaatctgaaaaagcaccttatcgccaacgaaaatgacgagggcgcaagcaaggacttcggtaagaatattatccctgcaatgctggcagagggaaacaagctcgttgcttatcactttgacggctactggaaggatgtcggaactatcgacagcctgtgggaagcaaatatggatcttcttgatccaaacgttcctctggatcttcacgattcaagatggagaatttattcgagaaaccccgtaatgcctcctcattacgcaagccccgagagcgttatccagaactctcttatttctgagggctgcaacattgaaggtcatatcgacttctcagtgctgttcgcaggtgtaaccatcgagcccggtgcagtcgtgcgtgacagtatcataatgccgaacaccacgataaagaagggtgcggtagttgaatatgctattgtcggtgaggattgcgtaataggtgaaaacgtcaaggtcggtgcaagacccgagtctatcgaggacaaggatacatggggtgttgcggtaatcggacacggcgtaacagtaagcgacaatgcggagattaagcctaaggcaatgatctcggctgatgtgtgaacgggaggagaaaacagaaatggctaatatggcaaatgtactcggtctgattttcgctaatatgcacgagcagagcgtagccgatcttacaaaacagcgcacacttgcaagcgtgcccttcggcggcagatacagaatgatagatttcccgctgtcaaatatggtaaacagcgatattgacaacgtaggcatcatcacaaaggacaactacttatcgcttatggatcacttaggatcgggcgatgaatgggatctttcaagaaaaacaggcggtatgcacctgcttcccccttacggaaacagcaacgctctttacagaggcagacttgaggctatggctcaggtaaagccctttatcgaaagctcaaacgcagaatatgtactgctttcagacgcagatgtagtggcaaatatcgactacagaccgataattgatttccacgagaaaaacggcgcagacattactgtcgtatacggcagaggaacattcacaacagagcagacaatgacaaagaccgttcttgctgtaaattccgacaacgttatatacgatgtgcttatcagacccgaaatcagcggcgaacacaatgtcagccttaatatgttcgttgtaagcaaggatttcctgctcaacgagattcgtggcgctgaaagccgtaacctctacagctttgaggtagacgtactgcagaagaagctccacgatataaaggtactcggctacaggttcgacaagcccttcgcacagattgacagtatggatacatacttcaaaacaaatatgaagctcgttgacaagagcctgcgtgatcacctctttatgagcgatgctcctatctatacaaaggtaagagatgatgcccctgcaaagtacggcattgacgcagatgtcaagaattctcttgttgccgacggttgcgttatcgagggtacggttgagaactgtgttctgttcagaggcgtaaagattgaaaagggcgcaaaggtcaagaactgcatacttatgcaggatacgacagtaggcgcaaaggctgagatgaacttcgtcatcacagataagaacgttactatcagcaactaccgttcgcttgcaggaacagaaacatatcccgtatttgtaaataagggtgcaacggtttaattgcccgacagaaaaatgtccgcatttgcggatagatacgacttcagagatcccggtttgttttcagaccgggattttgtttacataatcttattctacaagtttccgcaggagaaattctgcggcggttttactgtaaataactatcggcaggaggtaatattcctcaaagcctgcgaaaaaataacagagacatagcttaaaaaaacgatgcgaacaggataaatccgctctgttttcagcattacagtaagaccgcagaaagtctttttgcggaaattgcctatttacaaaccgaattcaaagtgctataatagtaatattgaacaatagcatcatattgccgccgtttgcggacggctgaaaagtatggtgcaacgaaaagtcaaaggataaaaatgaatttcagaaaaattaatataattaccggtcattacggctcgggtaaaacaaatgtatccgtcaatatggcgcttgatcttgcagaaaaaggcgagaaggtaaccgttgtcgatcttgatatagtaaacccctatttcagaacagccgatttcaaggagctgttcggggagcataatatcagccttaccgtaccgacctatgcaaactcaaaccttgacataccggctctcggctttgatatgaacggtatcgctgacagggaaggctatattattatcgacgtgggcggcgatgacgagggagcaaaggctcttggcagatacagaaaagtatttgaaaagtacgacacgcagatgctgtacgttatcaatcgttgcaggtatctcacgaaagaacccgcagaggctttacagcttatgtatgagattgagaacgcatcgggtatgaagtgtgacggaataatcaataacacgaatctcggtcgggaaaccgacaggaatatagttctcggctcggtcgcttatgcggatgaggtgtgccgtgaggcaggacttccgcttgtggctgtaactgccgaggcaggctatcttgacggtatagacaaagcatatcccgtaaatatatatgtcaagaagctgtgggaagaattcggcgatgaagccgaaaaataaagctgtttccttaccgtaatctgattaaaactgaatggtaagccgaataaaactttaggcgaaaggaaaggtcaagaaatatggcaaaaatgaaagtggattttgaccgctgtaaaggctgcggactgtgcacaatagcctgtccgaagaaaatagtcgctttacagacggaaaagctcaacaagaagggctactacacagccgtatgtacagatgacgatgcttgcatcgcctgtgcgttgtgtgctatgatgtgccctgactgcgctatcactgtaggaggtgacgacaatggctgaaaagagtcttatgaaaggtaacgaggcactcgcagaagccgctataagagccggctgtaaatgctttttcggttaccctataacacctcagacggaaatttcggcatatctgtcaaagagaatgcccaaggtaggcggtgtatttttacaggcagagtcggaggttgcggctataaatatggtttacggctgtgcaggctccggtatcagatgtatgacatcttcatcatctcccggaatttcgcttaaaacagagggtataagctacatagcaggctctgatttaccctgcgttatcattgacgtacagcgaggcggtcccggtcttggcggtatccagccgtcacaggcggattactggcagataacacacgcactcggtcacggcgacttccacgctatcgtattcgcacctgcgtccgtgcaggagatggtggatacggtaactaaggctttcgaccttgccgacgagtacagaatgcctgcagttatattggcagacggacttctcggtcagatgatggagccggttgcctttgaggataccgagataaagatgtccgatgcgtcaaagaagccgtgggcggcttgcggtcacggcaacaagagaaagcacaacataatcaactctctttatttaaagcccgatcagcttgaggataatataagagaaagatttgaaagatatgaggatctgaaggcaaagcatacggaggctgtcagcgactactgtgaggatgcagatactgttgttgtggcttacggctcgaccgcaagacttgcaaaatcggcagtcgaagcggcaagaaaagagggccttaaggtcggcatagtaagaccgataactctctggccttatcctgcaaaggaaattgccgaagcgtgcaagaatgcgaagaatgttctttgcgtggagatgtctatgggtcagatggttgacgatgtaaagattgctctcaactgctcaaagcctgtcgagttctacggaaggacaggcggtgttatcccgaagcccgcagaaatacttgcaaagttaagagaaatgggaggtaaaaactaatgcctgaatttaaaagacctcacgctctggcagacgtgaccacccactattgccccggctgtactcacggtatagtacacagacttgtagccgaagtaattgacgaaatgggtatcgagggcgaaactatcggtgtttgtcctgtcggatgctcggttatggcttatgattattttgaatgcgatatgcttgaagcttcgcacggacgtgctcctgccgtagctacaggtatcaagagagctaaccccgataagttcgtatttacatatcagggtgacggcgaccttgcggctatcggtacggctgagattgttcacgccgctacaagaggcgaaaatatcactgttatatttatcaacaacacgacctacggtatgacaggcggtcagatggcgcctacgacacttcccggtcagataacgcagacaaccccctacggcagaaatcccgatgttgagggcttccccgtaagagtatgcgaaatgctgtctacgctcagcggtgttgcgcttgccgagcgtgtaacggttatcgaccccaagaatataaacattgccaaaaaggcaatcagaaagggatttgagttccagaagaacaagcagggcttctctataatcgaggttctttctacttgtcctacaaactggggtaaaactccgatagaggcgcttgacagagtccgcacagagatgattccttactatcctttaggtgtattcaaggagggtgcgataagatgacaaacgaaattcttcttgccggattcggcggacagggcatactgtttatgggaaaaatgctcgcatatttcggactttacgagaacaaggaagtttcgtggcttccttcctacggtcccgaaatgcgtggcggcacctgcaactgctcagtatgtgtaagcgatgatcctatcggctcaccccttgtcgatacaccgaatacgcttatcgttatgaataccccgagctatgacaagtttatcggctcggttgtgccgggcggtactgttatcattgacagcacgcttgttgacgcaaagtgcgacagaacagacatcaatgtttattatgttcctgcaacggctctcgcaaacgagcatgatatgaagggtcttgccaatatcattcttgtcggcaagctgctcaaggaaactaaccttacttctatggaaacggttaaaaaggctatggaaaaggttatcccgcctaagaaagcccatcttatagacgctaacatcaaggcaatagaactcggtatggctcaatagcggcggctgtgagccgcttcaaattcgccgttccgattgttgccgatatgcttaacaagcgttatcggcggaggcaatttgatagtgcagattcagaattttgcgatttagaaaaaaccgaatataaaggaaatccactgctttcgggcagtggattttttgcggctgtgagccgcttcaaattccgcctgcggctgtgagccgcttcaaattcgccgttccgattgttgccgatatgcttaacaagcgttatcggcggaggcaattcccgccaagtattttcgacgtaaatgagcttaactactgtgttcggaatgggaacaggtggaacctcatcacaatcaacaccgacttttaagggatattccctcaaaattgaataacgaaccaaaaacaaaacatatattctcattaggtttaagccctcgaccgattagtatctgctggctaaattgctcacacaacttacaccttagacctatcaacctcgtagtctacaaggggtcttaacttaaaagtgggatatcttatcttaaggacggcttcacgcttagatgctttcagcgtttatccgatccgcacttagctgcccagctgtgccactggcgtgacaactggtgcaccagaggtgcgtccatcccggtcctctcgtactagggacagctcctttcaaatatccttcgcccacgacagatagggaccgaactgtctcacgacgttctgaacccagctcgcgtgccactttaatcggcgaacagccgaacccttgggaccgaattcagccccaggatgtgacgagccgacatcgaggtgccaaacctccccgtcgctgtggacgcttgggggagatcagcctgttatccccagggtagcttttatccgttgagcgacggcatttccattcacataccgccggatcactaactccaactttcgtttctgctcgacccgtcagtctcgcagtcaggctggcttttgcgtttgcactctatggcatggtttccatccatgctgagccaacctttgagcgcctccgttacctttttggaggcgaccgccccagtcaaactgcccacctaacaatgtcccccaacccgattcagggctgcaggttagaatttcagcactccaagagtggtatcccaaggacgactccgcataagctgacgcctatgtttcctagtctcccacctatcctgtacatgaaatgccgaaatccaatattaagctacagtaaagctccatggggtctttccgtctagtcgcgggtaaccggcatcttcaccggtactacaatttcgccgggcgggcagttgagacagctcccagatcattacgccattcgtgcgggtcagaacttacctgacaaggaatttcgctaccttaggaccgttatagttacggccgccgtttaccggggcttcgattcagggctctcactcctcctcttaaccttccggcaccgggcaggcgtcaccccatatacgtcatctttcgatttagcatagagctgtgtttttgataaacagttgcctgggactattctctgcgggtttccgtagaaacctccccttattccgaagttacggggacattttgccgagttccttaactacccttctcccgttggccttagaattctcttcctacctacctgtgtcggtttgcggtacggacacataagatatacactaagcttttctcgccttcatccacgctgacttcactacttaatttcgttcccttacgaccggggtaaccaacacccggcatcagctcttcaaaagtgtcccttagtttaaatctttctgtggtaacggaatttcaaccgtttgtgcatcggctacgcttttcagcctcaccttagcttccgacttacttggagcggacgaaccttcctccaaaaaccttaggctttcggccattatgattctcacataattctcgctactcattccggcattctcacttgaatgaagtccaccgtcgctttcgctacgacttcacccctcattcaacgctcccctacccctgtcacattgtgacaagcctaagcttcggtgtacgttttagccccgttaaattttccgcgcaaagtcactcgaccagtgagctattacgcactcttttaatgtatggctgcttctaagccaacatcctggttgtctacgcaatttcacatcgttttccacttaaacgtactttgggaccttagctgtaggtctgggctgtttccctttcgactatgaaacttatctcacacagtctgactcccgtgcatgattattcggcattcagagtttgataggcttcggtaatctctcgacccctaggccattcagtgctttacctccgataatcttaatcacgaggctagtcctaaaactatttcggggagaaccagctatatccgggttcgattggaatttctccgctatccacacctcatcccctaccatttcaacgggagtgggttcggacctccatgaggttttaccctcacttcatcctggacatggataggtcacccggtttcgggtctattgcatgcaactgaacgtgctgttaacactcgctctcacttcggctccgtagctgaactacttaacctcgctgcatacaataactcgccggaccattctacaataggtaccttatcacactttgacgtgctctaagtgcttgtaagcacagggtttcaggttctttttcactcccctcccggggtgcttttcacctttccttcacagtactattcgctatcggtcatcaggtagtatttaggcttggaggatggtccccccatcttcccacgggatttcacgtgccccgcggtactttggatactgctcgtcaactttcgttttcacctacaggattctcaccttctttgatcagccttcccatgctgttcggttaacaatcattgtactaaatgcagtcctaaaccccgaaaggattgctcctctcggtttagcctcttccgctttcgctcgccactactcacagaatctcggttgatttcttttcctcgccctacttagatgtttcagttcgggcggttcccctcatatacctatttattcagtatatgatacatggacttgactccatgtggattgctccattcggacatctacggatcatatcgtgcttgccaatccccgtagcttttcgcagcttaccacgtccttcttcggctcctgatgccaaggcatcctccctgcgctcttattagcttaacctattcaagaattatgtcttgtttttcaacagaagaattgtttgaaattgtattttacccattaaatttctttaattggatatctttaatttcctctttgttgtttcgttattcaattttcaaagaacatctctcactcttagacatttgaagtccttgagtgttatttggtggagatgaggagaatcgaactcctgaccccctgcttgcaaggcaggtgctctcccagctgagctacacccccaaattgggtttgaaggttgtgttgtctgacttcttttcgttgtcagcctttgctccggcttttccttcgttttcttacgaaaacgaatcccagctgagctacacccccaaaggtgatttttattcacttatggagtcgccagccctgagggcaagttccttcaaaattgaacaatacagatttaagaacttgtgagcaagttctcttacgaacgatgttcgcatcgctctttttcttccttagaaaggaggtgatccagccgcaccttccgatacggctaccttgttacgacttaaccctaatcatcaaccccaccttcggcggcgtcctccttgcggttagactaccgacttcgggtgttgccaactctcatggtttgacgggcggtgtgtacaaggcccgggaacgtattcaccgtagtatgctgacctacgattactagcaattccgacttcatgtaggcgagttgcagcctacaatccgaactgagacgttttttggagatttgctctgcctcgcggctttgcttctctttgttaaacgccattgtagtacgtgtgtagcccaggtcataaagggcatgatgatttgacgtcatccccaccttcctccgttttgtcaacggcagtctcattagagtgctcttgcgtagcaactaatgataagggttgcgctcgttgcgggacttaacccaacatctcacgacacgagctgacgacaaccatgcaccacctgtctttgtgtccccgaagggaaagcctaatctcttaggcggtcacttgatgtcaagacctggtaaggttcttcgcgttgcgtcgaattaaaccacatactccactgcttgtgcgggcccccgtcaattcctttgagtttcaaccttgcggtcgtactccccaggtggattacttattgtgtttactccggcacggaaggggtcaatccccccacacctagtaatcatcgtttacggcgtggactaccagggtatctaatcctgtttgctccccacgctttcgagcctcagcgtcagtaaaagcccagcaagccgccttcgccactggtgttcctcctaatatctacgcatttcaccgctacactaggaattccgcttgcctctacttcactcaagaatgtcagtttcaaaagcaggttacgagttgagcccgtaattttcacttctgacttgatatcccgcctacactccctttacacccagtaattccggacaacgcttgccacctacgtattaccgcggctgctggcacgtagttagccgtggctttctaaacggataccatcatttttttctccgtcaacagaggtttacaatccgaaaaccttcttccctcacgcggcgtcgctggatcagggttgcccccattgtccaatatcccccactgctgcctcccgtaggagtctgggccgtgtctcagtcccaatgtggccgttcaacctctcagtccggctactgatcgtcgacttggtgggccgttaccccgccaactatctaatcagacgcgagcccatctctaagcgataaaatctttggtatcagaaagatgccatcccgatacgttatgcggtattagcagtcgtttccaactgttgtccccctcttagagccaggttgctcacgtgttactcacccgtccgccactgatccgaggagcaagctcctcttcaccgttcgacttgcatgtgttaggcgcgccgccagcgttcgtcctgagccaggatcaaactctttgttaaatggtatattcaagctttcgctttaaatatcaaagtttgattgctctgttgaacgctaacttgctatctattagcacgttattttgtgttcatccagaatttcttgttattctcattaagaatctcaaggtaatgtttttaattctgtactgttcaattttcaaggaactttgtgccgctcttgcgacagcttatttattatatcacattcattcgagtttgtcaagcacttttttgaaattttttaaatttcttttttcagagttttgaactttttaccagtcggtcaccgtgcttccgccgtttcttctttccggttttttcagctcttcttcgtaccctcgactgccctctttctcgctgttcaagcggtttcaggctttctcaagtaccctctgtttttgtgccctctcgtttgagtgcttgtctattatatcacgcttttcgagctttgtcaacagctttttcattttaattttgcacaaatggttttaaactgttatattccccgattgtgcaaaatgcaaacaaccacaatatacagttttctgctatcaacatttagttatcaacaaccacattgctatatgttgaaaacccgtgtgttctttccgtaatgcaaaaagcaatgccgccctttaaggacggcaccgataaaaaacctacttttcttcgttcagctcggaaattattctgacaaagctgtcaatatcattaaagtcacgatataccgaagcaaatctgatgtacgccaccttatctatatccttcagccttcgcagtaccagctcaccgatctcgtccgacgatacctcacgtctgaactggttcttcagctcctgtacaatatcctcaaccattttttcaaggtcttcgatctgtaccggacgttttactgtagctctcgcaagcctgtttatcagcttgtcacggtcaaaaggttcaatggtattatcctttttcacaaccataagcggtattgtttccaccatttcataggtcgtaaaacggcacttgcacgacagacattcacgtcttctgcgaatcttattttccgcagggcggctgtctattaccttgctgtcctcatatccgcattccgggcatttcatctgttttcctcgctttcgctctgatcctcacggttttcttttccatattgctgtatttatgtattttaacacactttcgcagctttttcaagcgttttctgtaatcaaagccccatcttatacttatcgtatatctttttcatattattcgcacacgcagcaagctcgtcatagctgctgtaattctcacggtaaagctctactatcattgctttatcgtaatttattttttcaagctcgctgaaaagacggttgaagttaaagctgccctttcctatcggcaggcaatcgcagcctgcgtcgccgtcgcttacatgaagatgtacgaccttgtcacctattatatccagaagcctgaacggatctacattgctccttctcgcctgtttgagatctacaacaaatctgacctcgtcgccgagttgtccgatcatatcctcgataaatcttacactgctgctcttgcagtagcagatgttttcctgtgccaccgtaacaccgaattcttttgcaagacggaacagacgcagataacgttccatgtacctttcatcaggcacctttgagcttaggatagctccgtgcaggacaaacacacccgcaccgatctccgccataacctcaaaatacctcttgtaaatatctatcagatattcggttctgcgtggataatcgccgaataggaacagtgtttccataggcgaagaaaacggatgcatggataatacgttcatcccgtattcgccgatgatccttcttagctcaacaagcacctgcccttcaagctcgtctatcgaatttacgaatatctcaacattttttacgccccgctcggcaagctcataaagagccttttctgtttcaagagggtacagacaagccgttgatacgccaatatccattttcattacttcctttctgaaaatcagcccgccagagaacaaatgttccctattattgatatgattagtggtaatacatacaccgccgccagcaccgcaacaagcaatgcataaacgccgaccctgcacagaccttccgccttatcggcaattgccgttatctttttgcggaatataatgtacagcgccagtgccgcaaagcctgcaacgctcagcgcaatacccggtttaagtcctttagggcagaaactgaaggttatatcatttttgccttcctccagctttaccgccataaagcccgacatagaacggtatatctcagcagacttgccgtttatcgtcgcagaaaatccgctgtcatacggcaccgacaaaaacagccactgaccgctctttgcgttgtctgctgttccgcttatatttcctccgtcaaccttaaggtcggcggtttttgttttattgatagctttctccagcttatctaacgacagcccgtaaacaccgtagcttgagcaataagtgctttcgtttacatcaacatctatacttaccttctcattttcgaaagtaccgagatataaaagcccgttgctgtctttattcgggaacgacagatcctgcttgatgccgtttacatatattgcaaacgaaccattgatatgctcgttgatatttcttgtaacaagatcaaagcaatcgaaatacaacgcctgcttttcacctatatccagcttgtagctgagcgttgcgatgcgtgtattgctcttgggtgtgaaataatatatcccgtcacgatgtgcataccgtatattcttttctccggtatgctcatattcggtgaacagaagctcgttgcccgtatcaagcagattttttgcaagatattcctgtataactatgcgttctgccttaggcagctccgtacattgtgacagatcgctgtcggtcactattccgagcggaagatagtattcgctctcatagatcgaataattcttgtcacgataaaccacaggctctcttgcactgaatttctcgatataatattttatattcataacggcgtcggtaagagccgtgcctccgttacctgtgacctccatccagtaggacgaatagccgagccgcttcatcgcaaacatataatcctccgatgtaagcgaggtataatgtgcgatggtgggatagcccagtccgcctataagatttgcgtcaaaatatttcttcggccactgcatcagcttcaccctgtaaaaatcctcgtcctcggggatttttccttcaagctctatcgcattgttgtacttgacaggtgtatatgccgatgcgcctatatacacgtttgcgttgaaaacgctctcggctacaacaattacagccagtacagaacaaaccgatttgaaagtgagcttcttgaaaacgccgaaagccatagtcagaacatacagtgccgtaaatccgcagaagacaatcaaaagcagtacgaacgactccgagcttccccacagtgtcgaaacatacgaatccaggtcgtatctgcagttacagtagtaccatatcgtaaaaccgaaatagataacgccggcggcagttattccgataagatagggctttttattcttttgtgcataatcgtccggctttgtatgcgacagcttcaccgccgcaaaggtcagcatcataagcgtagtcatatagccgtaccgcatagggaatgccatatagtcacccgtgtgccacatcttgtttatcggctcgaaaactacaggcagaagcgtaagaaacgaaagcagtgcatagaatctgctgttcttgctctttcttcgcagaaaatacacaatgaaagccgcaacggaaaatcccgtacagaaaataagcggcagatttgtatatattcctgcaaataccgcagaatcaaacagacccttgagtatgttcgctccccttgcggatgaaagatactgtacaaagctcggaagccatacaacagcggagatcagcgccgctataccgcagcctatgataaacctcggcgcaatgccctttgtactgcccttttttctgttaagaaaaatgtaaacgccgaaatacagtatcgtgaacaataccaccatatagctgagataataattcagcaccagcattccgacaaggcagaatataagaccgcctgtgcgtttacgctttacgagcgaattgaacgctatcagcagcagcgggaagaaatacattacatcgagccataccgtgttctgatagaacagcatcgaataaccgctgaacgcatacataacgctgaaaagcgccgaatatgtcacatccagctttttatggcaggtgcggaagtacgcatttgcggttatcgcacagacagccattttcataagcgtcataatgttcatgaacagcatcatgtccgctttgtcgacaaatgcaacaagaaacgaaaacgggcttgatataaagaacaggaacacgccgaggaaattcattccgccggcattctgccagttgaagaagaaatcccccttgccctcaagtatgtccttgaagtcgagcaataaaggaagcacctgctggtgcatatcgcaccatgcgagcgttttatctccgaacggataaagcccactgcccgcaaataccgcaagtcctatgacaattaccgctatcggcggaattatcagcgtcaacaacagcttcggactgcgtattagtttaccgaaatgtgttgtgatttttttagtaatatctcttttcaaaatatcctccgggatttttaaaaatctctcccatttggtttttatgaatatctgtctaaattcaaaagccgcaaagactttatgtgctatgcggcttttatttttgattgaattatcagccgcaggtgattataccatgagcttctttgtgtctaccgtaccctttgaagcaagattctttgtatccttcttgctttcgccgtttcctgcatttgtataattcttgccgtgcttctcctgccagagtacccacagggggcccgagatgcacagtgaagaataggtaccgcagataagacctgccatcataggaatagcaaatgtcattatcgaggttacgccgcagattgcacatacaacgcagattgcgagtacggcaaaggctgtggtaacagttgtgtttacagaacgtgttatcgactgagtgatactcatattaacaagttccttgagtgaaagcgagttgccgtaaaggttacggttctctctgatacggtcatatacaacgattgtattgttgatagagttaccgagtacggtaagaacaaccgccataaagtttgcgtcgatcgggaaacggcagaacacgaacacagcataaaccatgaagcagtcgtgaacaagggctaccagtgcaaacacacctgccgaaagaccgccgattttcttgaatctgaacgcaatatagataacgagcagtataaacgagaacaatactgcaacaaggcacttaaggaagaactccgtacctgatgtggggttgacatcctggctgtttacaagcgtaaggctgttatccttgaaggtctgctggagcttatccgataaagctgtctgcttatctgctgtaagtccctctgaagacgagaatgaaatttcaatgacttcaagcgagctgttcatcgaagaacctgtagttaccgtaacagcaccgtaattttcgccctcaaccgtcttctttaccgcatttgtgtcaatttcgccggtatagctgtaggtcagcattgtaccgcccttgaattcaatagccatttcaatgccgaatatgcagttgaagataaccgtaattacagcaatgacgatcggtatcagaaagagtacctttctgtatcctataaaatcaaatacttttttgttattcattttgaagcaccgccttccgttgcggcagccttttcagcggcacgcttctttgcagattttccgccgtagagagcaggatttctgaatatcttgaatctggaaagcgacattgtcataagtcttgtcgcaaatatgccgaacaggaagttcagtattacgccgaccatcagagtatagccgaatgagtagatagtaccctccgttgaagcgccgaacataaagaatacgggcttcagtatagtagacgcaaggctgtcgggtgtaccgaaagcacccataagtatgatagcaacgataatcattgtgatattaccgtcaaatactgcgctgaacgctctcttataacctgtagctatcgctgtatctatcgtcttgccgctgtttatttcttcctttatacgctcgcccgtgataacgttagcgtcaacgcccatacctaccgcaagaatgatacctgcgataccgggaattgtcagcgtaaagctgtttgagaacgggaagaagcctgttatagcacagaacgtacctgcaacctgtccgataagaccgataacggcaactacaccgggcagtctgtacagtgatatcatgaatatcattataagtacaaatgcgataacgccggcgattgccatagcgtcacgggcacccgtaccgagtgtgggcgagatagtgctgaagctcgatgtttccagcttgaacggtaacgcaccgccgtttatctggtctgcaagcgccttagcctcatcagccgtaaagttaccgctgattgtagcctcaccgccgctgatttcctcttttacggtagctgttgaaatgcacttatcgtccatgtaggttgaaatgtatccctttgatgaagcaagcttctttgtagcctctgcaaacttctccttgccgctgtccttcagctttaaggataccatatactcatattccttgctgtttccgctcttgagctgatatacggcagaagccttttcaacgtccgagccggaaatgataaggggcagatcctcgtatgtctgaccgtcggaaagcgatttttccgagccttctctgaaggtgagcagtgcggtagcaccaagctcctttacagccgcttccggatcaaagctgtcatcctcagcctgccacgggaaacgcacgattatcttatcgctgttataatcaacataaacctcatagtctgttatgttgtttgcaacaagtcttgtttcaactattgactttgccgcatcgacctcttcattggtcgcatcgtagtctgccggtgacgtaaatgtaacgtcaacaccgcctctgatatcaataccccaacgaatatcacttacacctcttataatagtggtcgtgaaatcgccgtactgggtatgaacaccgaaaaatactatgcctgtaaatgccagtataaccgccagcactataaagaacacaggctttgccactcttttcaaatgtttcactccgtttctgtgcctcagcacatcctgttaatttatacattacagtattatactataatgatttcgattagtcaagaaatagtaaagaatttctgcaattttcacaatccgttcattatacggaaagctcagccttttctccgagaacgtccttattcttttcaaggacaggctttatgcacctgtcaaggaatgctgtcacctggcttgcgcttctgcccgtgtaattttcgggaatgagctttgcctcgatttcttcctttgtcgtcatgaagtcggggtctgcggcaattctgtcaacgaggtcgttttctccgccctcttctttgatgaccttacctgcggcaatgctgtgctgtcttatcttctcgtgaagctcctgtctgtttccgcccttcataactgcgtccatcataatgttttccgttgccatgaaaggaagctccttcattactcttgcacggatgaccttaggatatacgaccagtccgtttgtgatattcagcataatgttcagtatagcgtctgttgcaaggaatgcctccgctactgcgatacgcttgtttgcactgtcgtcgagcgttctctcaaaccactgtgtgcctgccgtgaatgcaggattaagagtatctatcataacatatcttgaaagcgaggttattctctccgctctcatcgggtttctcttataaggcatagccgaagaaccgatctgattcttctcgaaaggttcttccatctccttgaagtttgcaaggatacgcagatcgttcgagaactttgaacagctctgtgcaataccgcccagtacgtttactattctgctgtcaacctttcttgaataggtctgaccgcttacaggtacgcactgcttgaatcccatttcctcagctatcatctgctccagcttttctatcttttcctcatctccgtggaacagttccataaagctcgcctgtgtgcctgtagtacccttctgaccgagcagtttcagattacccatctgatactcaagatcttcaaggtccatcagaagctcgttcatccacagtgtagcacgcttgcctacggtagtcagctgtgcaggctgtaaatgtgtatatgcaagacagggcatatccttatatttatccgcaaaagaagcgaagttcgaaagaacgttcacgagctttctgtgtactatcttcatagcgtcacgcattacgataacatcggtgttgtcgcctacataacagcttgtagcgcctaaatggattatgccctcggccttcggacagcactttccgtatgtatgaacgtgcgccataacatcgtggcggagcttcttctcctcctcagccgcataagcaaagtcaatatcatcaatatgcgcctcaagctcgtcaaccttttcctgtgttacctgctcaagtccgagcttcatttccgctctcgcaagcgccacccacaatctgcggaatgtcgaaaacttcttctgtgcggagaatgtaaactgcatttcctcacttgcatatctcgtacagaaagggctttcgtaagtttcataatttgtcattataaataaccgtccttttcatcggattttttactttcctgtgtcatctgtatctgccgcctgtatctttgacgcatacagcgcttcatctgcacataccgacacattttatattgtatcacaaattgtccgtgttcgcaatagcaaacgtcattttttctcaaaactcacctttccgtatatcattcagccgctctgcttcaccctacggcaacatcgaccacaaccgccttacctacactctacggccacatcaaccacagccgccccgcctacactctacagccacatcgaccacaaccgctccgcttcaccctacggccacattgaccacagcccgtaatttcgcacaacaaagccgtttgaacagctctgccgaaaatttttcgtatttttttaaaaaagcccttgacaaatacccgaaaaccgtgtataatgtttactgttatctgggtgtggcgcagattggtagcgcgctaccttggggtggtagaggccgcaggttcaaatcctgtcactcagaccagttaaaaaccgcttgattgtcaaaatcaagcggtttttttgtttgccgttttagccccgacatatgcaggctctgcggatatatcctattaaattataacacgccccaccccgacatctcctgcctatacacttattcaaaccgtttcgctttctttttccttttctccgtctgtatactgccggtcgccgttctccctgtcatatgccttcaccgaatattcgctgacattctttaccgtttcgccatctatctgcagtgcggcaggcgaatcaaaccgcactgtgatttcctttccggtcagtacctctaccatctcggtatggctgatatgctcccccttgaagattgaagggaacaccataagcgttttcagctttccactgccgtgcatcacaacaaccgacagcttctcctcgggattgtttctgtcctgttgcggagcggtcatcataccgccgccgtaaaacctgccgttcattgtcggagcaagccataccttcttatagctgtactccctgccgtcaacgtttataaccgcattcgccggcctgaaatgaaacagcagacctttaaccgcaatagatgtataatttatcggcttgtcggatttttctctcagctcatcacccttttcacagcaatatccgtcaataccgtagcctatggcattgataaaccgtgagcttttgccgtttaccgttacgatcggcagatttctgacatattcatttatccttacaggctcgcagccctgctccataccgagatcacgcaaaaaatcatttccgcttcccgtaccgtaataatacagcggattctcataaggatacccgtcgctgtcgtttataaaacggttaagcgtaccgtcgccgccgcacagcacaatatcgctttcaggcgaaatactgtcaaaaaatgtgccgtacccgcttatctgcgtcatattgcaatatttcagttcatcgtccttatatatttccgccagcttttttgcaagctctgttccttttccattgcaagataaaggattatacagtatgtatttcacgctcatgtatgcctccccttaaaaccgacagccgattgcttatgatgttattggtccttcggctctctcggtcttttagtcttttggtatagtataacaaatttaaacggattttgcaatatattgttgtaatttgtcaacacgttggatgaaaaattgtataagttgttgcttgtaagcatacttgcttaaagcctccgggcgttcattttataaggcatccttgcccgtttcttgtcaaaggtgaggtgctgtcgcccacaaaaattcgggcaactgccggaggggatgccactccatcagccctcgccccgcaccaacccttccaaaaccgcactatcccacgccacgcaccgccgcacttggctcccttgccaaagggagctggattgcgacaaggctacttcttatcataaattgtcttgccctgcgattcaagtatatttaatatcctctcttgccctatctgtcgcaagactgagggatcgtcacataaaccctcgcccgtatcagccctctcaaaagtaagacaatccttcgaaaagcactaccacacttgcctttttatgaacgctctgttggtttcgcatcgtgcctcgtcagccgtttgggttgccacatctgtgcatcgacagccatttgtgccgttgcatcgtgcaacggctctgtgtggctgtctttatgcatccttgcataacggctttgtgtggctgtctttatgcatccttgcataacgactttgtgcgaccgctatcgtgcatccttgcacgtttatgaacgctctgttggtttcgcatccttgcgaaactttgggcgttcattttataaggcatccatgccttacccgcaagttgcgtgttctcccacccaccaacacacaaaaagtgtaaccccactcattgagtggggttacactttttggtgccgatggcgggggtcgaacccgcacggtattgctaccaacggattttgagtccgtcacgtctgccaattccatcacatcggcttattaaaatgtgttgtaaaaccgcactgcataacggtaatagcgatttcacagtttgattattatatcatagcggtaaaatgttgtcaatagattttcactattttccaaaataatttagtgtttttttataaaaagcccttgacaatttgttgaaaatgccgtaaaattaatatcgagtaaatatctattataactcaggaaggtcggctgtcttgcaaattttcaccaataaaagacaggacgatccgcttattttacatatatacaattaaatgttgaaatgtaaaatcagccgtgcaggcgcttatgcagttttgcggcggcgtgacacggcaattcagaaaaggaggaacgctaacccatggaagtgtggcttgcagttacactctgtgcggcggcattcgtagtcggagcggcgatattcggttttgttatgtacaaaatgggtatcgagcatagaaaaaagacggcagaagcgcagatagaatctgccgagaaggaagcaagcaggatagtatccgaggctaacgaaaaagctcaggcaacaaagaaaaccgcactggttgaggctaaagacgagatctttaagctcaaagaaaacaacgaaaaagaaattcagaaactcaaaagcgaaaccgaaagagaactcaaggaacgcagagcagaggtaacacgctctgaaagaagacttcagcagaaagaggagaacctcgacaagaagaacgataagatcgagcgtcttgaagaacagctccagaacaagaacaagaaggctgaagaaaagctggctgaagccgaatccatcaagaaaagccagatggatattctcgaaaaaatatccggctttactttagatcaggcgaaggaacacctactgagtatgcttgacagcgagctttcgcacgaaaaggcagtcaagattacagcttatgaacagcgtcttaaggacgaatgtgacgaaaaagcaagacagtatatctcccttgctatttcaagacttgccgccgataccgtatcggaggtggcagtatccgtagtgcccctgcccaatgacgaaatgaagggcagaataatcggccgtgagggcagaaacatccgtgcgcttgaacagctcacaggtgttgaccttatcattgatgatacccccgaggctataacgctttcctgccatgaccatgtaagacgtgagatagcaagaatagcgcttgaaaagctcattcaggacggacgtatccatcccacgagaattgaagaaacagtagaaaaggcaagacgtgaggtcgagcttaaaatcaagcaggagggcgagcgtgccgttatggaaaccaacgtaaacggcctgcaccacgagcttataaggcttatcggccgcctttactaccgtacctcttaccgtcagaacgtacttaaccactcaatagaggtcgctcacctcgcaggcattatggcaagcgagcttggcgttgacgcaactcttgcaagacgtgccggtcttctgcacgatataggcaaggctcttaaccacgagattgaaggctcacacgttcagataggtgtcgatgtctgccgtaagtataaggaaagccccgaggtcatccacgctatcgaggctcaccacggcgatgttgagatacactctgttattgccgctcttgtacaggcagccgacgcaataagcgccgcacgtcccgccgcaagaagcgaaaactacgaaaactacatcaagcgtctgcagaagctcgaagagatatgcagctcttacaacggtgttgaaaagtcattcgctattcaggcaggccgtgaagtaagaatcatgataaagcccgaacaggttgacgatgataagatgatagttcttgcaagagaaatttctcagcgtatcgagaacgagatggaatatcccggtcagataaaggtacatctgataagagaaagcagagctatagattacgcaaaataaaccataaacacttgggagccgttgcatagatttatgtaacggctctttttgctaaagaggtattcttatgaagaagagattaacggcaatacttacggtaatggcacttatgctgacaggctgtgccggaaatgtcacatcgggaacggaaagtcagccggcgtcggacgctcagagcggtatttcggataacgaaagcagtgatacttcatcacgctatgagataatcacagcaaccgaaatggctgaaaaaatggggcttggcataagtcttggcaacacgatggaagcatacgaagcgaccgattgcgaaaagataacgtatgaatggatccccgttgtcggcggaaacgaaccgcaggactatgaaacctgctggggagcggatgtgacaacgcaggaaataatagacggtatgaaggcggaaggcttcaacacagttcgtattcctgtgttctggggcaatatgatggaaaatgacggtacatatacgataaacaaggaataccttaaaagagttaaggagattgttgattactgcgaaaaagcaggcgtatattccgttataaatatccaccacttcgacgaatttatcataagaagaaacgaccttgacaagtgcaaggagatattcactcatctgtggacgcagatagccgagtattttgcggattatccctacacactcgttttcgagggctataacgaatatctcggcggcaatcagtttgattcaagcggtaatctcaaggaacagtccgaaaccaatgcttacaagatgaccaacacgctcaatcaggcgtttgtcgatgcggtaagaggcacaggcagatataacgcacagcgtgtgcttatcgtttcgggctactggacaaacatagataaaacgacttcttcaagatttcaaatgcctgaggatatggtaaacgacaggcttatggtgtctgtccactatgtcgacaactctatgtactggtcgaataaaataggcggcgaggaatggcttaaatatatcgacagccagtgtgccgagcttaaaaaggcttttctggataatgacatccccgtatttatgggagaaacgacatcaacctataccgcaagcaatatggcaaaggacgcaactcataccgattcctccgagtgcctgtcgattgtactcggaaagctgaccgagcttggcatcgttcctgttatatgggataccgacagccatttctattcaaggacgacttataagattgtaaacgagtcggaccgcaaggtcatccgtgaatattccgacaaactgaaagcaaaccttgaagcacagcagtaataacaaacagcagcaacgctactaatcaccgtaccgttgctgctgtttttattattcttttttacccttgttttccgccagatacgccaccgcactgtgaagtgcaacattcccctctccgatagccttagctatctgatacggtctgcctgtgcaatctccgcaggcaaagcacccttttacgcttgttgacatatcacgatttaccgcaacactgccgttattcatctcaagcccgtcaagcagtacatccgccgaaaccgtctgcttcagaaagaacactccgtcaacggcaattatactgccgtcggaaagcgttatcccgtctgcgtgacgctctccgtttacgcttttgacaaagccgggtaatctgataacattttctctcgaataattcgtcttatatgacggacagaaataaaccttctctgcaagctccgccagaaaatccacttcttcttcgctctccttgttatcgctgataacggctatcgttttccctttatagaaatttccgtcacaggtggcgcaatagcttacgcccttgccgagaagctcacgctcgccctttatttcgtttacggtctgtgcgcccgttgccagaatgacagcgtccgccttgtattccttctgccctgcaaggagcataaaatacttgccgatattatacactccggtaatacgttcgcaggttatctctatatccatctgctcaaggtgagcggcgaatctcctattcagctcactgccgcttatttcgggcagagcaggataattcgatattatatgcgagcgttcgatctttgcgctgaggtcggcatttccgaaaagtataaagctcttgttgcgtattcttgcgttgatagccgccgatatgcccgcaggccccgttccgattatcgctatatcatattctgcctgatttccgcccatttttagcaacactcctttgccttattatctgcatttacagtgataatatatcacaatttccccgcaaggtcaagaaaaacggcacagaaaaaacctctttaccgcttgaccggtaaagagggtgcttttatgcaacttttacttcattgctgtacatagtaatcgtttcggacctgccatccttggtagtaacggtgaatacagatttcacacgatatgtaccgctcgatacaaccttgtaattatcgaattgcgctacgcccgagtataccgttcttgtccaaggtccgccctctgtgttccagaaccacagaaaagcaaacttctcaagcgattgttctactttcacacttttgatagtaccgcttgaatcggtaagcgagctgtgacaatgtgcagtagtgcctttgaccgtaagcgtacagtttttggtgccggacaggtcgcactgtaccccctccgccgatacgctcataacaagcgtaagaacaaacaccgttgccagtaaaaatgcgagtactcttttcttcatagtataaatacctccgttgttttatcagggcttaatttcagtccctattaataaaacgtatgaaagaggtactgcgtactgctttttttatcacttcggattattttgtacaaatgcacaaatttcaaacgctgttttgtgcattctgacgtatcattgctttggttttacgctctccgataatgctattagctcatctttgccgagcttattagcctgaaaagaaaaaacatactcgtcattattccacaccagcatattttccatgccgttttcaaaatacaatgccgttatcccgttgacatcaacagccgtaatagcgtcttcggccgtttcggtgttgatccgtgtgccgttgaaatggctgaatgtcatctgagaaaatatgatttgactgtcgccgtctttatattcttctaccatacacccgtcactgttataaaacgtatatctcatatatccgtcaatgccggctgtgattacatattcctgttctatattttccggtgctttttcagtgtcctcaatatgtaacagggaaaatgtatcatgcttttcaagagcgatattattatagcagaccaccgccgccgctgtgattgtaagaacaagggtcacggcaataattatgatatatcgccaacgctttttcgacttatgaacacttttatcaagagtattgtcggctaaataactgcgtatcatcttcttcattctccggtcaaacgaacgacgaatcttataatttgtttttggaatatcggagaaaatcatttcatacatggtttcctccagtgcgatttcaatgttgttcatttttaacctccgtttctttcagcaatatacttctcgcttttctcagcttatatcttaccgcctgatagcttatacccagaatgcccgacatttcggaaagggagcatccgaatttcacattcagcataagtacatcatagtattccttcggcagccgtcttaaagcctgtttcagccgctctacacctatatttgaaagagcagtttcctcgttttttatgtctgattcataaaaatcaagctcctcctccgtaacaaaaacgcttttcttgctttttctgagtatatccaccgccacattccttgctatcactatgcagaacgctttagtctgaggagaatcaacatctttgattttacacagattgtctataatgcgtataaaagtatcgtgaaccgcatcttcggcatccgtccggttgcggactatcgcaaagcaaatattgtaaagagtgtttttataggtgttgtacagcttttcgacaaggtctttttcctcgtcggaatcaaccattgccagatatatcaaaagcaagcaaacacctccgtgctgataatgcaattgagagatttatttcaccttttattctatcactgaatcataatatagtcaagaaaaaaatgaagtatctttgtatgttacgaaagatacttcatccgcatattatctgatttcgtccgccgctttataccctattatatcctttataacttcccctgcgataataagtcctgccacagacggtacaaaggcggtacttcccggcacctgtctttttcccggcaccttatccgccttagaaagacaaccgttttcaccgttcggatcttcgtcggcaatgggcggtatcggcttttcctttgagtataccaccttgagcttctttattcctctgcgtttaagctcatagcgcattacccttgccagtggacacacagaggtcttatatatatccgcaacctcaaatgccgtaggatcgaccttgtttcccgctcccatagagcttataatcggcgttcctgccttctttgcattttcaataagtgctatttttcccgtaaccgtatctattgcgtcaactacatagtcatactgagtaaagtcaaactgatccgccgtttcaggcatatagaaggttctgaaggctgtcaccttgcagtcgggatttatttcctcaattcgctccttcgcaacatcgaccttgtacttaccgaccgtctttgttgtagctattatctgacggtttatattggtaagacacaccttatcatcgtctataatatcaatcgctcccactcccgagcgtgcaagcgcctcaacggtataaccgcctacgccgcctacgccgaataccgcaacacgagagcctttcagcctgtacattgcctctttaccgaaaacgagctgtgttcttgaaaaccggtcaagcattgttacctcctacagagaactgtgttccccttgctataaatgtaacggtcattccctttttatcgaagtagctctcaataaaccgctttatctcatcgtttctctcgtccagcgtgaaatactgtcctccgcagccatcgtgaaaatgcagagttacgccgaaattgtcaagtatcgcccttttaagttccgccgcttcggttatgcttattgccataattcgctcctttaagtctaccgtttctatctgtttaatgtacaatatagctattatacatcgtaatacagcggctgtcaatgttctgcaactgattttttcactgcgtttttctttttcagcagagccgccgcagactgcaaaaagcgtatatcctcctcgcaaagtccgcttatatcaagtgtacggcttctcttatcctcaagccccaacagatagtctgttgtaacgccgaatactccggctattttgattatcgtttcgggagaagggttacgctccgacaattcataattgcttattgccgcttttgtcacccatatcctttcagccagctgttcctgcgtcatgcctgcacttagtcttaactgctttactctttctccgaatttaaccatccgttcctccgttatgaatataaacaatctgaaaacataaaataaacagtttatttatctaaagtgtagcatatatcggatttcataccgttgatttttgtaacacataccgttgactattcgaagcccttgtgttaaaatacaagtacaatatctcataatacgcagataaaacaagagggtaaaatgaaaagatcaacaaatgaaaaagcggcgataattcttgccgtgtcggtcattctttccgtcacagcctgctcagccgagggagtagcttatgttgacggtaaccaaagcggaaccggattttcctcctcatccgccgcaacaagcggtacaatatatgaggaaagcacgcttcctgccaccgtcagcgttacaaccgccgccacaacaacaaaagcaaaagaaacaaccgctgtttcgacaaccgttgcttcaactcctgccataccgccaagaccgcagccatcaacggaagcagtttcttacaagcacttatgcgagatttatcaaaagctgcaggaacagaataaagcaatttttgcactcgagaaacagcgaagtgaccttgaaattgaactgtccgacagcaaaggtatcttcaaagcaaaaaggcgttccgagctttcaacggagatagccggattggaggaacgtatttcccgaatgaaagtccgcttatctcatatcgtaaaggaatacgggtatccgaatgtggaagccttctacaaggcatttcataaggcagagacagcttatggggattatcaggacagccttaagaattggaaacaacggtatggagaaaagccgcagtctctacacgataggcttaaatctaagaaacaggacattagggagcgagagttaacaagaccatattctccaccaaaccgtggaaggagtagataacaaacgaaaggaggcaattgcctccccttcgtttgttatctctccgtaaagactggaatttcaccctctcgcataaagatacaaattatttttctatttccttatcatatatcttttttgagtataccacagttacaattgttgctaataataaataaatcaacataaagattatgccagtcatcccacttgtaaatacggttgtaatgatagtcaataaccccgtaataataatacatattgcaccaaagcggttactctttctccatgtattatcattgtgcatactccaaacggttcgaactcccactactgcatttcgttttgcctttgtcataaaatttcctaatacaataaatataataccacacaaaatacatgaaacttttgcaatgtcaataaccgcatgttcaccacctgcatttgcctgtatccaagaagaataaagaataaaataatgcataatcccgaacatgattgcttgcgaaattcctacaacacataatacctttgcagaagattttgcttccatctgttccttttctgtatttgcattttttgattttttctcaaacacatagattagcaagtgccaaaacagtgtaataaacaaaataattaccggaaaaataaagctttctgttttacttccccatctgtcagtgtttccctccaagtcatgatgcataggtataatatcaggcataaactgtagtacaacacttgtaactacaactggtatcattgctactatccacattatttttttcatactttttttcctccaaactggttaacccatataattaattcatcgaaaaccgtagtgttgatttcataataaacaaagtttttctctttatattcagatatcaaatctgcgttttttaataattttaaatgataagaaagagcagccggtgtgatctgtaatttttcagcaatctctccagcatttaatcgctcatttctcaacatcataagaatggctcttctctggctatctgccaacactttaaaaatgttagtttctctcatatcttttacctatttaaaaatctctttaaatagattatagcatacgttttgtctttttacaaggactatttaaaaatatttttaaatagagaggacacactgaaaaatcaatgtgtcctctctatttaccttaaggcaaaattcaaacatctagaaacttaagattcctgcctcttattatggaataaccgtacgttctatatatttttctggaatttttagtactagacctctatcatgatattatattagcaaaatcaccacgtatctaaacgatcctctgcatcaacccatacttgcatttctccatccaagtataatcttgcatattctaatggattatcaatagccaaagcattcaacgaacactgggagccgggagtagttctcaatccttcctctgccttattgcaatcaattctaagcactacattttcaaacgtggttacatctatgctattacattgcggattatatcttgcataaatcaatctcatatcttatctgtcctttccttaattttctaaaagttttgaaagcatttcaatccgttcttcctgccattttcatttcatgttataatttgttactggattttctttcccttaattttgcccttgtgagcattcgtaacatgagggaaaaggatataacacaagggaaagcataagggcaaactcactcgctacaaatttagcattttcaaggggttgcggacttcacgaggataagatataacagttaataaatgttatgaattaagtcaaatcaaaactggaatttgatatcctctgttatccaacacttcccacaaaatttcatatatttgctgttgtagcagtctgaaagcttcttcttcgactttatcggggtgataaaatgtaatcgcaactctcataggaatgtcgtctacaccatgccatgaactgccatcaggattataataccatatatgagtgcccatatcataccgttcttgcggaaatcccatttctacttgaaatgtatgaacagcttccctgattttcttttgaaaatccgatgtattaaacccacgaacaagccagctgtcacctctttcatgctctatcgcaatacaatgaatttgtagtaaaacgcctgcctcaatataatcagaaacacaggtttcaaatcttccatgccatttatgttcccagtgcttacaccaatacaaatcttcggacatatgtattttgccgtcacatgatttttccacattgtttttcttcgttattttcttctctcttttcaaggctttctttttcgacaaacttttatgccataggaagccttctgttaccaataagaagcaaaaaatcagctctattataataaaaaatatgttccccataatttttcattttgctttcaatataaattctggtttatcggtctgtccgaccttgccttattataccacatctcaccgaaaaagtaaaggacggagagttactccatcccataaaaatttaattgacctcggctataatttcgctgtcaagagaaatgttttcaaaacagtcttgacattttcctctttctgtgctatgggacttcttgctgttactttcttttccatagtaattccgcctttctgacagtcgttttgagctttctacatattttaggcacagaaaaaccctgtacccgacggtttaaccgtctgatacagggttatctttttatctaccgagttcaaggctcattaccaatgtgatgtcctcccattgattttgccttaaatacttgccgtttgccttttggtaggctcttgccatttcaaaggttatcggaaaatcccattgtatagcgattctctgattaattcctttctgcaatagctgcctgtgcggctgagaatacaccttctgccgtatcacagcaggaaagcagttctgcggtatcgtctgaatataaaacgaccgcactgaccgaagaatccgccaaagaaaccgtaaagctgaatatgcccatagcggacaagttttacgctatctataaccgttgcagcctgcctgtagacaattccgcatcggtaacagatgataacggcttttgctactctcccgtagaaagcgtttatgatactctcgcctcgcttaaagccgataccgagaagtatttcacgaaagaatatcttgacagcacgttctataagaaccttgcggacgaaaccgcattctacaaggatataaacggcaagctgtacaaaaacaccgacgctgtttccgacggaaagaatatatgggatactacagcctgcgtcatttccgatattaccgatacaggctttaccgcaacagtgccttatctcgacttgtacgaggctcaccgcagtgcaaagattgaatatctgcttgataacggaacatataagataaacagctggacattgaatcttgacgctatatgattgaaaaatccgctttaatatcaaattatccgccgtcacggaattaaccgttgacggcggattgcttttttgctgaaaaaactctatcgttattaaaaatggggtttggggcgtagccccaagcgggatgagggcggcagccccacactcagccccacattcagcccggcatggatgccgggcatacacagcctttcacacgggggaatgggttttcggcaaggatgccgaaataaggacacaccaagctttgcacgaagcaaagccaacagagtgtcctaaaggggatagggattgcggacaagcacctttttgaaaaaacactttttctacaagctgttatccgccgtcacggaattaaccgttaacggcggattgctttttgtttgtgtaaatctatattttacagcatatgcagcttctttgtagcatacgcattcagcgacatatcagccgtatttcctgccagatactcataatatccctgacagcctatcatagccgcattatcgccgcatagcgaaatatcaggcatatagaactgcttgccgcaggcacgcgccatttccgacagcttgtcacggagcatagagtttgccgctacaccgcctgcaagtgcgagctttgtgtaaccaagctcatctgccgccgccatgaatttttccgcaagtatagacgtgatagtgtcctgaaagcaggcggcaagcgaatttacatccgtttcaatgcccttttgttcgttgttgtgtataaggttgataacagcggttttaagtccggaaaagctgaaatcatacggatttttggtcgcaggtcttggcagcttatacttctttgcatcaccctgctttgccgctctgtcgatatgcactccgccgggatactgaaagcccattgctcttgcggctttgtcgaatgcctcgcctgccgcatcatcggtcgtcttgcctaccgtttcaagctccgtatagctgtttacctttactatatggctgtgtccgcccgaaaccacaagacacagatacggcggctcaagctcagggtgcgttatgtagtttgccgctatatgccccttgatatgatgcacagcgataagcggcttgttttttgcaagcgcaagcccctttgcaaagttcaccccgacaagcagtgcgcctataagaccgggtgcgttcgtcaccgctattgcatcgatctcgtcaagcgtcatatccgccttttcaagagcctcggcacatactccggttatattctcgcaatgtctgcgtgaagctatttcgggtactactccgccgtacagcttgtgttcgtctatctgagtggctataaccgacgaaataacttttcttccgtcctcggttattgccgccgcagtttcgtcgcacgagctttctatggataatatcttcatcttcgtcatccttgtttattcttctaccgtataatagtcgtgattttcatcataaatatcaaagcccagatccatcagcttctttgtgtcggcatagcggttttccacctctccgccatacaccagtgtaagtatcttcttgccgttcatacctgcatatcctataaagcagaagcctgcctcatcggtaaatcccgttttcattccgtatacctcataaggaattgtggtatcggtaaggagcttgtttccgttatcccagctgtgaacattcccctgctcgtcatatactatagcaagcggctggcaggttatatcgcatatcgtctggctctgcgttgccgcaattgcaaactttagcatatcctccgccgtggtataatgttcatcatcgtgatacccgtccggcactgtaaagtgcgtattttttgcgcccagcttctttgcgtaatcgttcatcagcaccgcaaaatacgctacagcgtcattatcgcttatatcatcgccgtacagcttccttgccacgtttaccgctatggtatatgccgcatcgttccccgaaggagcgagcatagctgtcagtatctcgtttctgcaaaggcttgagccttctgcaatccacgacatacttgaatcctgcgcaacaagccccagctcactgcccacataatactcatattcgggcgcagtgtactcaatggcagtgagtgcggtaagtatctttgtggtgcttgccgggaacacctttttacccgcattcttgctgtatatcaccttaccgtccgtaaggtcgtaacatatagccgcattgcatctgacaaaatcgtcaccatatgatttcacaggcagcggcacttctgttgtaaccgctgtggtggtcacggtcgtggttgtctgagcaggcattatcacctcaacaacagagttgtcgctgctgttcttgttgttcttgcccatagtcagatctacagtaccgcatcctgcacttgccgcaatgattaccgccgcagtaacgcccgacagtatcactttgaaaatgttattctttttgcgtgtcgttgacattgaccctcccgatagacagtgttcgcttattccttttcgctatcggcttttattgcgttgatacgctgtgttgcttcctgctttaccttatagggtaatgttgtgagtatcatctcgaccattcttgcatcgggagagaatatcagcattgttctgccgtgcgtcttatgctttgcaatgagatagtaagcgtttatgttcgttccgtcggaagctattacggtagcgtccgcattagttccgttcgtgccgtcataaatgccgaattcctcaactgtattcattttcagcgtaataagacgttttctctttctcttgcccgtaatcttgtctatatcaagatcgtcattcgtaagtatatattcatactcatagctcatgcccgtaagcagccacacaagaccgaagagtgcgccgacagaaagcattgtcagaatcataaatccggtaaagaacgaaagccacataagtacagtagctaacgccagtcccagtaccgcaatgcctattctctttgcccagtctgcacctgttgttgcctttttaacaagctgttcaccaaatgtatccaaattgtacctctttcccgccgtcctttgcgacagcctataacatacttattttattttaacataaaacaagctctttttcaagcggattttgtctgtaagcacaatttcaccgttttttcatttgacgtcacttataacggataagctaatgttacgctttcaccttttttcgcagatataaaaatgcccaccgcaaaggtgggcacatcagactgtcgataaacctatataatttctgaaaatggggtcgcaggggcgtagcccccgacagggtctaggggcggtagccccagtaaaatccccctttcccggggaaagggggcagggggataggggtagtgagttagaagtttgtttcaaaaacatactttttctacaacatttttatgttcgtttgttattgataacatgtaaaccatgtgcttgcacaaagtgtaaaccatgttactcttgacacgagcccctcccctacgaaaaattatgcacgaagctatacatattatcaggatagtgcgttttttaaggtcaatgtcagtgcagttgcactgatacactcacgaaattattaatgccttatcggcaagggaagtattttaagcggtgttggcgatatatttcactgtgtagcttttataaaaatggttttttcggcaaactgaaaggcggtacccgtataatgagtaccgcctttattactcttattttcccacgcagaagcgtgaaaatattctgtctattacctcttcgcttgcggtctttccgctaagctcataaaggctgctaagcgccgcttcaagctcaagccctgcaacgtctgcggtcatacctccgtgaagtgcgttataggctctgtcaaccgccgcctgtgccgataaggcgcactgccgctgacgctcgtttgcgaggaagcctgcgcctgcgtcaaggttgcttattccgcaacgctgttttatcgcctgttcaagctcatctgcgccgccacctgtctttgcgctgattattaccgctttaccgagttcgttttctataaatgccgtgtccgcccttgcttcaaggtcggatttatttattatggggattaccgtcttgccgtggagaagctctatcagccgcttgtcgtcatcggacagctctcttgagccgtcgaataccgcaaggataagctgtgccgtgcctatgcgttctatcatacgctgtacgccgatgttctcgacagtatcttctgtttcccttatgcctgcgcaatcggctaacttcagcattatatcgccgagttgtaccgtatcctcgactatatcacgggtagtaccctcaatatcggtcactatgcttttctgtacgcctgtaagccgattcataagcgttgactttcctgcgttgggctttccgactatggctgtggcgatgccgtttctgagtatctctccgcagtcgtacgttgctataaggctgtcgatattttcttttacggcggtgacgcttttcagccagtccgcctttgctatttcgtcctcgtcctcgctctcgtcgggataatctatccatacggctatctccgatgtaatagctattatctcctcgcacagtgcctctatcctgcggtataatgcgccgtccgtctgcgctctcgcacaggaaagaagctggtcgttgcctgcgtttataaggtcaattacaccctcggcttctgtcagcgacagcttgccgtttacaagtgcctgctttgtaaactcgcctgcctgagccattactgcgcctgcggataataccgcctgcagtacccttttggtaacgtggatgccgccgtgacaggttatctcggctgtgttttctccggtatagctgtggggcgcacggaagattaaaagcactccgtcatcgagctttgtaccgtctgccgtaatatctccgtatgcggcggtatagccgtccatcttttcgatatcacgcacggggtacttcggtataaatacctttgccgcaactttaagtgcgtccgctccggatattcttatcattgaaacaccgccgcttgccataggtgttgatattgccgctatgcagtctgccattatatcttaatccttcttaccgaataattttgcgaaaaagcctttttttgccggcttttcgtctgtctgttcttccgtttcgtctttgtccctgctgtcgctgtcatcgccgttatcgtaatagctttcttcctcctcttcggaaagcgccgtttcgataaagctctttttgagcagttcctctccgctttcgttaagcgtatatgtccacagctctgtcggagtatttataacaaaatcgtctatattatcaaggctgagaagcgtctgaagccgctcgcccatagtatctatcacctgctcctccatacctgagaaaaattcctcgcaggttatgttatactcgtcggcaggattcttgccgcctattctcgtgaggtggataccgtcacgcagataggaggtgtaatcgagataatcgctccagtattcgtttattacctgtaatatgacacgcttctgcagggcgtttaccttgtcctcgccgaacttctgtgcggcggtgctgtaatcatcggcaaattcgttctgccatatatcgacctcagactcgcctgtcaggaatgctcttcttctgccgaacactgcgtcacggtgcttttcgcctatcatagtgaacttaagcaggcgcttacgcaactcgagcgtatcaccctgtgctatacgctgaattcggtctacctcacgcagtacaatcttatcgtcaatcggtctgcccgtttcggcggtgggataatgccttttcggtattaacttctttatctcgtattttgtcataatctcgtcttcaagtgagattatgaaacggctctcgcccacatcgccctgtctgccgcttctgccacgcaactgcatatcgcctcgttcgctctcgctcataaatgtgccgagtatcagcagtccgccagccgctacagcctcgtccttctgcgattcgtcagcgccgcccagctttatgtcaacacctctgcccgacatattggctgatatggtgacagcgccgggtctgccggcttcctttattatctcggcttcaagctcatcgttctttgcgttgagtacgtttgcggtgatgccctctgccgcaagacgaccactcagctcctcgctgagctcaatgcttgacgttccgacaagcacaggctgattctttgcgtgggcggtctttatgcagtcaataattgcgttgtcctttgccgcttttgtgagatatacttcatacgggtgatcgacacgtctgcagggcgtatgggtaggtataacggttaccttaaggtcgtataactgccagaactcgtcctccgagcttttcgcagtaccggtcataccgctgagaagcggataacggcgcagatagaactgcataggcacaacgcccattataacgcctctgcttgtacaggtgatgccctccttaagctcgaccgcaggctgtaacgagccgggataacggcggttctctgccgctctgcctgtgaactcgtctattattcttatattgccgtccttgacgatataatcgacgtcctttttaagcagaaagcacgctttaaggcaatccgtaatgcgtatcagaagctcgttgttctcctcgtcataaagccctgagccgtccgttataagctcctcgcacttgtcctcgcccttttcggtaaggtagatagtgccgagctcctcgtttatctcatacatactgctgtcaaaatccttgacaaactcgtatacctcgggcagcttttcatcgggctttacggcggtttcacctgctattacaagcggtactcttgcctcgtctatcatcatgctgtcagcttcatcggctatgcagaagtcgaaatccgtctgcacgcagtcctcaggcgtatttgcaacgaagtcacgcaaaaagtcaaagcctgcctctcttgcggttatatatactatctgatttttatacagctcttttttatccgcaatatctgtcgaatgtaaaatacaagccgagcttatgccgagtgcgtcatatatcggcttcatccactcgctgtcacgctttgcaagataatcgttgaaggtgagtattctgacattgtgaccgtttttcgccatatagcttgcggcaaatgcggcgcaaagcgtcttgccctcgcccgttttcatctcggtaatcctgccctttgtaagctctgcggcggcggtaagctgttcgtcataagggataagaccgaggtattccttgcttgcaatagcgcaggcggcgaatatctcattcatatccgtactgtctttaaactcgtctattgtgccgacctcggcgagtgagcgtattttttcgatggatatataagtttcagccatttttgctgtcctttcagaatagaattattgcagtgccgtgaaaacggcattttaatgctgtctcggcttgtagaaaaagtctgtttttgaaataaacttctaatttattatccctatccccaaacccctttcccccgtgaaaggctgtgtatgctttgttggctctgcatcgtgcagagcctttgggcatacacgcccggcgtccgtgccggggctgagtgtggggctaccgcccctagtccctgtcgggggctccgcccctgcgaccccattttcaaaaatcatataggtttttcgacagtcagaaacggcatttcaaagccgtctatatcgtttattttaccacagtgaaatgaaaaaagcaattatttttaaaaagcacttgaaaaatacggataaatgtgcgataataatattattatggcggttttatgccacacgataaattactaaaaatctgtaaaggaatgacttactttggataacaaaaaatacgcagtaatacttgccgcaggtgatggcaaaaggatgaaatccgacaagccgaaggttcttgccgaagtgctgtttcagcctatgctccgctgggtgcttgacgctgtaaagcaggccggagttgacaataccgcagttatagtcggcgctcacaaggagcaggtaacggcttatcttgatacgctcggcgaataccccgcatttgagcagaaggaaaggctcggcacgggtcacgcagtaatgcaggcaaaaccttttatcgaaaaggcgcaggctgaaaatgcggatatactggtagcgtgcggtgacgctccgttcattgacgcagacaccataacaggctcttatgagtatcacaaaaacagcggcaacgatgttacggtagtatccgcaattgtcgataatcccacaggctacggcagaataataaaggaaaacgatactttcaaggctatcgttgagcagaaggactgcgacagcgaacaggcaaaggtaaaagaaataaactcgggcatctactggttcagggcggaaaagctgtccggacttttagataagctcggcaataacaatgccgcaggcgaatattatcttaccgatactgttgccgttgcggaaaagaagggcgtatacacagcagacagcacggacgttgtactcggtgcaaacagccgcagtcagcttgccgctctgaacgaagtcgcaagaaagagaaagctcgctgagcttatggacgatggtgttgatattcctctgtcggacggaatcataatcggtaaggatgtaaagatcggtcacgatacggtaatacttccgaatacgataatcaagggaaaaacggttatcggcaacggctgtgagataggtcctaacagctatatagccgactgcgttatagaggataacgttatccttaacaacgtacaggcgcacgaaagcaaggtagacagcaaggctaaggcaggtccgtttgtacatctgcgtccgaatactcatctgcacagcggtgtaaagataggcgactttgtagaggtcaagaactccgaaatcggcataaacacctgcatagcgcatcttacatatatcggcgacagcgatgtgggcaagggtgtaaacttcggctgcggctgtgtaacggcaaactatgacggtataaagaagtaccgcaccacaataggcgacaacgcatttatcggctgtaacacaaatttgatagcgcctgtaactatcggggataatgcgactactgcggcaggctcgactatcacgaagaacgttcctgcggattctcttgcggtggaacgtggtcagacaagaattatagaacactgggaaaagaacagcaagcgtataaaaaaggcataaggaggaaaacaggtggaggtttttctttcggtgctgtcggtcgccggaatcattctcggcgctgtactgctgataatgataatatcccttctgctgtccgctatactttatgagagcgttttcggaaagcggttcgagatatacgattccgcacatctgcccgaccttaacgattataaggggcttgtaaatgagccggtaacattcccgtcaaagcgaggctataaatacacggggttttactaccacgatgaaagctatgacagcttcagggggcttatagttttctcacacggcatatttgacggacagctcagctatctgcccgaaatagcgtattttgcaagacggggatacaagatatttgcctttgacaacagcggcagtcatttaagcggaggaaagtcactgcgtgggcttcctcagtcggcggaggatcttgatgcagcgttaagttacgtcacaaagacaaacacgcttccgctgtatctgttcggtcacagctggggaggatatgcggtatctgctgtgcattgctatcatctttatgacataaaggctgtattcgtacagagcggatttgaccaaacaagcgaaatggtgcttgaagaaggctctgctatgatgggcagatggatatatatccttagagcctatataaagctgtacgagcgtatgaaatacggcaaggcggcaggctacacagcccacgcaggaatagcgaaagcaaccgcaaacggcactaagttccttatactgcacagcacggacgataagacgataagccttaaaaacagcgtacttgccaatgttgagaaaaacgataatatcactcttataaccgaaaagaacaagggccacaactctcttgacagcgacagagcaataaagtacaaggcgcagcttgacacgctttttgaaacgacctatccgaaaaaacaaaggactaacaagaatagaagagaactgttcagcgaaaaggtcgataagcagatatactacgagcttgacggcaagctgatgaagctgatagccgatttttacgaaacggctcagagtgggaagggtttcagcagtgcggggtcgcaggggaaaaagaaaagtcataaataacgtttgacgttataaaataaggaaaatcaggagataagaagaaatgaatattttcaagaaaataccggcggtgatagcgtctgttgcggttattgtatcgctctcggctgttgctgtatcggcaaacagctatgttcccgaagtatccgacgtggtaacggaagatattgaggtcgtttttgattctgcaacaaaagcacagcgtgagcaggcacagcagataatcgccgactatatcgccaagaacatacccaacggcattgcggacgtttccaagatggataaggttgcggcgtatgtggcgtcgttcacttacgacaagagcaattccgatccgtatcttatggtgctcaacggttcaggcaatccttctgccagtgcaaaactcgccgtttatatgctgggcgaggtcggtctgaccgcaaaaataagatatgcgtacagtgaaaatgaagagatacctatgaaaacagccacatctatggcgaccactgcggtaaggctcggtgacggatcggtttatctgctttatatcggcggcgacgtactcggtcagaaaactttcatttcacagaagttgaattcacgattcctttataaagagatctcaaaaaacaaatacgctgtttattcgtggatacagtttgacgatgaggtaaaaggctatgacaaggctaccaagaccgttatgaatatccccggatatatcgacggtcacaagatagaggtaatagcagaagagtttaccagaggctgtatcggtgtttcaaaggtaaccatacccaatacagttaccgagatccggcgtggcgctttcgtttacacaaagcgcatacagagcatttctatttcaagctcggtaaagactatagccgccgatgtattctcgggaaacaactgtcttaaattcactgttgacagcaacaataagtatttccaggctataaacggcgatctttactctaaggacggcaaaacgcttgtttctgccacaggttcgtcaatgacaaaaataccgagcttcgttgaagttatcggcggcgacgcattctgcggaaacaaccatatagttgatattacgattcctgcaaccgtcaagaagataagctatgccgctttcgcttcatgcaaaaatttacgcaatgtaataatcgagggtaacggacttaccactgtcgaatccagagccttccagacaacgaatctgatctcgctcaacattcccgcctctgtgacctctttcagttatgatgctttcgactgggctgaaatcatacttgtaatctgtccggatggagagatttcacaaaagctgacaggcagtgacgaaattcaaaacctgcttgttgatacatcaggcacatcgaccggcagaacatttaccaaaaagcccacctgtgagagtgacggcgaactgaaagtcaacttttcaacaggttcgtcgaaaacttataccattccgaagtcgaatctttatcacgattataaggtcgatgcaataaagtcggaagcctgtgcaaatgacggcagtataacttaccgttgcacggtctgcaattcccacagaaccgaagataccacttatgccacaggacacagcttttcatcgacatggacgctcgacaaagcgcccacctgtgccgagcaaggctcgcagtcacgccactgtacgaagtgcgataaaaagacagatgtaatatatgtttcccccacaggaaaccatacttataccgcctggaaaacaaccaaaaatccagactgtactaaacccggtgagcaacggtgcagctgcacagtctgcggtaaggtgcttacaagagagcttgatccgttgggtcataaatacgttgataccgtggtcgatgcgacctatgacgcaaagggctacaccctgcataaatgctcggtttgcggctcttcctacaagtccgactacaccgacattctcgttctcggctatgtcaagaacctcaaagtaacccgtcaaaacccaaaattcataacgctcgagtggtcaatgtcaaccgatggcagcggctatgaggtcgagcagtacaagggcggcaaatgggtacggatttccaagaccgacagcagtgccaattgcgctctcaccgtcacaaatcttactcccggtacatcctatacattccgtgtaagactgcgtaaagtgtcaggttctaccgttcagtacggcggctatatcagagccgttgcaaccactgttcttcccaatgtaaccacattcacagcctctcagacgacaagcaggacagtaacgctcaaatgggataagaatgccgatgcgacaggttatgttgtcgagcagtacaagggcggaaaatggactcagattctaaagacaacaggcaacacaaccttacagtgcacagcatcttcactcgctcccgaaacacgctattcattccgcatgaagtcgtataagaagaccggcagtgccgttgtctacagcgattatacgaatattgcggcaactacaagaattgcgtgtgtttcaggtcttacggcgaagtcatcaaccgtttcttctgttacactttcgtggaacaaggttgcttctgctacgggatatgtcgttgaaatctataagggcggaaagtggaatacagtccttaccacaaagaacaacactgctctttcctgcaaggtaacgggtcttgcggcaggctcaacatataaagcccgtatcaagtgctaccgccttgcaaacggtgcgtactcattcagcgaataccttgaagctgacgtgaacacaaagatagcaaacgttacaggtttcaagtcttccggcaatacagcatcatcaataacattctcgtggaataagaataccgccgctacaggctatatcgttgagatttacaagggcggtaagtggacgcagattttaaacgcaaaaagcaacacaacccttacctgcacagcaacagggctttcggcaaatgcaacatattcagtgcgcataaagtccttcaaaaagacaaccgcaaccacatatttcagcgattatcttacgttctcagccgacacccgtatacccaacgttacaagccttacatataaagcggattccgcttcacaggtaactctcagctggagcaggaacactgcagccgacggatatacagtagaaatctacaggggcggaaaatgggagcaggtgctgtgtgcaacctcgaacacaaagctttcctgtaagataacaggtcttgcggaaggctcgacctattctgtacgcataaagagctacaaggtgaaaaacggcaaaaccgtattcagcgaatatctgaaaagcactgctacaacaggtcttaaccccgttgcaaagcttggggagcagacaaacagcacagcctcatcaatccggttttcgtgggcaagaaaaagctgtgcgacaggatatatcgtagagatctataagggtgggaaatggaatcttgtaacaaaaaccacctcaaacacagtcacctcctgccagataacgaatcttaactcaggtatgtcatatacctgccgtgtaagagcatatcttaccgtaaacggttcgacaatatacagtgataatgtaagaacggtgcagacaacaaaataatatcacggctttacgagcgacggttttatgaaccgccgctctcagtttgtcgaaaaacctcttgtttatcgaaaatggggtcgcaggggcatagcccccgacagggactaggggcggtagccccagtaatatagccccttcccacggggaaggggtttggggttagggattgagaacaagcacttttttggaaaaacagactttttctacagtctgcgagcgacggttttatgaaccgccgctctttttttgtctgttacacagccgtttccctctttttaacttaacttataaatgtaaatttcgttagtttcatgaaacgttacattaagtaactaaaaaacaggctaaacgaccgttaaagctgttatttaagctttaaagcagcatcgctcagtgaaaatattacatataactgtgctaaatgcacatatatcgatttaaactgttgtgcaattcacagaaaaagccatctttgttaagtaaatttagctgaatttgttgactttgtataaagtcacatgatattataagacaaagctaagaaaccaagaggctatatcagaataatagcagaaggagtgaaatcatgacaggttttaagaaaagactggcaagcacggcgcttgccacggcgatgacgcttacagctttacctgtatccgtgtttttcataagcacgggtgcggcggccgagggtgttccgagcggatttgcgtatgcgcagggaacaaggttcatgcttgacggaagtccgttctactatgcaggcacaaactgctactaccttacgttcaaatcgcaggaggcggtagacaacgtattcaaagatgcagaggcgatggggctgaaagttatcagagtctggggcaaccttgatgtaggtgtcaagacaggtacgacagacagcgaaggaaagccggtatttacaaacaacaatgacggcccgggtgaaaaggacggaatatattttcagtatttcgacaaggctctgggtaagccggtaacaaacttcggtgaagacggcataaagaagctcgactacgcattatatcaggccgaaaagcacggtataaagctgcttatcacctttactaactactgggacgctttcggcggtatgggtcaatacgtcaagtgggcagaggagcttggcataaccggacttaaaaaagacgacttctacacaaacgaaacgctcaagggctggtataaggattatgtcaacggtctgctgaaccatacgaacccgtatacaaacagaaagctgaaggatgagccttccgtatttgcgtgggagctttcaaacgagccgagatgcaataccgacgctcagtgtaaggacaatatactttataactgggctaaggaaatgagcgaatatgtaaagagcatcgatccgaatcacatggtatcgctcggcgacgagggcttttacaataaaccttacgggtattacgacgaatatactacatccaattatgccttttacggtgcagagggcgttgactttgaaaagctgatgacgatcgacacgctcgacttcggcactcctcatctttatctcgatcagtggggaatgaagcacacaggcacaggacaggacgatctgctctggtttaagatacacggcgaaacctgtgcggagcttgacaaacctgtcattctggaagaattcggtcttacaaacaggactatccgtgacagcgagtacgagcagtggttcgaggtgcttgagggcaatgtctacgaaacagtcgaatacgcaggcacaaactactggatgatagcctcatacattgacggtgcgctttatcccgactatgaccagtataccgtttacggtccggagggaacagataccgaaagcacaagacagcttatcatgaagcacgccgcaaatatgacggcaaagaataacgtcaacacgatagtaagcgacaagctgagcttcgacagagcggacaataccgaccttacggtaacagcaactatgaaggagggtgcaataagcggtataacccttgacggaaatgcgcttacagaaggcaaggacttcacgataaacaataactgcgtaactataaaggcgagctatcttaaaacactggagcttaaaagccatgtgttcacgcttgactgcacggcaggcagcagcccgaagttcaccgtaaacgtaaccgatgtatccatccccgcaccgacgctcgataaatatatcgctacagttgacaagaacctgcgtcactataagcaggtgaatgttggctatgacaagaaaacaagcgaattcaggggcataacggtaaacggcaaatatctcacggcaggtacggattataccgataacggcggcttagtcacattctctgacagctttataaaatctctcagcgaggacaatgtaacgctcgtgttcgacttctatgagggtgcggattgtgaattccagcttaccgtaacagacacatcggcacttgaggatatagatacttttgaaagctacacagacgatcatcagctacgcagtgcgtatacaccgaatacaaacggaaacaacgtaacagtttcgcttgttgacaacgcaaacggcaaagcgatgaaatttgagtacaatgtaggctcgcccaacggatacagcggcgtaaaccacgcactttcacagcgtaacgttgcacagtacaagggcgtcagcataacccttgccggcgacaacagcggcaacacctttacgcttcagttcaaagataagaacgacaactattttgaaaaagaattcgctgtagatttctacggtgaaaaaacaatcaagataccttttgaagaatttaacgctccaagctggcaatcttcctctgctacgcttgacacaacgggtatcgtacaggtcgcattctatgcaggccgcagaggtaacgccgacacaggcgcttatataatcgatgatgtatacttctataacgaggaacaggaaaccgagggtgcacgccttatcgacaagacaggcacatttgacggctctgctcctgcggctgtacttacaaagctcgtgctgaacggtcaagctatatcaaagataacctgcggtgacaaaacgcttaacagcaataccgactactcgtggaacggcagtcaggtaacgctcaacacaccgtttacacagactcttgataacggcaaatacgaaatagtatatcacttcagcgacggcactacagacacttttattctcaccgttatcaattctgcggtcacagatgatattacggttgataatgtcacaaacttcacaagcacaaacgcaaccgattcctcgctcactcttgcgtgggacaagaacaacaaggcagacggctacactgtcgaaatatacaagggcggtaagtggaacgagatatacagcggagcggacgcatcctgcaccgcaaaagacctcagggcttcctcgacctataccttccgcataagagcatacaaggcttcgggcggtacaacatattacagcgactatgtaagacttgccgctaaaacagcggaaagctcaagtgtttcaaacgttacatccttcagaaaaatctcagcgacatcatccgaacttataataggctgggcaaagaataactccgcagaaggatatatcgttgaacagtacaagggcggcaaatggacggaagtgttaagaacctgcacaaatagcactgtaggctttatagcgggcgaccttaaggcaggcacaacctacaccttccgcataagagcatacaagacctcaggcgacacggttatctacagcaactatacaagacttgccgctgtgacaaacgcaaactaaaagcataataacagcaaacggagcatatcaggcagatatgctccgttttacttgtataaatagtctgtttttgaaataaaataaacttctgatttattatccctatccccctgccccctttccccagaaagggggtgaatgtggggctgccgccctcaccccgcttggggctacgccccaaaccccatttttaaaaattatgtaggtttttcgacagaccgaaacggagcatatcaggaagatatgctccgttattttttttattcgaattatctgaaaagcgtacattctccgcttttcctgtaatacgctatgcgttcctctattacctcacgggtggtgttgtaatactccgcaaggcaatctatgcagaaaaactcatcggcattgcgtgtgaccagctttctgtaaatcgctatatcatcgccgccaagcaaagcgccgcacttcttgcaggtcttgtagtttgccattacagctttactacctttgcagtatataccgcacagtcgtgaggctgtaaggtagttacatatctctcggagaatctgcctatatcctcgtgcgaccagcaatcgtgcatttcaagacctctgcctgccgcagtgctgagacctatatcccagaactgtaacgacatttccgcaggaacatcgctgaagttatacatacctatagcgtagtcgccgttggcgagcggctttacaagtgagaatacgttttcggggttgttccactggcttatgcggtagggtcctctgcactcaatgtcctggtttattgcgataacttccttattggtcagtatctcctttgtcctgtcggtcatatgacggatatcacaacccatcataagcggtgaattcatcattgcccacagtgagaaatgtgtcttgtactctgtatcggtacagccgccaagacccttgccttccttattgccgaactgatcgtcgctctcgccgtttatgtactggttgttcgagccgccgtgcataccgactacgagcatatctatatcattgtgacagaaacagccgccgtaacactcgttgcccatctgcgacagcgcaaggcgctttatcgactcccagttatcctgaatatcgcctgtcgagcggaaaagatgagctccgctttctcttatccacttgtatatatcgtcattgccccagttgcaagcggagaacattatcggtctgccgcagtttctgagggcggtagacatacgcttgtagagtatctcgccgggtatatgcacaggcttatagcaatagtcatatttcaggtagtcaacgccccactctgcgaatgtttctgcgtcctgaaattcgtgctcaaagctaccggggtgacctgcgcaggtatgcgtgcccgcacacgaatagatgccgaacttaagaccctttgagtggacgtaatccgcaacgggcttgatgccgttcgggaacttccaatgatcaggcacaagctcgcccttttcgtttctctgcttttcgctccagcagtcgtctataacaacatattcatagcctgcgtccttaagaccgttttcgatgaaggcgtcagccgcctgctttataagctcttcgtttatttcccaggtgaacgtgttccagctgttccagcccatagggggcgtcattccgagtaacttttccatttcgccgttcctttcagtaattattcttcaaagctgtcctcttcgtttcttgtattccacagctcgaccagacgctccatttcttcttctgtgagcgaaatgcccttacccattctgctgtggtcgggcgcccacgaacgaatgtcgtacttaggctctctgtcgttccagcttaccatattaagctcaatgttgtacttgccctcgctgataacgccaagctcctgtgttatttcatacttgaattctgccatatcctttgattcctttcttttacggagatttgtttttatgacaataccgcataattattgtcgtgcgattgcttagtcagatttttcgtcagattgtatatgagtgcaagcaggctgacgcctgtcaagcgaaatttgtgcaagatggcggaaaatatgcaagcttagcgtgcggcaaaggcgatagccgttaattgtgcggtgttgccttatatcaaagaggatttaatcctcttctcctgctgttttatccttttttgttttcttttcgggtttttctttcttcaccttttcgggcttctgctttttctgcttcggaagccgtgtatcgtccgctacatcgaccgcatcgaatatacaacggtatcttggcggtatcagcttgtttatatgccttttaccgaaataccacatcttaaactttgccgtatcaagcaccttgtcaagatatgtatttatatggttgcggctggttttgcctatgtcgatgaactctatcattcttgcgggcggctcatagctgattatgaaatccgcctcgttgccatgctgttcaaggttgcgaagcccttcttcaagctcctcatcggtcggaagctcctttatccagcttttctcttcatccggctcaagatagctgttgttttcctcgctctgaccgccgccgaaaacgaacacgttcttttgcgctatcgtgtaatactgccctctcataagctgacgcagattgccagatataagccttgttttaccgccgcaccactgctctacgggatattcttcgagcaggtcgaaattttcgtgtacgccctccgcaaaaagcacgttgtacttctttttgccgagctttttaagcattttcttttcctttttactgccgtcccaaatacagccgaaatcgcccgttattatcagtgcgtcgccacgtctgagctttttcagcaccggggacctgaatcgtgttatatcgccgtgcaggtcgcctgtaacacatatcataagctatatccttcttccgttctcttattgtctttatccgtatttacgatcaatgtatgctccagtcgatcggttctatgccgttgcttttcagaaattcgttcacctttgaaaaatgacggcaaccgaaaaatccgttatatgccgacagcggactcggatgcgccgctgtgaaaactgcgtgcttagggtttgtgataagcggcatttttgactttgcgttgtttccccataagataaatgccgtaggcacatcacgctcgtttaaaagctcgattatcctgtcggtcagtatctcccagccttttcccctgtgacttcccgccataccctcacggacggtaagcgaggtgttcagcataagaactccctgccttgcccagtcggtaagctcgcccacagacatatcaaagtctatgccaaggtcgctgtgtatctcggtaaagatatttttcagcgacgggggcggcataactccacgctttaccgaaaagcaaagtccgtgcgcctgtcccggaccgtgatacgggtcctgacctaaaagcaccgcctttacctttgagtagggcgtgtatttcagtgcattgaaaatgcaatccgcagggggatatacattgtatctgttatattcatcgacaagaaaagctctcagctttctgtaatattcgcttcggaactggtctgcaagcagattgtcccattcgttgcctatgttaaccatttttgtttctccgtcagatctcgtgcgttctcgcataatcgaacaggaactgctgtgctatcccctcgttgccctttatacattccggcagaccgtcggggtataatttctgctcgatacgctttatccatacatctctcggaaaagcgtccgtcttatgatagccgaaaagcagtacgcaatcggcgaccttatcgccgacaccctttatccttttaagttcctcccttgccgctgcggtatccatagcttttataccgtcaagggaaacctcgccgctactcagtttttctactgcgtcaactatgtaccttgctctgaagcctgctctcagcggcgctaagtcctcggcggtaacgccgacgagcttttcaagtgtggggaacatatagcctctgtccgtcttttcgccgaagctctcacacagcctgtcaataataccggtgatacgcttgatattattgttctgcgagattatgaagctgataagcgtttcaaacggctcttgcctgagtacccttatgcccggattttccttgcaggcaagcttcatatgctcgtcctcggagaactgttttatcaatgcgtcatagtcggtatcaaggtcgaagtatgactgccagtaagaaatatcgcttttttctatgtcgtgaacagtataagtgctgtcgccgttgtcggatatttcggcatatctgccgcctgctataccgcagaatctgccgtcaagctctttccagcggaaagcctgcccgcagaaaagcgtgcgccttatgtcaaaccgttcgcaagtgaatgtgtaatccatataatcatctgccgttatctgttttgtagggaaaaatttttgatttggtcttgattatttccgttatatataatacaatattaacagggaaattacaagtccgacgtgaaaaattttttcttttatccccctataaaccgacacggcttttaaattctgcggggttttccgcatatgccgaattttctgaaaggaaacgaaaaaagtgagagaaagtatacttacaataccggtaaacgaagtgttcgagcctcgtgagggctgtcctatctgccgtatgagagatacggttgaggagcatatctgcgaatatataatgggagcggctatgatggagcctgacgtaagacaggataccaacaggctcggtttctgctttacacactatcagcagcttatgatgcagaacaaccgcctgtcgctcggtcttatgctcaacagtcatcttgaggagctgaggggcaatatttttgagaaaaagggtttatttgcgcccaaggacgcaaaggctaaaaaggcaggtgcaataggcgatacctgctttgtctgctcaaaagtgcagtggggcattgaccatatgctcgaaacggtattcacaatgtttgcaaaggacggaaagttcaagaacctgttcaagtcgcaggaatgcttctgtatgcctcactaccactatcttgtacagatgagcgaagcaaagatggcaaagaacgacagagccgagttcataaaggctatggatacgataatgcaggaatatataacaaagctcaacagcgatgtaaacgacttctgcaacagctttgactaccgtaatgcaggcaagctccacagcgaagaaatggaacacgtccgcacatctatagaaagaagcgtttcgttccttacaggcagaaagccgaattcgaaataaaagggatgtaaattaaccgccgttaacatttaacggcgattcacagttaaaccgtataacccgaaaatcctgtgaaaccgcttgaaattttgagatataagttgtataattaagtataaaccacttttacggaggcgtccatgagtaagaaaaacacagcggctaccatagctacaataatcgtagctgtccttgccatagcaacgactttattcctgctgtaccagacctcacagcagcagatacaggaaaatcagtataattacgttccctcagacgaggtaaacgaagaaatgaatatgaatgcggttactcttatcaagaacaactgcgaggtgttcagaatttatctccagtacggtcttccccatcaggcagagccgtataacaatgttcccgaggacggatactacactgtaaaaagcgacagctacaagaccttttcagatattgaaacgctcgtaaattcgacctttgtcggaaaagaggcaaagcgtatcctcacaaacataaacggcgacgatgttgcggtctatgccgaggaaacggacgacgacggaaacaagggcatcggtcttgacataaaaatggtggacgagaacggcagattcaaggctatcgcctatgactacacctggtcaaacgcaaaatttacccttcaccccaagtcaaataccgagtgcgatataatagttgagcttaaccctgcggaagaaacctcgtctgccgacacttcttccggctcggaaagcggtaatacaaagaaaatcaccgccaatatgctcaaggtaaacggtcagtggcggcttcagaagctggtttactgataaatgaacaaaaaggacaaccctcttaaagtctacgctgtcgtaagtcagataggctttctggtaatcactcccctgctgatatttatctggggcggcagtgtactggtaaataaattctctctgccgtcgtgggtgatgattctgcttgtgtttgcaggaataatcacgatgatctcgggagtgggaacttatcttaagaaccttataaaaatgtacggcggaaaagatgataaaaaaacctacaagtatctttcggaccgccgtgacaatgactattacgacgatgaccgccgtgacaggaagctataaatatgaaaaagaaaattaccgaaacgacctcattcaaggaatgtatggcactgctgccgtactatatcggtgcgcttgttttgcttgggattgtgagcgttatccttatgatttcgggaataggcgattatacactgcttacgggagcggtcgcaggaactgcggtttcggcgctgaactttgttcttatggcaatcagtgcggaaaaagcgataactctgaccgagaaatccgcaaagctcgctatgaacggcagctacggagcaaggtatatcggcacatttataattctcggcgtgctgatgttctttaaaatcatcaatcccgtcacagccgtacttccgctgttcgtgccgaaaattgcgtataccgtgacggcattcaaggagaaaagcaatttctgacagcaaatttacaaccgctgacttaacattaaatttatataaagatataaaatattcattacgggaacgacccgtaaaaataagggaggagcattagaaaatgacagaccttataaaacctatggcggaattctccgtcgaaggaccgcttaaatcaatcagctttgatataggaaactacaacgtagtaatcagcgagagcatcgttgtacagtggatagtaatgctggtactcggcattgtgttcttcatactcggcagaaacctcaaggtgagatcgacctcacgcagacagatggcggctgagtatcttgtaaacttcttcaacaatatggtgcgtgacaccatgggcgaaaaatacagaaaatataccccctatataggcggacttttctgcttctcgattctttcgagccttatgggtcttttcggcttcagatgtccgacctcggacctttccgtaatagccgcatggggcatcacgacattcgttctgacgctcaggaacaagctgaaaacaggcggtatcaagggctatctcaagggcttcatcgagcctatgcctttcatgctcccgttcaatataatcggtgatattgcaaaccccgtttcacagacactgcgtcactttgcaaatatccttgcaggctctgtaatcggaggacttatctactttgctttaggacaggtcgcaaacggtcttgcgtctatcggtataccggctgtatgctcgctgtactttgacttgttctcggcattcattcaggcttatatcttctgcacactgacaatggcttacgtttcaatggcagaatgcggagatgactaatcagtttacccccacaggaaactgtggtgtaataaataacaataatctaccgacaggtagaataaaatgacggaggactttgatatggaaaacttatcacaggcaatcgtactgggcgcatctgcaataggtgcaggtcttgctatgatcgcaggtcttggccccggtatcggtgaaggcttctgcggcggtaaggctgttgaagcgatcggcagacagcccgaggcttcaggcgcaatcacgagaacaatgatcatcggtgacgctcttgcggaaaccacaggtctttactcactcgttatcgctctgctgctgatgttcgcaaaccccttcatcagccagctttaatctctggcagactacaacacgaaaggattgaagtgaaatgacggatatgctgagaatagccgaggaagccgccgagcaggcaaagttttctctggtcagcatagatcttaacactatagtcttcactctgatcaacacgctcatcatcgttctgctttatttcttctttctgcacaagcccgtctgcaagattcttgacgagcgtgcaaagacagtaaacaaggatatggacgacgcacagaaggcgaaggaagaagccgccgcagtaaaggcagactacgagcatcgccttgaaacctcaaaggaagaggcagcccgcattgtagccgacgctacgaagaaggcgcaggcaagagaggacgaaatcatctctgccgcaaacgaagaagccgcttctgtgaaacagcgtgcggaagaatctatcgagcgtgaaaagaagcgtgcggtaaacgagataaaggaagaaatttccgatatggtagttatggcggcttcaaaggttgccgagaaggagataaacgcacaggacaacgagaagataatcgactcagttctgtcgcagataggaaaggagaactgaaatggctgctgttgacaagacatacggcgacgcattgttctctcttgttaccgaagaggatgaaaaggctctgcccgacattctcggacagcttaaaggcgtttcggaggtatttgccgccgagccggactttataaagctgctgcgtactcctacaatcccgatcgaagaaaagacggcacttgtaaaagaggtctttgacggaaaggtgcataagtttgtagtgaactttctgtgcatacttaccgaaaacgacaggctgcccgactttgagcggatactggcatacttcacagggctgtataacgaaaagctcggtatagcggatgttactgtaacctctgcgatgcctctttcggatacggcggctgaaaagatcagagcaaaaatggctgagattacgggtaagaccgttaatatgacgctgaaaaccgataataagctcatcggcggcgttgttatcagctacggcaatacgactatcgacggaagcgtcaaagcaaggctcgaacagcttaaggctgatattgccggaactatcgactgacataaaaatcgtcagacggtaaaaaaatacgaaaggaagaacctccaatggatttacgcccggatgaaataacaggcataattaaatcccggatcaaggactacggctcaaaaatccgtcttgaagatacaggtactgttgtaactgtaggtgacggtattgttcgtatacacggacttgaaaagtgtatgatgaacgagctgctggaatttgagaacggcgttcgctgcatggcgctcaacttagagcaggactttgtcggtgcggttatgctgggctcagatgccgagatcaaagagggcgatacagtaaagcgtacaggctctgtcgtatctgtacccgtaggtgaggaactgctcggacgagtagtaaacgcactgggacagcctatcgacggcaagggcgctatactcgcaaaggaaacacgcccgatcgagaagatcgcaccaggtatcattacgagaaaatctgttaacgttccgcttcagacaggtatcaaggctatcgactccatgataccgataggcagaggtcagcgtgagctgattatcggcgacagacagacaggtaagactgccattgcgattgatacgatcataaatcagaagaaaacagacgtaatttgtatatacgttgctataggtcagaaggcttctacggttgcaaacgtagttgaacagctcacagccgcaggcgctatggactacacaatagtagtttcagctaccgcaagtgaacttgcgcccttacagtacattgctccctattcgggatgcaccatgggtgaatacttcatggaaaagggcaaggacgcactcataatatatgatgacctgtccaagcacgctgtggcttacagagcactttctctgctcctcaagcgtccgcccggacgtgaggcttaccccggcgacgtattctatcttcattcaagactgctcgaaagagctgctaacttaaacgaggactacggcggcggttcgctcacagcactgcctatcatcgaaacacaggcaggcgacgtttctgcatatatcccgaccaacgttatttcgataaccgacggtcagatattccttgaaacagagctgttccactcaggtgtaagacctgcggttaaccccggtatctcggtatcccgtgtcggcggtaacgctcagataaaggctatgaagaaggtatcaggtactctgaagctcgaatattcgcagttcagagagctgcagagcttctcgcagttcggctcggatcttgataaggatacaaaggaacgtcttgcaaagggcgagcgtatcgttgagatattaaagcagggacagaactctcctgtagctgttgaaaatcaggtcataatcatctatgccgtaatcaacaactatcttaaggatattccgcttgaaaaggtcggcgactttgagcgtgacctgtacaagcatatggaagaagctcaccccgatattacagcaagcataagagaagaaaaggtactcactcccgataatgaagaaaagctgaaggcggctcttaaggatttctcggagaagtacgtttaagactaagatataagaatcaagcgaaaggaagaatagttatgaaaaaggcatcacttgtactgagcatcgttgctttaagcatatccgcactcacccttgcgctcacggttttagagctgttctataaaaaaacgacttatatcgacagtgataatatccgataaaggaggctttgcatggcttcgggaaatatgaaggacatcaagcgcagagtaaaaagcgttgagtccactatgcagataacgaaggctatggagcttgttgcttcttccaaactcagaaaggcaaagctccgtgccgaagacgcacgtccgttctttgatgcacagtattccctaatgtgccgcattgcaggcgaaacggagaacttaagcaccgtatatacaaggcacagagaggtaaagaaccgtctgttcattgtaattgcgggcgacagaggtcttgcaggcggttacaactccaatatactgaagctggtacagcagactcacggcgatgaatatatgcctaagataatagctgtcggcaagaagtctgcggagttctttacaaagcacgaatatgacgtagtggcgcagttccccggcattgcggagcatatcaaaacggcagacgctgccgatatagcgcagatagcgacagatcttttcacaaagggagaggtcgatgagatagagctgttctttacgcagttcgtatctcctcttgtacagacccctacccgtatgcccgttctccccatagacgctccgacaggcaaggcagtacccgaaaacaaggcaggcactacctatgacccaagtcccgaggcggttttcaaccgtgtgataccaaagctcataacgagccttatcatgtgtgcggtaaacgaaagctacgcatcggagctgggcgccagaagaacagctatggaaaacgcaacggacaatgcggaggaaatgatcgcaaacctgtcacttatgtacaaccgtgcaagacaggaaaagatcacgaatgagctgaacgagatcgtatcgggtgctaatgcgctgaattaataagaaaggacaggactgatctatgccacagaatatcggcacggttgtgcagatcatcggtgcggtacttgatataaagttccccccggagcatctgcctaacctgcttaacgccatagagatagaacacgagggcaaaaagctgaccgtagaagtagcacagcatatcggcgacgatacggtacgctgcattgctatgggcagtacggacggacttgtaagaggacttccggcagtagatacgggcgcatcaataaaggttcccgtaggcagacagaccctcggaagaatattcaatctgctcggtgaggctgttgataacaagccccagcccgaaacagaagaaaaatgggaaatccaccgtcccgctccgtcattcgaggagcaggagggttcaacacaggtacttgaaacgggtatcaaggtcgtagaccttatcgcaccttacctcaagggcggtaagataggtctgttcggcggtgcgggtgtcggtaagaccgtacttattatggagcttatcaacaacatcgctaaacagcacggcggtctttcggtattcacaggtgtcggtgaacgtacccgtgagggtaacgacctttacaacgaaatgaccgagtccggcgttatcgaaaagacaacgcttgtttacggtcagatgaacgagccgcccggagcaagaatgagagtagccctctcaggtcttacgatggctgagtacttccgtgacaaagaaggtcaggacgtactgctcttcatagacaatatattcagattcacgcaggcaggctctgaggtttccgcccttctcggacgtatgccctcagccgttggttatcagcctacgctggcgaccgaaatgggcgctttgcaggagcgtatcacttctacaaagaaaggctcaatcacatccgtacaggcggtttacgttcctgcggacgaccttaccgaccctgcgcctgcaacgaccttcgcacaccttgacgctacaacggtactttcaagaaacatttcatcaatgggtatcttccccgctgttgacccccttgacagtacatcaagaatactcactcccgagatagtcggagaggagcattacgaggttgcaagacaggtacagtcgatactccagcgttataacgagttacaggatattatcgctatcctcggtatggacgagcttgacgacaacgataagctgaccgtatcaagagcaagaaagattcagcgtttcttatctcagccgttctccgttgcagaacagtttacgggtatgaagggcaagtatgttccgcttaaggaaacgataagaggcttcaaggaaatcatcgaaggaaagcacgacgatcttcccgaatccgcattcctgttcgtaggcactatcgacgaggctgtcgagaaggctaagaatgaaaaggcataataaaaggggctatttcagccccgctacaattatggccctgctccttgcggcgcttgcgctcggtttgccgtttataatgaacggacccgtaaatgacgaggatattcttactcctctgccgacccccgaatcaacggtaacgacgataacggaggattcaaaaatcaccgcagtgcctacgcagaagcctgtagcagtaactacgaaaaagcgtaccgatgtatctccgaaaccgtctgttgccacaagcaaggcggcaacgccctcagcccctgcggctgtagtcagcggcgaaacggtaaaaagcgtgcaggataaggctgtaaatctggaaaaggccgcactcggtctgtaccgtgacaacggcgataatcttaccgccgatgcggtcagagaaaaagcaggtgtacctgccgatgagcatttcatcgtaactataagcacgaagaacggcaacgtcagcaaggtatcctactttacaaaggattattccgttgcgttttcggacggtaaattttcggcgcttgcaaatatagccggcgatgatttcgaggatgcggtactgttcctttaactcctcaggaaaggaaaagatgatatgactgaattcaaactgaagatccttacccccgagggagtggtgtatgacggtatggctgaaagcgttatcgtccgtactaccgtcggtgacaagggcatacttgcaaagcatgagccttatgttgcggcgcttaccataggacaggcaaagatacgcattaacggtactgtccgtataggtgcggtgtcttcgggtattgtagaggtcacaaaggatcagacgtctattctggctcaatcgtttgaatgggcggacgagatagatgttgaacgtgccgaaaaggcaaaggctcttgcagaggagcgtatgcagcagtacaaggaagatcagcgagctcttgatattgccgagtataagctcaaaagggctataaacagaataaatacagctaatttcaagctgtaaacaggatataaaaaaccacgattctttttgcggaatcgtggttttttcagcttggggggaagtctgttttttataaagcagtgagcattctctgtccctatcagaacactttaacgtgcttatgcacgggataatccgcttatgcggattatataacgtaatcgtccgccgcattctccatatcgctgtctatcaggtcctgtaatgtcacactgtcaagatactcgtttataaccttgtacagcccctgccataacgataatgtggcgcaatgctcgctcctgtcgcattcaactactccgctttcaaggcaggcaacaggtgcaagagagccttcggtaagccgtaatatatctcctacggtgtatttgtcgggagctttagcaagacggtatccgccctgaaagcctctgttggtacgcagtatgtccgacttattgagcatcggaacaatctgctcgagatatttctttgaaacgccctgtcgctgagctatttctttcagcggaatgtacccgtcgccctgatgctcggcaaggtcaatgagcattcttaatacataacgtccttttgtcgaaatcttcatattattgtcctttctttatcgcttttttacaataccgaaatctgaccgtcatttctaaatactataataccatatttttagtaggttttcaagtggttttcctgtttttttaattaattctgaaattaagcagaaaaggccgtataatgacctgttttgtgtattaaggttataactttaattacttaatttcactgcccaaaatagcgaaaaagcgaggtattgctggtttgacttgtgataatgcacagcttttaaaaagcatgtttgtatactctgctcttaatttgaaattgtgagctttttttgaccttttaatagtttttttgcttgcagacggtcataaaatgtgataaaattaacttatatggaaaatgggaataggaaaaggaggcgggaaaatggttgaagaggtcagagggtatctttccgatatgatagatgccatcgctacaaaacgttatgatgaccttcagcagattaccgaatttgctcctgctgcaaaagcattgcatatttcgagaattgttcgtacattgaactacggcggaagattgaacgaaactcttatttataaagacagctctatctaccctttacacaataagaaatatgagcgtgaaaacacaagctgcagtctgacttatgagttttataccgatgtggattttgaaactcttacagatgagcaggaacagctatttgagcatatcaccaatcttctggctatcatttgcacctgcacgctgaatattcacgttgaaaaactgatcgaccatattgaccgtgacagcggaatacccaactcgaagggcttccgtgcttttattgaggaagtaaaggaaaacggagttctctcagactatgcggtcataagagcaaatatcaagggctgtaataccctaaacaccatcttcggctatcaggcaacaacagagataatccagagatttgctagagcgcttaacaaaacgatgtacagcgatgagatatgcagccgctcaggcagtgataacttctgtctgatggtcaaaaagagccaccttaaagctcaccttaagaactttgcaaagacacctgtcaacttctattacggcaaggaaaagacagtgtatgagatagcactcagagccggtatagtaatgcttgacgacagcacagacgatattgacactattcttgcccgtgcagaaacctgcattgatattgcaaagcgccgtgcggatggggattttgtttattacgatcttgatacaatcaaccgtgaaaaacagcttaccctgcttgagaacggtatgccgcaggctttggcggacggagagttcgttgtttattttcagcctaaggtacgagtggatacaagaacgcttgtaggtgctgaggcgcttataagatggaagcgtgacggcaagattatttcgcctgccgactttatcccgatagcagaacgaaccggttttataatgaagctggatatgtttgttttagagcatacctgtgcgatgataaagcagtggcaggaaagcggtaagcgcacagttccggtgtcggtgaacttctcaaagatacatctgcgtttccctcaccttgcggaaaagataatgaatgttataaaccgttacgggattgaaccgcattatcttgaggtagagtttacggaaactgcatatacagacgatttcaacgcaataaagcaggcgataatcgaccttaaaagctacggtctgatggtttctatggacgacttcggaacaggctattcttcgcttgctctgctgaaggatctcgactttgatatactgaagctcgacaaatcacttgcaggagcggacgatgacgcaagaggtcaggtagtgcttgaaaatattctgcatatggcgcaggagcttagcatgactaccgtctgtgagggcgttgaggataagaatatcgttgataatctgaggaatatgggctgtaatatcatacagggttactatttcgacaagcccctgcccgaatcggagtttgcgtcaaggcttgaaagcccgatttatgaaaataaataagaataaaaaccgctgtggagtttcacagcggttttttgatacagtaagacagctgaggatcgggctgtagaaaatgttatttgttcgaagtttttgctatgatggcaggctaccgatagttctttttgtcggacagcacttctcgggttcgctattcgagtgagtacacttgtcaatatgaaagagggagacaaccaaagggatcagggagagtctgagcctcgcttacgcaaggctcgtgcactccgctaaagctccgctgaaagccaaatataaaggaaatccactgctttcgggcggtggattcagtctgtcaataaacctcttgtttatcgaaaatggggtcgcaggggcatagcccccgtacaggtcgtcagccatttgtgccactgcatcgtgcagtggctttgtgtggctgactacaagcatccttgcttggactaggggcggtagccccacactcagccccggcacggatgccgggcgtgtatgcccaaaggctctgcacgatgcagagccaaccaagcatacacagcccttcgccacggggaaggggtttggggttagggattgagaacaagcacttttttggaaaaacagactttttctatagtctgtatccactgctttcgggcagtggattttttatataaatgctgactacggtaaaaattaacaaataaaacttgaaattaaattcataattcgtataaaaatttatataaaacacttgacaagttacgaagaatgtgctacaatatagtcacagtcgaaaacaggctgttgagatagaaattgaaatagatatttgaatatgaaagggatgatcgtcaaaaatgagtaaaagcgtatacagtcttgtactgaccgatgagatagtacgggcgatagactctcttgcgtacagaatgaacaccagccgctcggcactgatagacaggatacttgccgaaaagctgtcgatgcagacgccggagatacggatgcgtaacataatggaaaatatcggcagtttttttgacgatgaaattttccgcttgcagactgtggcgggcgatggaggaatgcttataaaaagcccgttgccttataaatacaagccgactatacgttactccgtagaactgctcagagaagacaggtatctgggcaggctgaaggtcagcttcagaacgcagaatatggcgctgatggagctgatgaacgatttcctcacctgctttgcaaatatagaacgcagacatttgtcacactttgacggaattgacgtggtgatgcagatagacaacgataagatggtaaggatgctcaacaagcctatcatcaaggacggcaggagcgtcagcgacccgaatcttattgcagaggctattgcggattatgtcaattttcttgacagggcaattaagctctattttgaaaatgcagacaacaaaaagcaggcggtttcgcttgtggattcactttataatgagcgtatcaagacattgaaggttatcctgtgatgccttgtacaaacgaagaaaggatgatgtgatatgcttaacacaaacaatctgacacagaaatcaatggaagctataagcactgcgcagagtatagctgtttcatatcagaacatgaacatagaacagcagcatattcttcttgcactgcttcaggctgaggacggacttatccctcagcttataaagaagatgggtgctgacgcttcacagcttacaaggcttacagagcagagcgccgcaggaattccgaaggtaacaggcagcggcagagatcccgaaaaggtatatgtatctcccgatgttgataaggcgtttaccgccgctgaggaaaaagcaaagcagatgaaggacgagtatatctcggtagagcatctgttcataggacttcttgaaaagccgaactcacagcttaaggacattttcgcaaagtgcggtattaccgaaaaggcattcttgcaggcacttgagcaggtaaggggcagtgtgcgtgttaccggacagaatccggaggaaacatacgacgtgcttaaaaagtacggtcaggacttaaccgagcttgcacggcagaataagctcgaccccgttatcggcagagatacggagataaggaacgttatccgtattctttcccgtaagacaaagaacaaccctgtgctgataggcgagcccggtgtaggtaaaacggctatcgccgagggtcttgcactgcgtatagtgcgtggagatgttcccgaaaacttaaaggagcgccagatattctcgcttgatatgggtgcgcttgttgcaggcgcaaagtacagaggcgaatttgaggaaagacttaaagcggtattacagaccataaagaaatccgaaggtcagataatactgttcatagatgagcttcataccatagtaggcgcaggcaagactgacggtgcaatggatgcaggaaatctgctgaagcctctgcttgcaagaggcgagcttcactgcataggtgcgacaacgcttaacgagtacagacagtacattgaaaaggatgccgccctcgaaagacgtttccagccggtaatggtaaacgagcctacggtagaggatactatttctatactgcgtggcttaaaggaacgttacgaggtgttccacggcgtaaagattcacgactcggcgcttattgccgcagcaacgctgtctgacagatatatttcggacagattcctgcccgataaggcgatagaccttgttgatgaagcgtgtgcactcatcaagacagaaatggaatctatgccgtcagagcttgacgacatccgcagaaagataatgcagcacgagatagaagaagccgctctcaaaaaggaaaccgaccgtatctccgttgagcatcttgccgaggtacagcaggagcttgccgaaatgcgttcaaagttcaacgagatgaaggcaaagtgggagaacgagcgtaacgccatctcaaaggtacagaaactgcgtgaggagattgaaagcaccaacagccttattgagcaggctgaaagaagctacgatctgaacaaggcggcagagcttaaatacggcaagctccctcagttacagaaggaacttgaggaagaagaaaagctggcagagcagtcaaagtccgcatctatgctgcacgataaagttacagaggaagagattgcaaagattatctgccgctggacaggtatccctgtttcaaagctgatggagggcgagcgtgaaaaactgctccatatggaagatatacttcataagcgtgtaataggtcaggacgaggctgtcgaaaaggtaagcgaggctatactgcgttcaagggcaggcatcgcaaatcccgatcagcctataggttcgttcctgttcttaggtcctaccggtgttggtaagacggagcttgcaaaggctcttgccgaggctctgtttgacgatgaacacagcatggttcgtattgatatgtcggagtatatggagaaattcagcgtgagccgtcttatcggtgcgcctccgggatatgtcggatatgaggagggcggtcagcttaccgaagcggtaagaagaaaaccctactcggtcgtacttcttgacgaggtagaaaaggctcaccccgatgtgttcaatattctgttacagattctcgatgacggcagaatcaccgattctcagggcagaacggtagactttaagaatactattatcattctgacaagtaacctcggctcatcgtatatccttgatggtatcaacgacaagggcgagatttccgaagaagcaaaaaacgaggtcaacaaattgcttaaaacacagttcagacccgaattcctcaaccgtcttgatgaaattgtattctacaagccgctccgcaaggacgagatctccggtattgtcgatcttatgctcggcgagctcaagaaacgtcttgccgataaggaagtaggctttgctattacagacgccgcaaaggactatgtaatcgacaacggctttgaccccaactacggtgcaagaccgctcaagagattcatacagcgtaagatagaaacgcttatcgcaagaaagctgatagccgatgatgtagcacccggcagtacgctgacggtagactatgacggcgaaaagctgatttgcagtgagagctgataaatgaattacggtcacgggcaacagtccgtgaccgtattttttgtactataaacagtacagctttagccggaaatatagacaagcggttatcggtgtgctaaaatatatcgtgtaaggagtgatattttgagaaagaaaataacggcggtgctgacagcacttgtaatgcttacaggctgtacggcaaacgcttcggtttcgtcggaaaacgcctcatcttcatccggcttttcgtcggaagtatcggctgaaggctcatcatacagcgaaacgcagagcgttacccaggaaaacgacaatgtaaataaccttgacagcgatgagatgaaggtgcattttattgatgtcggacagggcgacagcattttcatcgaactgccgaatacaaagacaatgcttatagatgcggctgaaaatgaatatgcggacaggataaccaactatatttattcctgcggatacaatacgcttgattatgttgtcgccactcatccgcacagcgaccatatcggcggtatggctgacgttatcggtgcgtttaatgtcgaaaacgttatattgagtcccgcaacgcacacaacaaaatcgtacacgaatatgcttaaggcgatagacgacagcggtgccaaggtaaaaatcggagtagccggaacggagattttctctgacggcgatttgtcggcggttgtgatagcgcctgttacggaggactacagcgaccttaacaactcgtccgttatggtgatgctgaaatacggggataacaagtttttattcacaggcgatgcggaaaacggcgaggaaaacactattacagccgatatagactgtgatgtgctgaaggtcggccaccacggaagcagtacctcgacaagcagagcttttctgacagcggcaagccccgaatatgcggtcatatcctgcggtatgggcaattcatacggacatccgcacaccgaaacgctcgacagactgaaaggtgcaggagtgaagatataccgcaccgatttgcagggcgatataataatgacctgcgacggcgaaaaaataaccgtgaatgttgattcggcatcatcagacgggcaggcgagcggcatatatgtgctgaatacgaaatcaaagaagatacaccgtgcggattgttcctccgttgccaagatagacagcaagaatttaaaacgcacgaatgactatgacagggctatagcggcaggctatacgccgtgcatggtatgcagtcccgaaaaaagctgaaacataaaatgcttctgctgttataaaaaacttgccctccctgcatacgcagggagggcattcgtatatccttgaaaagtaaaaatggaacttccgtttaaaaatatcgtcaacatccgccgataacggaggtgtagcaaaactcaaactgtcagaacggcgaatttgtagcggctcacagccgctcattcaatattctgtatctgttccctgatcttttcaatctcgctcttcatatccacaacaagtcttgttatgcgtatatctgccgcctttgagccgatagtgttggtttctctgttgatttcctgcaccagaaaatcaagctttctgcctatctccttgtcgctgtcgagcattgagcgcagctgtgaaaggtgtgaatgcagacgtaccgtttcttcgtcaacagctgtcttttcggagaatatagccgcctcggtgagtatcctctgctcgtcaatatccgatgagccgagtatctctttgagcttgtcctctaatttcttacggtatgcggcggtgctttcgggtgagtatatctcaaccttgcttaccatatcctctattacatctgccttttcgagtacatcagccttgagtgccgcaccctctgtttcacgcattgcaatgaacttgtcgagtgccgagccgactaccgatgaaatatcagcccagagctgttcctcgtctgtttcttcctttatcactgtgaatacatcgggtattctgaaaagatcggaggcggaaagatcgtcggttatgccaaggtcgggggcgatagtgcggatagcttctatgtactgtgatgctacctgctcgtttacctttaccgaggtgtcctttacgtctatgttgtaaacgaggagcgacagttcgaccttacctcttgttatcttttccttgagcattgttttcagcttaggctcaagatactggtagttgcgtgggagctttgacgaaaattcaaagaacttgtgattgacacttctgatttcggcgatgatttctctgccgcttactacagcctgttctctgccgaaacccgtcatacttcttatcatagtgggtatcctttctgtttatatatttctctgttggggagctacgccccaaacctcatttatagatatattatattttcagttcgccgctttcaagcattgattgtgcggcaagtaatattcctgtttttccggacggataggtgataccgccctggagccataccgcaaacggctctctaagcggtgcgtccgctgaaagctctatgcttgctcccattgtaaatgcgcctgccgccattatgaccttgctgtcatatccgggcatatcccacggctcaggtgttgccatagagtcaaccggcgagccgttctgtatgcccttgcagaatgcgcaaagagcgtcgggtgtgccgagttttattgcggcgattatatccgtcctgttttgattgtacttagggaacgtttcatagccgagcagtgagaagaacgcacacgcaaaaaccgatgtctttacagcactttcaactatctgcggagctaagaagaagccgagatacatacccctgttttcgtcaagcgaacagcctacctctttgcccgttccgacagtagtcagacggtagctgcacagctcgaccagatcttttctgcctgctatgtagccgcctgtgcgggcaatagcaccgccgggattcttgataagactgccgattataagatctgcgccgacctcggtaggctcacgcttttcaacaaattcaccgtagcagttatcaaccattataattgcgtcactgtttacgctcttgacagcgctgattatctcgcctatcttgcttattgacagcgaatcacggagcgaataacccctcgaacgctggatatatgccaccttacagcccttagctacagccgcctttattccctcaaggtcgggtgtaccgtcggggagaagatccacctgcgcatactttacgccgaactccttcagtgagccgccgtgttcgccgtttatgacctccgttaatgtatcatacggagcgcctgttacacacagcagtgtgtcattcggacgaagcacaccgaacagggcagtggagagtgcgtgtgtaccgtttacgaagctgtgacggacaagtgcgtcctccgtgcgaaaaacctcggcatataccatatcgagcttatctctgccgtcatcgttgtagccgtagccgatagtgcctttaagatgcatttcgctgacacggttgtttataaatgcggagagtaccttatttccgttgtactctgcggtttcgctgattttcgcaaactgttcgcttgccatttcttcggccttctttgccgtttcaagcagtctgctgtcaatattgaaaaattccatttttatcctcttgctatttcatacgctgtgcctgcaaccgtaaatccgcagcttatataaaaccgctgtacgtttttcttgcagataagcgttatttttctgttgtcaagtaaattagccgtacaggaaagcagtgctgttcctatgccgtttttctgcatatcccgtcttactgcgatgtgcgacagaaaacagcttttatcatcatcgaaaagcactgtcgccgttgcagcgggttcgctcccgtaatgcattacgataagccttgatataccgtgacgtacacggtggcaggtgtctgcataccattcgtcaaactgatagtcggaaagtgaaaatccgcttttcagtatctcaaatacagtgcggtagtcctcggtaaattccgctgtcagccgattgttacacacggcaggcatttgtcccgatgtcattatataaagcgtttcggattcttccgacagcttaatatccgacattacggcttttgcaccgagcatttccgaaaacgttataatgctttgcaaatcgccgttttcgttgcagtgaacataaagctcgccgccgtaataaagggcaagcatattatcgccggtatcgccctcatagaacgtgcagaagtcatagcccgttccgtaagccttgcaatacgcatttatccgcccgactatcacgttgcctgacggataatcgggcggcagtgcgccgtatattcttctgatcatttttccgcaagcgcaagatacattgcatacgcaagctcagcggtactttgcacatcgcttttctttatcatacacgacggcgagtgcagatacctgcacggaacggatagtgcaaccgttctgataccgccgacagatgaatggattgcgccgctgtcgttaccgcctgctacaagcgtctttgtctggcagggaacgtttatctcctttgccttttcaaagccgagccgatacagttcacggtcatatatcgtacttctgtccatatagcttactacacagcccttgccaagctcgcatacacgcttttcaccgtcattgccagaaaagtcgcaggctgtggtggtttcaaggacgatagcgtaatccggctttaccgtataagcggcaacctttgcgcctctcgtacctatctcctcctgcacagtaaacacgcaggtaacgtcatacggcagattcttattcagtatatctaccataatggcacagcctatcctgtcatcaagcgctttctcacgcagatagccgttgccaagctcggtataatcgcttctgaaatatgcgcagtcaccgggagacacgtatttttccgcttccgcctttgatgaagcaccgatgtctattgtcagcgtatcgagctttaccggttcgtcacgctctttgggcgaacgctgatgtaccgccttgccgccgactactccgacagtgccgtttttgaagtgcagctgtctgccgattactacttcgggattgataccgccgacagttgtaaatttaagatttccgtcatcggtgatgtaggtcacgataaatccgacctcgtcctgatgagcggcgagcataaccttgtttttcggggtcttagcgccctttttatttactacgatgttgcccagtgggtcgattttcgcgtcgcattcctgcggcagcattgaaagtatcagctttgttacatcgccctcatcaccgctcgtaccgtcggcaagacacagcttttttatattctcaaacaattcagccattttcggcaccgcccttcgtggcaaaagccgtaatcagctttgctgttgatataacatcgtctgtgtcgatgatctcggcaggagtatgcatgaatttaagcggaatggacagcgtgcaggcctttgcgcccgacttgttcacgctcatcgtgtcggcgtttgtgcctgtttctccgcccatgacctcaagctgataaggaatattttctaatttcgcaagtgatatgagcctgcctgacagctctcttgaaagtgacggcgcaatgcctatcataacgcccttcgacatatcggcacatttcgccctgtcgctgtcgggagttttcgcaaagctgacgtccatttcaagaatatagtcggggtcaaggtcatatacggctatcttcgcaccgctctctcccgtttcttcctgtgttgtaaacgatacgtcaaggtcaaacgcaagttccttacttttaagcatttcgagagcagccagtatagaagctactccgcacctgtcgtcaagcgcacctgcacagtatcttgtgccgagcatagccacaggttcacagtcgaaggttatcctgtcgccaagctcaatacggctttcaagctcctgctttgtatagcccgtgtctataacgatttcctcaattttaggcactccgtcgccgctctttacatggggcggaagaacggatacaacgcccttcactttttccttgccgtgaatcgtcacgctctgcgccgcaagcacacgtctgtcaggaccgcctaccgcaccgacctttataaagccgttatcgtcaataaacgatacgataagtcccaccctgtcgatatgtgcgtcaagcagaagtttcggcttgttgcccgtactttttatatgtccgataacgttgccgaaatcgtcaatactgcagtcatccgtgtagcttttaagcattgacagtgcaatttcggacgcacttctttcatcgcccgaaacgccgtcaacactgcacagacggtacagcatactgttaatatccattgtcatctttctttcatggcttaatataagccgtccatttttatcttttcctttactctttcaagctccgctataaactgctcatcgagcttgcttaagctgtagcccttcgggaagataagcacgtccttgtttactttgtagggaacatcgcatttcagctgtaccattgcgtgctgttcaagacagcttttaggaacgggcgaaacccacatataagtgttgtacaggtttccgagcaggtcaaactgacttcctctttcataaacatatatacgctttttacggtgttccgaaacgcttgaacgtgataccttcgagaatgacagcgacggcactgaaaggtcgccgtgtactatctcgatataatcctctaagtcggaatatttcactataccgtccggattttcctttgcaagcgggctgtccttgttcacaagaagcctgtattcaaactcccataacggacggtatttcagattcttcccgtcaagcattgcaaaatattgcttttcgtggatattctgatacctgattattcccagcttgaagtcgaagttcaggatgttgttgatagcgtccatcgaatttgtttccttgaaattgatggatatttccttgtcggtatcaagcaggctcacaaagtttgaaaacgcctttgtgatataggtagctcttggaacggaaatgctgaaacgcacaccgtcatccaccttaggcttgtagagcgataccatttcgtcaaactgatcaagcaccgcctttgcatagcctaagaattcgccgcccttttccgtaggagcaaccccttttgtagtcctgcggaatattgtgataccgatttcattttccagctcttttatagccttgctgagattaggctgccccatgaataaattgtttgccgcctttgtgatcgaaccggttttttcgatctcaaccgcatatttaagatgcagcaggttcattgaaaaccatatcctttcatcacagagggaaaaacctctgttaaattataacccttttaatatttaattttcttttttaggttcaacgtgtgaaaaagactgtattgcctctgttatagtcttttcgtgtgcgagcttaccgtacttgtcaacctctgccttgttcttttcgccgtgtgtcaggcaacctgctcccccgatgcagccgccgacacaagccataccttcaatgaagttattaggcagaagattctttgatgcacgcataagcgcacgcttgcattcttcaataccgtcgcaggaaagtccgttcagcttgaagtcctcgttgccctgctccttgagagcctcggcaactgcgtctgcaagaccgccgcagcgtgcgaatattctgccgtagtacgatgcgttatcaagcactgttccctcaagctcggatacctctatatccttgctgtcgaagatagcctgtaattcttcaaacgtcattgcatagtctacataaggctttaccttatcccactgtacctccatcttctttgctgtgcaaggtccgatgaatactaccttggctgtgggatcgctgtccttgatgtactttgctatttcagccataggtgacaggttgtgtgaaatcttgtctgtcatagtcgggaatgccttctcgatgtacattacgaatgcgggacagcacgagcttgtaaggaagcccttttcggcaagctcctttgactccttgtacgctaccatatccgcaccgagcgccgcctcaactacgctgtggaagccaagctgcttgatagccgtaaccacctggtcgagcttagcatagctgaactggcttgcaatcgagggcgctacgaccgcataaaccttataattcttgctgttgtcactgccctttaacgtttctataatgtcaacgatatatgacttgtcgcttatcgcaccgaacgggcaggtgtaaacgcacgcaccgcacgaaatgcacttgtcgttgtcaatgtgagccgccgccgagcttgtgtctgtcgctcttgagatagcgcctatcttgcaggctctctcacacggacgcttgaattccagaatagcgccgtaaggacaaacctttgcacactgaccgcagtttacgcactttgacttgtcgatatgcgccttctgatgctcgtcaaatgttatagcacccatacggcagacatcttcgcagcggtgcgctatacagcctctgcacgcctccgttacatcatagccgcctacgggacattcgtcacaggcaatatctattacctcaattacgttgggatttgtcggatcgccgcccatagcgattttaatacgttccgaaacgatagctctctccttgtagatacagcatctcattgtgggcttatccttgactattttctttgcaacgtcattaaagaagctgaacgaatctgcaggcttttcagtaccctctgtcgtccatgcgtgtcttgcgacttctcttaaaaccttgtacttcagatactgtaccttggtgtcaaactttcttaacttcttgtccatttttcttactgcggattttccccgccgaccgcccgagcggccgctcctttcgcatagttttttcttcttgttctactttttatattgctttctctttagaaatagcttacttttattttcttgcccatttgccttaggcatttgctcagctcgtcaacaagctgcatttttatattgaaggtgataggcaggttagggttctggtgtgccgcattgacagccctgccaacatagaaattaatatctgtagcgtcttcaaagagcattcttgctatgcacgatgcgccgtcctgaagtatcgtccagtcatcgtacagcttattttcacccagataatccttagcgtagtcaagcaccttgcttatcgtgataacgccctcggtaactatatctacgccctcaatggtagccataggcggaatatcggggctgatgtagtcaaggcagggtataaccggctttcctaagaactgtcccgtaagtgtagatgtcgtaccgccgcagacgatatgctttccttcttttgaaaagaacagcgtcatcatcttgttcagatcctttggatcggacggcggacctatcataaggttcacctgttcacgctcacggatttttatgacgccgacagtagtatcatcgccaggcgagccgccgtacagtcttacgcattcgtcaagcagaagcgtggcaagcgcttttgcggaatactccctgtcatatacgccttccatgaattctattatattatctctctgccagccaaaattgagcgacgagccgacaccggcatagatagcgccgtcacttgtggtgataaaggtatcgtcaagcttcagctgtacctttgaaatatatatcgtcttgccgtctatctgatttatggttttcggatagtcgaaattcttgccgtcacgcagcattatcacctgcggattatcgtactggattatctcggcttccttgttgtttaccaccctgatgattgtaaaggtcgaatatgcgaccttgcgtacctcgcacacgggaagcgttgccgccattgttgcaacgcagtcctcaacgctcatactgttcgccatcatcgtggaaattatcttggaggtgagtgtcgagagtatcgacgctttcacaccgcttccaagtccgtccgccagcacgaaaacgatagagttttcgtcctgctcgacaagctccacatggtcgccgcaaagctgttcatcgtgcttgttgacgctcagataacctatatcggtgcagaagctgaacgctttactgttcatcatttgacaggttctccttaagttttgtaagtgcaacctttgtttcagcggtcgtttcgccgagcagtgacgctatttcctgaacgacacgcatctgcttttcgattaccttgtcagtgaccgcaatagtttcggcggcgttcttctcacgcttcgcccttgatatttcttcgcctgtaatatcacgcattatcgacattatgatatgatagctcttatcatatattatcgtttcctcgacatactttccgtattcggcaagatatgtacgcttgttgtggatattttcacccgtgctcataacctcaagatatgataccgggtcgagaatcctcacaacaggacagcccataacatccgacaggctctttatattcattatttcacgggcggccttgtttatctgctgtacttcaaggtcctcgctgagcaccataatgccgttgggcgtattgttgattatattatccgagaagctctccgctttctccttgagatacggcagacacattgtaagatccgccttgccctgcagaatagctatcgctttttcacggcaggtatcatatccgcagcttccgcagttaagctcctgtgacggatcgctcttgttcatcttgcgaagtatttcttctattgccttgcttccgggcatggttttctgcatactgataaacgggagcgattttgtcatatccgcaagctccacagtatcaaatctgccgcttccggcaaactcgtccacagcccttctttcgtgtataacgccctcgtgctttttatccatcgcaggaccgcctatacagctgttgacgcaggcggacatttctataaagcactttcccacgttgccgtctataatatcacgcagagcgttacggcagttctccacaccgtctatcgccatatagagatattcggggttgtccttgttcatagaacgcagaatgcccgatgtcgtgggatacagccttgtctttgctctgttgcttcttccggcattgtcagaaaccggacagacctctatgttttcttccttgagccagcctgtaagctcctcaaatgtaagcacgcagtctatagcacctgcgtaagcgtcagcctccgcttttttcgaaaggcacgggccgatgaacacggtgtgacagccgggatatttcttcttgagtatctctccgtgcgcaagcatgggcgatttcacctgtgcaagataggggagagcctgagggtagtatttctgtataagcgtatttaccgtgtgacagcacgagcttatgattattttatgctcgccgtccgcaaccagcttttcatactgctcggtaacaagctgtgcgccctcggcggtttcctccgctcccgcaaagcccagctttttaagagcgtcgtttaaagcggttatgccgataccgtcatagtttgccacaaaggacggagcaatgctgacataaacgggagtaccagagacaataagctcttttgctttgcccacatcgtttcttatctgctttgcgttctgcggacaggctacaaagcacataccgcacagaatacattcgtcctcgacaatgttcgcctgcccgtcagaaaaacggatagactttaccggacagtgtcttatacatttataacagtttttgcagttggatttcttcagccgtaaataactcatagattacaccttgccataagttttagcagtgaatttttccgcattcacaataaagcgctcgtggatgcccttgcctataatatccttttcatcccttgcaacgacctcaaatacgagtctgcggttgtcgatttcggtaagaaccgcttctgcggtaacattcataccgacgggagtagcggcaacgtgtgcaacatccagctttgtgccgacagtggtctgtccgtcctcaagctgtccttcaagcgccttgcaggcagccttttctataagtgcgatcatcgcaggagtagcgaaaactttgagtgagccgctgcccattgtgacagccgtattggtgtcatcgaccttaacttccgcttttccttttgttcctgttgtgagcatttaaaattcaccgttcctgtttatttttttgtacctccgtcagtcaagacagacaagtaccttttcgtcaaatatctgctggaagttgttttcgtttactccgcagattatttcatcgtctatttttatcgtaacgccgtctgtgcatcttccaagacagaaagcagcaccgagatttaccttatctccgatgttgtggtttgctatgtagtcttttgcaagctcgattattttatacgagcctttcagatggcatgagctgccgacgcagatgctgatgttcttcataatactgtttcctttcgaataaagcggagttatcagaaaatgtgaccgtccctgatttcaaactccagattttgtgaaagcaccgcaagagaagccgcaagattttcatactggactattacgccggtcggaacagacagatgtacaggtgcaaaattccatattgcaagtataccgcttgccaccattttgtcgcataccgattgtgcacattccggaggaacgcagattataccgatatgtactttaagccttgagcatatatccgccattttatcagccggaagtatgcgtttgctgtcaataatgctctcatccgtgtcaaatgccgctactatgttaagtccgtagcggtcaaattccttatatgagagaagcgcctgtccaagctttcccgcacctgcgattaccgcctctttcgtattgtcatatccgagaaagctctcaagatcacggataagttcttcggcaacataacccgttttcggcttgcctcccgtaacgctcaccgatgccagatccttacggacctgcacctcgttcagcttaagctcgtttgcaacggtagtagcggaaatattgcgtaccccgtccgcctgctttttcttcagataatcaagatagaatggcaatctcctaagtgcctgcctagaaattgtaccgttcatttgttctgcctttctgtgcggaagatatagttcctccgtctgtctatacatataatattatattaaaaaatgtaagccctgtcaaccgatttcgccaaaatcgttaaaattttatcgaattgacggacgaatactccaagacagataaaaacatacctgaaatgccgtctgaaagaatgtttgttgtaattccgcacaataacataacactgttatgctgttgctttggtgcaatgctatgaaatggtgtcaggggtattgacattatcactgatataggttaagataacagtgttatgtaaaatctttgcggaaaggaagtgcctttatgagcgataacgaaacaagacaaaagctgatagacagcgcaaagaaagagttctttgaaaacggctttgcaaaagcctcgctcagaaaaatctgcacaaacgcaggtgtcacgacaggcgctttgtacttctttttcaaaaacaaggacgatttgttcagtgcaattgtcgcacctccgcttttaaagctgaaagaaatgctgattgagcataaccgtgaggacgaggagtatatgggttcgccggacgagcagacgaggagcgttgaaaatcagctttcaactcataaagaggcagtcactatggtcggttatctttatgataattatgatgcattcctgctgctgctcacaaagtcgcaaggctcggtctacgaaaactgtgttgacgagttcgttgcacttatggaagagggctttcgctcaggcgcagaagcattgcttaaaaatttgccgggttgccgcattgacgaatatatgcttcactggctcgcccatatggatatagagatgtttatccatctgcttacccacgttcccgaaaaggagaagggacttgcgtatgccgagaaaatgatcggcgcaatggtaaagatgtggtttgatttgttgtttgtaaaagatgaataatgctgaccgccttacacggcggtcattaaaagcgccataggataacgctgttatgttagcaataactaatacagttagataaaactaataacgatacgggaggacaaagagatgtatcttgaagtaaaagacgtaaaaaagagctacggctcagacgcaggctacacacaggtattgaagggtgtgaccacaagcgttgaaaagggagaaatgtgcgtaatacagggaacgagcggttcgggcaaatcgacactccttaactgcataggcggccttgacattatggacagcggctctgtaaaggttgacggcacggaaatattcgggctaaaggctgacgctctggcaaagtacagaaaggcaaacatcggctttatattccagttctacaacctcgtgcctaatcttactgtcgaggagaatattcaggtatgcgagtaccttaccgataagccgcttgatatgaacgagcttctcgatacgctcggacttaccgagcatagaaaaaagtttccctcacagctctccggcggtcagcagcagagatgcgctatagcaagagcactgataaagaacccaaagctcctgctgtgcgacgagccaacgggtgcacttgattcgaaaacttcgagggatatacttgtgcttctcgaacaggtaaacaggaaatatggcacaactatgctgatagtaacgcataacaatgcgataaagaatatggtgcataaggtgataatcctcaaggacggacttatcaaaaaggattattacaacgaaacgcttatacctgccgctgagctggaggatctttaatatgaacaaggtgctttcaaaaagaataccgagggagtttaagtctaatctccctaagtacatcgcactgctgcttctgatagtgctttgtatgtatctggtaacagcgatggtggcaagctcggaaacaattattatcagaacagacgagcataacgccgcaaatcacgttgaggacggacagttcacaacgttcttgcctctgacagacgagcaggaaaaggatattaccgataagggcgttacacttgaacgtatgtacagccttgatataaaggctgaggacggttcaactctcagagtgatgaagaaccgcagaaatatcgaccttgtcgagcttataagcggcgaatatccgtctaaagataacgaagcagtagtcgaacgcagatatgcggaagaacacagccttgatgtcggcagtaagctgacagtcggcggtacagagtataccgtatgcggtataggcgcatctcccgactatgacgcaccgtatcagaatatgtccgatatggctgtatcaagcaaaaatttcggtattatctttgttaccgacagcgagtacgagcgagtgtcggacagttcgaaatcggcgcagaccttcacatacggctatcttctcggaaatgatatgaccgatgataagcttaaggagcttatcgaggattttgatttcgactatacgaaggttaccgacaagtattatcttgaaacggtaaacgaggcgcttgaaaagcgtaccgaaatagaaaacggcatcaatgatttagccgaaggtgcggacaaacttcataacggtcttaaagatctgtcggacggagccgacacgctttacggcggtatgaatgatttatccgacggggcagataagctgtacgacggacttaagactctatatgacggcacagtacagcttcacaccggtatgacaagcatatatgaaggcgcatcggctcttgataagggtcttggcgaattgtcgggcggcgcttcttcgctgaacagcgcaatagcaggagcagattccgcagggcttatccctcccacgatgaacgctcttgtaagcggtgcggacagccttgcctcaggacttaaaagtgctaaaagcggctcgtctgagcttgtatcgggcataagcagtgcaaatagaggagcagagcagttatcgacaggcgcaaccgatgcggtaaacggagcaaaggagcttgcagacggcgcaaagaacgcaaaggacggtgctaaagagcttgcagacggagcaaaagacgcaaaggacggagcgggtgagcttgcagacggtatacacgagcttaagagcaatatcggaaaactgctcgatgcggctttcgaccttgatctgaccaacctcacatcgtttgtgaaaagagcggataacgtccgtatcgcaggtgcggcaggcgatgtcgtaatgaataagtacggcggacttgcggcttgcgtaattcttatggcactgtttgcctatgtaatatctgtattcgttgttcatcagataaacagggagagcagtgtaataggtgcattgtacgctctcggagtaagtaaaggcgcacttataaggcactacataatgctccccacgataatagcgttcatcggcggcgttctcggctcggcgataggcttttcccctatgtcgatacagtcacagcttgcggacagctactcgtatttttcactgcccgattttcagacggtaataccgctttaccttgtgatatatgccgttgttattcctcccgtgatagcggcaatagtgaatgcgcttgttataaacagacgtctttccgcaccggcgctgtcgcttatgagaaacgagcagaacataaggaatatcagccgtatggagataaagagcggcggctttgtaagaaagttcagaatgcgtcagcttctgcgtgagatgagagcgaatatcacggttgcggcttgtatgttcgtttcgatgctcattcttatgctcggacttgactgctattcaatgtgtaataacgtaacaacagatatgcttgcaggcgcaacatacgagtatatgtatacgcttaaatatccgacctcagaagctcctgagggcagtgaagcgtgttatgtcaaatcgctcgaaaaggaaaaggacggctacacgcttgacattacggtaataggcatagacagcgataatccgtattataacgttgatgtgaaaaagggaaaaagcattgtcacagcgtcgttatcggtagcccagagatacggagtagccgaaggcgacaagctcattcttaccgatgaggcggcaggtaccgactatgctttcacagtcggcggtataagcgattattccgcaggacttgctgtatttatggatattgacagtatgagagaacttttcagacaggacgatgattactacaatatggtgttgtccgacaaagcgcttgatatagacgagggcagaatttactcggtaacggcaaagtcggatattgaacgctcgtcaaaggtgttcgccgagcttatgagcggaatggttataacgcttgtcggcacatcggctgtaatctttgtagtggtaatgtatcttatgatgggcgtgatgatagacagaagctcattcggcatctcactgctgaaaactttcggctacagcaaaaaagacgtaaagaagctgtaccttgacggtaatgcaatcactatagcaatatcggcaataatctgcttaccgctgtcaaagctcgtaatggacagaatatatccttcgtttatccctaacgttgcctgtggaataaacctcaattttgcgtggtatttatatcccgctttgtttatcgccgttatgctgatatatcttctcacaagcacgcttcttgtaagaaagctgaacaaaatcacacccgccgaggtgctgaaaaacagagagtaagagaattaaactggatataaaaccaattcttgataaagtcacacagtgaaatatatcacaaacaccgcctaaaacactttcagtgccgacagggcattaataatttcgtgaccttatcagtacaactgcactgacatttacccttcaaaaaaacgccactaacctgagatatatgtactaacttgcggacgtgtagcgttaagcgtccctacacttacaggatatacaatgttcaggcggttattcgagtttagctaacaccccgacggggtgggggtgtgagtaaggaaagagggatgccacgctgagcattgctttagcaatgctcccgctcctcacgtcgctcaagaggaataactgatttgggagagaacctaagagtatagggctgagtcttgcttgcgcaagcactcggacgtttcgctctgcttcactgggctgtcaagtccagcggagctttagcggagtgcacgagccttgcgtgagcgaggctcagacttgtacctgatctctttggttctttccctcgttcatattgacaagtgtatccactcgaatagcgaacccgagaagtgctgtccgacaaaaagaactatcggtagcctgttatcatagtcaaagctgaatgatataacagaagcacatcaaataaatgacttttctacaaacaaaatcgctcccgaccacatcagccgggagcgattttcagtattcgatttatttatgccagttcattcgccagctcatcaatctgtgccacgcttgcatcattcagtgcacaggtaatcttgaccgtcttgtcaaggatattaagctccttcgacttttcaaacatacccgccataaccttagccgccataggcgcccatgcgccgttttcaataaacgcaaccgtccgcttctgatagtttctctcggtaagaccctctatgaacgttctcataaacgggaacacatccgcattataggtaggcgttgcaagcaccagcttgccgtaagcaaatgcgtccgagattgccttggacatatcgcatcttgcaaggtctgtgataataacatcaacattctttgccttcagcttgtcatataaaagctctgcggctttctttgtgttgccgtagattgaagcgtaagctatcataacgccgtccttttcgggaacgtatgacgaccacatgttgtaaagatcaagataatgtgcgaggttttcactcagcacaggaccgtgtaacgcacagattttctctatatcaagcgcagcggccttcttgagaagcgcctgcacctgcgcaccgtactttcccacaatgccgatataatatctgcgtgcctcatcatcccacgcctgctcgctgtcgggtgttccgaacctgccgaaaccgtccgcagagaacaggatcttgtcctttgcgtcatacgttaccataacctccggccagtgtaccataggagcgaatacaaaagtcagaacgtgactgccaagcgtcagagtatcgccctcttttacggtaagcgtgtttgtgatggtaaggtcggggaaaaatccctttatcatcgtgaatgtctttgcgttgccgactaccgttgtatcgggatagaatttcagaaactccgcaatacttgccgaatggtcaggctccatatgctgaaccaccagataatccggctttctgtcgccaagctccgtttttaccttttcaagccatattgccgaaaagtttatatcgacagtatccataaccgccgtcttttcgtcaagaatgacataagagttgtaggaaatgccgtcaggcactttgtactgaccttcaaacaggtcgattgtggtgtcgtttacaccgacatattttacgtcttctgagataaacatattaaaattctcccttctttttcaagaaatctacagatattttaacacatccgaaataaaaaatcaataggtaaattcaaataaactcacagtttacaaagaaatcagtatttattatcattgttcttccgcttttcctctatatgtcgcacacgttcttcaaaatgttccttcagcatctcatttttctcgttcgccttgtccgagattgcatcgtacctgtcaaccacattgtcgcttatcttaacaaagttttcggtaagcatttccttcaccgtgtcgatttttgaagcgtcacagctgttatctgacgttataggtgcatttttatctgcgctttggtttttgtccgtatgccgaagaagcatagcaactcccagtacaagcgtggtaaggtagacgataacgcccgaacaggttattattattagcttatcgctttcgctgagccacatcgcatataccgtaagcgagcggataagagtaactgcggatacgcctgcgtccgcaagagaaatgtttcgtatagcactgagaagcggcgagcggtgcttctgcacttttataaggttgattatcgcacgggcaagctttatgaccgtgtacacagctatacttgcgatgacaagccttgcatattgccgtgccgtattgtgtatcatactgtacagctcgataagcataagtaccacgctcatgacaataaacatcatacccgtaaaccgcattacatatacttccgatactacctgtatgcccttgtccagctttttctcatacgatacagccatataacgcatcacggcaagcagaccgtaatacacgcccagtatcataaaccatatcgagccgtagaacagaccgagaatgccgttgtatgcggcataggcgacattcagtgtcagcgagcctgcggtgtacagcactatccgaaaacgcttgctttgcgtgaacaggcggataaattctttcagcctgagtctgtgttttttcagtttatccgcctcccttgagaaattaagtgccgtcacaatttataaccgtgacggcatagcttgctattatattttaccttatctgcgcagaaaatgcaaatatcatatcattttatcatagctgtcaaggaagtggtgcttttctcctccctttttccacgcaatgacagtatcaatattcacgttttcaacgctcttgaaaatatgcttttcgacctccggatttgtctgcttcagctttgcgataagctgttttatctccacacgctttgaacggttttcctcgttgttgcaggtagtgcaggtgtccgtgaatttgcaggcacactgtataaagtgcagaccgttgtagtccctccacgcttttatatcgtcctcacgcacaaggtacagcggacgtataagctccattccctcaaagttcgtgctgtggagtttcggcatcatcgtctgtatctgagcgccgtacagcatacccataagtatcgtttctatcacatcgtcatagtgatgtccgagtgctatcttgttacagccaaggctctttgcatagttatacaggtgacctctcctcatcctcgcacaaagataacagggggatttttcaatgttataaacagaatcgaaaatgtccgactcgaatatctctatcggtattttcagcttgcgtgcgttctcctcgataacattcctgtttgccgtgctgtagcctgggtccattacgataaatttcacctcgaacggaaaatcactgtggcggtgaagctcctggaacagcttagccatcagcatagagtccttaccgcccgaaatacatacggcgatacggtcgttttcctttacaagctcatactgctttacagcctttgtgaatgccgcccatatctttttgcggaactttttttgcaggctctgctcgacacgcttcgaaacctcgtcagcctgctccttctgcattacagcaagaagccaggcggcatatccgcccgaaagcgaataagcgtcatagcccatttccgataattgttctgcggtatctacgctgaattttcctcttgcacagcagataatcagcttctgagttttgtcctcaggcggtgcggctaatagctcgtctgccgaaaccgatacagcgccctccataacgccgtacagcttttcctgctcactgcgtgtgtcatataaaatatagctgtcgggggagagcctttcaagctcgcttacggttatttccaaagttattttcctttccttatgccattgtcagcacatggctgaataagtacagcagacccatatatgacagcgtgcctgccgccatacttacgaaagtgttatgccacagcttatagcttccgcccgttatagcaacggcaagaagtcttggaattcctacgccgaacatattgtcgccgatgtccttcaggcagtagattataagtatcgacattatcatagccggtagcgacttttctatgcgttcgagccactttggcattttcctgttgccgtgaaagattacaaagggcagcgcacgcagtgagaatgtgataacagcactgatgactatcgctatcaccatctgtaaaggtgtcataggagttggtgtcatatcttccgctcctccttttcatcggtgataatatcttccggagaagtaactatctctgttttttcatctgccgtttttatctcaccgttatcctttccgccctttttcttatcgaagtttgtatttgttatcagcagtaaaagcgctgtggataagagcagagcagggagcataaagctgttctgaccgaatataagcaggcacagtacgcctaccccaagaccgataagcgcaggggagtgcctgtcggcgtgttcccacttgtcgataaagataatgacgaacagcgccgtcatacagaagtcaacgccctcaagctgaaacgggagcagctgtccgataacgcttcccagtaccgaaaagaacgtccagtagaaatggctgaaaagcgcaacgccgaacatggtgctgtgcttgtcgtcctcgggcatatagtcgagcgtagtgtttaccgcatacgtttcatccgtcatcgaatgtatcatatacagcttacgctttcccatagcgctgaaatccttcagaaatgtaaggctgtagaagctctgcctgctgtttacaagcagaacagtgagcgccaccgtaagtagtgacgctccgctgctgaaaaatgttataagtaagaactggcaggttccggagtagaggaacagacaggagaacagcgagtagtaccactgataccctgcctccgccatcatcattccgtatgccatacctaaaaacagataactgcacagtacaggcaggctcttgatgaaagagtgcctgataagttgctttttagtcatttggtttatgaagccgcccttccgtaaatactgagtatcttgtcctcgaccgcacgggcaagcgcattgtgtccgttctcgtcaagatgttcgcagtctatactgcttggttttgcgtggtcggaggcggcaagtatatctgtgccgtgctttcttgcgacctttgcaaaggtgtatttcagatttcgtgaaacggcgggcgagcctgcgtcaaactgcggatcgtatccttcctgccatacgtcattaccaagctctataggtgaaatgagcaggacacggcaattaccggcatacgctcttacctgctcaataagacgctccgcaccgtgtgcaatcgtttctgcgtcagcgttataaaccggcttgcagtcgttcgttccgagcattataatgaccatatccagcggagcgtggctttcaagaaatacggggagcagcttgtcgcctgctctgccaatcctgtctgggtcctcaaaaaccgttgttcttccgcaaagcccttcttctattatctcatagccgctttgctcaaggtcgtttcttataatgcttgtccagcgtacaccgtcggcaaatctcttgtcagtgccggggataagcccccaagtattcgagtcgccgaagcaaagtatccttttcattgttctcacctgcacttaaagtttttatgaggagcttttcggctcctcataaactgtatttatatcagcttgtcgaaaaaagtctgttttttataaaatagagcaaattatctatccctatcccctttaggacactctgatggctttgcgtcctgcaaagcttagtgtgtccttatttcggcatccttgccgaaagcccctttccccggaaagggggagaatacggggactggcgtccctgcgacctgccttggggctacgccccaaacctcatttttaacaacgatagaggtttttcaacagcctgatttatatatctttctcagcttttctttacttcgccgccctctacaacgagtgtttccttgtagtctgcaccgtatgtgtctgtaagagtagcgtcatagtctgcgtggaagaagttttccttgccgagtgtcttgatttcatcgtttatccagttaaggagcgtttcgttgccttttgaaactgcgggagcaatagtatcctggctgccgagtgagtcaatgcctacagtatagcccttgttctgctttgcaaatgcgataacctcagtgttgtcgttagcccatgcaacaccgttgccgttttcgatagcactctttgccgtagcataagaatcatacttctggagcttgatgtcggggtagttctttgtgagataaagctcagccgttgtacccgagataacgatcatcttgtcctcagccttccagttgtcaagcgatgtgataacattgctgtcgggtgaaacaacgccgagtgcaacgttcatgtaaggaagtgcaaagtcaaccttttccgctctttcttctgttacagtgaagtttgcaaggataatatcaaccttgcctgtttcgaggtattccacacggttagcggcctctgtcgaaacatagtttatctcaacacctaaatccttgccgagtctgtttgcaaaataaatgtcatagccctgatattcgccgttctcgtcaacatagccgaaggggttcttgtctgagaatacaccgatgtttatcttaccgcttgcctttatctcgtcaagtgtgcggtaaaccttcgagcctgtgttgccgtcactgccgccgcttgttgcgtttgtgctgcacgccgtaaatgaagctactgccgcagctgccgtaagaccgagtgctatcagcttcttgaagtttaactttttcattgtgattatctcctttaaatatctctctttattctgcgagttctttctttgctcttaccgagtcgaactcaaatgtgttaaggaattgttttgccctttctgtcttaggattatcaaagaactcatcgggcgttgcttcttccacgatttttccgttgtcgaggaagattattctgtctgctatcgctcttgcaaactgcatttcgtgtgttactatcagcattgtgcgaccctgctttgcaagatcgagcataacgtcaagcacctcacggaccatttcgggatcgagtgccgcagttacctcgtcaaagagcagtatttcagggtgcatacaaagcgcacggacgatagccacacgctgcttctgaccgccggaaagctctctggggtagcttttagccttttctttaagtcctactctttcgagaagtgacattgcctcctgctttacctcttctttatcccttttctgtaccttgcaaggtgcaagaagaatattgtcaagcaccgtcaggtgagggaacaggtcatagctctggaataccattcctatacgctgtcttaaaagaggaagcgtcttgctgtttctttcgattacatcgccgtcaagcgttatactgccttcctgtatcggctcaagtgcgtttatacagcgcaggagagttgactttccgcagccgctcggtcctactattactatgacctcgctcttttttacggaaaagctgataccgtcaagtatcgttgtgtcatcaaaacgctttacaacgttgtttattgttaataatgcatctgccatacgctttagctccatttcttttcaaggtatttcgcaagcatacttatcggccagcaggcgatgaagtatagcaggaataccgtcagatacactccgaatgcaccattcggacttgtcattctgttagcttctattatctgctgtgcgaccttcagaacctctacaacgcctatcataaggataaggcttgtcgtctttatcattcttgttatcagatttatcgaaagcggtatgagccgtcttatcgtctgcggtatgataacataaagataagtctgtgcattcgttagtccgagagcctcactgctttcatactgatgcttcggtattgagataagtgcgcctcttacaaggtcgcccatttcggcagtgccccataatacgaatactattatagaggccgcttcgcccgaaagatcccaaccgaaagcccttgtcgttccgaagaacattatgaaaagaagcacgagctgcggcattattcttataaattcaagatacacacgaagaacggctttcaatatcctgttcttctttgtcataagtacgcccattccgataccgagcggtatgcttatcgcaacggatacaaggcttatccagagcgccgtccaaagtcctccgagaagtcttatgaagttcgtacccttgaacagaacgtctattccgagattaaccgccaaatcctgcacggcgcaccctcctttcaactatcgttccgacaattgagatcggaagaagtattatgagatagaagccgaccagcaggcacagagcctcggtggtatcgttgtacattcccataagatcctttgccataaacataaggtcaagcaggcttatcgcactgaacacgctcgtttccttcataagaaatatcacgtttgcgacaaatgccgggatacttaccgacattgcctgcggaagtatcacataacgcattgcctgcattttgttcattccgagagaataggcactttctgtctgtatcttgtctaccgattcaagtccgctcctgaaagcctccgccatatagcttcctccgaggaaggcaagtcctgcgataccgcaggtttcggcgtcggtcggtatgccgactttaggcagtccgtaatagatgaaaaaaagctgtactaaaagcggtgtattgcggctgatttcaatgtagacggaaactatacggcggataaccggtaccttgtagtactgaaccactgcacatacaagccctatgatgatcgagaatattataccaagaacaccgagctttacagtcagcagtgcggcttccccgaacagcggcaggtactcagcgatagcgttaagatccataccgtcacatcctttcgatttactgtgccacaggcaaaataaaagccgggcaattatgctcccggacaaatgacagtcgccgcagtgcttttacggctgtatgacaacaatgccgctgcacccaaatgccattttacttgtccgggagctgatacagcaacacattattctgttgtgcgttgatgaaatagtagcgtacatcgtatttcctccgtttgtttcaaaacttataattctcatcggttttgttccgatgatgctattatactacccaaaacctactttgtgcatacgagatttcgcggagtgactggagttcagacgtgtgctcttccgatcttgcactattttcgtaagaattacaacacagaaatcagcattgaggagtactccgaatccagagggcttagcaactgttggtttattcagtgctttaaagaaatcacaggttccagtccgctgcaatatatcttaaagctgcgaatctccaacgcacaaagtttgttagaaaatacgtactacaccattactgaaattgcaaatatggttggatacaccaattcgctttatttcagcagactgtttcataaatacattggtatgtcaccaaaagaatatcgaaaagtaaaactcaaagaaaatctcagggagtaaaaaacaaaactcgtttggttaaagctaaaccaaacgagtttttgttgtataataaaacttgacacccacgctcaaaagaatatactaaaacgaggagggtgacgaacaggtcagaagcaaagaaatacgccactttcaacctttatttatctttccttgacatcaccaccacgcactccacgtggcacgattgctccagattgatgtcgagtgtgtagccaaattcgcgttcgttcgcgggaatttatcaaagcgtgtttttttcataaaatacacccatttttactcttgtgcgttctcggaaacaggtcaatgcacttgctcctacctataatatgcaaacacacagttttgctgaccgcttcaagacctcgctctgacggaacaagtatgaaatcccatcgtctcaaccttaattcttcccgtgacagaatttgtacttttttccgcttccgcatggacatggatcattacgtcctatcttctttggccagtttgctctttcctgaaccataagtggtattttgtcatcatacataagagaaagttctcttagtcgatacaggtattctgaaacacccaataaggcctgaaacatgtgcattgcttcattttcaaattcgagaaggtattccgttttctttatggttctgtcttttggatttggaatgtaagtaataacctgactcaccgcgtcatattcaacatcattgtgtccaatcgcatttctcagttttgcatttactacaacatccaagaaatcggtgtagacttctgtgttcaagcaaaaatgataccttgatgcctttgtgagctttatataatcctctaaagaagatacattcttttccaaaggattcatcgaattcgcgtcagccctgtattttatgttattaagagcgaccgggataacaagcaaattaccaagggcttcataaacatccaaatagaactgttttacattatcaaagctacttgttgtcgagccttcaacttcaaaatcaaaagaatcatctttgcaatactgtaaagcgagagcaggaatgaggcgctggtatatttttataaaatcatcatagaccttatatatcaaatcctgtagctcctcaaaatgataaccatcatgtgaatttaagaagtctactaagctcttcagctgaacagagtccagtttcataattcctgcactaaaagagagattatccaagatatcttttttgagtgcagaataaaacccatgaacctcaatcatatgaacagctctcaatacctcagactcatctctgcactgaaagtattgtctggagaattccttttgtatctcctgaacaaggtattcactattacttctgaagaggtcaatgattcttttatagctcttccatttcttttctgttgctttaagctgtgataccgcttttccgaactgctcatatgaatcatccgtcttcatacgattcatatagcggataaacggagtaatgacgacttcttccaactccgctgctttgccttgtttcacggtcggaaattcaccagagcattcaaccatgtaatcagcttcagcatccgggatttcatccgcattgtcaaaagaaaactttagccccggtcggtcttgtcctatcttaacgctgccagataaggaagtaccacatttaccgcaagccacaacaataggatgttcttcttgccatccaacctgtaatcggactctggtaatacttccgcaaacctgacattttataaatgtattaaaaaccatgcattttctccattcatattatcaagcattaaatcgcctcaacctttgacggctccgcaagtgcatgggatttcattgtcgtagccctaatatgcctctgctgggatcgatgatccatctctgacaatcttgattgttccatcatcagaaatttctattacagagacatcttcaagcaaatgcccatgtgcccgaacataatactcagccagtgtttcctgcttgccacgaaacactgcttttttcatacaaagcagcttctttgtcccagaaggcagaaagccaaagtaaaatacagcctcgtccaagcccatcaactttgcgctcggaacattcccggaatcagtccacgtataacatttgcattcagccacgatagacctgtctgcattggcaagatcaaacttgtgctcctttggcggtctgccgatggggattgctgcttcttgctcaaaatatgtattatatttttctttgagaatcgtttgaacaaattcttggaacttgcgtccaacgtgcggattctcagaatttaaatttgccatcagtgctcctcgtcctgagtggactattgccaatctaccgttatatacggcacaatcaaatcgtagaacttctttgaccattctgcatggaactttgccatctgcggccagtcatcctcgttttcaatgctcacattatcaagctgaataaataccttcgaggatttgatatcatctccacggttccactgaagctccgttcccagcttcgattcaatctcgctcttatgctggtaaagagcatcaaacgctgctttattctctgatctctccgctctggcaaatacgacctctgaacgtgcagagtcaaaattcgcaacacagcagaggtagaaacctccaatgccaaagaagccgtttatccaattgtccgtactcggatttacattgctgaaagagccgggattaccatgagcctcatggatttgtgttagggcatacgtccagtaacgttttctgatctcaaacctcgtttcagaggaatcaccgcttatactgagatgctctccggcattagataatgctgtcgtgatccggtcaaaatggtcgatgatccaatcaaatattttcggctgctctgctggattgaatacatcagccttctcctcaataacgatggaacgtgttgtacctgtcgattttgagcattcccaatttaggttctcatcaaattcggcctcaatctggtcttttaattccttcagacggttataggtatccacattataggtgtagatgcccatcttgattcgtttaccatagggaatagaaaagaataagtgatatccgttcgcgcctatgtgcacatcgtaatatgtacgaccagcagctttctgttttgctatatcacttgatctgccgtgctcataagcatagtttacgaatgctgtccagaattgcagtttttgatcatctccggagccttctgcacttttctcggatttcggtacgtttgccgatacttcctccaactcctccgggatttctcgtccatctttgacgaacgaaatgccaatcagcttttccaactgttcttcgtcgaattgcaggttccagcgttcctgcatgaaaacgaggagcttttcagttctgctgtatatctcaaatgcagtccaatcctgcagtttggatacctctatctctgagtgagatccattctcgtacccgcgacgtcctgtggttttggaatgcttcttatcctcaaaactatcattctgcaaagccgagtttacgctctgagacaacggcagaaggttcccaagtgctccggaaagcatcttgatttctgaatccttaaactgccggtacatattacgccagtaatacttcgtcggtgtctgagggagaatatgctcgatagacactttatccttctcggactttgtaaacattgaccacgtgcagaaacgatctatattatttttctctgccagcttagcctcatattcataaaagaagtatcgtagactgttccagtcgtaatagccattccctgtagaaaaatatttctcaattctggtgacaaagttctgcgtggcaaaatcgatatcgttcgttgtcctgtcatatatttctttgcagagctcatcaacatccgtttctttcacatacacctgacgtgcagctctataataatcactgctgccataggatgcattaaaattacccaagcgaaatgcaacaaagataaagcgctcaactgcttcaaagattttaactctgctgtttgcagaaatatcccgccgactgatgaccgcagtaactagcggcctgaaatgtccgatgccgatacggttaagcctatcgactcgtttttgctcttcaggagtaagattagcactttcaaatgggaaataggtgccataccagtacttcgccatatctttgaggctattgacatagtcctcgatttcttttggctggagtttggatacctctatgatttcctgttcttctgtttcagtaacttccgtgtcgtctgcatcagtgacatcatcgctgataaccgactcggcctctgtctcaaccagaacaggtgccttttcaaatatgccctttgaagagaacttgcttagcaggaatttgatgtagtcatcgccacgtttacgggaatacctgaagtagataatccaatgggcacgcaaaaagtcatcatcggaaagaggaacactcttgttcctgccaagctgatagtagacttccttccaagtgtcatttatcttcttacggagggcagacttgtccttctcgtcaaacacctcatcatcataaagcgtggttaaatagattagtctgtttttcaacaattcaagattcgtcagcttcttaccacgattgttcatggtctcgaaagctacaaacacatcgtaatcatcgtcgatttcatggagattaaacatcaggcgctgggtgagcttcttgtacagagtatttactgcctcaagtccgccttctccggactcctcatatagctttctgatgttctctgcaaaaaagttctttgcaaacttcagattttttgtatagtaagtctcattcactgcaccggaatacggctcatcgaacaccttatatttcatgtattccgcgctgggattatcgacctcatagccaaaaaggtatgttgttactactccattcggcggtctttttcggcagatgtattttgaaacgatctcttcgactgtttcataccccagcgtgatttccttatcagacttgcccttgttctcattcaagccgcgcacgaatcccacaatctcgttcaagagaatgacaaacgtggtgatgcgctgctgaccatcgactatatggcaaggcttatatccgttctcgaccagccacaagtcctcgccccaactgacggtctccttgcattttagaggcttaagggacaggagacctgtatagtgatagcggtcagcctgaagatttacaaggtcatcccaaaaatccaccaactgttgctgcaaccatgcatagccacgctgatagtccggtatcaggaataatctattttgaaagagcagcgacaatggctgcagctcatttgccataatggaatgcctccttattcgataactccatccgtatcaaagatgtgatcgagttcgtctgtatttattgcatgagagactttatcacgaatagctgttttagacatatccagcctcttaaactgattctttccgattgcatccttgctcatgcggatgagctgaattcttccaactcccggattctggcgtgcgtattcagcaaagcccttagccttgccaaggttatctttaaaatctgggctgtgaggctcaaggatatcaattacatacccaacacgctcatctcttcttacgacaatgaagtccggataagtcggcttgatttctccatcgatttcatacggaatgcagagtgcccatgagcctctggatggattacgaatccagcatacaaagtccgggcgcttctcctccgtctcgatgagctcggcttcccatccgttcaatttcagctttgcagttccagtcgcttcactgacaaaaagatgatctctgtattccttaccaccaacctcatgaggaacctgtatagtttctggcaagcggaaattgtgcttgctgacagaatcaccatcagagacaatactgtcatattctttgcggattttctctgattctatggtggcaatgtatcttctataatcgtcattcaggccgtgaaaacgggtctccgcataggaatgcaaccggttcatacactcttcatctgccacaaagagaataacgtcaactttaaatgccgtcagatcagacatatccatatacttgtttccataggccataccgatgccttctcgaccgagctttacgtcggcaatctgaaattgccgctcgatatcagtatccgtcgtcgtgaacatatcatgcaccgaataattgtccacggtttctccaaaggcatcaaaaatttgagttgccagtttgaactgcttgacctgctgtataagatcgtcatatttcccgtctgccttgagaccttccgcataactgtgaatcatctcaacaatctcatcctgaacctcccggatggcctcacggtgtaatttggacatcgtaagcagatgtgccatcctatacagagatttcaggtagtcattgatcctgagcgctctaacgttataggaaagcaaacctgcatcatttataaatttcataacctcttcacggtcaaacagatcttcctcttcaggagtttccgtttgagccgtctgctgacttcccgcagcatcattatcggactgtgcagcagtgtccgatggttgtggtgtaaccggtgcagactgagcgggagtcgttgtatctgtgctcgactgtgtttggatttgctctgtcgtttcagcctgttttgcttcttcgccagtgacttgaggctgtgctgtcggagtagagtcgacagctggctctgttactccggcagactgctgttcgcctgcgttctgcccagagaacacatcgaatagagtcatctgtcccggcgtctgctgctctttctttttcttcttcggtctgacagtcagcgtttcaaatttctttccggacaaggactcgccataaatatcggtcgggatatctccgccttctgtgctctgcaaggcttccacaacgtccttgacggtatcctcattgaagtacggcaaatagagatgcacgtcgttcaaaacgtcgtccacctgaatatgcatctgcatcggcgttcttaccattcgaccgagaagctgcgcaatatatgtggcgtcgttagcgtgcttaaaggacatcatggtctctgctcgtgggcaatcccagccagtagaaagattctctttgaagaataccacgcggatatttctatcctcagcaatattggatggctcctcgtagcgcacatcgagcccattgacagtcagtgttgctgtcgtactgccgaaggtatgaaccacttgtccgctttccatcttgaatccggttcgttcctcaatctttgcaatgcagtcgtccagatttgtatccgtcagggcatcaccggttccattcaaaacctgaatgatcaggatcgggtttacataggcgtagtgctgttcgaagcaatactgcgtccaatgctcccacttttctttccaatcatccgcagcagcctgcaaaatggccatatcattattgaccgtgccttcttccggataggtaataacaatcctatcttttaaaaggccagaagctcgcacctcatccgtcgtcacgattgacttgtgaattgtagaggatgtaccttcgaccagcgcattaaatctctgcgtggtagcggacataccgatgacaaccggcatgggcggaatgctatccgaatcactgcccttgatgaacttctgcatgatcgtagtggctttgcttgcctcacgtccctgcatgccacggtgcgcttcatcgatgataaagtacaaccggtcgctcttttcccggacagtatttgcaagtgtctgccagatcgtataagttctgccatcaccgtttttcgtgagcttggaggtaaccgacagcttctgcgtatttaagaaataaacatgaccatcctcaaacacctctttatcaaaggattcctcggaaaccgtaacacactgcgacagcttgatcttatctgccttggagtcaatcttttgctttgactgctcgttcagctgaggcgaatctgagagccagactatgattgcatccggctgttccatatactgttcgtcgccgaaaagaacagcctcaatcagcgcagacatgatgatagtctttccagcgccagtcggcgcagtgaaagaaaccacctgcggtgcatgtgttctgtgatagctgcccattgcctccgcagtcttcatgcggatatcagcaagagctctcttctgaaaagggaataattctactctcatgtttacctccctgtgttaattctgaaattatccagatagtctctataaagctgatagcagtctttaccatcgtaagtacggatcatcgaccggtatgctgtttctgaatccgtcacaatgaaaactgtctggatttctggatgctgacttaactcagcatcaaactcggaataatatatttcatctaccaaaactgccaacttgttctgtggcaaaatcagcatgttcgggagatcatcattttcaagagctgggcacttaccaatggctccgctcttcatccagagcaccggcaacagttccctgaattgtctaccaagtgcgacggatgtcttgtcgagaaaactaatcttgaaaaaagctgcatttgcaagaaagccttcactcattggtatctttttgggttcctgctcattgtaatctccaagcaagctctgaattttgtctttcaatgaattaaacaagcgattatttggggttactacataaaactcacgaatatgatcctgtccgtcaagagcctcaacccactcatctgcagcactgtcatcaaagagtattgatatatcatatttctcagaaacaatatatttcgtatcagctttggctaaggactgtgaaatgcgtcctttcccaaacaaagaaagtagttgctttttcttagccgcgttttcgaccatctctttagtggtaaaatccagctttctaaatgtccttgggtacgatttttctacattcgtagatgcaaagtactcaccattcaaactcgtaccatcatcaagacgacctaaaattgagtgcgttgtccttggccatgtcactgatttacaaattccatgactttcccattcttgatctcccggtttaaagcccttcgttctcagtatttcagcgtcctcatttgcaacttcattatttgtaacaagaacgcacctcctgttaccgttatcctcagcatttaataagttgactgcatgaagcgtagttccgcttccagcaaaaaaatcaacaattaatgcatctggattgttccctacaaccatttttatagagtctctttcagcatataaagatttaggaaatgtaaatgctctggattgaccaacaatatcagatactaaatcggaaccataagcacctgcatcatgcaaagttctatgccaaaccgtctttacctgcttctcctgctcatccgcatattcgactgttaccgttcctgtgacggcatctcttgaagtgatgattatttctccgttctcaatttggcgctgaggttttttactcagatacgaaattccccatgtttttctcttgggatcatatctccccagcgatatatatcctttggcgagcatatcgttaaaagtttccacgctgagcatccatctaccttctgacagatcatcccgaataggccaagcagcttcatagctttcaattttttcgccatatggaggttcttccggaaatggcacaacagctccagcttttactattttcttatttattgggtctatcagcactgggtaaaacaggttcttactgtcctctctccttgcgccctctccagagcgcaaaagtcctttccatcttggctttttgcttgaagttgtttctcctaacatgggatcatttccaaaacagatggcagctttgggcataaaacaataaattgcatattcttcaacccttgaaaaaaatcctctggttgaaccctttggattatttactattgtcaccatttgaatgtaagcttccggcaacacctgatctaaaagcgttctcaaatgatgaacctcatgctcatcaatggtaacaatcagaactccggtctcaggctttaatagtttttttgcaattttcagtcgcttctccatcatggaaagccacttgctatgacgatatgcatccttatcatctacatagtcattgttgtatttccagtctttggcaccggtattgtatggcggatcgatatagatacagtccaccttttctgcatagagatattccagaagttgcagcgcatggtaattgtccgcctcaatcagtgtatgccaaaggccactgtccggagcgttctccacagtgtcaatcggtctcagtgtcggataaatcggctcaccaaattctgctactgcaacgatctcatccagcttgaatgttatttgctcgtgcgtctctctgcggtcacagagcacatcatcgccgtctatcttcacaacggtataaatatcgctgacgtagccggtcttcagcgcaacttttgaaccgacacgaatcggcacatcatacagaggcgtgcactccggcagatgctcttcaaataccaatccaaactttttctttttgagtaatttattcgtctcctgcaggattcgttcccgaagcgccggatcatcaatctgctggatcaggtcttgtaatagcgccataatgccacctcattcttccgttatcgttttttccttaatatgataatcaatactgtgctcctgacagaaggaaatcacttctgttgcgcactcattgtaaaaatgcctatgcccttcgtaggcgtttgctaccttactatagttcgttctcccgaaaatgatccgatctgtaaaagataccgcctcaagcagtgcgtgcagatcctgctcaaccatgttcggtgttggatacggttccatacttacccatgtcttacaaccggcatcatggagtgctctcaatgctgccagtcgatctgcgcaggaagcagcgcccggttccatctgttcccgataggcttcatccaaagtgatcaatgtaatcccgtattcgttttccggagaaagctctgccaattctataggtagcagacccttcgtcagcgtagtgcatttgattctggcctcgttcagctttcggatagccgcaatgctcatctgggacacctctggatatccttccatgaacggatctgtggtaaagcaaagctgcacagactgaatcttatctctgagcctcggtatctctttatccagcaattcaagcgtgtttgatacaagcactggctcaagccagctctcataatcctttatttgcccgaatcgcttcttcatcaggaatgcataacatggatatttgcacccatgagcgcagccctgcacgtgattcattgtgtagtcaccatactctacccctgtttgataaagcatggattttcgttctatcgtcttcaagttgttttcatcctccgcctacttgttcttcaatatgtagtctgccatccgcagtgcaagtccctgcgctttcgggctttcactcgcaatggcaaaacagaataggaacatcggcgagttcctgctgtttctgaaaatccgtgcatgctttgacacgcatggaaagattgtcccaagccgagagaggatatactcctttatgtgatctggatttgcgtctttaaccatccgtttgccatcgctctgtccgggctccggaaatagatcaaacagcgttatctggggatctttcttatagaattcctcgcgccatccggaatctccaagcaatcgatctacgcaatcctcccatttatcgtacttcccgtttttcggcagcatccgttcaagtgccgagaacggaaacaggtaccatacatctattgatttcgtctgcgctacattttcaagcgtagtccaatttacctgcgtcgcatacggatctaaaaacagcaatcctctgttaaatctccaatctacattgctaataatctccgcaagcttatcgttcgcatcgccgcaaaaaattgtcacaattcgcctcatctgcgggaactcggagtttatcatatcttgaagttctcccgccttctgagagtccgcttctataaaatagtagtgatcaaacttcttttcagacgccagtgcacgcttagcggagcccacgagatactgcccgccgtcgctggtttcaatctcgccggttccagcaaaggcgtctatataaatcttcttaaacttctggttttgtagtgcaatcaggtatgcgtccagatagctggtgaagatattcagcttctcctcagtccaattgccaccaaatttctgcgacgttgccataaattccaatcacctcatctatatgaaactctgtctcatgaagaaaaagagatcaccgtttccttctttcctgtatcaggattcacaatctgttcgatcttcgcgtcaaagaaacccgtgagatcactctttatctcattacgaaatccctctgaaggaaaaatcggatggttatccaaaagttcccacatctcatcaagaggcacttgcttacggcctttcaggcagcgctgtagatatttcgcgatgtcgataacatgcaaacagctttcatcttcctcttctgtaatctctccgaaaaggttgaatgacaactgcctgttctcaaccgaatgttttgtcgaggactgagctccgaaaactttccaagcactcatcttgtagagcttaaagccctctttgttgctcgtgcagtgaatcagattgtagacgagcgaattctgcgtgttatagaacggaaatgccgatacatagtatctgcgggctccttttagtgaatttatgatttcctccactctggcctcataggccttcttgtcgcttccgtaaggcaccagcttctcaaagtcttccagataagtgttctcatactttgccttggtcgttttcttcttggcgcttgtgatcgcccgcactggatctgaaaccatgtgattaatcataacttcaccccagttttgaaaaaacggcagaagtgcttcccagtcgatggtcgcatcatacggatcgtagagcaggaaataatgcagatgcccggttccatataactgtggcccgatagttcgaagtagctcgtgcgcatcactgtaggacgttacaatcttaaaattgcgctcatcctgtggaagatgctttttcaactcatctacgcgcgctttatccttgtcatttaagtaaatgtgtatatttttctccgtgtaggttcttgatgcttcccttagtgcttctgagacgcgtactgctgtacccttcaccaattgcccggcatcatcggtatatacaccactgttgcacatgcagtctataaagatcagcccattgcaagactcagtcagcagcaacttctgcgcccacgattttatatattcctcaatcaactcaaatttcttgatcgtatgaggacttgctttactgattacgctctttttcctgccggacatcatatcactcctcaagtagtttcattatcttctgtagggattagctccatgatgtccccaatatcacaattcagcgttttacacactttcattagaacttccatgcttactgtctctcccttcgagagcttggttaccgaagcccagcttatcccggcagctgcctgtaagtctttcttcttcatgtctttgtcaatcaatattttccacaattttttataactaacttccacggtagtcacctctcgattttcaaaaacgtgatttttgccactgtacttccacagtatagcacagatcccttaaaaaatcaagagtaattcttcacgttcgcaagaattttctttcattactattgaaaaatcagcgaatttgtgttatactgtgcttgtatcctcaaattttgtgtccaagaaagggagtctgctggccgtgggaacgtataacaacgagatcgagcagtttatatatactgtgtgctaccgccccatgtgggaggcagcttatacatacattgcagagcatccttatgccctgaatttatcttactccagaattcagaatccggattctgccatgcttgaggacatgatcctcgaatatacaaagaatatccgaatagatgaagacagccttctgtttgacgcagtcgtaagctgcacaataaatctgaccgaagatacttacaaaggcacagcatcgcacgaaacaagtcaatggcttgtcctttcctgtgtggcggtcgtaaccgataaactcgaatctgttactgttatgaacatctccgggcacacctctggccaacctcgcaaaacggatggtcatgccgtctcgaagaacatagttccgatcttatacaaaaaggatttggatgatgaagccacaacttttctccagcattatttcccagaagcactggaaaagccaatggccgtccctattgctgatattgcaaaaggtatgggacttgaaattatccaaggcaatcgtatcacggatgatttcagtgtttttggagaaatatacttcaatgctgggaaggcaaccatctatgatctttttaaggtttcagaaacaacaatcgatgtaaagcgcggtaccattttggtagatgcctacaccttctgggagcggaatcttgggtgcgtcaaaaacacaatcgcccatgaagtctatcactggtataagcaccgattgtatgcagcgataaaacacgttctctatggtcaggacttcgttgcatgccgctgtccttctaatatggcataccctcaaaaagatgatgagtggtctgatatccaacgtatggagtggcaggcaaacaatatggctcctcgtattctcatgccatatcgtacttttcgaatgaaagtagatgaacttctacagacatacgattatgaaaatagtcctataaaaccagctattctcacctccgttgccgaggagctacgcgaattttatggtgtgtcccgtcaatcagtattgatccgtatgatggaaaccggctacaaagacgctgctatcatttaccagtatgacgaaggatctccataccacggatacttagaccagcgtgatgcgttctacgcctatcgcaccagcagtgaattccgcaaccttgttgattctggtcttttccggtatgtagacggatactttgttatcaatgacgggcaatacatcgagcgtaacaatgaaggcaagccgacccttactgattatgcatgggcaaatctgaatgaatgcaccctgcaatttacatggcagcccctgcgagcagatgaagcaaaaaaacacttcccattcgagctgtttcaccgtgaaactggagagcgcaaagcatcaaaatatgattccaagcaaagcgcctccgctgttcagatgtccgaagcgctgcaaaagaagcgcgaagaattcgagcgccagagcgccgccagaaagataacaggtgtgaataaaacctgctgggaggtcatttttgagattgtgcaatctcgcggacttagcaaatcgcatttctgttctttgaccggtcttggcgaagaggtgtaccgaaaggccgagaagaacatcggcacaaagccaagtctgagaacgattgtcgctataggcagaggacttgaccttgatatcggaacgacagaaaagctgttgcaacttgctggacatgcatttgatgaatctgacgagcaccaagcattaaaatactgcatcaccggtttctctgggatgaccattgatgatgcaaacgagtttcttgaatcatataattatgagccgctcggctccaaacaacgcctgtaagcagacttaatttaccgcacttccgtcatggatgtgcggtttttttaatttttccgactcgccgagtcggatttttttatgcccatattccttaccatcgccgtcttttcaaaaaatctgcaccctatttaaggctcgtaaaaccgcctgttttaaggtgtttctgcgactcgtcgagttttctgatttttctctctcctaactaaaatgtaattagcacatgggagccatctgtgcagggtgtttccggttccacgtgactaccgatgacaatcaaatactgtaccgatcaccggaagtgaggtgcagccgaaatggagtaatccttcggtatgccctcacacctgtggtatggttttgcatgtctggagctctccatttcggcaaaagccgaaggagggctttcattatgcaaaacaatgacaatcagaagacctattttatctacgttcgaagcaccggcgagaaagtgccggtcaccaaagctcagcacgactctttctataaggaagccgaccgtattcgccacaaagagcaggatcacggcaggtgcatgtgtccttaccgcttcatctggaaatgtgacggcgactgcatcggctgcgaataccatgcaggaggtgacattacttctctggatcagcctctcccggacggcaacggtaggcagattataataacaagtgcaacagaaaaaagatagacttcatatcaactttagtgtaaaatgtaaataaccacaaatacaaaaacacggaggtcaatatgaagtcctacacacattttacactagatgaacgaatttgtctacaaaaacttttttcagagggattaagtatgcgaaaaatcgcatcaatactcggaagaagcccgtcgacaataagccgagaaattaaacgcaactggagcaaaaagaaaaagcattatcatgcctggggagcaaacgtcaagtacatctgccgaagaaaaaacagtcacagaaagaatcgtttgctgacagacagcgaaatgtacagatttactcatgaagcgttattaaagtattggtcacctgagattattgcaggcagatggaatgttgaacattcaacaagactatcgttttcgtcaatttaccgagctgtaagaaccggacaatttccgggaatcaagccgaatacgcatttcagaagaaaggcaaagccttacaacagcgaaaagaaatcttacacacgatttcttgaaaactcgattcacgacagaccgatagatataaataaccgtactcgattaggtgattttgaaggcgatacgatttacggctctgtcggaaaaggctacttagtaacagcgattgacagatgttcacgcttgcttgttgcggctaagtgtgaagataaaactatatctgttatcaacaatgctttttcgaccgctttttcaaaagtgtcggaattgatacagccgattactttgactttggacaatggctcagagtttaacggcttcaaagaaattgaaagggagaaccatttaaaggtatattttgctgatccgcattctccttggcaaagaggaagcaacgaaaatataaatggtctgattcgctttttctttcccagaggaactgatttccgcaaactgccacaggaacaactggattctgttgtttccttgataaataacagacctcgcaaatgccttggttacctttctcacattgagtttatcaaaaaatataaaaatatgttgcacttggcttgacaagctgggctcctgcaaggcggctccatcgcaaccggctgggtaggccatgtatcagaaattcaatggacggaggacggataaatgccagagtttacacgctttacagagacaattacaaaaaagcagaataagcgcgtcataaacattacggtgaagcccaccatcacagattgcaccggttcagtctggtttaccgacctgatgctgcaggaaggtgataaagtcacaggctttgtcatcaataccgaaacacttctggaaaaatatgatggcgatgacgctaaagcagacaagagattttataacggtatcgtccgctcagctgcaacctgcgtcatcttcaatatcggctccactgctgccggtcttgactacaaggtctatccgattcaggcaatggctgccgggagtatatcactggcgctgggtgaaggtgcccataaggcaactttcaaagcagcagcgactgccggtgatgaatttgaccttttcgcttctacaagggagtgcctgaagaacggcgctgcaatagccaagaacggcttttttcaatactctgctgccggtgacagcaagcacccgatcacagtcgaggataaaaaaatcggctcgaatctatgtagtatttcaggaaatgcgggacggaggtgatgccctgtgagctatgattatttgaaaggccacaagtgcatggcctggacattcatgggcaattccagaatgtatcaggcacttgccgcatatggagaccgcctgtcacaggtgggtctcttttcttttaaggtatcgcgcaccggtatcatcacggaaagcggcgtggctatttccaatatgctgacatacatcaaccgatggccacacatcaaatggctgctgactatgtccaacgatggcacgaacagtatctttgcagctctccgggataacaccgacggcgctcaggataccttcctttcggagatcgtccgcattatggaaaaatacccgtggcgcgacggcatcgacattgaccttgagaaaggcgacggatattccacgcacgctgcctctacggcgatgtttcggaatatctataacacagtaaaagattatgacagcagcaaactcatgaatatacgcctgccgtgtatgaattccatcaacggctcggtcggaggtgaaaactggtgcgtttacggcgacctcaacgcttactgcgatacggcagccatcatgagctatggcatggcgtgggcaggctctgctcccggagccgtctctccaagggactggcttgagggcatttacgactacgcggtcacggtcatgaatccggagaagatattcttcggccttcctgcatacggctggaactggcagatttataatcttcctgcaaacctcggtaaaacctatcgcggcacatcaaatacctactatgcggcaaagaactggatgaccggacaatacaacttcacggacgatgttccaccgcagcccttcatcccgatcctcgcatactgggacgattacgacatggtgccttgggcgcttccgcaggtctacgacttcatggaaggcagcttttcggaggctccctctgcgggcactgcgacctttacgctctctccacgccactttatcgacgtggacggcaacgagtgtcagctggacagagctttcaagctcacctgcgaaatgctgaggcgaaagccggactctgcccttatctggtatgaggatttccgggactacggtgtgctgcaaacaaactactggacgaccctttcaggctcttggacggtatggcacgaagatgaatattccgaaagccgcgtctactcccagcttgacggctccggaaagctcgcatggcgatacgacggcttttccgatattcacctgcgggcaaggctggtcttccctgcgacaggaagtggcaaggccggagtattctgcggtgatctattctgctgcctgaattacaacacacaggccgttgaattatataacgacagcacgctacttggaagctatagccagaccatagagcggacggcaaatgccgaccttcgtaccaatccatccatgtacacagtcgagatgcgtatccgtggaaacaaggtgcgtgtctattccgaatcttcctatacgctgcgcttcagagccgtgctgaacggctcggcagaaacggtcatgtaagaaaagaacggtcggtgaatgtccctgtgcggttcacatttatcagcgcagcggattacttcgaggatcccattcggcaggcagaatatatgtatggattgataaagacagaggtgacgaacattgagtaacataacgataatcccggcaagaccccagcgggctaactcacagcagaatgaaacggaaaaaccaaagcttcgggtggctgcgtactgtcgcgtcagcacggacagcgatgagcaggcgaccagctacgaagcccaggtgtcgcattatacagagcagattacccgaaatcccgagtgggcatttgcgggtatttacgccgatgacggtatctccggcacgaataccaaaaagcgtgaggaattcaaccgtatgatagccgactgtatggacggcagaatcgacatgattatcacaaagtccataagccgatttgcccgtaacacgcttgactgcctgaaatacatacgtcagcttaaggacaggaatatccctgtgttctttgagaaagagaatatcaacgcgctggacgcaaagggcaaagtcctgcttacgataatggcttcgcttgcacagcaggaatcacaatcgcttagtcagaatgtgaaactcggcttgcagttccgctatcagcgtggggaagtgcaggtcaaccacagccgcttcctcggctataccaaggacgagaacggcagacttgtgatcgacccggagcaggcagaggtagtgcggagaatttaccgtgaataccttgacggttacagcacagataaaatctccgccggtctggagcgtgacggaatactcaccggcgcaggaaatccacgctggcatacaagcactgtagccaagatactgcgcaacgaaaagtacatgggcgatgcgcttctgcaaaagacctacacggtggattatctttccaaaaagcgtataaagaataacggaataatgccgcagtactatgtcgagaacgaccacgaagcaattattcctaaagagatttttatgcgggtgcaggacgaacttgtgcgccgcaggcttgtaaaggtcagcccgaatgggagaaatcacggtttcagcagtaaccatgttttttcgcagatgatagtctgcggggagtgcagcgagctgtttcgccgtgttcactggaacaatcatggctgccgctcaattgtttggcggtgcgttagcagattgcagccggctgatgtgatttgccacgcccgcacggtaaacgaagaagtgctgaaaaatgtggtcgtgcaggcattcaacgaaatgctcggtagcagaagcacctatcggaagaggcttcgggataaccttgcagcggtgattcgcgggtatgctgatgacgaggctctggagatagacaagcggcttgctgaacttcagcaggagcttatcaaccacgcttcccgcagggaggactacaacgacatcgccgatgagatattccggattcgtgagatgaaacagaagaacttcacagacacagccgtccgtgacgagcaggtcaagcgtatcaacgagctgaacgagttcattgagcagcaggattccgaacttaccgagtttgacgagagccttgcccggcggtggcttaaggagattgtcgtctgggacgaaaggttttctgtggagttgaagtcgggggtgatagtgaatattgtggtgtaaatgttataaaaatctaaatataattacgccctccttattacgaaattaggagggcgtaattatatgaaaaaatcacattctttgccaatggacgaatggagaaatatcgataatgttttgagggggaatctgtaagtcattttttataagaagaatttcttctcttggagcgccaaaggctgtatcgtaagctttggttaagtaatagattactttttcagtatcatttctgccatcgtcaccgtcatatattatcatatctccaggtgcttttgctgttacttggtatggagtatgtgtattagcccattctcttgaaagcgataaatttaataacttatctaaattcattaaaacttctggacgagcgtgtactagtcccccatatgggctaatgtcccatatggataagaacccgcatattgaaaagtcataataaaacttcctgcctacagaccaacaacaaaattcctttgtattggatttgggacatgatccgaattcaatgtcatatttgtttcctgcataagaaagaaaatgtttgcttaaatcaattgttatattgtgtgcgtctaaaaattgacgtaattcagatttgggacatagataagagtttttcaaatcaagtataccagtttggcgaaaagattcacagccatttgcacttgtagtaacatgaaaaaaataaaatcaaaatccgtgaatgaatttggcatatgtccatgtgtacgtatcacatcttcaactaaatcatcaacatattcatattcttgctcatgtcctacatatttatcccaaatgtccttacttaccccactaagattagtaagagtagcaagagcattggtagaagttctaatatcaaatattttactattcattcgtcatcacctctataatatctatcccacccactatcacagtactcccgcacacccgacccaaaactcgtgtatcgctgcggaactgctgtcaccgtggatatattacctaaaacggaaatctcctataaaacggaaaaccagtatatttgccccagcgtgctaaaaccgcaccgttaagccaaatatcctgctttactccgctttccttgacatcgcaaccacgcactccacatgcctcgtatgcgggaacatatcaaacggctgaatatcggtcactgtgtactttttcgttagcgttttcagatcccttgcctgcgtagccggattgcaggaaatataaactattctttccggtgcgattttcaaaagcgagtttaaaaactttctgtccgctcccgttcttgcagggtcgagaatcactgcgtcataatgcgtgccgagctttgtcttcttttcaagaaattcgcctgcatcgccacggttaaaagcaatgttgcgggtaagcccgttttcgtgacagttctttactgcgtcacggacggctgatgcgttgtattcaatgccctgcacctgctttacatagtcagacgctattatgcctatcgtgcctattccgctgtatgcgtcaagcagaacgtccttcttcgtgagcttcgccgcctttatagcgtagtcgtacagcttttcggtctgtgcgtgatttatctgatagaacgagtgcggagatattctgaatctttttccgcaaagaatatccgtaatgtatccctcgccgtaaagcacctcgttattttctccgagaagaagcatttcgggagtgcggtttaccgagaatgtcacggtcgtaatatcagggaaccgctttacaagcgctttcacaaagtcgtgctttttagggaacattgagtttccgccgacaagagtaaccagtatctctcccgtattctttccgacacggacaagcacatgacgtaaaaagccacactccgtaccctcgtcataaggatgtaatttgaacgatctgagcagctctcttatgcctactattatctcgtccgcacgcttatcgtcaagcatacagctgtcaattccgacaatgccgtttctggacgactgatatacgccggagattatcctgccgtttctgtcagagcggaaaaccgcctgcaccttatttctgtagttatacgggtcgtctgcacctataatttcagataccttgccgaaaccgccgagcagcttttctgtatccttttgcttccattcaagttgctgttcgtatgtcatgttggacagctgacagccactgcattttttcgcaacgggacatttcttgtttgccatttatatttcctgttctttctccaaaaattcttcaagaccctcaagatacattttcatatccttcctcccaagctcataaacgcttctcagcctgtcgggatttctctccgttctgcttatcgttatcggctcagatggacggataataaacaccttgccgctttgttcaagttcgcatagcttgtctatgctttcgttgtagacattgtgacggttttcaagcgcattgcacaagcctggaaatttgctgtagaacgagcgtatcagcagtttgttcatcggctttttgcggtagttcatatcacgggtgaggattaccacctgctttttgtagcccatttcggaaaaatgctcaaacggtatgctgtcggaaattcctccgtcaagatacgccctgcctccgattattacaggctttgatataaacggcatcgaagcagaagcacggagcatttccatatcccgaagtacgctttcgaccttcagatactccggctttcccgtttttacatcggtcaccgttgcataaaacggcacgcccgatttctgataggcttcgtcatcgaatatatcaagctcgttcggcactttgtaataggcatattccgtgttgaaaaagtcgccgcttttaagtaacggctttatccccatgtagttcctgtcgccgttgaaacggcagttatagcggatgaccctgccatcctgccttgacaggaaattcactccgaacaccgcacctgccgatgttcctattatcccgtcaaaatttatatcgttttcaagaagtacgtcaagtgcgcctgccgtgtacattccacgcatagcgccgccttcaagcacaagtcctgttttcataatgttctcctttaaatttatttgccgtattcgttgtcaaattcttgtatttctctgagcatatcctcagtgctgtcatcgctcatatcgtaccattccatctttttcagatacttgccgagccagctgtcgtgaagcgcatttgccacgattccgacttcgctgaaagaattgctaccgtccccgataacaaaagcaagccgcttattatctgtcggcacttctttaaaattacaccctgcaaacgcttctcttactgtcttatataccgcatccaaatcgtgttgctgtaagctcagcactttttcatcgtctatttccactgtgattttatataagtaatccatacctgccgccttttcgggtaatatatttttagtaccgccatatttgacaacatccgcccgatacgctataatattcagtgcgacaagcggatgcgctgtgataatattctatcacttttcgatattatttgcaatacgaaaaagtccgcccgaaaggaaataataaacaatatggctgaaataatagatgttgccgatataaatatacccgagcttgaaatatacactcacctgacagatgcacggcttcgcaaggtgtatgagtatgaacacggaatattcatagccgaaagtcagacggttatagaagtagcccttgatgcaggctgtaagcctatttcgatgttcacagacagaaagtatatcaatgaccgtgcaaacggcataatagagcggtgcggtgatattccggtatataccgccgacagtaagataatgtccgggcttacaggctatgagctgacacggggaatgctgtgcgctatggagcgtcctgcaccgaaaagggcagaggagctttgcaaaaacgcacgaaggattgccgtgctcgaaaatatagccgatgtcagcaacacaggagcaataattcgctctgcggcggcactcggcatagacgctgtgctgataaccccgtcctgctgtgaccctctttgcaggagagccataagagtaagtatgggaacggtatttcttatcccgtggggatatatcggagaggatgagcattggtggcaatcacacggccccgcttatcttaattcgctcggctttaaaacagcggcaatggcactcacagataactcggtaagtattgatgacaagacgcttcagagtgaggaacggcttgctataatactcggctctgagggttacggactgtcgcagaagactatagacggctgtgattacacggtaaagatacctatgtatcacggtgtcgattcgctcaacgtcggtgcggcggccgctgtcgcattcagagagctgagagtaagagaataataaaagggctgaattgcaactaagcagttcagcccttaggctgtcgaaaaacctatataatttttaaaaatggggtcgcaggggcgtagcccccgacagggtctaggggcggtagccccagtaaaatccccctttcccggggaaagggggcagggggataggggtagtgagttagaagtttgtttcaaaaacatactttttctacaatctgagggctgaattgcaactaagcagttcagcccttttattattacattatgaatattaagttatcttataaaatccgttcttacaaccgcacttgtatcgggcagtgcaatgccgttctttctgccaagctcaaagcacttcatcatccacgccatgttctttgcgaggttctgcattgtctgcataccctcaagatcctgtccggcttcaccgggtactctgccgtataccatgttccagtaggtagagccgacaacaggcatctgtgctatgccgaaatacttgttcaggcaatcgaacgatgctgaactgcctcctcgtcttgcaaccgcaaccgatgcacctggcttgaatctgaaagccgcaccgcctgcgtagaatgctctgtcaaggaatgacaggatacgtccgctcgggtgagcataatataccggcgtaccgaacacaaatccgtccgcttctttagcttttgctataaactcatttacatcgtcatcgttgaaagcacagcctttttcactgcactgtccgcagcctacgcaatctctgacaggctttccgcccatctgaaatatctcatatgaaatgccctcgttttcaagcgtcctgcctacttcaagcagtgcggcattggtattgccgttcgccttcggactgccgttgagcatcaataccttcattaaaatcgctccttcaaataatatattgcaattttgcgttacagattatatcaccttgaataaaaatagtcaaggcaaaatttaccgcataatttcatgctgtttatcattccgtcattcccacaacctgcctatacatttcctcatcgtcataaataagataaaagtcggtcggaacaaagtatctctcctgcaataccgagcttagttcatccgcaaatttctccgtgctttcatacttacgggtaatgaccttttcgctgtctgtcggataaattttaagggcggtatcgttaaatattctctgccataattcgctgtgtctgccgcagaaatgatactcggttttaccgaactgagttatcatctgcaacgcctcgtttccgataaattcgctgttatcggtgttgtttacaatatagaatatctgcgcaatatgttcctttacgggtgtaattgaacctgtcagcaattcgacacagtacagattatcccgcagcttttcacatctgtccatttattcttcctccgggtaaattatgccgtgttcctgcctgaaccttgtcattatctccataacatcggcggtatagtcaaggcacattacgtttttgtcgccgtttaccgccttttccatatcggttatttcatagtaaagcgcatcggaattttcacctgcgccgacaagctccgtcctgccgtccgtataggttatttttgcttcccacgctctcggatattccatgatctcgatatagccgttttcgcaggagatcatagcacgcttgggctgttttgaatggagcgacagcataacggttgccatctgtccctccttgtccgacagcaaaaggctcgcctgttcgtcaactccagtcggtgcggttttaagctgtgacagcatattatccggctttgaatcgaaaaaccaacggataacagataaggcatacacgcctatatcaagcatcgcaccgcctgcaaggcttctgttgaaaaaacggtttttcatattgtattccttaaaactgccgaaattcatcgtgataagattcactctgccgagtgtgccgcttttcagaatttcattcagctttttatatatcggcatatgataaaccgtcatagcttcaccgattacaacgttgttttcgtcggcaagtgtgataagctcaccgagttcgtcgctattcaatgttatcgacttttcaacaagaatatgctttttgtttaaaatcgctttcttcataaagccgtaatgcgtattgtgcggagtggtgatgtagattatatcgacatcggggtcggtgaacatttcgtcatagctgtcatacaccttgccaatattgtatttttcggcaaaagccacagccttgccgtgcgttctgttacctacggcgaacagatttcttccgtttttctgcaaagcggcggctgtttcgtttgcgattacgcctgtaccgagtaccgcccagttgtagtttttcataatatgctccttttagatacagcggttgaaaagaaagcttccgccggcggtttttatatgccgtcaacggaagcttgtctgtttaaatgtgttttgtactcccgtcaataattctcagcgtgtacttcaaagtagctctgcggatgattacatacggggcatacatcgggagcctttgtgcctactacgatatgaccgcagttgcggcactcccacaccttgacctcgctcttttcaaatacctgtgcggtttctatgttctttaacagcgcacggtatctttcctcgtggtgcttttcaatctcgcctaccgccctgaacttagcggcaagctcaggaaatccttcttcctcggctgtcttggcaaagttttcgtacatatcagtccattcgtagttttcgccgtctgcggcagcctcaaggtttgcctttgtatcgcctattcctgcaagctccttgaaccacatcttagcgtgttccttttcgttatccgcagttttcaggaaaagggcggacatctgctcatagccctcttttttcgctacggatgcaaaatatgtatacttgtttcttgcctgagattctcctgcaaacgcttcctgaaggttcttttcggtctgtgtgcctgcatacttgcttttagccattttttcatcctcctgtattgcggcttgcttacaattaagaattgccgtttatttactttgattatagtacggaggcaggaatttgtcaataaggctatgacgcaaaagatgtttcttgacaaaagatttttgcctgtttacaataaatatatcttattatgttatgaaagggagatttgatggcagaacaggttacggcaaggcaaaacgctatttacgattgtacacatatatatcttgatgctttcgacaaaaaaggaccgctcggagatttgtgcagcaaagcggttgcggagtatcttgaacggtttacaaaaacagaaaattgttttatgtaataattgactatattaagagaactatcatatgcatatggaggtgtggacataaagaaaggctctccggtggggtagaggagagccgtggatttgtaatatatgaacaaaatatgcgataactgtttcactgatgaattcggttttggatgtactttaattatccggataggacatataaatagcataagctactttcttgaatttttcttgtgtagctttgttgtcaatgtacacttcatcaccaaaactgaaaaaatagttaaatatctgaaaatcagagcagtagaaatgagctatatataaatactctttattgtgaatttgttttggaacgggtaaacgtttgacactttcggcggggatagggcgcatatgaaatatactgtatttgtattttttatatccggattcagtgagatatattgtatacatatcggatttacgactgatgaaagcgattccgttattagtgatttgttgggtaactttagctgcaacttccttactgtatttgaattttctttcttctttgatatccgtcatgtttattatcttacacgaaaaaacagatttgcttattgagattccgttgctttcttcggtagaggcgttagcactgatttggtctgaactgttgtcttccgatataccggcaacatagcaagcttgagaatttgtatcaattttaatacaatatggctgaatcgttctgaaatcgtcctgcggtttttcgcgtataagcttgaagcggattgttttgcaatttaaaacagcgtttttaattgttttgtatgtgtcatatctgaatataatttcacgattgccgcgattcgatgaacaataatgatataatatcaaatctaccagaagcctgatttcatttttaatcaatagacttttgtaggcaaaacgtttttctttggtacttttttcgttgtaggtaattccatcctttaaattctcagaagctaaacccagtgttacaagatcgtcagcgcttactgataattttgcatagttttctgccggatgtgtttcgcacaggatatcaacattatttatacgtacattgaaggttccgccaaactcatttctatatttaatgagctcatttacaatactgtaaggtgttttttgtgtttcggtaacatatttaatataaatacgatcgttagtttttgtgaaggacgtacttggacagttacgtacagcagggcatgatcgtatttctcggtgggtggcatattgccactgcgtaaattcgatattttattctgaagggacgcactatggaagaaaagaacttgactgaaaatgagaataacggcactgctgacagcaagaagttttttgccgatatgttcgactggatgtgcagtattttttcagccattttgtgctttataattatatttgcactttttgcccgtgtgataaccgttgacggagaatcaatggttcctacgttacaggatcagcagaggcttatcgtatccgatatgttctatactccgcaatatgacgatattgtcattctgtatgcggataagctggttaacgaatcctcaggcggctacggcaaaccgatagtcaaaagagtgataggactccccggcgacaaaatcaggatcgactttgtaaaaggtgttgtttacagaaacggagaacagctccccgatgactatacaaacacgcccaccaatttaccggagaacttcccaaataatcaggatgtaacggtcgaggacggaaaaatatttgttctcggtgacaacaggaacgggtcaaaggacagcagaagcaatcagatcggacaggttgatatgcgctatataatgggaaaagcgtatcttcgtatctggccgctgaacgcactcggaatgttataatcgttttttaaacgtatgttagcggaggtacaatggcacaggtatccaatatacagtggtttccaggtcatatgaccaaaaccaagcgacagatagaggctgatttaaagctggttgacgctgttgccgaaatagtagattcaagaatacccgaatccagcagaaaccccgtcatcagcgatataacaggttctaaaccgagaataattcttcttaataaatgcgattatgccgatgaaaaggttactgccgagtggcagaaatattacacggctcagggctataaagccatgatatgcgactgcaggagcggtaagggtgtaaaagcgtttacgccaaacgtcaaaaatctgctctccgaccttcttgctaagcgtaaggcaaaaggcattgtgggtcagtcgctgagagttatggtagtaggtataccgaatgtcggtaaatcttcttttataaacaggatttcgaaggcgggaaagaccaaggtagaggacagacccggtgttacaagaggcgctcagtgggtatctcttgataaagagcttgaactgctcgacactcccggaatactttggccgaaattcgacgatcagcaggtagcgataaagctcggctatacgggtgctatcaaggacgatgtaatggatgtctgcgagcttgcagacaatctgctcggttacctgtgggaaaactacaagggaaacgttatcgcacgttacaagctggacgaaaacacggaaaagcccgaccttgaaatgatagcaagaaagcgtggaatgcttatttcgggcggcgagcctgatatagaaagagcggcggctgctgtactcgatgaattcaggagtggtaaacttggcagaatctctctcgaaagaccttaagacaggcgaagaaaagaaagatttatttctttacgataatgaaatgagaacgcattgcggagtcatctgcggtattgacgaagcagggagaggacctcttgcgggcgatgtctatgcggcggctgttatacttcccgatgatacaatcattgacgggataaatgacagcaaaaagctgaccgagaaaaagcgtgaagccctgtttgacattatccgtgagaaagctgtcagctactgcatagctacagcgtctgtcgaagaaatcgacagtatgaatatacttaatgccgctatgcttgctatgaaaagagcatacgagggtcttgatgtaaagcctgataccgcacttatcgacggcaataagacgcccggacttgatatacctgaaacggctgttgtcaagggtgacgcaacaagcgcatcaatagcggcggcttcaatacttgcaaaggttgcccgtgaccgttatatgaaggagcttgccgaaaagtatcctcagtatatgtttgaaaagcataaaggctacggcacaaagcttcactatgaaatgcttgataaatacggtgcaagcgatattcacagaaagagttttctcgtgaaatatttcaaggcgaaaaatgcaggcaaataacgaaagagccgtaaaaggtaagctcggtgaagatttcacagcagattatcttattaaaaacggctatgatattataacaagaaattaccgcaagccctgcggggagatagatatagtagcgtcgaaaggcgatatacttgtttttgtggaagtaaagacacgcagatacagaagtcttgtaagcggggtcgaagcggtaggatataagaaaaagggcaggataattgcaactgccgactgttttctcgccgaatacggcgaagaaaagcaaattcgctatgatatagcggaagtaacggtttcgaccggtgatgctgtgcgtgtgattgatttcagatatttcaaggacgcattcgacactacaggctatgaaacgcaattttaactctaaagaaggatgtttgttatgaactacaaaagcaccagagatgtcaaggtaaatgtaccgagcgcttatgctatttcacagggcctttcgtctgacggcggactttttgttcccgaaaatctcccgaagctctccgaagaaaagataatgtcgctgtgcgatatgtcgtatgccgaaagagcttacgagatattcagacttttccttacagactttaccgatgatgagataaagcactgcgtaaacggcgcttacaacgataagaattttgcaaccgacaatatcgctgagatttctcaccttttccccggtacatacattcttgagctgtggcacggtcccacctgtgcattcaaggatatggcacttcagattcttccttatctgctcacaacttccgcaaagaagacaattgacggtaagaagatttctatcctcgttgctacaagcggtgataccggtaaagcggctcttgaaggcttcaaggacgttgacggcacatcaataatggtattctatcctgaggacggcgtaagcaatatgcagaagcgtcagatgacaactcaggagggaagcaacgtaaacgtttgcgctgttgtcggcaactttgacgattgccagagcggtgtaaagcagatattcacagacaagagcgttatcgctcagcttgaaaaggcaaataccgtattctcaagtgcgaattctataaactggggcagacttgctccccagataatctactacgtttcatcttatgttcagcttgtaaaggacggcgaactcaagtacggcgaaaagctgaatgtagtagtacctacaggtaacttcggtaatatacttgccgcatattacgctaagcagatgggtattccgataggaaagctgatatgtgcttcaaacgccaacaacgtgcttaccgactttataaatacaggtatctatgacagaaacagaaagttctacacgactgtttctccctcaatggatatacttatttcaagcaaccttgaaagactgctgtatcacctaacgggtgaaaacgataagctgataaacgagtggtttacagctcttaagaatgacggcagatacgaagtaaacgacagcgtaaaggcggctatcaaggaaaacttctatgccggatgctgcgacgatgagcagacaaagggcgctatcaaggaagtattcgatgaatacagctaccttatggacacccacactgccgttgcttacaaggtatacgaggactacaagaagaagacgggcgataacacaaagacgcttatcgcttcaacagccaacccttacaagttcggctttgcggtatatgatgctctgggcggcaaaactgaaggtgttgatgagtttgagcttatcggcaagcttgaaaagctgacaaagacaacctgccccaaggcactttccgatacaaagaacaagcctgtaagatttacgggttcaataaagcccgaagaaatggctgaggcagttcttgaatttataaacaagtaattaaggagcgtttatttgagagtattcacaatgggggatcttcatctgcctttcggcagacaaaagccgatggatattttcggtggctgggagaattataccgagcgcattgaaaaaaactggaacagtgttgtcggagaagatgactgcgttgtgatacccggcgatataagctgggcaatgtcgattgaggaggcgcttccggacttcgagtttatcagcagaaggctcagaggcaggaagataatctctaaaggtaaccacgattactggtggacgacactgaaaaaaatgaacggctttttacagacaaacggttttgataatatcagaattctgcataataacgcttttgaggagtgcggtatagcaatctgcggcacaagaggctggataaacgatgacggcgaaccgcaggatgagcttgtgcttctcagagaggcgggcagaatggatgcttctctcaaagccgctgtgtcaacaggtcttgagcctgtggtattcatacactatccgccgatatacggcaacgagcagaacgattatattcttgatgtgatgtcaaaatatcctgtgaaaagatgcttttacggtcatgttcacggtactccgtgttttccgaaggcttttcagggcgaaagggacggaattacatacagaatggtatcggctgactatgttaaatttacacctgtacttgtgcaggaataaaatacaataatacgcatcgccgtatataaggctatgcaaaaacggaggatttttcaaatggagatcatttcaaacaacaagaccgcaacaaatacggttgaggtagaattcaaggcatcagccgaagaattcgagcaggcagtacaggcagcttatttaaagaagaaaaagaacataaacgttcccggcttcagaaagggtaaggcaccccgtaagataatcgaggctgagtacggcgaaggcgttttctatgaagatgctgttaacggtatgtaccagaagagcgttgcggaagttatcgacgagcttaagcttgaagttgttgatatgcccaacatcgaagtaacagaagtaagcaaggagaacggtgtttctttcaaggctacatttacaacaaagcccgaagttgaaatcaaggactataagggtataaaggtaaacaagactgtcaagaatgtaactgacgaagatgttgcaaacgagctcaagagatatcaggagaaggatgcaagaatcatcgacgttacagacagacctcttcagaagggcgatacagcagtattcgactttgaaggtttcgttgacggcgaagcatttgaaggcggcaaggctgagcatttctcacttgaaatcggcagcggtcagtttatccccggctttgaggacggtatggtaggtcacagcattgacgaagaattcgaaatcaatgttacattccccgagaactacaatgccgagaacttaaagggcaagcccgcagtattcaagtgcaagattcacgagattaaggctaaggaatacgctgagctcgacgatgagttcgctaaggatgtaagcgatttcgatacacttgacgaattcaaggctgacatcagagcaaagctcgaagaaagcgctaagaatgccgctgacgctaagctcgatgccgatattacagacgctgttatcgaaaagctcgagggcgaaattcccgatgctatgataaacaaccgtgttgacgaccttgttcgtgactgggagtacagaaacagataccagggtatcacagttgctgattacctcaagtttacaaacacaactatagagcagttcaaggaaaacttcaaggagcccgctgcaaagcaggttaagctcagacttgctcttgagaagatcgctcagatcgaaaacgttgctgtaacagatgaggacgttgagaaggaatacgctgagatggctgaaaactacaagatggagcttgacaaggttaaggctcttgttgccgaagaagcgctcagaaaagaccttgaggttgagaaggcattcgacatcgttcgtgagagtgcagacgtaaccgaagttactgaataattaagtttttgcaatcgggagctttctgtatcattatggaaagctctttattgtaaataaaaaacattttgaaaggcaggagttttatgagtttagtaccaaccgtcattgaacagacaggcagaggagaaagagcttacgatatattctcaagactgcttaacgacagaattatcatgcttaacgaagaagtaaacaatgttactgcgggacttgttgttgcacagttactgtttcttgaaggacaggatcccgataaggacatcagcctttatataaacagccccggcggttctatctccgcaggtatggctatatatgacacaatgaactacatcaagtgcgatgtatctacaatctgcgtaggtatggcggcttctatgggagcattcctgctttcaagcggcgcaaagggcaagcgtttctgcctgccgaactcagaggttatgattcatcagcctcttatcagcggcggactcagcggtcagcagaccgatattacgattcacgcaaagtaccttgagaaaacaagagaaacacttgaaaaaataatggcagaaaactgcggcaagagctatgagcagcttcataaggactgcgaaagagataatttcctttcggctgaagaggcttgcgcttacggtcttgtcgataaggtaattgcaaaaagataaccacttgaaaggaatttgaccatgcttagatgcagtttctgtgaaagaactgaggatcaggttgaaagaataatttacggtgcgagcggctgtatatgcaatgattgcatagtagcctcataccagatgctgatggagcaggaagacaaggcctccggcaaaaaatccaaaggcaagcaaaaggaagataagcatgagcttataaaacctacagagcttaaggaaattcttgataagtatataatcggtcaggatgaagcaaagaaaaccatctgcgtatcggtgtataatcattataagaagaatttcttcggcgatgaggcaactgcagacgagatagaacttcagaagagcaatgttctgctgcttggacctaccggtgtcggtaagaccatgattgcccagacgcttgccaatgtgctgaaggtgcctttcgcaattgccgatgcaacaacgctcacacaggcaggatatgtcggtgaggatgttgagaatgttcttctcagacttatacaggcggctgattatgatattgaggcggctgaacacggaatcatatatatcgacgagatagataagataacaagaaagtctgaaaacacttccattacccgtgatgtaagcggtgagggcgtacagcaggcactgctcaagattatcgagggtacagtgtcaaatgttccccctcagggcggcagaaaacatcccaatcaggaattcatacagattaacacaaagaatatcctgtttatctgcggcggtgcattcgagggtatagataagctgataatgcagagaacaagctcatcggcactcggtttcggcgcagaggtaaagagcaagcaggacaacaagataaacgaggcactgcatcaggtagagcctgaggatcttgtaaagttcggaattatccccgagcttgtcggcagacttcccgtaattgccgtacttgacgatcttgacgaggacgcacttgtaaagatactgtccgagccgaagaacgctatcctgaagcagtacagctatatgttctcgcttgacggcatagagcttgagattaacgatgatgcaatgcgtgccatagcgaaaaaagcggctgaaagaaaaacaggcgcaagaggtctgcgtacagtagtcgaggaggcactctccgatattatgttcgatgctccgagcgacgataccatatcaaaggtaatcctcacaggcgaatgcgtcaccgacggtaaagcaccggaggttatcagagatccttccgcaagaaaaaacagaaggaacagcgaaaagaaaaccgcaaagaaaaatcccgcataacaaaggttgagctgttttcgttgactgataaaaattaaaaaattttttaaaatagtatttacaaacgttgctttgtatgctataataactttgttgtgcattgcacacaatcaattcttgtcttggctctgtggagaatgctcgttatgagaaacaccgtttcccgccgctatgacaaagaaaatatttttaagaggtgtaaccatgcttttaaaggaagaaaagacagcggttatcgaagctaaccgcacacacgagaacgacacaggttctcccgaagtacagatcgctattctcacaaagagaatcaacgacttaaccgagcacttaaagacacataagaaggatcaccactcacgccgcggtcttcttaagatggtaggtcacagacgtaatctgttaaactacctcgctaagaaggatatcgaacgctaccgtgcagtagtagctaagctcggtcttcgtaagtaagagtttaaaaaagggcagggcatttttgttctgccctttaacccttatttcagcattgattttttgacttaaggagaagcagtgcagtcagcaataaattgaacggaatagtgttattccgctgaatttattgctaacgctgtttctcttaaaataaaacaggaggaacaatatgttcgagaattacaaaacattcaaaacgacatttgcaggccgtgagcttatggtcgaaaccggtaaggtatgcggacttgcaaacggttcttgctgggtacactacggtgaaacagtcgtaatggtaaacgttacagcaagcgcaaagcccagagagggtgttgactttttccctcttgcagttgactacgaagaaaagctctacgcagtaggtaaaattcccggcggttacttaaagagagagggcagacccagcgaaaaggctatactgaactcccgtgtagttgaccgtcctatgcgtcctctgttccccaaggatatgagaaatgacgttgctatcgttatgacggttctcgcagtagatcccgaaacacagcctgaaatcatcgctatgatcggcgcttctatcgcagtttccatttccgatattccgtggaacggtcctatcggcggtatctccgtaggtcttgttgacggtgagattgttcttatgcccaacgcagagcagagagcaaagtcagaccttcagctgaccgttgcgtcgagcgagaagaaggtcgtaatgattgaagccggcgcaaacgaagttgacgatgatacaatgctgaaggctattatggcaggtcacgaagagatcaacaagtcacttatccccttcatcaagcagattcaggctgagattggcaagcccaagttcagcttcccctcaatggaggttgatcacgatctgttcgaggctattcagaacaagtacaccgagcaggtaaagttcgctcttgatacagacgacaagaatgtccgtgaggagcgtttacagcctataaaggatgctatccacgcagagtttgacgagcagtatcccgacaaggccgctatgattgacgagtgcatctacaagttacagaagttcatcgtaagacgttggctgttagacgagcagaagcgtgttgacggcagaggtatggacgagatgcgtcctcttgccgctgaagtaggacttctccccagagtacacggctcaggtctgtttacccgtggtcagacacaggttatgacaatcacaaccttaggccctgtaagcgacagccagaagctcgacggcattgacgaagaagaaacaaagcgttatatgcaccactataatttccctgcatactctgtaggcgaaacaaaggcaagcagaggccccggcagacgtgagatcggtcacggcgcacttgcacagagagcgctcgaacccgttatccctcctgttgaagaattcccctacgcaataagacttgtatctgaagtgctttcttcaaacggttcaacatcacaggcttctatctgcggttctacgctttcactgatggacgcaggcgttccgataaagtcacctgttgcaggtatttcctgcggtcttatcacagagggcgaccgttggatgacaatggtagacattcagggtcttgaggacttcttcggcgatatggacttcaaggtaggcggtactcataagggtatcacagctatccagatggatcttaagatcgacggtcttacacccgagattatcaaggacgcatttgcaaagacacacaaggcaagagattacatccttgacgaaataatgctcaaggcaattcccgaaccccgtcccactgtaaacaagtacgcacccaagatgctcaactacaaggtacccgttgacaagataagagaagttatcggtacaggcggtaaggttattcagaagctctgcgcagacttcgaggttaagattgacattgatgaagaaggcaatgtattcatctgcggtcaggatcttgaaaaggctcagaactgcatagcgatgataaaggctatcacatctcctcccgaggttggcgctatctacaagggcaaggttgttcgtataatgaacttcggtgcgtttgttgagattgctcccggcaaggacggtatggtacacatttcagagcttgaaaacagacgtgtagaaaaggttgaagatgttgtttcaatcggtgacgagataatcgtaaaggttctcgaaatcgacaatcagggtaagataagactttcaagaaaggctgctcttgctgaaatcgaagcaaagaagaaaaacggctgataaagctgaatattgcaaaaacagacctgtgggaaattctcacaggcctttttatacgcaatttcgtcttgcaatggcacgctgtttgtgatatacttatactgtatcattatgtgataactgcacgctttgccgtatattttctgctcttttgctaagaataaaagagaaaaaatcagcaaaggagcagggtatgaataaagataatatcacaaataacgaacagaccgacgaggagaacgaagaacaggcggtaacctgtcaggtgtcggataacggcatattcgcatcggaaaacgctaagcacaatatccattgccttaacgtaatcggtcagatagagggacattatatccttcctccccagaacaagaccacaaagtatgaacacattatgcctgcactggtagcaatagagcaggatatgagcatagacggtctgcttataatactcaatacggtcggcggagatgtagaagcagggcttgcaatatccgagcttatcgcaggaatgtcaaagcccacagtgtcgatcgtagtcggcggcggtcattcaatcggcgtaccgcttgcggtaagtgcaagaaagagctttatcgtgccgtctgcaacaatgaccatccaccctgtcagaatgaacggacttcttctcggcataccgcagacgctgtcatattttgagcgtatgcaggagagaataataaatttcgtaagcaagaacagcaggataaagcccgagcgtttccgtgagcttatgatgaagaaggatgagcttgtaatggatgtcggttcggttcttgacggcgaaacagccgtgaacgagggacttatagacagcctcggaggactgagcgatgccgtgcagtgcctttactctttgatagaacagcagaaaaccgataaggaaagcactaagcgcactaagtatagcacaggaaaaaccgtttcaaaaaaaagagcttcgtccgcaacagctaaaacggatacaaaaaccgcaggcaagggtaaagcaaccgccagagtgagcacgttcagagaatatcatccgtcggcacaaagagcagaaatgagagcaaagcgaggtgcggagaatgtttcagaccgttgtagatgaatcggaggttttcagtaacgcacagctttatgacaataactcctattatgcggttgacggttgtgttttttcttatactgtctgcgaaaagaacagcgtttctgtatcgcacgatttacagagttatctgaaatacacgcagataaagccgctttaggcaacagtcattacgggcgtaagcccatacatatatattaaataaacaatacgaaataatccgaaaggaacaaaagaaaatggattacataagcataatcattcagggcattatacagggacttacggagtttcttcccgtttcaagctcaggccatctgtctgttgcccagcattttatgaatatcggagaaaacacccttataacctccgttgtactgcatttaggaacacttctggcagtttttatagcattttttcctactatctggggaatgataaaggaatttttccttactataaaggatattttcacaggtaaattttcgtggaagaatatgaacgcaaacagacgtatgatgtttatggtcataatttccaccgctatgcttgtaccggtttacttcttcaaagacttctttacaggctttgagggcgacaatgacattatttttgagggctttgcctttatctttaccgcaattcttctctttatgtctgataagtgcataaaaggcaacaaaacaggcgataagatgaaggtcgcagatgccgttgcaataggcgcaatgcagtgcgtggctctgtttcccggtgtgtcacgttcaggctctacaaccgccgcaggtcttttctgcggacttacaaaggaaactgcggtcacattctcgtttatactcggtatccccgcaattctcggcggaagtgtgcttgagatcggtgatgcgttaaaaagcaatgtagagcttgactgggtacagctcggaataggctttgtcgtatcggcggcagtgggacttcttgcgatagctcttgtaaagtggcttcttaaaaaagacagattcaagattttcggattctatacggcggtactcggtcttgcctgcataggcatcggtgcttatgaactggcgaccggctcacacttcgtttttgttttctgacagtaaaatataatataatgattttgggagaaaggacgtagaaacatggcagcaaagcgcaatctgaacaacagcaccaatgaagataagaccggaacgtcaaagtcatcgggcaaagcacggaaaaaggatcagactatcgaagataagcagcgtgaactgagtgaacgttgtaagacggacattgaaaaggagcttaaatcgaaaagaagaagaagctctataattcttttcgccataggtgttcttatggcgctgtttacgattataggttttatcggtagtcttaacagggcggaaggcgacagcctcaatctgcttgatatgatttattcattcctctgcggtatgttcggctttacggtattttttacaggccctattcttatatatgtagccgtacttattgcaacggataagagcaggacaagcatcctcaccaagatattacagctgtcgggcggaatagtgatattaagcacagctatacagatattctttgtaggcagtgtcggagaaggcacgaccgactttttcggagcggtggcaagtctttattcggacggaacacggctgacgggcggcggtatcataggcggtgtacctgcgtggcttttgctattgttcggcaatgtcggcgcaatagtaatgattatactgattgctttcgtatttgttatgcttatcagcagaaagtcgcttatggactttttaggcgctgtaggaaaacccgtcaaaaaggttgcggttacagcaaaggagaaacacgctcagcataaggaagaaatggaagcgtacagacttgagcaggaacagcagaggctgcaggctgaaagcgagcgcaaggaaaaaattatagagcttgaatcgaacgctgtcggaactcctgcaacaacgcttcaggaaagacacgatgagaatatcgaggagcagaaaaaggacagcgataatttcataaacgagattaacaattacaacggcaaggtatcgcccaaacccgaagaagcggttcagcagagcaatgagcatctacccgagattgctccggagagcgatgtacatatgtcctgcgataagctgccagacctgcccgtagccgataacaacggttctgtgcaaaaggcacagagcataacggcagataagcaggaggacagcgagccgataccggaatattttccgcctctgcctatttatccgccggaggaggtcaatcccgttgaggctgctttgaattcgtttatagaagaaacaaatagtgaacaaaattcctctgtacagagagaagagcagtttgtgaacgatgtgaacgctcccgtagcaccgcctgctgaagcgccttttatcgcagataataccgattccggtattgcaggcactacaactgccggtattacggacagtgccgcagagcaggaggataatcaggacggcgatacaagcgacagcgataagctctacacagtgacgcttaacgaggaagatcaccctctgccgcctactgcgcttcttgacgagattatgcccggtaaggcacaggaggacatcgacagagagcttgaaacaaatgcaaacaccattgttgaagcgttacgcagcttcggcgttcagacaaaatgtatcggtacttgcagaggcccgtctgtaacaagatatgaattacagcctgcggcaggcgttaaaatttccaagataacaggacttgccgatgatatagcgctgaacctcgcttcatccggcatcagaatcgaagcgcctataccaaataaacccgctgtaggcatcgaagtgccgaacaagataagagataccgtaccattcagacagcttatcgaaagcagtgatatagccgaaaagaaaagcaagctggcggcggtgctgggtaaggatatttcgggaggcattgtaatagccgatatagccgagatgccccatctgctgattgcaggtacgaccggctcgggtaaatccgtatgcgtgaactcgataattatgtcgatacttttcagaagcaagcccgaagacgtaaagtttataatgatcgacccgaaggccgttgaatttatggcatataacggcatacctcacctgcttatccctgttgtaacagatcctaaaaaggcggcaggcgctctgaactgggcggtaggcgaaatgctgaagcgatacagtatgttctctgagtacaatgtccgcaatatacacggctataacgctcttgcggctaaggatcccgagatggataaaatgagccagacggtgatttttatagatgagcttgccgatcttataatggcgtcgaagaatgaggtcgaggacagtatatgccgtcttgcgcagatggcaagagccgcaggtatgcaccttgtcatagctacacagcgaccgaccgtagatgttgttaccggtcttatcaaggctaatatccccagccgtatcgcattaaaggtaagctcgggtacagacagccgtgtaattatggatgagcagggagcggagaaactgctcggcaagggcgatatgctcttcaaatctgtttctatgcctaagcctatccgtgtacaaggctgttggatttccgataaggaagttgaacgtgttgtggattttctgaagaataaattcgagcttgattatgacgatgatgttatgaaagaggtcgagcgacaggcagagcttgttaagggcaatgataaatcctcagacagcgttggctttgaaagcggagatattgatgtcagcgacgataagctggaggacgctatccgtatcgtagttgaaaacggacaggcaagcgtaagtacgcttcagcgaaaactcaagctcggtttcggcagagccgcaagacttgtcgatgtaatggaagaaatgggcatcgtaggaccgtcacagggaagtaagccaagagaagtgcttatgactaaggagcagtactacgagcgtcagatgaataaacaacaataaaggaaagtgaaataaatgccttttttacctatatcaaaacaggatatgaaagatagagggatagatcagcttgatttcatctgtgtcacgggcgatgcttatgttgatcatccgtcatttggtatagctattatatcccgtatgcttgaaagctgcggctgtaatgtcggaataattgctcagcccgtaaccgatgaggatttcaaaaagctcggtgagccgaaatattgttttcttgtaacgggcggaaatatagacagtatggtgtcgaattataccgtattcaagaaaaaacgttgggacgatgcctattccgagggcggaaagggcggaaaacgtcccgacagagcggtaactgtatattgtaaaacgcttacaagattgttcccagataaagaaatagcgataggcggacttgaggcaagcctgcgcagatttgcccattacgattattgggcagataaggtaatgccgtcaatactggttgacagcggagctaagcttctgatgtacggaatgggcgagcttactatagtacagctttacagagagcttgccgagggtaaaaagctgtcggagatacacgacataagaggtacctgttatcttaccgagcctaagaatactcctctcggtgcggtgcagtgcgacagcttcgagatagtcagcgagaataagaaagcatacgcaaaatcctgccgtcagcagtatgacgagcaggacgaggtttacggtaaaactatggtacagcgtcacggaaatatgatgcttgtacagaatcctcctcagagaagccttacccagagcgaatttgacaaggcatacgagctgccttatatgaaagcgtatcacccttgctatgaaaaaggcggcggagttccgggtataaaggaagttgagttttccataactcataacagaggttgtttcggttattgtaatttctgttcgatagccttgcatcagggcagaagaatacagacaagaagcgaggaatcggttataaacgaggcaatcgaccttacgaaaaaaccgggcttcaagggatatatccacgatgttggcggtcctaccgcaaacttccgcaggacctcctgcgacaagcaggaaaaggcgggactttgtaagggcaaaaagtgccttgctcccgagccttgccctgcactgaaggtagatcacagcgagtatcttgatatgctcagaaagatacgttccataaaaaatgtcaagcgtgtatttatccgttcgggtataagatacgactatatgatgaaggataagaacgatgagtttttcaaggagcttgtagaacatcacgtcagcggacagcttaaggttgctcccgaacacgcaagcaacaaggtgcttgatcttatgggcaagcctcacattgaggtatacgaggactttgaaaagaagttctacaagtatacaaaggaatgcggtaaggaacagtatctggtgccttatcttatgtcatcccatcccggctgtaccataaaagaggcggtcgagcttgcggtgttcctcaaaaagcataacatcagacccgagcaggtgcaggacttctatcccacacccggaacaatatcgacagctatgtattatacagggcttgacccttatactatgcaggaggtctatattccccgtgacccgaaggaaaaggagatgcaaagagcacttctgcagtattataaaaaagagaataagcagatagttgcaaaggctctcataagggcaggcagacgtgaccttatcggatacggtaaggaatgtcttatcacccccgatggattagccttgcagcaggacagaaaaggagcagtgaaaaatggcaaaaactcctcttcaaaagcaaagacgtatcaacgacagggcaataagagcggcggcaggagtaaaatgcagaagaaaaagcactaacgtgctgattgcgttagctgtgataatcgcttgtgtttgtatttttatgaccctgaatgaatatgtgttcaacatcgaacatcttccgtgctggagcagtatattcggcggcaaaaacagcataagcgccgaaatctttcatcatcacagcctgtacttgaaataggagaacattatgcttgttgttgacagatttgaagaagataaagcggtagtttttgatgacgaaaagcagattatattagacagagacaagctatctcacgatgtcaaagagggcgatgcggtcatcctttcggatagcggtatatatgttcccgataaagcaaaaacggagcagatgagaaacgataatctcagccttctgcaaaaattactgaataaatgactaagaccctgcggcatatttaccgcagggccattttcgttaacggcttgtatgtacttccgtataaccgccgcttgtgccgagccttaatacctgcccgttatcaagcgtcagcttggcatttgcactttcgccgtcaagctgttttcgtacatccgaaataaattcatcggtgctttgcgacttgcagaaaactttcagaaggttttcaagcgcaaggatgtcgttttcgctttctatgaacatttcaacttcggttttgtcgatatttccgcttttgttatatacgattcgaagctttgatgtacggctgttgtcggctgtggatttagtgtaaagatatacgatgttgctgattttctgcattgtaaagccgttttcggtgagtatcttttcaactgcagcgttgctttgggagatattgccgtttacctcgtcatttttgccgtagcctatacacaaatcggttatctcgagtgccagaaagattgcaaatactaaagccgctcttttgataaccctgcttgcaacggatttctttaccgtattttctgcaatgcgtaaatcaggcatactgtcgtagattttcagtatttttattgttctgccgttactgctgtatttaagataacgctttgtttcgcctgtcaggacagcgttttcataaatcgtctttttatatctgtcggtatcaaaattcgctctcacaaattcaaaatccgtatttgcagtgattttcgagataagaccacctcttgcggcaagagtgcctttgattattgtattgccgtcaaacttatatgacgttgtaagaactgaggcgaatctcaacagaccgataaagaatatgataatcgccaccgcaaagaacagcataaggacaaatatcgtattatcctgcaaaaaggtgcttgttattttaagcaccgaagcaccgcacagaccgatagcggtaacgcctgtgccgacagtgaacatagaaataaggctcactgcccaccaaagcatcgcaccaaatgcgtgagtgtgcttctctgtttcaaaagacgggtttgagtatatcataagcttctccgtttcatatttatttctttttaaattataacagctatttccgatgctgtcaatcggaacaatattgccgtgttcaaaattttccgatgccgttcaaaactctttacaagtgcttgaaataggtgtaaaatagtatcatgatatgaaaggagatgcattatgaaaaagtgcttaattgtagtggattatcagaatgattttgtaagcggttcgctcggctttgaaaaggcaaagacgctcgaactcggaatcgccaacaaaataaattcctatcatgtaaacggcgatgatgtcatatttactcttgacactcattatgacgattatatggatagctatgagggaaagcatctgcccgtacctcactgtatagagaatacggacggatataagctgtacggcagtgttgccgactgcgtttccggcgaagatatagtattcaggaaaaccaccttcggctcggacgctctttatgagtatcttaaaaccgcctgctacggctctgtcgagcttgtgggcgtggtaacgaatatctgtgttgttgccaatgccgtacttgcaaagacggctttgcccgatgcggatataatagtagacagcacgctcacagcatcaaatgacgagcgacttcacaatgccgcccttgatactatggaaggtatgcagataataataaaataaaggagcagactaatgaacaaggataatttcacaatgctgtgcgatttctatgagcttactatggcgaacggctattttaaaaacggcttctataagcgcacgacatattttgatgtatttttcagaaacgtacccgacaacggcggatttgcgattgtggcaggacttgaccagataatcgaatatataaaagagcttcatttttctgccgaagatatagaatttttgcgcagtaagaagatttttgataaagaatttctcgaatatctcaaagacttcagatttaccggcgatatttacgccgtacctgagggtacgcctgttttcccgcacgagcctgtccttaccgtaaaggcaccggctatcgaggcacagcttatagaaacctatatcctgcttgcgataaatcaccagtcgcttattgccacaaaagcaaacagaatagtcagagcggcaaacggcagaacagtgcttgaattcggctcaagaagggcacagggcgcagacggtgccgtgataggcgcaagagcggcttatataggcggttgtgcaggtactgcttgtacgctgaccgatttcaagtacggtgttcccgcaggcggcacgatggcacattcgtgggtgcagatgttcgataccgagtatgacgcattcaggacttactgcgaaatatatccggataatgccgtattgcttgttgacacttacaacacactgaaaagcggtgttccgaacgctataaaggcatttaaagaggtgcttgtgcctaagggtatcacaaatttcggcataaggcttgattcgggcgatatatcctatctgtccaaaagagcaagaaagatgcttgatgaggcaggacttcagtgctgtaagatagttgcgtcaaattcgctcgatgaatatcttatccgtgatcttatgatgcaggaggctaagatagataccttcggagtaggagaaaggctcatcaccgcaaagagcgcacccgtgttcggaggcgtgtataagctggcggcagtggaggatgaacagggaaacatcattcccaagataaagataagcgaaaacaccacaaagataaccaatccccattacaagaagctgtaccgcttctacgacaatgaaagcggcaaggcacttgcggacgagctttgtgtatacgatgaaacaattgacggcacaaagcctcacactattttcgatcccgatgcaatatggaagacaaagacgctgaccgattactcggtaaaagaactgcacgttacggtattcaaaaacggcgagcttgtatataaacagccgtcgctgtttgaaataaagcgctactgcgccgagcagacagaaactttatgggacgaggtaaagcgttttgaaaatccgcatacttactatgtggatttgtcaaagaagctgtgggatataaaaaacgaattacttgaaaagtcaaaggacggaaagggtttaaaatgaaaaaatcaatatcaataactctctgtgcggcattactcgctctgtcgggatgctcgcaaaacacaaactcagacgttttatcctcggatatttcttctgccgcatcggaatcgcaaagcacagcatcgcaggaagaaaacagcggttcatcattacagaatggtaacggcggattcaaagtagaaggcacaaagctgcttgacgcaaacggcaaggagtttataatgcgtggtataaatcacgcacacacatggtatctggatgaagatacaacggctattaaagcaatagccgaaacaggctcaaatgtagtgcgtgttgtttgctcagacggcgagcagtggactaaagatacagaggatatgcttgaaacggttatcgatctctgtatcgacaatgagatgatcgcagttgtcgaagtacacgacgcaaccggcaaggatgataagactgcacttgataaagctactgattactggatagagatgaagaacgctcttatcggcaaggagcagtatgttatactcaatatcgcaaacgagtggacaggcggctggaacggcgaattatggcgtgacggctatacagaatctatccctaagctgagagaagcaggcataaagaatactatccttgtcgatgcggcaggatggggacaatatgccaagagcataggcgattacggtaaagaggtatttgattccgatcccgataagaatacgatgtttgccgttcatatgtacggcacagcgggaaagaacagctcggttatcgagaaaaatctcaaatatgctacagataacgggctgtgtgtaattgtcggcgaatttggttatacgcatacagacggcgatgttgacgaggcatttataatgaaatattgtcaggataacggcataggatatatcggctggagctggaaaggcaacagcggcggtgtagaatatcttgatatagcaaacagctgggacggatcggttttatctgccgattggggcgagaatctggtcaacggcgaaaacggcataaaacagacttctgtaaaatgcagtgtatttacaaaggaataataaatgacattcaggatttatgacaagctttgtgaggatgcaaagcagatacgaacagaagtatttgtagcagagcagggctttgaaacggaatttgacgatacggacagtaaggcaaggcatatagtcggttatgacggagaaaagcctgttgccgtttgcagatatttttacgatgaagagcataagtcgtatatgataggcaggatagccgtcattaaagaatgcagaggcttgcattacggcgataagatattatcctttgcggagcagaagataaagcaggacggcggaaagtcggttgcactgtccgctcagcttcgtgcgtcgggtttttacgagaaacagggctataagaagcacggcaaagagtattatgatgaatactgtcctcatgtgcttatgacaaaagccctgtaaggaggatttatgacggatattataaccgcaatggagaatcgccacgctgtaagagcctacgatcccgaaaaaaagataccaaaagaaataacggatatgctcagagaaaagatagaccttctgaatgccgaaagcaagcttcacatacagcttgtaacagatgagcctaaggcattcgacagctttatggcgcattacggcaagttctctggcgttaccgattatattgctcttataggcagaaaaaacgataagctgaacgaaatatgcggatattgcggcgaacagcttgtacttctggcggcacagctcggacttgacagctgttgggtggcaatgtcatacgccaaagtaaaaaacgcttatacgattgcaaaaggggagaagctgtgctgtgttatctctctcggctacggaaagacgcacggaacaccccataaaagcaaatcactcgaagaagttgcggtaataaaggatgatacgcccgagtggtttataaacggtgtaaatgccgcattgctcgcacctaccgctatgaatcagcagagcttcggattcatgcttgatggcgataaggtgcttgcaaaagcgggtaaaggcatactttccgatatggatctcggaattgtcaaatatcactttgagatcggctcaggaaaagagtttttcaaggatgaaatgaaactcgcttgatgaatataatgtcttgcattcacttgatatacgcatattattcatcgtgcaaaagcagaatttgccgttttcactgaaaaaattgctgttttcacataatatgacacaaacgaatgtatatatgttattatatagacgcagggttactctgtaatatatttgggtaaaagaaaggttttgtgaaaatggtacattatgattatatccgtgaagaatgctcggacagcgaaacaggtgattatatttcgtatgcgataatagccgtcaggataaaagagaatgacggagcggttacagcggaggaaatatgcacagtgcatgatgtgttcctgaacgaaagcagagcaagagagtttgccgggatttgcaacgagcttggattatcgcccgtacatatctatgatgctgtacaggacgctataggatgaaaatcaacagcaataagtcaaaccgcccctcagcgtgtcgttcacactgaggggcagttatgtatcattttgaaccgttctgatatttcagctttgttgcaagaccgcctcttatatgccgctcgtccttgtttttctgcaacacctccttgaccttacctgcaagatgcggatctaccttcgcaagccttaccgtaacatcctggtgtacggtacttttgcttataccatacacctttgctgtgcttcttactgttgcttcgttatctattatatattctccgagtataacacatctttcacgtttcgtatccggtaccgttattgttccggctttcacataatcgcccctttcataagacagcaccttcttatatcaacagtgcatatcgtttgttgatatatatgctgtaaggagcgtgaatatgataggcactgtaaaaaacaaccgaaacaaaaaaatcgactgcattgtttccgaaaggtaggaatgcagtcttttttgttatataattgagttgtgaaaaacattactgccacagttagatattatacaccatatcaactaaaggcaataccgcacaaagaacgcataaaagctttgtacgtcatctgcttgcatcttttccgttatattgcacagaaaacccttgacatacgttagtatgcctgcggtttttccgtacaatctgacgaaaaatctgactgcgcacctgacgcacaatctttgtgcggtattgcctaaaattaccaccgtaaattacaaaaaagataaaaatttctgctccggtatatacattctgtgaggtttttgatcatattgccataaataatttcctcatgttattagtttgcgttatatacaaaattgacataaatcagtgcataatacacaaatgattttgcctaattttgttgttttatccattgacaaatttaatttaatatgttaaactataaacaatcaaacggactttataaggtattttattgtataatatttcttacgcatattcgaaagcttttataatctatgcaaatcagaagcggaaaatattatgagatattttaagcagaaaaggactaaatatcaaacacattttctacaagttgaatgtgtaagatatatatttttatgattgataaaatcaatcggaaaggacatttaaatgaaaaaaacgtttaaaaggctgattgccattgtcatggcaacgactactatggcggttggattcggaggtatgagtgtaagcgctgtttcagaaactgcaagctggagtgcaagatatgttaatgttcatggggcgccaaccagtgaaagtcgtacaggttatgcaactatgcaagcatcttccgaggtatacaccggtaaggtaaacacaatgtcagacattacaaacagaagcttgacattatcatctacttcacacgttatgacaaccggttcaattgtctataataataccggttcaagaagatggtatattaggggaaaaattgaaaaagttacatataaaatggaagcctatacttcgttaaaagctgtactttacgtaaccggtatcataagcagatagtccatgtttgttatcattatgaagcttgtattgtaaagtgcggcatagccgcactttactttgattattcggaggagatcgaatatgaaaaaaaagattttactgtttacatttgtttcattgttgtttttaactgcttgcaataatcaaaacacagatattgaaaaaaaatctgatacagcagaaaacgtatcatctgatacagcagaaaacgtatcagttgatttcttgtctgaatatgaaaattgtaggaataaaaactatgttaatttagatttttcaaattgcagtgcacgtcttcctgaattaaatacatgcagtagtctgaatgtgacaattgcgcatggtagtggagcaaacaacgaaaagcttgaaaatttcaaaaaatactctgagttttttttcggcgagtacaattcttcaaatgcgctcttttcatcatcttcgaaaaatattgtgtataatcaaaatgaagatgacggtaaacatgcatggtatccaaagattgataattaccttgagcaaatacaaaacggtaatatagatattaattcatttttatatagagatacaaacaataataagtatttatggtggcttagttctgaggcttctcctcattggatgaataagggagaagcatactcactcatcaaaacagatgatacaaaagtttcatcatggataccgtccgatatggataacaaggttgcatcttactttaatgatggaacgcacaatgatgaaacataccgtattcttgacggtaatgtttctataggtgaggctgtaacatattttgagaaagactacttatcttcttttccgtatgattttgattctgacttttcaataaatgtttcaactatagatgtttataaaatacgtgatgatatctattgctacgtttttcaattcagcaccgcatggaataatattcctttcgatagaataggggaagtattcagctatcaagatccttcacatcaatatacggtatccggcgaagcgcttatgataaaaaagaatgatattgatgcattcgttaatttaagctttccgaatataagcgaaatagaagaacctattgaaaacatctgcactttagaaaatgctgtagatattatgagcaatacgctgacgaagggagttaagtttgaattgcagacgatagaatttatatacaagggaaattatagtgacgactatacgacagcccacctcgaaccttcgtggaaatttgtaactcgtaacccgaacgatgatttatactattgtgtatatgtaaatgcggtaaataacgagtgcagttatatgtcatataagccattttagaactgaaattacagcgttggcactttgcatgaaggaaggagattcctatgcttaaatcaagtatgttatttaccgattgttcaaataaggacagcagtacagataatacaactatagaatcattaactgacactgtatcaattgatgataataatcctaacgacaacttgacatatgtttgttatgttgacgcaaaagacggcggaaatttcagatattttactactcccgaaaacatggagttgatacaatgatgatccgaaacataagaactaatatatacaaaatacttacaggctacggcttctatatctgtattatctttacggctgtactttgcttctccgcatacatctatgaagactcaatgaacggtgataagtattcagtatttatggcgcataaaacctttgacaaagattttatgcttagcgatacaagattttgttcgtttgaggttatgcttaaaggggcaggaagctggctttctctttttattccgcttatatctgcgtttgcgtttattcctcttgtgtgtgacgaatatgaggcaaagtcggtgcgctttgaaatcttccgaagttcaaagttatgttataatctgtctaaattcataactgcatgtttgtgcggaggatttgcggttatgctgggcttcggattgtttacattagcagactatgctttattcccaaatataaatgaatacagtgctgagttgaaaaaaacatatgaagaatttctcgtttacagttatccggatataacgcaaaacggttatggctttattatactaaaaaaacttggagaaatgtttttgtacggagcggtctgcgcagctcctgcgattatgtttaccggtttcatcaggaacaaatatcttgtgctgtgcataccattttttataaaatatgcagtcagtcaaacttgcataaagctgcaatcgcaggcagtttccgattacaataatgttgacacagaaatgctgaaaatcagttcaatatttaatcctgacgcactttcatatctttctgactttgggaatgataaaaagcttgtacttatctataacggagcgcttcttttttcagcagccgtaatttatcttattacacaaagcaggaggctcgacagcggtgaatagaaactttaaatgtgtattatctgtagcaagatcggaatacataaagtggataacaaatccaagagtcattattgtgggagtgcttcttgtatttatgcgtactcttgccattgagcctttgcttgaacgtgcggcaaagatggaaataccgttaaacatactcgaaccgtttgttgcgatcggaaactcgggaatgctggttatgcttatgccctgcgtatttatggtgcttataagcgactatcctaaaatgaccggaaatacactgttttttattcagcgaaccggcagatttaactggtttgcgggacaggtaatatttctgtttatgtctataataagttttctgtgcgtagtactgacaggcagcgtactgctatcaaaaggcgagttttcaacaacgtggagtgatgttgttacaaaatattccgctcgttttcctgatgaagcaaacagctttacctcatcgcttctgccttcaaatctgtataatcagatacctcttgttacagcgatcttgcaaacgcttgctcttatgtgcgcatatcttttcctgctgtcaatgataatatatttttttaaattgatccatattcagtcatttggactttttgcggcaatttctattgttgcggcaggcgttgttacctgttcgctgaaaatgaatataatgtggtcgttcccgatggcaaatacaatagtttggctgcactatgaagaaataatcggaaaaccaatagttccgatatggtattcttacatttatttttgtatagcagttattattttagtactattaaatattatcgcagtaaagcggtttcaatttacaaatatagaacaggtggaatagtgatgggaataattgacataaacaacatagatctcactataggtaaaacaaatattttgaaaaacataacagtgagctttgacgagggaaaaatccatggacttataggaagaaacggttcaggcaaaacaatgcttatgaagtgcatctgcggatttatcaagccaacgggcggtgaaataacggttgacggaaaacgcgtcggtaaggatgttgacttccccaaaaatatggggataattatcgaaacacccggatttatcccttattactcaggctataaaaatctaaaactgcttgcaggactcaataataaaatcagtaaacaagaaataaagaaaagtatggaacaagtgggacttgatcccgatttgaaacgtcatgtgaaaaagtattctctcggtatgcgtcagagattaggtcttgcgcaagcaattatggaaaacccgaaaattttaattcttgacgaaccgtttaacggtcttgataaggatggcgtcgcagatatgagaaagtatcttcttgaattaaaagaacgtggaaaaacaattcttattgcttctcactcatcagaagatatcgaaattctctgtgatacagtttgcgaaatggataaaggtgtgcttacaaaaataaaataaaggcaataccgcatagttattgtcgtgcgattgcttagtcagattgtataaattgagtgcaggcaggcttgcgcctgtcaagcaaaatttgtgtaagctgacgggaaatatgcaagcttagcgtgtggcaaaggcgatagccgttaattgtgcggtattgccttaacatcaaaggtgtaaatccccacacctttgctttgtcataccaaaaaacaattagttttccgcaaaatctaaaatatttgtattgttttccataaaaaacaccggggctcacgaaaaaagtgagtcccggattttcattaggctgttattttacagtgtccatttatcagttgtttatcctgtctttatctctgcccgtgcttataacttcgttctgcctgaagaaaagcgaaatgcaccatatagccgcaagtgctactactatatacagaattctgctcataacacttgcacttccgccgaatgcccaggctataatgtcaaatccgaacagaccgacaagtccccagttgattccgcctacaagcaatataaaaagtgctatcttgtcaagcatagttgcgttaccgtccttccgttaaacgtgatgcctgtgaataaatcaacataagcacccttaaaatattgttaccgcagaaaagcatattattcttgtgcaaaacagacaaacatgacaaataaatgttgataaaacagaaaaatgtcacaaaacaataaaaatttcgaaaaaagtgttgacaaatgcgtaattttggtgtaaaatatattactgtcaggtggcgagaacaaaacaaggcaatgcagggacgcttaacgctacacgtccgcatattagtacatatatctcaggttagtggcgtttttgtgaaaggtcaatgtcagtgcagttgcattgataaggtcacgaaaatattaatatcttatcggttaggaaagtgtttttggcgatgttagtgaaatttttcacagtacagcttcaacaataggttttttctacaaagtaaaatacccttgcgaaacgttttgaagtttgcaagggtatttctttatatttttgcatatggaaaaggacgggcagaacccgtcctttgaaaaagcgtattcagcgcagaacttacttgagttcgatcttagcgccagcttcttcgagcttagccttgatttcctcagcttcagccttagaagcgccttccttgatagccttaggagcagattcaacaagctccttagcttccttaaggccaagaccgcaaacgtccttaactgccttgataacagccatcttagcatcaccgaatgatgcgagaactacgtcaaattctgtcttttcttcagctgctgctgcgccgcctgctgcggggcctgctactgcaactgctgctgcagatacaccgaattcttcttcgagagccttaacgagctcgttgagctctaatactgataagccctttacttcttcaatcatagctaaaattttctctgaagccattttaattatcctccgttaatatgttttcattgtttgtgttacggcaggtttatgccgccgatttcgtccgtacagaaattattctgctgattcggactgcttcttctcgatttcgcttactgcgatagcgagcttctggataggggactgaagcataaataccagctgtgcaagcagtgtttcctttgtggggagctttgcgtatgcaacaacttcgtccttgctgatgcccttaccgtcaacgaatcccttcttgattgagaatgatccgttgcttgcttcttcctgcttgtacaggatcttaggagcagttacgatgtcttcctctgcgagtgcgagagctgttgttccttcgagaacatcctcaataccctcaacgcctgccatctcagctgcacgctttaaaagagtgttcttaactacaaagtagtcaacacctgcctcacgaagttcctttctcagaactgtgtcatcggcaactgtgataccgctgtaatcaacgagcacaccgcaagcggacttcttgagcttttcagcgagttcagcaacgtaattctgctttacctgtaaaactttctcactaggcatattgttttctcctttcgtgatttactgttcgtaaaaaggaaaaacatttaataaaaatgccctcctctgtaagacagaaaagggcagaaaattcagtattcttcccattcctcggcaggtgagcatatgctcgttagcggtaaaccgacctgctgtctttagaacagcgtgattattatatcatattaaaatgcggttgtcaagtagtttgacttaaattttttcagtctgtcagcacatttgaatatataactctttttcggggcgttatcttacacttagcgaaaagatcgcttaccgtcacaaacgtgtatccctgccttttaagctccgggattatcgtatcgagcgcctgtaccgtgcggaaattgccctccatatcgtgcagaagtattatcataccgttttgcgcctgatcgattatacgcttactgcgttcttctgcggatatttcgtcaagccagtcctccgcaccgtttccgcagataaatgtcagcggtatatcgtcatacatactgtcgcaaagcgcaatatacggcggacggaaaaatttcggggcgacaccgcctgttatctgctttatcttatcgtttgtgtattcaatttcagcctttatttcttcgcttgtctgctgaggcatcgcactgtgcgtcctgctgtggttgcatatctcacagccgtactcaaagcattcacgggctatccttgcgctttcctcgtttatgttatcgcctacaagtaaaaagctgcccgtaacgttatgctttttcagcatttcaagcacctgcggcgttgtgacggtgttcggtccgtcgtcaaatgtaagcgctatgtacttattctccatcttctgctcctttttttcttgctggatacaacacatctacaaagcgaaacagcgacagcgaaaatacgatattcgtcacgctgttgcagaaataatatcccataaaattagttctttcgaccgagccgtaaaaaacgaaaacgctcgaaaagtatataagccccgtaataagatatatcgcaggacatatcatagcggcttttctgctcattgtacctcgtacaagctgtatcataactatcgagtccagaagaagaaatatatccataacaagatacagcgttacattatattccccaccggaaacgaagccgttttccgatatgaacgacaagtcatacacaaggctcggtgctatgcctataatgcacatataggggataagggcgaacatttttctgctttccctgtaataaaagaccgctacagaaacagaaaaccacagatacattataagagtagacggtatagatgccacatacgctccgcagtttatacagcctgccgatataatgtgcggcatatagtcgattatctcgaatacgccctgtactccgacaagcagtgacagcacaagcaatagcaatgcgtgcgccagcagaaacgtttcgcttttttcgttttgcgttttattgctcagcatgaattacctccgtttctgcggcttcaatatcaacaagacattttttccgccatttgccgcccttatatctgataagacacattactgctgtcagcacccaggtaagacaggtcgttgtccataccgcccacattcccactccgggtatattaacaagtattgccgcaaagcctattctgcctactacctcggcaagtccgttcagaaatgcaaatcctacatcgcccgcaccgtttaaaagtcctcttgtcgtgtggataaagcccagcggaacataaaagcaggcagacagcaaaagtgcctttgcacctatatctataacctgttcttcggtaacgaagaagccgactatgtatctgcttgtaaaagcgaacacaccgagcatcagcaaaccgaaagcggtcgatataagcattgaacggtgatagcctttcaccactctgtccggctttgccgctccgacattctgaccggcaaaggtcgaaagcgccgtgccgagcgaattgaagggctgttgtataagctgttctacacgcattgtcgcagtgtatgcggctactactatatctccgaatgagtttgcggtcttctgaagtgaaatcatcgacacggaaacaagcgcattctgcaaagctatgggagtacccgttttcatacaacgtacaaactgctccctgcgaagcctgagatgctctcttttcagccggaaatattcgtttttctttaccgcaaacaaaatacttccgacagcggaaactccctgtgcgataactgtagcgagcgccgcaccgactacccccataccgaataccattacaaaaagcaggtcaagtcctacattcagtatacttgcgacaataagaaaatacagcggagtttttgaatccccgagcgcacgaagcaccgagtttatccagttgtagcctgctaccgcaatcgttcctgcacaggctgtgcgcatatactccgtagcgtttgcaagtatgttctgcggagtgtcgagcatctgcaaaagaagatgcgcaaaggctaccgaaataatcgtcagccccagccctacaaagccgagcgcataagccgagtttgcgataaaacgctttacatcgtcgtgccgccccgctccgaagctctgtgctatcagtattcccgcacctgccgaaagtccgttgcacagcgtgtaaaacaggaacgttatcgagcctgtcgcaccaaccgccgccagtgcctcgtgacctagataacgtccgactattaccgaatcgactatattataaaactgctggaacagatttcccgcaagcaagggcagagtgaacataagtatgtgcttaagctcacttccctgcgtcatatttcttacatatttgttcatatattctaccgtacaacatcgttttattttgttcgggcaaagccaatagatatagagattataacccttttttacggtactgtcaataatgcatcgtgcttaatatattgtaactgtgtacaaataagaacggggaatactgtcggaatgacgaaaaatgtaacgtcgggaattgtcgcaccgccgtgaatattgacaaacggtgcggaatatgacataattatcttggataagtatccggtaaacaaaacagctgagataatccgaaaggaaaagcaaatgaaattaagaaaacggataatcgccggttttctgtcggcactgttcatattatgttccgtgtcgcttccggttgcggcggcggctgacccgtacacctgggacggcacctccgtgcttgcggcggacagaacctattacataaaaagcaatataacactcggcaaaagccttactgtaccggcaggtactgttatggtactgctcagaggaacatccgttaccgtgccatacggtattacccttgatataaagggcagacttgttgcggataacggcgcatcgcttataataaacggcacgctcaatacctacggcggttctgctctggatattgacggtacgatgtctgcgagcggaagatctgcggtttcgctgtcgggcgttacgctactttccgatacggcacagacggcattcgcaggcactcttgatgtgaattcggactttacctcttacggcgagataggtgtgacaggcactgctcgctttaatgcaaaaagctatatcggcggaaagctggagataagaaacaatgcgcaggtcataaacacaggtgctatgacgctcggaaacgattgttcatatacgctgaagggtatgttcacaaacagcaaaaacggcagtgtcaccgacaaccgcagagcctatgacaactcggcaatgtctgtcgaaactatatcgctgtatacaacagacgcactgacgggaattgacgtttcgtgggcgcagggcgacacgatagactgggcaaaggttaaaagttcgggcatcgactttgctatgatacgttcaagccgtggcagaataagcgacgattaccctatgacgagcgatacatattttcacgagaatatgaaaggcgctatgcaaaacggcattcctgccggagtgtatcactactgctatgccgaaacggtcgaagaagcgagagatgaggctaaatttgtactcagccttatttccggctatgagataagctaccccgtagtatttgacatagaggatcagtggtatgtaaagaacggctattcaaagcagaccctcaccgcaatggcagaagcgttctgcgaggagatagctaacgcaggctatctgcctgtcgtatattcctacgcttcgtttttcaacagctaccttgatatgacggcgctttcaaagtatcccgtgtgggtggctcacgttgacaccgacaagcctgcatacagcggaacatattttatgtggcagtattcgtgggagggcagtatcagcggaatcgacggcgatgttgatatggatcactgctatgttgactttgatgcgtatacaaggaagttcgggctgaatgggaggaagtaagttcggataacggatataaaagtatcggcggctcggtaacactaccgagccgccgctctatattgctttatataaccgcttaatctgcgtttttgtttgtcatttccgattcaggttcaaccggcaaagcaacattcttctgccagtatccgtacttcttcctctttatgataaggaacatcagcgacagcaggaaagcgaaaaattccgccacaacattcgccatccatataccgtcaacgtcgaaaataaggggcagtataaggatgcttgaaacctggaatataagcgttctcataaacgacacagcagcagagatagcgccgtttccgagtgcggtgaagaacgatgaggtgaatatattgaagcctgcaagcaaaaagcacagcgagaatattctgaaagcgtgacgtgtctgctcgtaaagctctgcgtcatagccgacaaatatctttgcgagagggcttgcaagcaccgccgacaatgcgacaagggttactcccgctatcgccgcaaagcaaaggctctttttgagcatattgttcagttcataacggttctgcgctccgtagttgaagcctatcacgggcgcacatccgatagcatatccgacaaatatcgctatgaaaataaactgcacatacatcattacgccaaagctcgaaacgccgttttcgcctatgtatttcataagctggaagttgtagattatacttacgaccgatgaggaaatgctcgacataagttccgatgaaccgttcgcacaggcacgcaggagcggtcttatctcaagccttgtcttagtaagacgcagtatgcttgagttcggacggagaaagtagataagtgggaatattccgccgacacattcgctgatgcccgtagcaaatgccgcacctgcaacgccaaagtccataagacctacaaatacagcgtcaagtatgatattcgtacagcctgccataatagttgaaataagtccgagcttcggcttctcggcggcaataaaaaagctctggaatacgttctggagcataaaagccgttgtaaaggaaataactattctgccgtaaagcacacagtcgcccagcatttcaggagttgcgccgaagaacaccgcaacgttttcggtaaagataagaccgaatgttgttagtaccgcaccaagtatcaccgtcagcattatcatcattgtgaaatagcgttttgccgtcttttcgtcaccctcgccgagcttctgcgaaacaagcgccgttccgcccgtgccgaccataaagcccacaccgccgagtatcattacaaacggcattataagattgatagatgcgaaagaggtcttgccggcaaaattcgatacgaaaaagccgtcaacaacaccgtatatggatataaacaccatcatagccaccgacggcagtacaaacctgaaaagccgtcccgctgtaaagtgatccgaaagttttatcttgctcattttccctttgttctccttttgtatctttatatttttgccgtctgatttttaagaagcacgctgtacagcttcataagcgcagtcatattctcgctttcttcatctgtcatattgccgagtgcggcgcattccgcctctatcaccttatctaccgtctgttcgcacagctttgttccgctttttgtaaggctgatattctttgtgtgcgcacctgccggagtaagcgttatatacccctcgctttcgagctttttcagtgcggagttcaccgtctgcttaggctgatacagcacggtgcagacatcgctctgcgttatgttgcccggctccatacgcagtgtgtacagcgtccagaaagccgcttccgaaaacccgtagcgctttgctatattcctgtagcaatcatctattgatttcagtacattattatattcatacagtttttttctgttgtttttattatccaagctgattctccttgtcggcaaatgtttaagtccgaaatcggactgagagatattataatccgatttcgaactattgtcaagagtttttctgcaaaaaataaaaactgtgcctgaaacagacacagtttagcttgtagaaaaagtctgtttttgaaacaaacttctaactcactatccctatcccctttaggacactctgatggctttgcctcgtgcaaagctcggcgtgtccttatttcggcatccttgccgaaaacccctttccccgggaaagggggattttactggggctaccgcccctagtccctgtcgggggctccgcccctgcgaccccatttttaaataagcaggaggtttttcgacagactgactgtgcctgaaacagacacagttcagctgtcaatttttgttatcgccttacacccttgtgaacaacccgtaataaccgtttatacgggatgcaaactgaattttttcaccgttttcgataaagccgatcctgccgcccatatcattttcagggtctcgctcaatgcctttacctttcagataatctgccagcttttcaacagaatccgcaggcggacacattataatttttccgccgtctatctctgtcacattctccgagccgcttatgatcccaaaaaatgcagggaacgaagaaaaacagttgaaggtgttgaattttgccgcagaaaagacagatgataacagcaaaacggctgatactgccacaggtattgcgatgataatgatacgttttccgatcttggtcataaagtggactcctttcaatttgcaggcattgctaaagcattgcatttgctattacctttataatagcatattatgtttttttgtcaagcccatcttgtattattttactgtattgtgctaaattagctgtaaattgtactatattcttcgctttaccggaagcgatacaaaaattattcacaaaagttcatttttgtgtcggtttgatattgactttaggctcgaattgtgtcaaaataattatattaatgtaaattcggcgtttttctgcaaaggagcggtaaaacgccttattgttgcaaaacggaaaggcgagaaaagtaattgaaatacgatgtagtaattgtaggagcgggacctgcgggcatcttcaccgcaattgaaatggtcagaaacggctcagacaaaaaaattctgataatcgaaaagggcgcttcggtagagaaaaggagctgtcctaaggcaaaaacaaagcactgtatgaactgtaagccctactgccatatcacaacgggcttttcgggcgcaggcgcattctcagacggcaagctgtcgctgtcgtgcgaggtcggcggaacgctcccagaacttatcggtgaggagcttgcacaggaaaccatcgactacacagacaagatatatcttgaattcggtgcagataagcacgttgagggtgtaagcgaccccgacaagataagagatataagaaagaaagccataaacgcaaacttgaagctggttgactgtcctatccgccacttaggaacggaaatggcgcatgagctttatttcaagatagaaaagtatcttatcgaaagcggcgttgaggtgctgttcggcaagaactgcgaggatattataatagaagacggcgtatgtaagggtgttatcatttcaaatgcccgtgacggcggcgaacaggaaaccgtatacggcgacgagatagtagtcgcaacaggccgtaagggtgcagactggctcgaaaagacctgcgaggcgcataatgtagagcatacaccgggtactgttgacatcggtgtaagagtggaagtcagaaacgaggtcatggaggagataaacgccgtcctttatgagtcaaagctcatcggctatcctctgccgtttaagaacaaggtgcgtacattctgccagaaccccggcggatttgtgagtcaggagaactacgacaacgatttagcagttgtaaacggtcactcatataaagagcttaagagcaacaacacaaaccttgctatactttgctcgcacaatttcagcgtaccgttcaaccagcctatcgaatatgcgaagaaggtcggcgagcttaccaatatgctcggtaacggtcacattcttgtacagcgttacggtgatattcttgacggaaagcgtacatggcctaaggagcttaacttctccaacgtaagacccaccctgcccgatgcggttgcaggcgacatcacggcggctatgccttaccgtacaatgactaacattatcaatttcataaaggctgtggatatggtcgttcccggttttgcaagccgtgaaacgcttttatattcacccgagcttaaattctacagcaaccgtataaagatggacgagcatttcaacacgaacgtaaagggactgcattgcttaggcgactcaagcggctggacaagaggacttatgatggcgtctgtaatgggcgtgcttatgggacgtgaattactgaaataaacggaggaaatgtaaaatgcagttactggaagaccgcataaacaaggacggtatagtaaaagagggaaacgtactcaaggttgacagctttctcaatcatcagatggatattgagctttacaacgagatcggcaaggagttccgcagactgttccccgacaagagcataaacaagatactgactatagaagcgtcgggcatcggcattgcgtgcgttacggcgcagtatttcggatgtcctgtcgtatttgcgaagaaggcgcagagcgtaaacatagacggcgaggtttattcgacctctatcgagagctttacgcacaagcgtacatataacgtaatagtcagcaagaagttcctgtcgcccgatgacaacgtgcttataatcgacgacttccttgcaaacggctgtgctttactcggccttatcgacatagtaaagggcgcaggcgcaagtatagcaggcgcaggtatcgttatagaaaagggcttccagaagggcggagatcttgtccgctcaaaaggcatcagagtagaatcgctcgcaatagttgactcgatgagcgttgacggcggctgtattttcagacactgagccgtaaataaccgtatttagcggcaaagtgccgttaatatatcttttactgttttaatagggaggaaaaacatgaaaaagaaacttatcgccattttactggcggcaacctgcgcacttacagcaggactcacaggctgctccggcaatgccgcaacaagcggtacggatgaaagcaagacttccgacacacagagcacaggcgacagcacagccaagagcgatgttgtagcaggctttgtttacatcggcaagatcaacgacggcggttacacacaggctcacgatgcaggcagacttgcagttgaggctatgggcgtaaagaccttctacgttgaggacgtacccgaaaccgttgccgacactaaggaagctatccagacacttatcgatgaaggctgcaaccttatctacacaaactcatttggctttatggaaggtacagaccagatggcaaaggagcatcccaatgtaaagtttgctcactgctcaggctatatgagagaagacaatatgtcaacctacttcggtaaggtataccaggctcgttaccttgcaggtatcgttgcaggtatgaagacaaagaagaactacatcggttatgttgccgctaagggtatccccgaggttatccgtggtatcaacgcattcacactcggtgtacagtctgtaaaccccgacgctaaggtagaagtagtattcacagatacatggtatgaccccaccgttgaaaagcaggcagcacttgagcttctcaacaagggtgttgacataatcgctcagcaccaggatacaacagctcctcaggttgccgctgaagaaaagggtgcatactgcatcggctacaacttccccacatcagacgctgctcccaaggcttacctcacagccgcttgcttcgactggaagacattctatacagacgatgtaaagaaggctatggacggtacatggacaagccgtgcatactgggaaggtcttgccgctaacatgacataccttgacaagctgacagacctctgcgcagaaggcacacaggaaaaggtagatgcggctcagaaggctatcattgacggcacactcgaacccttcacaggtcctctttacgatcaggaaggcaacaagaaggttgaagacggcgttaagatgacagatgaagaaatctggaacatgaactggtttgttaagggcgtaacaggtactatccccgcataattgacaggtcacagaatcttaagactattaaagacaatacgagcagtccattgcgactgcccgatttgtctttttaaagcaccggaatatctgcgatgttttaaaaagacaaatcgctattttcaaggaggttatatggcagacccttatataaaacttgaacacataaccaaatcgtttgactcggtatacgcaaacaaggatatttccgttgacgtatacaagggcgagatacttgccctgctcggcgaaaacggttcgggcaagagtacccttgtaaatatgctcagcggcatatatacgcccgacagcggtactatctcgattgacggtaaaaagatgcacttcggctcacccggtgacgctataaaggcgggcatcggtatggtacatcagcacttcaagctggtcgatgtaatgaccgccgcagaaaacgtggtaatgggtcatataaagcattttgtcacatcgaaaaagcgtatggctcaccatgtgaacaagctgaacgagaaatacggccttaacgttacccccgacaagaagatatacaatatgtctgtcagcgaaaaacaggctgtagagataatgaaggcgttctaccaaggcgcaaacgttcttatccttgacgagcctacagcggtgcttaccccgcaggagataaccgcactgtttgctattctcagaaagatgaaggagcagggctgtacgataatcattatcactcataagatggcggaggttatggatatttccgaccgtgttaccgttttgcgtaagggcgaatgtatcggtacggtaaagacaagcgaaaccactccccaacagcttaccgagatgatggtcggcaaggctgtaacgcttgaaatagagcgtccgcagtgctgtgactataacgcaaagccgatgctctccgtgaaaaatctcacgaagaaaaatacagacggcgtaaacgttcttgataacgtgaactttgacgtatacggcggtgagatactcggtgttgcaggcatagcaggaagcggtcagaaggagctttgcgagataatcgcaggccttgacaaaatgaccgacggcgatattgagtttgacggcgacagcataaagggacttgatcccagagcgataatccgcaagggcatcagtatgagctttgtccccgaggacagactcggtatgggtcttgtggcaggaatgagtataacgaacaacgttatcttaaagtcctataaccataatcccggcccgttcatagacagcaagtttgcaaagaagctcgctgagcagatagtacacgattttgatatttacaccccgtctgtaaactacacggtaaagaagctgtccggcggtaatatacagaaggtgcttctcggcagagaaatatggctctcgcccaaggtgcttataaccgcttatcccgtaagaggtcttgatataggtgcgtcatacaatatatatcatatgttaaacgagcagaagaaaaaaggcgttgccgtgctgttcataggcgaggatcttgacgtgctgaaaagcatttccgacagacttatggtaatacacgacggtgagataatcgacatagtagaccccactaccgtcactaaggaagacataggtcttatgatggtgggcgaccatatcaacaagggagaggagaaagccgtatgagcatgatacagatttcaaagcggcagaaaggcacatcaaagctcgttgacgttcttataagaataggcgccatcgtgctgtcgctgatatttatcggcattgttcttgccataatgggttatgatcctttcaaggttttcggcaaaataatacagaccccgttcaagcgtttcaaggacgttatgaacaaaacgataatgcttaccactctttcactcggtatagcgatagcgttcagaatgaagttctggaatatcggcgctgagggtcagttctatatgggtgcattcggtgcggcatcaatggcttttatgtgtcccgatctgccgcctatactccttttaccgcttatgtgcgttgcaggcttcatctgcggcggcttatgggcgcttatccctgcggttatcaaagctaagttcggtgcgagcgaaacgcttgtaacgctgatgatgaactatattgcgatagcctttataagctaccttcaatacggtccgtggaaagaccctgcggcactcggtgcggcaaaggtgcctaacttctcggaaaatgcggtactgcccgatgtattcggcattcacgcaggctggataataatgctggtactcgtaattattatgacgatactgctccgctacacaaagctcggctatcagattgacgttatcggcgaaagcgaaaccaccgcaaaatatgccggcatgaatacggttaaaatactggtgattgcagttcttatctccggcggtctttgcggaatggcaggctttatgcagtcgagcgccgttgagaagtcgataaccgattcaatgtcggcaggtcttggctttacggcggtaatcaccgcctggcttgcaaagctgaagccgcccgttatcgtggttgcgtcgtttatgttctcgatacttctccagagcggaagctcgcttcaggtaatgaagataccctcgtccattacggaaataatgcagggtgtcatcatattcttcgttcttgcgtgcgagttctttataaactataaaatatcgtttcgcaagcataccgcagtaaaggaggctgaataatggatattcttcatcagataggtctgtttttacagaccgccattcagacaggtactccgatactgtttgccattgtcggcggtatactttgtgagaaggtaggtcatatgaacctcggtgtcgagggtatgatgcttatgggtgcgtcgctcggcttcacagttgcgtgtgctacgggaaatcctctgctcgctatgctggcggcaggtgctgcgggtgcggcaggtgcgcttatatatgcctttataaccgtcacgctcagaggaaaccaggtcgttacaggtcttgtgctgactatattcggcacgggcgtttccggtcttataggcggctgggtatcaagcgaacagataccccagtcggtaagctcggcattccgccctgtagaaatacctgttctcagcaatatcccgatactcggagaggctgttttctcgcaggatatatatgtatggctcggacttgccatagctgtgcttgcgtatttctacctcaacaagacaaagctcggactttatgtaagggcgattggcgaaaatcccggtgcggctgatgcttcgggtataaatgttacgctccataagtatataaatattctgctcggaggtttcctttgcggactcggcggtgcttatctgtcaaccgcattcctgacaacctggcaggataacgttacggcaggcgcaggctggatagccgttgctctcatcatattcagcacatggaatccgctcaaggcgatattcgccgcctaccttttcggtatgctgagaggtttaaactacaagatgcagggctgggagatacagataccctcgcagtttttaacaatgctcccttacatcgccaccattatagtgctgattttcatagcaatgagaaagaagaaagagaatcagcctcctaaggcgctcggtgaagcgtacttcagagaagaaagatgatataaaggacgggtttcccccgtcctttcagcttgtagaaaaagtctgttttttataagataatgcgaattctctatccctataagaacgctttgtgggctttgcgtcctgcaaagcctttggacgttctatctcggcatccttgccgaaacccaaagccccttccccgtgggaaggggctattttgctggggctaccgtccctagaccctgtcgggggctacgcccctgcgaccccattttcagaaaacacaaaggtttatcgacagactgaaaggacgggttttcccgtccttgttttgcggttgaactttcaaccgcatttttttattctccgacagacaaaacacatctgtcagttgtattacattcaaagagaaaaactcagggggaacgatttatgacgtcagattattcttccgagagcataagagagctttatgaacgcaatttcgacactctctacagggtgtgctatatgtatatgaaaaatatacaggatacagaagacgctgtacataacgcttttctgaaagcaatcgaaacaagaaaacagtttgaaagcgaaaaccacgaaaaagcatggcttatccgtgttgcttcaaatatctgcaagaatatgctcaaggcggcgtgcagaaaaaacgagccgctcaacgacaatattcccgacagcaatataagcaatgaagcaaaagagcttctcagcgagctttcaaaactgcccgacaagctgaaaatacctgtgtatctgttctattatgacggatactcgagcgaagaaataggacagatgttgcacataagctcttctgcggtccgcacaagattgcagaaagcgagggagcggctgagaaatgtcctcagtgatgaaaggagcgttgaataaaatgacaattaaacaggcatttgatgaagtaaacgctacagacgagcagaagaaaaacagccttgacaggctgttgcaaagcgacaagaaacgcagcttcgtaccgcagataaaacgttatgccgcagcggccgccgcagtagttgtcgccgcaggcacggcaggtgtcggaatacattttgcggtaataaataatcagggcggacctataaacgtatcaataggcgacaacagcgccgccgacagtgttattacgccctcggaaaacacaaaggtacattccgaaaagagcggaatgacttttgttgatgataaggcattctgggcacagctcggaaaaataacttatcacaggatagataatacaccgaccatagatactacagaaatcaatgcggctgatgattttgacagtcttttctgcacggataagcaggttcagagtgaaatgcttgacctgttcgataatgcaattgacatcacaaacaaatatatcgttcttcccgacagcaatgcggcggtaggcatatcctcggatatgagtgtacaggaaattgaaagcttcaaaaacaacagtgccaactgctttgtcggcacgggctattatgaaaacgaacgtttttattatgccgacaaagcgtatttcggttttgacacctcagaggaatttataaacaccgtatcacaggtatatacgggaaattactcagataatttcacggaagatttttatgattactgccccgattacattcagccggcggataaaaataacataaaatcgaatttcggtataaatatcggcaaagagcttccgataacagaaccctactcagcgcatacacagtattgtgcggctgtttataccgatgaaagccataattctttgatactgttatcgcttaccgcaaaagagggcaataacgacagcaaaacgtttgagcttaaatatatacctatgaaatatgttgacggaaaacttcgtatagttgttgagatatataacacgatttttatggacgtaaacgcattctccgataattttatgtataattgcggaatggcaagcgaaatagaatcagacgcaaaaaccattgatataacctctgtggtgtgtgacaatgacaattcatcacgacctgaagaaaccaaggctgtgacaacagtcaaagcaactacttcaaccacagctcccgcaacttcaaccacaccgcagacgaccgcaacaacgactgtgaccactaagacaacagctgcaacaacagccgagcccgctcccgaaccgacaggcacagcaacaaatgtgacgctcagaatgacaggcaacgcagccgatcttgacagaagtatgctttactattataaggttgacaaagcgttccttacaaatgatgaagtcataaccataaagcaatccaaaatatcagaagtaccctattttaataccgatggcagtgatcacacatttgacagcatagactacggcatttacgttatagccgctcctatgatgaccactacaggcgacaacggatttgccgtattcaccgtgaccgaaagcagcagtaacagcattataaatatcgatctgacaaccggtactcttcctgccgacaaatttgaggttgtagacgaaagtattcaggaggaggatactctgcccgattacagcgaacagcagtatgcgcttgcagaaaaatcctacacatatgaggaacacacttacataccggttgagcttatccattatggcgatacctatatagacgataacatatggcaaggagcacgactgatcgacactgttgacggtcataggattacgggatgtaaagtgaaaaagactccggtaagctatgcaagcataagcgttgacggcaaaattatcaccggagaagaagtaaatgattatatcctgcttgtaagcatagataatatccaaggcgaaaacaatcatatctatagcactataatggtgcgcaaagatcttgtaaagagcagtaagccgaaagtcatactcggggatagattttactcttcatacattgccaccgactatggcgatattgacatcgacatggtgcttaaggatgacaacggaaagcctgtaaagaactgcgaaatatattttgtacatcttgatgatatagacacatataatctggaacataacaacgcaaacgttcacgcttcaggcgactattgcatagctaacacggattctgagggaagagtcagtacgtttaccggtctgtactgtggaaagaactatctctcggtatcaaatgccgttgaaaaaggttatgtattcaataacgatcgttattatgacattatcccaaaagatcctgtgccaaagctgatagcagaaattccgattacaaacgaataagtgatctatacagcaaacagtgtcctgcttttcaggaaaagcgctgaagtctgtcggaaaatctatatatctactaaattaaaacgggtattgagtgttgcttgctctgtaggctttgtggcaagcaatcaaagcgtccttgctttaggcaaagctcttcacctaggagaatggagtttgggttagggattgagatcaggctatatttttcaaaacaggcttttactacaagcagacacacggcaggaatactttcccgccgtgctgttttattcgatttctttataaaaagtacttgcattttatccgcttttttggtaaaataaatatgagcgcagaagtataaaaatatgcgtggaatttgtatttcttgaggacagcctcatacaaataaagtaaaagcgaaaggatcattaccatgagcaaattaaacaagaagaatgtagaagatttacaggtaaagggcagaaaagtccttgttcgtgtagacttcaacgtacctatgaaggacggcaagatcacaaacgacaacagaatccaggccgcacttcccacaatcaataagttagttgagaacggcgcaaagatagttctttgttcacatctcggcaagccgaagaacggtcccgaggacaagttctctcttaaggctgctgcagaaagacttgcagagcttgttaatacaaaggtagttttcgctaaggacgatacagtagtaggcgagaacgcaaagaaggcagttgcagaaatgaaggacggcgagatagttgttcttgaaaacacacgtttccgtggcgctgaagaaacaaagaacggtgaagcattctctaaggagcttgcagatctcgttgacgacgatgtattcgtaatggacgctttcggttctgcacacagagcacacgcttctacagtaggcgttacaaagtttgttaaggaaacagcagtaggctaccttatgaacaaggaaatcgagttcttaggcaacgctgttgaaaaccccgtaagacctttcgttgctatcctcggcggtgctaaggttgcagacaagctgaacgttatatcaaacctcctcgaaaagtgcgacacacttatcatcggcggcggtatggcttacacattcttaaaggctaagggctatgaagttggtacatcactcgttgacaacgagaagattgactactgcaaggaaatgattgaaaaggctgaaaagctcggtaagaagctccttctccccattgatacaacaattgcaaaggaattccccgatcctatcgatgctgagatcgaagtaagcgttgttgacgctgacaagattcctgctgatatgatgggtcttgacatcggtcctaagacaatggctctgttcgctgatgccgcaaagtcagctaagacagttgtatggaacggtcctatgggcgtatttgagaaccccgtattaaagaagggtacagttgctgtctgcgaagctcttgcagaggcagacgctacaacaatcatcggcggcggcgactcggctacagctgctatcaacctcggttatgcagacaagatgagccacatctcaacaggcggcggtgcttctcttgaatacctcgaaggtaaggtacttcccggtatcgcttgcattcaggacaagtaaaaataacgagggcggatattctccgcccttattgttgtgtaataagcaatttataataaaaaacgaaaggaacactgtatcatgaaaaagacagtaagaaaagcagttatcgcaggtaactggaagatgaataagacaagacccgaggctaaggctcttttagaagaattaaagcctatggttgccgatgtaaaggacgttgaggtcgtagcctgcgttccctttacaaaccttgaaacagctctcgctgtaacagcaggcacaaacataaagatcggcgctgagaactgccactttgaaaagagcggcgctttcacaggcgaaatttcagctgatatgctcgctgaaatgggtgttgaatatgttgtactcggtcactccgagcgccgtcagtattttgctgaaacagacgaaacagtaaacaagagaacaaaggctgctcttgaagcaggcttaaagcccatcgtatgcgtaggcgagcttctctgggagcgtgaatgcaacattacagaagaagttatcgcacgtcagattaagctcgatttcttcggcatctccgcagacgacctcaagaagtgcataatcgcttacgaacccgtttgggctatcggtacaggcaagacagctacagcagatcaggctgaagaggtttgcgctttcatccgtgctacactcgctaagctctacggcgcagatgttgcagaaacaatcacaatccagtacggtggctctatgaacgcaaagaacgctgaagaactgctctcaaagacaaacgttgacggcggtcttatcggcggtgcttcactcaaggctgctgatttcacaactatcatcaaggctgccgtaaacggctaatcaaaaaatcggataatttacgaaaggacgactaaacaaatggcaaaacccgttttactcgttgttatggacggcgtaggcttttcaaagacaggtcttggcgatgcagttacgctcgccaacactcctactcttgacagacttttaagagaatgccccaacactcgtttaaaggctcacggtgacgctgtaggtctgcctacagatgacgatatgggcaactcagaggtaggtcacaacgcactcggatgcggtcagatttactcacagggcgcaaagcttgttaacgaatctatcgaaagcggaaagatgtatcagtctgaggcttggaaggaactcgttgacaactgcaaggctaacaacagcaccctgcacttcatcggtcttttatcggacggtaacgttcactcaaatatcaagcacctgttcaagatgctgacagaagccaagaacgagggcatcaagaaggcaagagtacacattctgctcgacggcagagatgtacccgctacttctgctccgatatatatcgaacagcttgagagcttcctcaaggagcttaatgcggacggcgcttttgacggtaagatagcaagcggcggcggacgtatgaaggttactatggatcgttaccaggctgactggcctatggttgagcttggctggaagactcacgtcaagggcgagggcagacagtttgcatcagctatggaagctgttgaaacctaccgtaaggaaaacgatggcatcatcgaccaggatctccctgcattcgtaatcgctgagaacggcgagcctgtaggcaagatagttgacaaggacagcgttatcctcttcaacttcagaggcgaccgtgctatcgaactttcaatggcattcgacgatgacgacttcactgcatttgacagaggcgcaaagcccgacgtatgcttcgcaggtatgctgcagtatgacggcgacttaaagcttcctgcacgcttccttgtaaatcctcctgagatcacaaacactctcacagaggtactcgttgccgcaggccttaacgaatatgccgtatccgaaacacagaagtacggccatgtaacttacttctggaacggcaataagagcgataagttcagcgaagagcttgaaacatacaaggaaattccttccgacaacgtttcattcgatcagcgtccgtggatgaagtctgctgagataacagacgatcttatcgaagtaataaagagcaagaagtatgactttatccgttgcaactaccccaacggcgatatggtcggacacacaggcagcctcgactcaacaataatcggtgttgaagcggttgacctcggcctttcaagacttatcaaggtttgcgatgagtatggtgttacgctcgttgtaacagccgatcacggcaacgcagacgagatgctcgaaaagaacaagaagggtgaggttcaggtaagaacagcccactcgctcaaccccgttcctttcatcatctatgataaggaagtcaagtacactatcaaggacgatacaaagtacgctcccggcgttcccactaagtacggtctggctaacgttgctcccaccatcgttaagatgctcggtcttacagcgcctgactgctggcaggaaagcatgatctaagcggctgtgagccgctccaaattccgccgttctgacagattgagcttggctcaacttgcgttaccggcggggcggcaatgtgccgcttcaagttccgcctttgacattgtcggagctatccgcaggataatgaaacggcggggctgaacgcactgcgaatcgcatagcaatgcggtttgtggcgattaagacatatactttgtcaggtgcagagtaaaacagaaaatcgtgtgaagcgggttgccgtgtatagcgattgtttggtattacaatgcggtttgacagcgtgatattgataaaaataagacggcaggcacagataaaatgtgcctgccgtttttgcggctgtgagccgcttcaagttccgcctgcggcaatgtgccgctccaaattccgcctttggaatagttggtgcgtttcgtgcgatagcgaaacggcggggctgaacgcactgcaaatcgcatagtaatgcggtttgtggcaatcggagaatgtacgcagtaatacggcaggaacaggaaagtacggtttcggacgagatattcctgcagttgccaaagtgtcataaatggctttgttatgcggtttgtggcaatcagagaatgtacgcagcaatacggcaggaacgggaatctgcggttgcaaacgaaattttcctgccgttgccaaagtgtcataaatggctttgttatgcggtttgtggcaatcagataatgtacgcagtaatacggcaggaacgggaaagtgcggttgcaaacgagatattcctaccgttgccaaagtgccataaatggctttgttattcggtttattagggtttataaaaacggcaggtgcggagaaataccgttcctgccgtaaatatgacgttttacaattccgctttatatatcaaagcgtcgcaaaccggctctgtgtaatagtttctgcgtctgccgacctcagaaaagccgtgcttttcatacagcttttttgccggctcgttatcacagcggacttcaaggaaaatgctttttatgccgttatttttgcatttatttatgaaatattccattaattgtgtggcgatgcactgatgtctgtattccggcaacactgcaatgcgatacagctcgcattcatcggatacgctctgaccgcagataaagcctaccggcttgttttcggctttatcatcacgaataacgacattgattgagccttctgtgaacacctgcgactcaatgcttcgctctgtccacggcaccgaaaaacactttttttcaatcgctgcaatgtcgctacagattgatgaattatgatgatttaaagccgtgatttttcctttatctgtcaaacagtcattgtcaatgagtatcataccacgttttgccaatatttacatctaccgtcataggaacggtgagctttacggcattctccatttcttcctttaaaagtaaggctaccttttctgcgcaatcttcttttgcctcaacaataagttcatcgtgaacctgaagtatcagccttgcatccagaccgctttcttcaagtctgttgtaaacttttatcatcgcaatttttattatatcggcagctgtaccctgtatgggggtgttctttgcgacacgctcgccgaaagcctgcagattcttattctttgcggcaagctctttgatatatcttcttctgccgaacatagtttcaacatagccgtcacgcttagccttcgcaacggtctgctccatatagtgagctataccggaatatttggaaagataggagcggatatattcgcttgctttcggcactgaaacaccgatgtcctttgacagcgagaatgcgcctattccgtagacgatgccgaagttgaccgctttcgccttgcttctgaggtctggcgttacccactctatcggctgattgaacacctgagatgcggtaacggtatgaatatccactccgtcaaggaacgctttcttcattatctcgtcgcccgaaatatgagccagcacacgcagttcgatctgtgaatagtcggcatcgacaagcaggtagccgtcctttgcggtgaagaatcttctcatctccctgccaagcggagttcttacggggatattctgaatattcggttcggcactggaaattcttcccgttcttgtttccgtctgcttgaaggtcgaatgaatcctgccgtcctcgcctactaccttcagaagtcctgtaacgtatgtgttctgcagctttgtaagcgcacggtattcggttatcagaggaactatagggtgcttgtccataaggctttcaagcacatcggcatttgtggaatagcctgtttttgtctttttggcacttggcaatgcaagtttttcaaaaagcacgcttccgagctgtttgggcgagcctatattgaattcatagcctgcgtattcatagatctcacggctgatcttttcagccttttcgcaaacctctttgccgaaagcctttataccgtctgcgtcaatacttactccctcacgctccatagctacaagcacagtggcaagaggtatctctatatcggtaaggaccgccgcagagcctgtttcactgattttgcaattaagtatatcgttgagggcggcaacggttatcgacttttcctgtatgctgtttccttccggaactccgtactgagcgcagagccttgacaggctgtaatcgtttgaatcggggtcggcaaggtaagccgcaagcgttgtatcaaaacggttgttcttaagcctttcacagccggtaacggtcagcgtttcctttatatcaaaggtgtacttcgtgctgtcgctgtcggcataggctttaagctccccgtctgacaattctaccggagcgcctactgtgcctgcgtacacgctcccctcctgcgtcagaactatatcgcctgcgggcatagcgggtatctgctttgcggcggattcttccaaagcctcttttgagcctgcgggagcggaagtcgggtgcagcttcagcttctggagcatcttgtacatttcaagttccgacagcaatcttgcaagctcggtatcgtcacgttctttcggaacataatgtgaaagctcggtatcaataggtgcggtaaggcatatttcggcaagctgtctgctcatataacagctttccttgccgttttcgagctttgtgcgtacaccctttgtgataagcgttgagccgatgttttcataaactccgtccacgcttgcaaattcctttataagtgacagagcggtcttttcaccgatgccgggaacaccgggaatattgtcgctcgaatcgcccataagcgcctttacttctatcatctgtttcggagtcacgccgtactcctccataataacatcgggcgtgtagtaaatgtcgccttttgtcttggcaagtcttacggtaacataatcatttacaagctggaacgagtcacggtcgcccgttgacactgtacagggtatcttcttatccgcacaggcggctgaaacagttccgattatatcatcggcttcaaagccctctttttcgataatggttattcccattgcggtgattatctttttcatataggggagctgttgtgcgaggtcttcgggcatacccttgcggtttgccttatagccgtcatacatcttatggcggaatgtcggtgctttaaggtcgaaagctaccgctatcatatccggatctacgtccttttcaagcataagcagagtgttcataaagcctgttacggcatttgtggcaacacctcttgaatttgtcagcacacggataccgtagaatgcacggtttaatatgctgttgccgtcaataataagaaatcccatatttatcctttcaagcagaggtcagattgattttttcggtgatttatgattatagtataacataaatcaggtcggtgtaaaccgacacggcggtaagccgtattttgtcgtcagacaaaagatttaatggtaaaatgttctcagacgtgcggtgcgccgcaagccgtgcttcggcacggcaaaatccgcttcgtcggattttaagtctgaggttattataccataaatcaagtcggtgtaaaccgacacggcggtacgccgtattttgtcgtcagacaaaagatttaatggtaaaatgttctcagatgtgcggtgtgccgcaagccgtgcttctgcacggcaaaatccgcttcggcggattttaagtctgaggttattataccataatataacataccgaggaaattctgtcaagttttttcgccaacagtgtatattccggtgcttttgcgggaatactgttttctttgttttctgcggtgcagattttaaccgtgctgtgtcaaactgaaaatcgcaaggccaaaccgcaaaatcggctcggccttgtttctgcttattcaatcctctgacggtttacacaacacttcggtcatgattctcgccgcgagcttaaagccgctgataaacgcttcgcgctcattcataccgtgcagttccgcctcgcagtctttgagcttttcaaaggtttctttttgctgagccgtaagcgtcggaatcaaactatcctgatgccgaataacatagctcaacacttcgctgtaagcactcccgcgcttaaaactgtgttcgtgcggaacgatattgccgtagtacagatcttcaagcgttgtcattttcattccacctcacataagaagaggacgacacatcatcggtcaaacccgacaccgtgtcgccctcatttttcattttctctgccgcaatcagcgcgtgcttgacaagcagcatatcaagccaagtccgctcgttgtattccgacggacgcccattttggaggaagtctttcataacttctcccataatgccgtacttttctcccgcaccttctccgcggtacaattcttctaaactcatctgtgccatatccgcacctcctttgcagtacacaacagtatcacaaaggtttgcaaaagtccagagagaaatttaattaataacggcttcataacactcatcacaggatacattggaacacacatatttcaatctgccgttttcctctgtcaatagcattatattatggcattttgggcatcgtggcacagggaggaattttctcttaggtaaaaatgtagccggaaagtctattttttgatctgaatacttatctgttttcaacacataattcaaagctttttgtaatttagattcatcatactcgaaatggagtccttcttctattattgttttgaaaaactctgtcacagtaatagtttgatctggggttcggatttgttgaaatttaatactactcagcgcgttgttactcggtttttcgatatccgaaaatgaaatatcgataacaacattcatgcaattttggtttgttgcccatgcagcacccgcttcagagatacatatgttcgaatcataaaaagccttgctgaacaggaatatcaccattaaatcctcacggaaacaatccttaagataatcataaatatcctttccttgaggaactcccaagcgtctatctccggtaaagataatcgttgacaccacgtcaaccccgtacgtttccaatacatctacaataaactgaccatatagtttatgttcttctttatggctgataaaaatcttctttgtctgttttccgttatttactgctcgagtgaattgcagattttcttcctgaaccacttgtttttcagcatcattaagacgaagttctaatatttctcttgtctgaggattttcccaaaatttctttttgattttttcatcctcgatcctttggtcatcttcttttcttcgcttactaacaatatctttttgacctactatatatccgagcaagcgtttggctattttaatgacttcgatatatctcggatcgttttcttcgtatccgcgtcggttactaatcgccatatcagctaatccatcttgttcaaaaatatcaacgtacaattcaccaataacataagcttcgctgtttcgattgtttgcgcttgtaaattggcataccacatgaaatcgtgttcgtaatcacctaccagtgcagcgccttcatcttgaaagatgcaatactgcgacttaatttttcgttcaatttccgttttttcttcttcagtaatagcaaaagtttctccgtactgatcaacaacttgctcaaagaaatgagaaatgaattcatcatctattctaagtgtcggattcaataaacgactaatttggtaatgtgaaccgaattgctgcagatatgtagaaataagttcttttttatcaatcattgaacaatctcctttttaatttctccatcaaatgagcctcgttaaatggaggatacttacacaatttttcgaaagcaaccccatcggtacattgtctgatttttttaatcgagttaaattgctctacaccaagcagaacaagagaatcttccttatcctcgctcagttcagtttcctgatttttgttacaaacagaaatataaatatcatcaaacggtatattggcagatatagcatccagcattctcaatattcttgcacgctcaccatcttcaaaactatccaaacattgttgaacaaacggcgagttgtgatttatagagaacacatcttttccgtttcgactcggcgttttaatccatatttgttcttcattttcaccgtcatttagcttcactcgtctgcccgttttttctttagaggtagagcatactctcatcacagatttgcgcaataaatttacgatctgtttgggaataactgcattctgcttttttatatcaatatcccatagcgaatcaagtttgttcgggatatcaaccttgatcctaccatacttgtaaagttcggcattcacgcttcgtgacgacaatctaaaccaagttccatatataatcaatctatcgttcctgtaaacgaaaaaaccttgttcgtcttttaagacctccattcctccaagtgcttctacgtcttctttggagaggtcatcttgatgtggtaaaataaaagtttgtacctttatcatcgcttccttttcatagcccttgtcataatacttaaccgccatctcgacgggtttgccttcatctgttttgggatttcgcttatgatgaggagaaccttcaaggaaaggatctagccctttcaactgtctgtcatttataaaaaaagaaacaggggaaatgctacgattcataaaacgatggaatatcaaacaaagatgactttcactttcgtccaacttttcagaaagatactcataagcatgtccattcgatttttgatcagcaatatcaaaattctgccaaacgaccatggtcccctgaactaaagaattgagcttttcatagttgggacatgcctgtatttcgtcaaaatcaagtctaaggcactcccactctttagatcttaaaacctcatcaagatcccaacgatatgcatgaatgtctccgttaaattttgacataacagtgagcgtacggcactgagaaagtgatgcggatttcaatccaacaccaaagcgccctaaatccttttctccgtactcatcgcgctcgctgccatacttcattgcattgaataacgcagcatcatccatgccaatggcatcatcaaggattgtaatatataaattgtcgctactatatgaaggaaaatctatccaaatatttttagcatccgcggatatagaattatcaattatatcagccacggcagtcttaaacgaatatccgatggatctcaacgaattcattaaaatatcgggagatggtatattttttattttttcagccataatcaattcctcataactaattatttacatttcatttggcactatttcaacaatatcatccattgtacaattaagggcagtacaaatcttcacaagaacatcgctgctgacgacggcgccgtctttacccatcttagtgattgttgcgatgctgatgccggctttttcggcaagttctttctttttcatatcacggtcgattaaaagcttgaataattttttatagcttgcggccattgtattacacctcataaacagttatagttagtacattgtatcatcagaaatcattataccacactccacaccaaatatcaacaactttcggcagataaatactgcgatttcagcatttatcaactttttattgcaagttttctattccctctttgcttttccgtaatccctttttctttgtctactgcggtgcaaattttgacttgaacaaactgctgttcagagttataataaccatataaaaagcgatcgcctctcgcgtgataacgagaggcgtgtattgcgtattattgtgcagaaatccctgttgaccacataacagaccacctaccgtttcggagcactcggaaacagtggacataagagtggcgaagagcacagttttccgagcggaaaggggcggaaaaagctatttttagcggaaattgccttcataggtccgtttgggagcaggatgccgcaggttcgagtcctgtcacctcgaccataaaagaaacctcttttgtctaccaagacaagagaggttttttcttgctttccgggcaaaatgcagggcgaataatagaaaaacgggctttggagcggtcgatcggctgctccaaagcccgtttttttgctttcagcagcagaaacagtccgaaaacgccggtgtacacatagaatttctttgctttgcaagcaactactaaatgtgtttagggtatgagacttgaacctgatgtttgcgaaaaatccagttcgggtaatgatataattacgcagaagccttgaaaaatcggaagttttgtgttatacttaatcagtattattatacccatttcaaagaggaggcacagcatggctgccaatatgcaaaagattaagttgctgaagctttatgagctgctgcataaagagacggatgaagcacatcccatctcccgcgtcgagctctgcagacggctgaatgagatgggcatttccagtaatgtcaggacactgagtttggatattgaggtcatgcaggaaaatggcttcgagatcatgagctacctgaaggataaggaaaagttctactatgttccggagcatgagctcaccgtgccggagataaaaatactgattgatgcggtacaagcggccagttttatcacagagaaaaaaacagccgagctgatagaaaaggttgccgctctcggcggatcacaccaagccgaactgctaaaggaaaacatggtatgcttcaatacccggaagcacaccaatgaggccattctctacacagtggatggcattgaggatgccattattcgcaggaagaagatcgaattcaactacttccatttgaatgaaaaggcggagcgcgtatatgtgaccgccagcgatggcagtaagaaacgctactacgtggagccggtcgcgcttatcttcaatgaggacaactactatctgatggcatacagcagcaagcatccggacagcaccgccaactatcgcattgatcgcatagatcatcttactcttgtagaagaatcggtaatgtcgaatgaagcggtagcccggattgatggcgtggcagagtatacggagcaggttttcaaaatgttcagcggcgagctggaggacgttgttatacagttcaacaagcagcttatcggccccgtgtttgataaatttggcgaagacacaccaatgatgtccgtgaacgagaccacctgcgctgcaacggtacatgtgcagattagccctccctttttcggatggctggcacagttcggaaacagaatgcaggtcatctccccacccaacgtaatcgatcactacagagaacacattaacaatattgtcggaggaaacgtggaatgattacaggagcaattaaaaataaggtcgataagatctggacggacatttgggctggcggcatcgcaaacccgctgaccgttatcgagcagcttacatacctcatgttcatccgttccctcgacgaaaaggaacttgagaccgaggaatttgagacgatgaccggcgagaagatggcaaagattttcccccagtctcccgtcgggcaatcaatgcgttggagcaaattcaaaaacgacgatccgcgccagatttttgatgtgatctcccagcgggtatttcctgcgattaaaagcatgaagtatggtcgtctccctgattttaatgaaaagggtgagctcgtagagattgaagacgaacctggcaaagcagatgaaagcacgactgcttttgcacggtatatgagcaatgcgatgttcatcatccccaccccgcagctgcttcagaaaatagtaacagggctggacgacctttacgagcacgatattgcagaattggatatgcagggcgacctatatgagtacatgctcggcaagctggctacagcaggccagaatgggcagttccgcaccccgaagcatattcgagagatgatggttgagttgctgcagccgacaccggatgatactatatgtgatccggcatgtggaacggctggtttcttggtttctgcttcggagtacatccgtcgcaactatgaagataccatgacctccgagcaatggcagcattttgcaggccccgcatttacgggatttgacacggactacaccatgctccgcatttctgcgatgaacctcatgctgcactctatcagcaatccggagattgattataaggatagcgtgtcgaaacaaaatcagatttccgatcgctttacgatgtgcttggcgaatcccccgttcaagggaacgatcgacgcagagagcatccacgataatctgaaagcggtaacgaacacgaagaaaacggagctgctgttccttgccctgttcctgcgtatgctgaaaaagggcggccagtgcgcctgcattgttccggatggtgtattgttcggatcgtcctcagcacataaatccattcgcaaagagctcgtcgagaaccaccagctccgtgccgtgatatcaatgccttctggcgtattcaagccatacgcaggtgtttccactgctgtgctggtattcacaaagaccggcgcgggtggtaccgacaaagtatggttctatgacatgaaggccgatggcttcagcctcgacgataagcgttccgagattgcagataacgatatccccgatatcattcagaggttccaccatctggagcaggaaaccacacgcgagcgtaccgagcagagctttttcgtaccgaagcaggagatcgtagacaacggatacgacctctccataaacaaatacaagaaaacagagtatgtggctgtcgaatacccctctaccgcagagatcatggataagattgatgaactagaagaaagtatctccgccgaactgaaggaattgaggaaaatgctatgatggagaaaactttacccgaggtatgcataatccaatatggatttccttttgactcgtctaagttctgcagtgcagaaggcgttccgcttgttcgtattcgagatgttgttaggggctattcggaaacgtataccacagaaatcgctggagaaaactacattgttaacgatggtgacctgctcattggcatggatggagagtttaatatcgcttattggaaaggtggtcgtgcatatttaaatcaacgagtatgcagattgatcccacgtgaagacgttgaccgcgattacatattttactatatgccacaagcactaaaagcaatagaggatgccacgccgtttgtgacagtaaagcatttgtctgcaaaacagctgagcaaaatactaatacctctgcccgatatgagcgagcagcagcgaatttccgcagtattgcgtagtgttgacagggtaattgccatgcggaaaaaggaattggacgagcttaccaatctcgtgaaatcccgatttatcgaactgttcggcgatcttaaatctaacccaatggaatggcctgttgtatctttcactgagtttgctaagatcgatgggaatatgacaacagattatgaaaaatacgctggttatccgcatataggcattgacagcattgagaaaggcactggagcgctaaaaggctaccgcacagtcagagaagatggtgtaataagcggaaagtacatatttaccccgcaacacatcatttatagtaagatccgccctaatctcaataaagtcgcattgcccgattttgaggggttatgttcagcagatgcatacccaattttaccgaaccacagcaactgcaatcgagtgtttctggccattgcgttgcggtcggaatacttcttggagtacattttgcaattcagttcacgcacgaatctgccaaaggttaaccgaaaagagatcgcaggttttcgtatgccccttccaccgcttaagctgcaagagcagtttgcggccttcgtcgaacagaccgacaaatcaaaattggcagtgcagaaaggactgcaggaactggagattttgaaaaaatctctgatgcaacagtattttggctaaatgagccggtgcaggatgttggtacacaacataaatttagaggtgtactagcatgaaaaaccagcttatttccgaaatcacacgacaaatgatcccctatttggataacgcccagatggagcagctgcagaatgttctgcagcatgctctctggaacgtccaaatcaccgctaatgaggatggtgctcaacagccagacaaagaaaccaattctgaattgttggaaatgttcttgtctgcaaagcgggttgagggatgcagcgagaaaacgctgcggtattatgaaacctcaatccggaggctgtttgcagcagttgattcccatgttacacacatgcagacggatgatttgcgaggatatctttctgattaccagcaacaaacgcagtgcagcaaaggcaacatagataacatccgaaggatcatgtccagctttttcacgtggctggaggacgaaaactacatactaaaaagccctgtacgccggatccataaaatacgttcaaacaagaccgttaaggaaacatacacggacgaagcgctggaaaccatgcgcgatcagtgtggttgtttgcgtgatctggcgatgatagacctgcttgcctccactggtatgcgtgttggagagctggtaaggctgaaccgtgacgacattgactttgagaacagagagtgcgttgtattcggaaaaggtagcaaagaacgtcccgtatactttgacgcccgcaccaaaatccacctcaaaaactatctggaaaacaggcgtgatgataatcccgctctattcgtttctctgctcagtccatacaacaggctggagatcagtggcgtggaggtacgattgcgaaagctgggacggaagctcggtatcacaaaggtacatccgcataagttccgaagaacgctggcgacacgcgccatcgacaaaggaatgccgatagaacaggtgcagcggctcctcggtcatgccaaaattgacaccacaatgcagtacgcaatggtgaatcagaacaatgtaaagatttcccatagaaagtacattggctgattgccaatcccgatttatcgaactgttcggtgatccgattgcaaacccattgggctggcctgttaaaaggcttgacgatatttctgtgctgatcacaaatggtaatacgccaaagggtggtagcgataattatgtcagtgagggaatcgtatttttgcgaagccagaatgtatggcgcaataaaatagatctcgatgatgtcgcatacattgatgctgctacacatgctgacatggcaaagagcagtctgcatgacaaggatattctcataacaaaaactggtaggataaacactgaaaacagcagcttgggacgtgcagctttgttccgtggtgccgataatagcgctaatattaacgggcatgtctatttggttcgcttggatagaacgacggtgcctgaatatgtagtggcgatacttacaggagaaccatatcggcggtatatccgaaaggtttgcgtggggggcatcgacaagcgccagattaacctcgatcaggttgaggatttcccaattatcctacctcctatagaactacaggagcaattcgcagccttcgtcgaacagaccgacaaatcaaaactttgcggtaagatggaggtggcagcatgaacgagttcatgagaattggggatatttgcgacatcctaaacggttatgcatttaaaagcagtaaatatgtcgctgacggaattcgtgtaatacgaataacaaatgttcagaagggctttgtcgaagatacaaatcctcagtattacccagtaagtgagcaacgggaaattgagaaatatatgctttgcgaaggcgatttacttatgtcgttaacaggcaacgttggtagagtcggcctactgagtgctgaaatgttgccagccgcgttgaaccagcgtgttgcatgtattcgcataagaaatccagccgtaatatataagccatttctgttccatctattgaattctgattatttcgagaataaatgcatccttgcatcccaaggtgttgctcaaaagaatatgagtacagagtggttaaaagaatacccaatcccctcattttcaatggataagcagatggaaattgcgtcgatctttgacaagattgatgatttaattgcccgccgtaaggagcaagtgcgaaacatggatcaggccgtcaagtcccgatttatcgaactgttcggtatgccgggaacagacgccttcggatggggcttagtaccgctcgggagtacttgtaacatcaaccctaaaaagagcctcgattcacggcttgttagtggtgcgatggtttcctttgtgccaatgcctgccgtaaccgaacatggtgagatagatgcgacggcaatcaaagagtatgatgaggtaaaaacgggtttcacatactttgccgaaaatgatgtcctttttgcaaaaattactccatgcatggaaaatggcaagggggcagtagctaaaggccttcataatggcatagggtttggctcgacagaattccatgtgcttcgtccgctcagtggaaagaccgatccgtactggatttacacgctcaccgctttttcgcagttccgcatagatgcagcaagcaacatgaccggtagcgcgggacagcgtagagttcctgcttctttcttggaaaactatcgagtatccctgcccccaattgaattgcaggaacagttcgcagccttcgtcgaacagaccgacaaatcaaaactttgcggtaagatggaggtggcagcatgagcagtttcgtcaaattgggtgatctgacacacattcgtactggaaagctggatgcaaatgcgtcatcagagaacggacaatatcctttttttacttgttccaaagaaccattgcgaattgcttcgtattcatacgattgtgagtgtgtcttagtagcaggaaacggcgatttgaatgtaaaatactatgacggaaagttcgatgcatatcagcgcacctatattattgagtctgcagacaagagaaaattgcttgtaaaatacctgtactttttcttggacatctatgtagaagtgctgcgaacacaatcaattggtggggttattaagtacataaaactaggtaatctcacggatgcccttattcctctccccagcatcgaaagacaggcagaaatcattgaatgcctcgaaaaatgcaatacacttatcgacaaaaggcagcgacaaatagcgttaatagagcagaccgtcaagtcccgatttatcgaactgttcggtaattatgatttgacacacccgcaggaatcatgggctcccataaaggaagttgggacggttgtcggtggcgctaccccgaaaacggatcatgacgaatactggggtggctcgtaccgctggatcactcccgcagaattagatgccgatagtggatacatttacgattcggtaaggaagctaacaaaagcaggtgtggaaagctgctcattacaagaaatgcctgtcggaacggtaattttatcttcccgtgcaccgattggtaaagtggctattgcgggaaatacgttctattgcaatcagggctttaaaaacatcatttgcaaggaaggcataacaccgcgatatttgtataccgttcttctgttgaacgtcgaatacttaaattcacttggcaggggcgcgacatttaaggaaatctccaagggaatagtcgaaagcattcgcattcctgtgccatcaatggagctgcaggagcagtttgcagccttcgtcgaacagaccgacaaatcaaaatattacagctctttgagctttagatactgccaagcggcagcgaatacatacagacaggagtggatgacatgtcgaacttcggatttctaaaagataaaaaggagtacgcactgtttgcctcggctgcgatcgaggcggaaaaggtgtatgtttccgcgcctgctatgtgcgccgtcggcagcagaaaagctctggaattagccgtcaaatgggtgtattcggctgataagacgatgcagatgccttacaaagataatctgcaggcactcattcatgagccaaccttccgttttgcggtagactacaacacatggggcaaactgccgtttatcattaagttgggcaatctggccgttcacacggagcgaagtgtacaggccagtgacgctctcgcttctctacagggactctttgagtttattcaatgggtggactattgctatggcgctgattacgaagagcggcagttcgatgaggcactaattccgaccgaaaaggttgtcgtcgacaccaagaaaataaaagagcaagagagtctgctcggtgagaaggacgcagagattgaggctttgcgtaaaaagatcgagcagatgtccgagcagatcaccgcaacaaaggagcagcaccagcaggagcgcacctttgtcgcagcagacctttccgagtttaagacccgcaaaatttatatcgatgtggacatgaagcagatgggctggaaattctccggagcagatgctgacgttcaggaagagtatcccgtcgaaggcatggcaggtgtgctggggcagatgggatatgtggactacgtgctgttcggaaaagacggcctaccacttgcagtggtggaggccaagagatccagcaaagacccgaacataggccgcaaacaagctgtgctgtacgctgactgtctggagagaaaattcggacgtcgccccatgatgttcacgaccaatggttttgaaacctacttttgggacgatcagagcagcccgcagcgcaaggtcagcggcatattcagcaaagacgatctgcagaagctgatgaaccgccgtatcgagcggaaggatctgatgaccattcctatcgatgacagaatcacagatcgctactaccaaaaggaagccatccgcgctgtatgtgagcagattgggcaagggtttagaaagcacctgctggtcatggcaacaggaacgggtaaaaccagaactgcatccagcctcaccgatgtgctcagtcgcggcaaatatgtcaccaatattctgttcttggctgatcgcacggcgctggtgaaacaggcaaaggacgatttcaaaaactatctgccggatatgtctctgtgcaatctgtgctccaataaggacgaccggagcgcacggatcgtattctcgacatacccgacaatgctgaacgccatagacgatatgaagacgaaagatgggcagcgcatgtttaccccagcccactttgacctcatcatcatcgacgagagccaccgcagcatattcaaaaaataccgcgcgattttcgaatacttcgatgcgatcatggtcggactgaccgcaaccccaaaaacggacgttgatcgcaatacctatgatttcttcgaaatggagcacggtgtaccgacgtatgcatacgactacgagacggcagtctatcaggatcatgtgctcgtgccctactataactatgaggttaaaacaaagttcttagaggaaggcatcacatacgacgacctttccgatgaggacaaggaacggtatgaagaggactttgttgaggacggcctgatgcccgacttcattccgtcggcgcagctgaacaagttcgttttcaacgagacaaccgttgacacggtgcttcaggatttaatggagcgcggcatccgtgttgctggtggtgacagactgggtaaaaccatcatcttcgcccagaacaagcgccatgcggagttcattctggagcggtttaataagctgtacccaaaataccgtggcacatttgcacagcgcgttatctgcgacgatacatacgcgcagacgatcattgacgatttcaaaattccagagaaagacccgatcatagcggtttccgtggatatgatggataccggcatcgatgtgccggaatgcgtcaacctcgtattctttaaaaaggtgcggtcaaagacgaaattctggcagatgatcgggcgtggtactcgtctcagcaaggagctcacctgcatcgatcagatcgacggcgaatacacggcaaagagacggttcctcatctttgactattgcggaaactttgaatacttccgtgctcacaaagagggctttgagtcccgcgagacgaagacgctgtcggagaacatattcgggaagcagatccgcattgcggtggcgctgcaggaaagtgcatttgccggagacgactatcagagctggagatccgagcttgtagagacatgctactctcaggtattggggctgaacaccgatctcatcgccgtgaggctgcacatacaaagcgttgaaaagtttaagaagcccggagctttcaactacattagtgaaggcgacaagggcgaactgatgcagcagattgcgccaatcgttcacttggatgacaacgacgaatttgcaaagcgctttgataactttatgtacggtctaatgattgcccagatagagcagatgccctcgcttaagattgcacagaaacagctccgtgatattggaacgctgctggagcgcaaggtcagcatcccgcaggtaaaagcgaaactgccgatcatcaaggaggtcaacacagacgctttctggaatgcgaacgatgttctgctgtatgagcgggtgcggaaggagctccgtgatctgataaagttcctgaatgacgttgaccctcgaaagccgattattactcggctatctgacccgattatagatcagaaagagggcgacccgatggagccggggtatgatttcgaagactatcgcgccaaagtcaatcgctacgtcaacgaaaacggaaatgcgcttgccatctataagctgacacacaacatccccctctcggctgcggattacagcgagctggagcacgtgctgactagcgaattgggcagtaaagaagactacgaaagagaatatggtgatacgccgtttggtttgctgatccgcaaaatcgccaagctggatcacgaagcagcaatgcaggctttttcgcagttcataaatgaccagtcactgaaccagaagcagatcgcttttgtgcataagatcattaaccacatcgagcagaatgggtatatggagaatgttaccgagctgcagaatccgccctttgacaagccgatcagctttgtaaagctctttgatgcccgtacacgtgcagcgttattggccgcgatcaacaaagtgaaagaaaacgcggttgtcattgctgcttaacggaagccctaaacaaatagcaaacacctcgcagtcataacggctgcgaggtgtttctgtaagtgcaggttttatggaatatagattacggggacattctgccgagttgcatagtcaatcgtgttttttgtcccgcccttctcgccgctgaacacggcgatcacacggccagcgtggtcgaccatccattcattgcggcgttggaagcagccacggtcatactgcggagaaatgaaacggacgatatcggcaccggccagaaccgaagcatagcgactttgccacgctggcgaccatgcacgttcaaagccctgataggggcttgcggcaatcagatgaatcggagagccattgtcccgtagacgaaggacgacctccgcagcccagatgtcaacacctctggccataccggagataaaagtctggaaaccgtctgtgatagcagcgcggatttccagctcaagcaaggctacgatctccgcctcgcttttattcaatttttcagggcggtggccggtaaagcatacccggcgcattctgagctcagactcgtttgacataaggatcaccacatttcccaaatatagtttactgcctgaacgcgcaagtttcaagtataaatatcaccataacttgcgatactacttccacccatttgctctaacggcatcaccaaacgtggtgatagaatatatactggaagtgaggtggttttgtggacatccgtcaaaggctgatcgaattgcaggagcaacacggttggtcagattacaaaatcgccaaagaggcaggcttatcgccgaacacagtatccaacatctaccgccgtggcaacactccgagcatggtcacattggaagcattgtgcaaggcgttcggcattaccatggcacagttttttgcagagggcgaaatgattgagattacgccggagctgcgggaactctttgataaatggacagtactgacaccggaacagaaaaccgcactttggcaaataatcaaaacatacgagaaataaaggcagggcgagcaatcgcccttctttttttgcccttgtagcgcaagatatggtggtaaaaccgcaccacatgttgatatacagcgctataataaagtagcgccgcctccgcatgcgtcagggtcgatgtcggcaatcgatcaaatctgtggcgcagaaggaggtgatgcattcttgaagaagattaaaatcgacagagctatacaagagcgccctgctacacgaaagcagacgcgaaacgagaaaattcggcagtcactgacagagcatgttgatgtgcaggtaatccctgctatcacagatcgagagggatatgaaaagccgaagctccgcgtgtgcgcgtattgccgcgtcagcacagacatggacacgcaggcgctctcttatgagctgcaggtacagaattacacagattacatccgaggcaacgatgaatggcagtttgcaggtatatatgcagatcgcggaatttccggcacatccctaaaacacagggatgagttcaatcgaatgatcgaggattgcaaagcgggtaagatcgacctgatcatcacgaaggcggtcacccgctttgcgcgtaatgttctggactgcatttcgacgatccgcatgctaaaacagctggagcatccagttgccgtgtactttgaaaccgagaggatcaacacgctggatactacgtccgagacatatctgggattgatcagcctgttcgcgcagggtgaatcggagtccaaatctgaaagtcttaaatggtcgtacatccgacgctggaaacgtggcgcgggtatttatccgacgtggtcacttctcggctatgagatgggcgaagacggaaagtggcagatcgtcgaagcggaagccgaactggtacgcatcatttatgatatgtacctcaacggctactcgtcccctcagatcgccgagatcttaacccggagtggtgttccgactgctactaaccagacggtatggagcagtggcggcgtgctcggaatacttcggaatgaaaaatactgcggcaatgtcctgtgccagaagacaatgaccgtggatgtgttcagccataaagccatcaagaacacgggacagaagacgcagtacttcattgaagggcaccatgaacccattattctgaaatcagattgggatcgggtgcagcagatgatcgacgagaaatactatcgcaaaagacgcggccgcaggacgaagccgagaatcgtcctgaaaggttgtcttaccggtttcactcagatcgacctcgattgggatgaagacgacatcgcgcgtattttttactcgaccacacctgcggcagaagccgcaacgccagctatggcagatcacatcgaaattattaaagtcaaaggagaaaactaatatgtccgtactcgaaaaattcaagctcgtagagctcatcacatctcgcaccgactccgttgccacctttatgaacggcaaccagatcaagttcaatgcagccacctttgtggatctgggatacccggaatacatccagctcttcgtcgaagagaaaggcaagcagttcgccatcaaggcctgcaaggcagatgcgccgcaggcgatcaagttctccaagcccgctggtgaacagcgataccccatcaagatcagctgtgccccggcagccaatgcggtgcggagggtcatgcagtgggcacccgaagaaagctggaatgttcccggcgctatcttcggtgaagaaaaagttattatctactcgttggagcaggcgtatgccccagtgcccaagggtggatggacggccaaaaagcaggctgcagctgctgcggaggctgcttctaaagtcaacgccaaataatccttagcgcctcaacttcataaggcagcgccatgtggtttgtactgcatggcgtttgcctatcattgccagcagcgtaatgaaatcattacttcaaagctgcaaaccgggaattttgtctcaaaccccttgacgcgttctgccgtcgtgagtataatttagttgtaaatgagacacaggtttcatttaggaggaatttcgcatgagaagcaaagataagaccctgatggcggctatcgagaagttcgtgagtgactacacggacagcaacggtatctcgcccactatgcaggaagtcgcagacggggtcggatcgtcaaaggccacggtgcagcgctacatcgcccagctgtgtgatgatggcattcttgactactccggctaccgcacgatgacctctacgaaaacgaaggcagcagcaatccgagtccccgttctcggcaccattgcctgcggcattccgaaatttgcagaggaaaacatcgaggaatacgtccgccttcctgtcgcactattcggcaaaggcaacttcttcattctccgcgcctacggcgattcgatgatcgaagcaggtatcgataacggcgatctcgttctgattcggcagcaaaactacgcagacgaaggtcagattgtcgttgcccttatggaggatgaagcgacactcaaaagattttatccagaacccaaaaagcatcgcatctgtctgcacccggagaattctcgtatggacgacatctacgttgataactgtgagattcaaggcgttgcggttaaagtgctcaaggatctggagtgaacggagggatgggtagatggaacgtgtattagagcacgttgatgtggaagaaatgtatctggacgttgatccggaaaacctgcctgacaagggagaaatcgttgaaacagcgcacttctttgtcggacaggcatacaacgcacacatccatgtcgtcgaaaaagaatccggcgacatggtgatgcacatcaactgcacgatcatgtattcgaaagagcggctgcaggcatttgctgaccttatcgaaagggacggcggccccagcattgaggcggtgcgagcgctatgactactccaccgcacctcaaatgataaaacggagcgtacccaccatggcaaaaacacgaacttacttctgcatagacatgaagagcttttacgcatcggtcgaatgtgccgagcgtgggtataatcccttcgaaacaaatctcgtcgtcgcagatctcacacgcgggaaaaatgccttgtgtcttgcgattactccagcgatgaaggcacaaggcataagaaaccgctgtaggctgtcggagatccccaacaatgtcaagtacgaggtcgccccgccccgcatggctttgtacattgaatacgcagcggatatctactcgctgtatttggattactttgacccacgggatattcacgtgtactcgatcgacgaatcgttcctcgacgtgaccgattatctggcaccgaatcacatggacgcagtgacgttcgccaagcatctgatgaatgaaatcgcagatcgctttcatattcctgcaacagcgggtatcgggacgaacctttatctcgccaagattgcgctggacattacagcaaagcacgccaaagatcacgtcggggtactggacgaagagaaataccggcagacattatgggatcaccggccgatcacagatttttggatggtcgcaggtggaacagcacgacggctggaacgatatggcgttttcgatatgcgtggcgtgacccagatggacacaggactcatgtacaaagtattcggcaagaatgcagaactgcttatagaccatgcgtggggacgtgagccgtgcctgatttctgacatcaaagcatataagagcaaaacaaaatccgtatcgttctcgcagattctgcctcgggattacacctttcaggaagcccggactgttatgcatgagatggcgctcaatggagctgccgagcttatgcggcggaaagttatcaccagtaaggtcggtatctttgtcggctatactcatgatgagcttgcgcccaccaagggtatggcaaagctggatgtgacaaccgccctcgcctccttcctcgtggaggcggcactgcgggtatacgacaaaaccacagatcgctgtaccaaaatcagacggctcggcatcacatttgaggatgtgtgcgatgaaggttgtgagggctacaacttgttcacgaactttgatgccgtcgagcgggagcgaactgttcagcagaccgttttggacattcggcagcggtatggcaaaaacgccgttcttcgcggcatcaactatatgccggagggtacgcagcgtgaacgaaacggttttataggagggcatcgagcaggatatgatgacaagagcagaaagagctaaaatattcagcccgtttgatgcaatgaagggcttacaggaggcgttgcgggatcgtgaagaacggcacctgcgagtagagcgccatgatatttccgaagagcaggcagaacacaactcacggattttcctgaagcttcggcgcggtatgaaagttgaaattgactgctactgcgcctttcacgatgtcaccaaacgtggcagtataacggacgtgagctgtacgttccgttggctcaaactggatggtgagcagatatatttcgaggatatctactcaatcgaaatcacagatttaggttgaacggaggaactgagatggaacaatacgacgttatgtgcccgatttgtggcactttgaataaaggcttgtttttagatgaaacaggcggatggatggaatgtgagcattgccacaccatggttatggatggcgaatacgcccgtaagcacactgtgcggatccctcttattaaaatgggacggctcgcgcagtgcgttgcctcggaggccgtataaatgcccgcacgtaccacaggaagcaaggaggaagtcggatgggcgaattagacacgcttttgtatgcctgctgtccaaaatgtagcaagccgatcggcagatcgaagcgctgtgatggtatggagctaaattgtccgaaatgcggaagccctttgcgtgtggtcgtagatcaggacgcaaaggtcatggtggagctggtacaacgtacatcggcaaccacaatgaaaacaaataagactgctgttgcgccatgagcaccggactcggccagaaccgttaggggtaccgacacgacagtaaaatctgttatgggatcgaaattgacacagatcaataggcttccggcagatagaaatcctgaaggataattctatctgccggtctttttatgcccgctgcggtaggagcaatcctgctgcagcgggctgttttcatttctactgagaaaaaagaagattatttgaaaaacccttttgaacacgacattaggtgtcgggtttatccctgaaaataaacacaacgaaggacggaaggaggtgagaacatgcagagtgcgattgagcgcagacagcaagtgctggaggcaatcagcgaccgaaggacagaacgcattgagaacttagcagctgaattcggtgtcagcagaaggacgatcgagcgcgacattctcgtactctcatgttcttaccccattgtcacagtacaaggcgcagcgggcggtgtccgcgccatggacggatggtacgtcactcgccggtacttaaacgacgatcaggagtctctgcttcgctccctcctccccggactgcagccggatcagcaggaaacaatgcagcgtatcctttccgccttcgctaaaccaaacgtgaaggagaaaaatcattgaatgcaataagagacggcaatcacattcgcatatacgacgcatttctggcgaaagaaagcatcaaagaaatcgacggaaggttttatgatccagacgacaagtcttgggtagtgccctattccaaggaaaatgtagcactgctgcagatgctcggtgcatccctcgacgatacgctctcgccggatatcaagtcgcaggacgcaggcgacgaagtcccgctcattccgatgccgatcaaggcgacaccttatcagcaccagatcagagcatacaactttgccctgcgaaccttcgggatcggaggtacggcatgatcgtgcattgtgtagtatgcgggaaagccctcgagcggaaaaaaccaaacagaaagaatttctgctctgtggagcaccgcaatttatggatgagcgagaatgtggatttcgccaaactcgcccgtggccataaggcggctcacctcacggatctcaatcgccagcgtaatccatactgccatatcgccgatcgcggcaaagccaactcaaagaaggcgcgtgccgcagcagaggtgtacatcggtagaccactggagcatggcgaagtcgtccatcacatgaacggcgatgcctccgacaacagtccggagaacttgctgatcatgcctgacaggcagcaccgacagcttcacatggcgcttgccatagagcagatggaaggcggtgattccgatgaccagtaaaggctgtgcctttctcatggacatgggcaccggcaagacgatcaccacaattgcgctggcgggtacgctccaccacaagcacaaaatcacgcagatgttggtcgtttgcccgaaatctatcgtggatgtctgggagcaagagtttgaaaaattcgcggattttccttatcaactggctgtgctcgatggaaccagcgtgaagaaggccgataccatccgatacatgatcggcaatggccttcagatcatcgtagtcaactacgaaagctgctggcggctggaggcggaactctcgcgctggcacccagacatgatcgtgtgtgacgaaagcagcaaaatcaagaatccgcaggcaaagtgctcgaaggcactgcaccggctcggtaagatcagcagctataacctgatcctgacgggcacacccatcacaaacagtccactggattttttcagccagtacaagtttctggacgaaagcatcttcggcggcagcttctacagcttccgcgcctactacgccatcctcggcggattccagaatcaccagatcgtcgggtacaagcatctggcggagctggtcgaaaaggcacattccatcgcatatcgcattcgtatcgacgaggcggttgatctgccggaatttgtggaagaggtacgaccggtaaagctggagcaaaatgcccagaagatctatgacggcatcgaaaaggacagcttcgccgagctcatgaacggcgaaatcacgacccgcaacgtgctgacccagcttcttcgtctctcacagatcacaggcggattcgtccgcaacgatgacggtgatgacacccagcagctatcgacggcgaagctcgacgcactcgaagacgtgatcgacagctgcatggaggaaggcaaaaaagtcatcgtgttcgcccgcttcgtgccggagatcgatgcgatcgcccgtatgctccgcaagaagaacatcgggtacgccctgatcaaaggtgacgtgaaggatcgcgccgagcaggtttccgccttccagaccgatcccgacaccaaggtgtttgtcgggcagttacagaccaccggcatggggctcaccctcacggcaggcagcgtctgcgtgtactactcgctggatttcagctatgccaactaccagcaatccatggcgcgtgtgcgccggatcgggcagacgaagcgcggcgtttacattcaccttgtctgcaaagacaccattgacgaaaaagtcatgggtgcgctcaagcagaaggccgatgtctccaagctactcgtcgacgactacaaaaaaatcattggaggataacgatatgaacgaaaaaagcatgctcgctgcggcggataccctgaaggcgctgcgcgacgagaaatctgaccttcaggcaaagctcaaagatgtacaggaacgcatcgattctgtggaggccgagctgattcagctgatgacggatgaagaatgcaccggcttcgaccgcaacggatcccgcttctcccttgtaattcgtgaattccccggcgcggtaccggaagaaaaggaagaactgtaccgacggatgcgggtacacggcttcgaccatctgttcaccatcaacaccatgacgcttggtgctacggtcaaagaactcaaggccaacaacgacgatgtgctccccgactggctcgaaggcgtgattcaggtgttcgagcagccgagcatccgcgtatccaaatctaagaaatgaaaaaggagataagcaccatgaacacaaagaacaccactgcaattgctaccaccgatcagaacaccggttatcttaccgaaaccgtaaatctcgccgagctgtttagtgaagagcttgacggcctgcgtcccagctttgagcgcatcaagattcccgcaggcggtgggctcgcctatgaggtacccggcgacgatccgaacagccccgacagcgccaaagactttagcgccgtcattctgtatcatcacccgatcaacagttactataaagaaaaattcaccggtggcaacaatcctcccgactgctccagcttagacggaaagcttggcgtcgttgccgagaccggcgaatgcaaagaatgcaagacctgcccgtatgccaagtttggcagcggcgaaaacggcggcatggcttgcaaacagaagcgccgtatgtacctcctacgcgaaggcgaaatgctcccgatcatcatgacgctacccaccgggtcgctggcggaattcacgaaatatgtcacccgccttgtgacccgtggtatgaaggccaatcatgtagtgacaaagttctccctgaagcgtgcgcagaatagcaccggcatcaattacagtcaggtgatctgctctgcggatcgacctctttccccggatgaaaagaagaacatcgcatccatgaccgagcagatcaagctcatcgcaggcaaggtttccgtcgccgaaaccgagactgcagcggaataaggataaagcagccgtgagcgcctattcacggagctcacggctgcacgatttgaggtgcagactatgaatgattataagacgatccgcaaaattgcggaaattgaagaatatatcggcagcgctggtgtagtttcctttgacttcgagacttcgcccacggagaaatatcgcagtgacggcaaagcggcattggatgcacataaggcagacatcaccggcgtgtcactttccgtgaaggcaggcacaggcagatacatcccgctcaggcatcgcgtcggtaagaacgccagtattccttctgttatggcattcctgcggcagcgcgtatttcagaatccgaaaacagtcaaaatcgcacacaacatggcgtttgaggcaatgttcctgtataaagacgggatcgtgttgcaggagcccgtgtacgacacgatcgttgcatcacaacttacgctgaaaaatgattttgagtaccgcgatctcggtgacagcggacttaaaacccttgtcccgtatctgtatggcgttgaactcccgaaatttgaggatgtggttggcgagcacagttttgatgagctcgacccagatgcatgggacacctgccggtacgcctgtgcggatagcgactgggcattgcagctttactacacgttcagcgaatggtttgagaacaacatcccgaagcaccgcctgatctgtgaaaagatcgaaagcccaaccgccgttttcaccggcatgatgaagtataacggcgtcctgttcgataccgacctcatggaggaaaagaaggcggaggccgaagcacaccttgtggatcttcgagcaaagctgcaggcggtcatcggcaatgtggatatcggagagaactgtggaacgcaggcattcaaggactatctgtataagacagaaaacctgcccgtcctgaagaccacaaccaaatatgccgaggcagcggacgatgaggctatgcagttgcttcgtgcatattgcaaaaagcaccgccctgagatggtttccttcttcgataccgtacaggaattccgcaagtgggcaaagatcaagagcacctacatcgacggatacctcaaatggatcaatccggcgaccggtagaatacaccccgaccttctgccgatgggaaccgacacgggacgttttgcatcccgcagacccaatctgcagaatatgccccgcaagggctctgacccgatcggcgtcaggcagttcgtggtcgcgccggagggcacgtccttcctagatttcgacttctcgcagatcgagctgcgcgtcggcgcgttctactgccgcgacccacgaatgatggaaacgtaccgcagcggtggcgacattcacgccagcactacatcggtcattttcgggatcagtgtcgatgaggtgctcgttaattatatctggaatatatttagcaagagctatatattatacaataaatcagaccgaagtttacgttgacgaaactcttgtttattcttttgaagatagcactctacctatcttggctaacctgtgccttgcaatttattttgtaattattttcctgcttatccttgcgcagaaaaagaacaaaagaaaactaatcgctgtcggaaggtgtatttttgtaatcccgctcatagcttatatagcgcttcattataaatattttatttatatttactatattttttacacttggttgaaatacggcacgccctatcttaactttgacttaatttgcgattatctccagcaaattcttttgatagccggaatttttatattatccctgtcaatgataataaccccgaaaaaactcaacatacctgcaagcagtacggcttacggtaagagctacaaatcccttgtacctcacgttctgcttttgcttttcacctgcggtatttattatctcgtgtggatatatcgcaccaccgacagccttaacgcctgcaagaacaaggaataccgtactcctataaacaagctgttactgtgtatgtttgttccgttctattcgatatactggacatataaaagcgcacaccgtatagatatgctcggatatgaaaaaggcatacagggtgaaactgcaacgctgagtcttatattgtcgctgttcgttcctatattaccgcctatacttatgcagagcaagctgaatagcgtaataatggctgacagtgtttctcctgctgtggcaacagcaatgcaatatgcagctaaacctgttgataacggttataatggccttgaaaagctgaaagagctttacgataaaggtgtaatcaccgaagaagaatttacagagaagaaaaagcaggttctgggtatctgacggatagtattaaaaccgtatggcgaccaaacgctcatacggtttttgctgtatttatttgcataagaacgcaaaaactccccgccaacacggcggggagttcgcatttattatattaccctgtaacccttagcctaaaacaacctcaaccttgtgagtgccgttttcaaatacggggataacattgctgtcaacagccttgccgtcaactgtaacggacttaacgccgtggcaaacgtgatcggggttctttacagtaatctcgtaggttgcgcctctgaacagtcttgaagctgtgaagccgtcccactcgtgaggaattgagggatcaatcttcagaccgttgtattcgggcttgatacctaagatgtactgagataccgcaacgaagttccaagcggctgtacctgtgagccagctgttcttagcttcgccgtgacgcttagcgtccttacctgcaatcatctgagcatatacataaggctctgtgcggtgcagatcggaaatatcctctctgaatgcgggagcaatctttgaataatactcgaatgccttgtcacctctgcctacggcggcttcagcacagattatccaagcgttgttgtggcagaagatacctgcgttttccttgtaaccgccgggatatgtggagatttcgccgtactggatgtagtagtgtgtgaatgcagggttgttaagaacaagaccgtgctttgagttaagatacttgtctacgctgtcaagggtctgaatatcgtagcccttgtccttgccaagacctgcgagaacgcaccaaccctgaggctcgatgaatatcttgccctcttcgcactcgtgtgagccgaccttcttgccgtagtggtcgtaagcacggaggaaccattcgccgtcatagccgtattcaagggtgttctttctcatcttttcgatctcagcctgagccttttcagcttctgctatgtcacccttcatcttgcacatttcaacgtactcgggagcgattgcacagaacatacctgcaatcattacagattctgcaaccttgctgtagtaaggaggctccttgaacatttccttgttgttgtatgtctggaatgactcgccgggcttgtctgagaagcaggagaggttaaggcagtcgttccagtcggcacgtccgctgagaggaagtccgtgaggacctaccttcttaacaacgtggtagaacgctctcttcatatggtcgagcattgtgtctgcaagctcgtcacggttctcataaggaaccttctcgtcgaggatagaaacatcgcctgtttcctttatgtaagccgcaactgcgagaatcatccacagcgggtcatcgttgaagttggagccaagctcgtggttgcccatctttgtaaggggctgatactggtggtaagcaccgccgtcctcaagcattgtagcggcaaggtcgataagtctttctcttgctcttgcgggaatctggtgtacgaagccgagtaagtcctggttggaatcacggaagcccatacctctgccgataccgctctcaaagtaagatgcggaacgtgacatattgaatgtaaccatgcactgatactggttccagatgtttaccattctgttgagcttttcatcgggagaattaacgctgtactgaccgagcaggctgttccagtgttctttcagctctgcgaggagcttgtcagccttttcggctgtatcgcacatagccatcatagccttagccttagccttgtttacgatgttcttctttctgtcgccgcttgttataatcgtgctgttctcgtcaaggtcgggagcaaacttttcttcaaacttgttctcaacatagcccaggcagaatacaagatccttgctttcgccgggctggagcttgatttcgatatagtgagaagcaacgggtgaccagccgtcagcaacagacatattgggtgcgcctgcgaatactgtctgaggagcgtcaaagccgttgtataagccgaggaagctctctctgtcggtatcgtaaccgttgataggtgcatttacagaatagaatgcgtagtgatcgcgtctttccttatattcggtcttgtggtagataacagaaccgtcaatttcaacttcgcctgtgttgaagtttctctggaagtttgttgtatcgtcgtttgcatcccagaggcaccactcaaggaagctgaacagctttaagttcttttccttatcgctatcgtttttgattgtaaccttctggatctctccgttgaagttctggggaacgaagaatgtaactgtggctgtaacgccgtttgatgagccttttatgattgtgtagcccataccgtgacggcactcgtagctgtcaagtgttgtcttaacgggcgaccagccggggttccatacatgaccgccgtcgtttatgtagaagtaacgtccgcccatatcaatgggaacattgttatagcggtaacgtgtaattcttctaagtcttgcgtccttgtagaagcagtaaccgcctgctgtgttagagatcagcgagaaaaagccctgtgtgccgagatagtttatccacggataaggggtcttgggagatgtaatgacatactctctgttcttatcgtcaaaataaccgaatttcatagaatcctcctaatgtttttgttcctgtagcgaaaaaattacaacgttacagaaacgtctatgataattatatcttaaatgaatttttttagcaagggctgtaatcgttttaaaaataaaaatttttgtgaaaagtaaaaatccgcaatctgcacaaaaaaacgggctgtgttagtgcattgtgacgattagttgcactatattgatattttgttttggagttgctttacaatatggtgtaaaaatgatataataatttcaaatacaaattgtcgaaagagtacattttattaaaaatagtcaaaaattctctatccctatcccccttaccccctttccccggtgaaaggctgtgtatgctttgttggctctgcatcgtgcagagcctttgtgcatacacgcccggcatcagtgccgggggagaatacgggggctgacgcccctgcgacctgtcttggggctacgccccaaaccccactcaccgaaaattatataaactctttgatgatttgtattttggagtagtttttcatgatattaaactttgctccgattaacaatatgacgattttgacaacttagccaaaggacgtaatatgaaatacattgaataccgagaaaaacgtgagcatggcacaagggaatttccgtatgcctgctacagagtgacagagaattttccccgttataatatgataccgcattggcataacgagtgcgagattatctatgtcaggagcggatatttcgagctttttcttgacggtcatacacacaggatagatgcaggctgctgttcgctgataataggcggaagtatgcacggcggtacgccgaaggacaactgcagatatgactgtcttgtgtttgatatggcggctttgcttaaatcaagtcagatatgcacattgcatcttcagtcgataatcaaccacgaaagacggtttatcaccttcttttccgccgatagcgagcctgcaaaggatgcaaaggcggttatagacgcaatgcttgaaaaagaaccgggatatgaatttaccgtacccggacggcttttgtgtatgctcggtcacattgtggcaaggcaggagcattatcagagcggagaaacagcggcgagcgatataaagaaggtacgccgtttcaagaatgttataagctatatcgagcagaattaccgtaagaacataacgcttgaggaacttgcgaacgagtgcggaatgaacaggaattatttctgccgtgcgttcaaggaatatacgggcaagacacctgttgaatatctcaattatttccgtatcgaatctgcctgtgagcttattgcaagtaccgatgagaagctgatagatattgcgatgaagtgcggattcaacgattacagctattttataaaggtgttcaagagtatgaagggcgtaacaccgagagattattgcaggagaagcttctgatctatgatgtatatacttatagcgttgctttccgcattctttgcggctataacaacgatactgtgcaagtgcggactgcgtgacgctgactccgatgcggcaacggcactgcgtacaacgatagtgcttgtgctgtcgatagcggtcgtgtggataacgggggaatggcacgaccttcctaatgtaacgggaatgacgctgttgtttctgatactttcgggctgtgcgacgggcggctcgtggctgtgctatttcaaggctctgaaaacgggcgatgtgaacagggtcgcacctatcgacaaatcctcgaccgtactcgctatgctgatgtcgtttatttttctcggcgaacagctaacagcttataagatcatagcgatggtgcttatcggcatcggaacgctgatgatgagcatacataccggaaaaagagggtcaaaggcaggcaggtggatgatatttgcgtggatgtccgcaatattcgccgcactgacctcgattctcgcaaagataggcgtacagaatgtcaattcaaatctcggcactgccataagaacggctgttgttcttgtaatggcgtggatagttgttgcggcaaagggcaagaagaatgttttttcggggcttggcggtaaggcatttgtgtttattgcactaagcgccgtatctactgcggcatcgtggctgtgctactattatgcgctgaaaatcggcgacgcatcggtagttgtaccaatcgacaagctgagtatactggcagttgtgctgttctcaaggatattccttaaagaaaagctcacggcgatgtcttctgcggggcttgtgcttattgttgcaggtacggtgtttacgatactgtgattttaacaggatatacgagaaagcggaacgtgggtttcacgttccgctttttatataaaagtcttttgtttaatgtgcttctgttatatcgttgttatttgacaagcagaatcagaatttttgacacgcaaaatacaaaatcagaataattcttataaatattaaaatctctttgtttaatcagtttttctcaacataaacaataacgattgttgaaaaacggctgatttttcaaagagatttttgtttttcgttttttatatggagaaaattcactttaacagcttctattttattgatgtttaaacagtgttttttcggtcaggtctattttatttacggagataatggagcaatgtagtattatcatcgtaaagaaaatagcactgtatctatcagtagtttcttatcaacagttctttaaaactgcctgaagacaaattgttgttccttgaaactgaaacaatgtcgtaatccctatagagatctcgaataaacatatcatcgttataagaaagaagaaattttccttgaatttgcgaaagctttaatgcaagacgtttgtgatcattttccgtaaattcaatatcataatatttctccgttgtgtgatatggcggatcaagatagaaaaaagagtttcggcgatcatagactgtaatcaaatcctcgaaatccttcctttctattaaaacgttttttaaacggtctgaaataaccgataaataatcttttgaacgatatagtggctttttgctacaaccaaaagatttgccgtcagccccgaaggataggcgcatttttataaaatatcttgccgcccgttgtatatcggtaaaacctcgacagctcaactgttgggatacatcctgaaaaatttctcgactgttataaaagccgtctatttcacgttgaagctctgagcaatgatatttaatacaacgcattaaattaacaagctcgccatctgcatcattgtaaatctctaaatctgcttgcttttctttagaaaaaagcacccaaccgccaccgccaaagacttctatgtaacggttgaattgatctgaatttggaaacatatcgcatattttattacgcaaaagacgttttccgcctatgcgtggaatcggactatttatcatcataagcctcctataaaaaaataatggtggggcactttcgccccaccgatgtaatgttaaacttttttaagatctttaatattaaatgctgtatttattgcaagcactgtgctatccggagatttgttaagtactacacgtttaccgtttacgcttgaaacataaaaacgtttgaaataaacccagtcatcaacacttgaaccgtcataggttttgcttccgctctttattcgaacgatatctccgacatttatactcgaagaatcagaagctgtgttgctttcggaaacggcttttttcgatgaaagcataagatccttacaaaacatccatccggtatcctgtccatcaattccgatgcaggcttctgtaccatcttttgataatcgctgaataacaaattcagcggtataaacagccgaaataggctttataccatttgaaaaaaatgctcctgatttaaccttcaccttatctccggacttaaaacacgatgttttgttttcgcttttggtatctgtttttacagaatcgttagttttgccgccatgcttcttataccactttgaggtaagtgaaggataatctacaaagcagatgttgctgtcgacttttctgtcatcaacaatctctgttccccactgccatattttctgaccatagttaaacttgctcggaacatcaggattatttgtccagtgtgcaagccatatatctatgccagttaagcgatcgctgtcatagtaattctgcatccatgacggattggcatacacgccggacggtaaacctatcgctgtcatttcactgcagaatttcaaagccatgtcagtacgctgtgcagtcgtcagattatctatctgcacctgttcttcagcgtcaaaaaatatcggataagcaggctttaagccttttacagctttcttgcaagcggcaagttcttcttcaaaagccgtgtctgtagtggcttcaaaataccagaacagaccgaaaggtatatttcgtttctggcattctgagagattacgtttgaaatatgtatcttcatcagaacgtatgcccgcacgaagtataacaaatttagccccggatttctcaattttatcaaaatcgatattttcctgagcacgactgatatcaaatcctttaattctcatctgtgttaccctccttgttattactgtctgcaagaccctcgccgatagtataggcaagtactgcagctcccgacatcaaacaacccgatacggtagccgctgtttcgtccgatccgccaaaagcaattatcaaaccggttataaaaccggttaatgataaccaccatttacggcttgttaatttgcgtttccagtcaattttattcatagttttgtcctttccgcctattcggctaccttttccatgccctgctgtgcaaggattttttgtgcttctttgctgttgtcgggcactacaattgcaccttcgagtgtttcaccctcagtttctatgccgcccaatacaaaagtgtcatcttcaaatatctgcatataagctcctttcatctgctgtttgtgtatcgtatcataaatgataacgcagttgttcctgtcattgacatcgtaacagatccgttgtctaacgttacgctctctgatgagccgttgctgatagtcaacatcacacgttctatactcgccgtaggtgacagtgcaaacactttacgattacgcacaggatttagtgcattatcatagtatgcttcgatttcgactacgctgaacccctcgccgtatgttgtgtatgcgaaggttttcggattgtcttcagtgacgctgccatatacaacgacatctgtatcacatttccatgctgaccacgccccgtcattgcaccatcttgtataagtccgttttcgtgctacggaagtatagcgttgcatggtattaaaagcccctgtgttgatatttcggatattgtcgaccgacaattcaaacggttcattggcggatatcggacggttctcaatattctgcgcagatactgatgcgcaaaaataccgcttacttttacttttatctgatgattcgttcaatttgatatcatcaaggtttactgtctgtccggttatctctgtagctttgagataatccttgctgtcaagctcataaggtgtcaccgctccgatttcatcagccgtgtaagtgggcttactgtcggctttcgcccagtccgatatgtcaccggttttcagatattccgacaggtcaatatcgtaaaggttgacatataacagctctgaccacggagtatttccgtctcctattttgataccatgctgaccgctttcaaagtcggttatacacatatatccttttgggggtacaaatgaagaatgaagagtccactcagccggtgaacgcatatcctgaagtaactgggcttcaagtatttccgcctccgatgaatttggctcagctacagactgaatctgctttatcgaaaaataatctctgcctacgcaataataagcactgattttcgatgaccatttatatgcagaattgtcactgctgtcaatatagagaacatctgtgtctcccagctcgggaaaatccgctgttccgttcgcttcaatcacttttgatactgtttgcgttacatctttcttttccaatggagatcgtgttaattgaactgccgaattatattcatcaactgatgaaaaagaaacatccaccgtttgagaagatccccatgtatactcttctggattaacagacacattgttgtgaaaattaattccaagtataactctggcacgtccgcatggaaacttagtagatggcggatagatttctttccactttaatgcttttgaaaagttaccgtgtcgtgctcgtacacttgtttcaattttttttactgtgtctccatcaacagtcgtgtattcggacatcaaatttatccaatattccgtgtactcggaatattgtatgactctcgttatatctaaataaaagctaaattttacaaacgactgtgcatatattttatctgatccgtaaattccgttaaaaacagtaaaatcaccacaaatagcccctaaaccatcattatatgttgctttgaaaccttgaacaataatatctgtatctccaccatctaagccatacgttattttatcgtctacgctgtatccgattatgctgtaatcgtatttcagatattcttttgtcctttcggaaattataacgggatcatttataatggtcgtgctgttgtattttcctgctcccgcattagatgtatgatccgctgcggcactatacctgtttgacgactgttcggtactttcggctgtcgatgtaatgtgttctgaaaagccgctgtctttgctgagtgagtaagatatagctgttatggtaacttttttagttgcaccgttactctttatggagattacgtcatcaggaagcaaccaccctctgccacgtcttgatatatcagcggcatagtaatgatagcctccgagcttattccaaacgtattccataatttctaccgttgcaaacggattaaccgcttcaagcactcccggcaaattctcgtcataagcagtaccgtttgcatcaatatagaatgctgtatcggtgccaattgtaaagcgtatgccttttacggtaaatccgctgtcctgagcgactgataagctttcacaatcaccttcttcgattgtttcaacactgtttgaagggcgtgtaaatatcagtttatcatttgcatcaaactgggcattacacccgttgcaggcggctataaagccgattatttcacggtatgtgtaatatttatttgtcggatttgttgcttcactgttaaaaaccggcttggtttttatttttgcaaagtcattcgattttgcacttattgtaaaatcgtttatttttccgatgtacgaaagcagatcttgatgcgtcgcaggaaatgataaggtgtcaaccgtatcatcggcactgccgttgaagctacacggcttatcaaggaaatagaatctgtcatacgcttcgatatttacatatcctttttcctgagataaatccgttatataaaagattccgatttgtgtcaattcggtaaagccaatgaaaacggtcactttatacgcatccattgtcggtaggaggtcggcacgtatagttgctgtcagccgagccgctgatgtgcctccgacacttataccgccatcagacgtggaacgagaaatatctaaagatactatatcttctattccgtaatctacagatccgattgaaatttttgcatttatatttcgtaccggcttagtagcgttggttttaaagcttgatgatacagaaatcatatctcttctacctccactgacacatctttatagcactcgccgagtgttgcatcggtataagcgtatggagcagaaatgtcaccttttacatgaacagtatacgaatctgcatttacaaaaagcgtaaaactaccgcttttaaatatggtaaaaattgatttccattttgttgccggtataataccaaaagcgacagaaccggagatcttaaaatctccgaatctgtccgtataagccgttccgttcaagctgtatgaagtactctcgccacggcatgaatgacgtaagtcgcaatttgtgacgtactcggaaatgtctgtattattgattttcactgtcatacctatgcctcctataatggtgatttaccggtttgcttctgaattttctttatccccttgacggtagcttttgcaagtgtgtaatcatttgttttcagcgtgacatcaagcgtatactgcatcttttcctgtgcagttttcaactttttaagttctgataccacatcgttaagcgtagcatctgatttttctgccgaagccgatacctttgatgccgacgataagccactgattatcttacctgatttgctgttaccgactttgcttgcacctatgcctgcggcgagctttgcgtttgcggtatcaacattatcccaaactgtcggtatgtaagacgtaatattgatattttgcataccgctgcttgaactgctcgaactagttttctttgatgatgagcttaaagagcttttagactttgtgcttgaagaactttttttcttagtgcttgacgagcttgacgtttccttttcttccttttcttccggtacataaacataatttgatgctttatatgtagacggagtataggtgtatgtcggagctttgtatgttgttttccctgcactgctatacgaataacttgtgcctgcaccggtatatcctaaagccgcttttcctttacgctcctcttcttcggcaatgttttggctataaacggaagaatggtcttcatcgtctgaataaccctgtgaatatagcccgttattatttctgacgttgttataccactctttaaccttatcctcattgacataatcctttaattgtgaattgaaatattctttcttttccgctgtatcaaggaatttattttttgcatttgataatgcctcgtcagctgatttaccgcttcgtaattcctgaactatgaatttattcatatcaccatgcaaatcggtatatttcgtgctcagctcattcgctctgatttcttcctgatgcgtagcagcatacatttcttcgccgattttctgacaagcctctttaactttgttataccaatttgtgagattagtaccgaatattgaatctatggtgcttagaacaccatcaaacagatttacaagaccgtttccgaaagattcaaagccgcccataatatcaccggataagaaatttgtaacgccggaaaaaacatctgcaagtgaattaacaagccccgcaacaatatcaagagccggaccgagtatctgtagtagcacatccgcaagcgatgatattacaggcataatcggcgataatgccccatcaataagatcgataacagctgatagcaacttcccgactgctgagataacagtaccgagcggttcggcaagctcagccacaagttccagaatcggagtaagcagttcgattacgacatcaagtatcggcagtaaagcctctattacttccattagaggtggaagaagcgtatccacgatcttgattatcggcggtaacagcttatcaaagagcttaatcaatgtaggaacaagcttctgaattatacgagtgacactttccattatcggcttaagcaattccataaactgaggaagtatccctgtgatcagctcgatgagcggcggaataagatccgaaacgctgtcaagtatcggcttaacctgctcaattatctgtggcaaaagctccgaaataatcggttcgataagctcaataatatccttaagtacaggaataatctgttcgccgagcggaatcagaagcagttcaattgtacgggaaagtccgttgcacatatcggataagctgttgtgtttaacgccttccatctcgcccagtttgtcccgggttttatcgatgctatcgccaatttgagccatagcaagaactgcatcttcaccgagatcttcccactttgtgccgtaaagcgcaacaccggcggcattgcggtctacatcactttcgcaggcggcgagcttttcgttaacaagcttgaatgcctgatatgcacgatcgccacctgcggcaaattcttcgccgagctttgttgcatcaagaccgagtaaagccataccgtcagctgtagtctgactgccatcctttgctctgatagaaaactctttaaaagcatcattcagaaaatcaacttgaaacgcaccgttttttgcgccttctgccatcatagacatggcttcttcggcagtaaagcccatatcagcatagtaagtgctgtactcggcaagctgatcggctatgtcaccgttctgatttaagcccttttctgcaccctgagcaaggagattatacgcttcctcggctgtaatgccaaactgcttcattagagcatttgctccacggataccatcagaaacgtctatatcgtatgtatctgataaaagatatgtgctttcaataaccttttgaagctcatcgtctgtgacgtctttcatctgctgcttgataagagcgagcgtgttggatatatcatcaaagctttcgccataattatcaccgtaaactttcttgatgatgtcaccgtatttttcggcttcttccgccgtaagactgagtgatgcggttagctgcttatttgctttatcaagatcgtttgctgcggatatagcttttcctgttgccgctacagctaccgtgcctgctgcagcaagtccggcaccaacagcaacgccgatgccttttccgacgcctttaagacctgtgccgatttttgagcctatgccggaagtcttcttttcgacttctgaagaaagcgtatcggtactgttgataatttcttgcgtatcctttttataattatcaactactttgtcgccttctttttttgcagtctgcgttacagcttccttgtttttcttttcggtctgcactactttgtcagactgcttctttgctgtgtctgttatattcttctgcgtcttggaattgtcgttctctatttcatcgtttgcttttttcacagcctgcgaaatgttttcctgcgccttttcaacgacttcttcctgtttttttgcgcctttttgagccgcttcggaaaccttttttccggcttccgccatatcagcgtctattttacttaagtccgcacggacttcaaattctactcttccgtcgctttccggcataatctcacctctcttctgcctgtttttcgagaataccccataaccgttcccaaccgtcctgagccgattgtttgtttacgggatttttaatcgcatactgtgctttaagttttaacagtgccgatatctgctcctgatttcttccgttcggagcaggaacaggacgtattcgtatatcgataatgtcgctcaaacgtgtatcggacggcagtgctccgagcagtgcaacaaactcccaccattgcagcttaccctgttcctggaacaaatcaatgccatatgcttgtctgaatgccgcatagataaacggtgcgtcttgctcaaagcttatcgtttctgcttccgtgtcagaggtatttttatcaaaattgataagtttatcgaaaatttcattaaccacatcggctcttaccgaaagatttttgactttcggggcaattacaaaccaatcgaagataacatcaaatgaatcgatgccttccagctcatcactgctcagcagttcaaatgccgataaaacacggtcaaaactcaaatttaatgtataacaaatgcccccgacttctatgctgcgggggcacggctgtgacaatgaaaatgtactcattagcggtacttatgtaacgctctgatctgtgccttacgattacgaagcgtttcatttattttcggtacaatgacagcattaataaacggtactacctgtatacccatttcaatgtaattgtcctcgaaaaattcaagcaacttttttgtaccgtcttcgccgaatatcagctcaaaaattgcaattaccgcatttccatacgcctcataagcgcattcaagatctgtttcaacaccgttttttcttatttctttaagacgtctttccgcatcaattacttccgtctgtttctttcggaaagctgtgcagacggcatctgcatctatgtctatatcaatgctgtcgatgacgtttccgtttttatcagacagctcaagagtttccgtgattttctgtgttcgtgtgattttatatgccattgttatcctcctgacaaaaattcagcagtgtgccgtttggcacactgactgttttttgatgtaatatcagacacccgaaacggtggctgttgttattgtgggtttgccgttaaaagcaattgtacagcttatggtattcggtgctgtagattcgcctccgcctataccggctgcggtaaccgtaacgggacaggtaagttccttgccattacgggttattttgatgtctgttactcgcttagagccgatctcatactgaatttcatcaagaaaagcgcagacaggatcgtcttttataaaatcacccgcaagcactaccgtgggtgctgcgccaacaaccgcagagcttgcaaagccgccgtctgcaagatatgtcgcactgtatacgacctcgtttattgcggttgttaccgacttaaatgcctttcgcatatccgaatatgtagccgcttctcctgtaggagtagtattgatttcaacctttatctcactgttcagctcggctttgccgacagtaggtattacctgttcatttgccatattagtacctcctaaaatgctatcctgacatcaacaatcatagaatatatccagaaatccccgacttttccgacagttgccgcatcagtagatacggttgcgctcatcagctgaacgcattcatcctgtggcagtttggttgctcttgatataagattgccaatattaaatagctgttccatagctacaccctgtatcttgttcttggataaaataagtagcggcaaggttctgtcctgccgctgtctgtcaagtgtagtaccgttatcctttgccgcttgcgcttcggcggaaagtcctccgccgaccggcaagcctgctgtttcgattgtatatccgagcttatcttctataaaattgagaataagctcgattgcttttttctgaggtgacattatttatcacttcctgttaaaagtttctgcagttgtcttcgccactgttcccctttaaccgattccgctttatgcgcccacattttgcaggcttttgggttttcatcatgtgaatatgatatagggttaccttttttagatacgccatagtacaatgttcttgcataaggtgtttcccaacgaagaaccatagcaatactatcgtttcttatttcaacttcactgcctttagcacgggcaagtgcttgtaactgttctgaagtcactttttttccgagcggtggtacccaatcggcagagattcctgtatggattatactgctatttatgagaacgctctgatcttgaggagcgtaatcgttgcaatccttaaggaaatttgacataagaagtttcatagcatcatgtgttttttccgtcattctcgccttgactgccgcactgttaatgtttattttcacattcataacgataaccctatctcataatggtgcggagcgtttgtgtcataccgctttatgcttgcaatcctgtattccattttttcaaaaatcacctttgcgcccggcacaaatttgaaatttgacggagaggaattacggcaatcgtaatacatgactgcgtcaacctttacccgattattctgcttatcgctggtataactctctgttggttctatacggacatatttcaatgtttccgtagacgtttcggagatttcgccccatctgtcggtcttttcggcaacaacagcggcagtgtgtatcaaaagactgcgtggtataggtttcatcataacgcatcaagacctttatacataagcccggtcgataaaagcaagccgtatgacacattgcacatgggtagttttccatccgatacgctactgtttccgcctgccgaatagctgaaactgccgagtgaaatattgctgaagctgccgtcatgcacgaatgaaagaccgccgtttgctgatatataatcaacctgccaacagatagcatctttaacagccgtctgaacctttttatccagactgtcgaactgagctattctgccgcaggtttcgttatatataataatgtatgcaacctcaaggagcttagacagctccttttcgtcaccgtcaaactcgccgcagaaaacgtctttgtagtagtcaggtgtaactatctgctgcatcggatacctccgccggcttctttgactgcttagactgctttttgtttgccgaagttgttttctgctcctgctgaactgtgttatccgccagatcttcggctgtaaatcctactcttgtcatagaaacctccttatgtcagcgccgttgtatcacggttaaggtagataccctttaccttgttttcgtatgtttcagcaatgctgtaagcacggtagaagaacatataaccgtcatctgtctggttctcttcgggagcaacgaccttgtttactgtgtgcttgccgaactggataacagaatcacggttgatgatcataaagtttatcttgtagccgcccgttgcgcctgcatatccgcctgcggtttcgttgcttgaggtgccatccttcatatcgatcgccgtatagaatcttgtctgcggaacagtgatgatcttttcaaaacggtcaaggatagccttgctctttgttgtgtcaacgtttttcgcaagcgtaagcagtgtaggcgtaataaagagtatctttccgtcaacgtttacttctgcctcgtcctgcgcattgacagcggtctggagagctgtcaggacagctgtaccggcggtgggagtagcttcggcggcggagagaacgcctgtggcacttgcatattttgcaaagcggaaagcgtccatttcgggaacgacttttgttcttatgaactcgcttgcaagcttgccgaacgcaataccagccgtttcttcgttgtccatagcgtcaacggagaacttacgacctctgtcatagttgcacgatttggtttcataggtgatcgtgacatcgcccttgacataaccgcttgaacgagagtaatctgcaagaccgtccatgctcatcttaggaataagaaactctcctgcttttgcgcccattctcaccgtatccgcatcagcatcaagaatagatgtggcggaagcctgctgatagactgtatcgagcttgtcgatatacgccttgaattttgtaattgaatttgccatagtgattttcctttccgggcttacttaatacccattatcttgttgattcttgcttcatcggctgttttctgttcatcgtttgcagttgcaacagctgacgtaactattgccttgggaggtttttctcccttgaagttgggatatttttcgatcacactgtcaatagccttgtcaagtgtaacatctccggcgacctttgactttgcgagcgcaagcacatcatcaatgcaatctgccgcaacgccgacagaaagtgcatgaaccttgcccttaagctcggctatctcctgcttgttttcctcctgagagttgtcgctttcgccgggggattctgcgccgcctgattttccgccgtcagcatttcctgtttctgaatttccggaaggttcggctttctgcttagcctgcggttcggactgcgtaacagcttccgtggcagtgccgtcctgtgtgctgctctgagcgggggcagctgcctgttctgcctgagctgtgttttcggcattttcagctgccgatgttgtgattttttcatccataatgattttcctttctgtaaaataggtaatataaaaacagcaccgtgaaagtgctgttttaatcatataatttgtcataagaaaaacaccctcgaaagtgtgcttaaacgttgtatttatctcttatggttttaattcgtttacgaaaagctatggttaaatccataagttcttttgctgatctgtcatctcgtccgtgaaaacctttatacttagattcgatattggaatattgtgactgatattctttttttagcttttctaattcttcataacaaccgtcagggtagttttgagcgtttatatgcgattccgagtttttcacaggctcttttaattctttcatgttgttcatctcctaacggtatgagttctggattatgaaatagaatatcatccacttcaagtcttgcttcttcataaagttgttcggctaaatcagcaggcgtcttatttttaataatcatcgtgtaaagatatttctcgtcacaagcatatgaaatgtatgaaccgtctcgaatactttcaacaaggtcttccttactaaaggaatactgactttgtcccttaacgtgattatggatattgatactaccatccatttcgtcaccaagaagtccggtattgacagtatattcatcaccgtaaacagtatacatttttcctcttttgtttattacacgacatttttcaataggactttgtgattcttctgtaataaatttctttaattcagaagaaacagctttaccatcattgatattaacttctccgtaattttcataataatgttcagatttgttaatagatttccctttaccgcttgaccttattatatcattaacagcagaattgtcaacatcaataagctttatctgctcttgttctgccttaaccgccgccttatagcttgctgttgtcttagccgcttgactgcgtccatatcccggagtagcggtgcggtcgggcttgtatgcaagcccgtttttctcacagtagcttttaagctgctgttcctgctgcttgagcttataagccgccttgtcaaaaccctctttatctccgagagtgtcaagagaggtacattcccgtttggaagctctgaccttgcgttcaagagcacgttggttgcagattttttcgtactgctcggcattttccttttcgtcatacggaaaatatgtttgaacgcttattccgggcaggaacggatagagctgatgaccacaatttataccgagaagccctgcaggcttgccgtatgagcttgaccgccaagcatagaatttaatacgtttgccgtcaaggtctgtagtataacctccgccgccgttgcgattgaatattttcccctgatctttcgcacacagtggtcttgcgccgctgtgactgctgacctcaatcaaatcaagcccatattcatccataagggaaaactgtgtttctttggcaacacttcctacagtggagcgtatacacatattagtgtatgcttccggcgtccagttccgaccgtttttatcgacaaatgccgggatacctttctgcgtcatttcgccgatacattcacgcatggcactctgacgtgcctctatgccggtaactaccttgcccgcagccttattaagactgtctatgtattcctgcttatttgcaagctcggcggtacggttgatcacctgcatagcggcgttctttgccttatacttcatcgttgtatttgtaaggttcaggtctttttttgcctgtttttgaagcattttaagactgtttaacatattgccggacattgacggcgtggctcgtctatcaataagcccctcttgcaccatacgttttaatcccggtgcaagctcctgaatagcggaatttgccgctctctgaagcgtaagctccagaagctcgggcgtttttcctgcatattcagctatcgtttttgcgttctgcttagtcagcttgccaagctcggcgagcttcttcattttccacttcgccgtatcctcttcaattctccctgcggcaagataggcggctatgtttgcaataaggtcagtttcaagcccgactattagatcggtcatgccttgcgacagctgtagggaagtcagcttattcatagctgtcaccgtccagtatgccgccgtctatgtcattttcctttgcaatacgctgcagttcttctgcggcttctgcttcatcaatattctgtgcttccataatagcacgaatttttgatttaagccctgcctgaacaagcttgatattgttatctatacgggtgttgtcatcaccgataatgttatcctgccaatttacagaaaccgtataatctttgctgacttcctccgaagcctgtgttatttctataatcgccgttgcaagactttcaagcacctcggatatgatattcttattattctgcacggtgcgaagtgtgtccttttcatcggcggcaacttctgtcgccgtttttacgccggaattactgtcaaatgacagcgttcccggagaaaatccgagctgagtgctgagtatattcagctgaagcttcaaagcttcaacgtgttcgattactctgagggactgggtattgtcggatatattcagcttcggcgcatcatcggcgttgaatgcctgatatacttcgtcatcggtgtcaaagtattttacttcgttgccgtcgctgtcataggtcgacttaacacattccgaaggaataatgatacgctttttgccaaggataaactcccgctccaagctgtcaaagatcacatctatctcacgcagcgtatcgatcgaattagcaaaaacaggcaagccgagcggcaagtcgaaaaccatattgtttccgactgcaggtttaaaatagcagaataacggcttttgaacgcctttgaacaccatttcatagtcaagttccgggaacagctccgaaacgggaacttcctgaccgagataactgcgtgaatcgcttcgccgcaggacgtggtaaatgtgaactccatcagactgcaatgtatgatactcgaacagcttgtagtagaaaccgttctgaacatagtcgttgcagaaaataccttctgtgatctgacggttattccattttgtcggaaagaaacgatcggcatttatgtaattcagacgtatcacattatcttcaagatacacctttattactcctccgccgagtgcgtatgaccgggaaagaaattcgggaaaacgctcccagaaacagttattttcaagaacctcacttaccgtatcgttgtacttttcgtcatcaacagatatatcgcactgttctgaaaaagtcatcgtggcgagcttgtcgcagataacctttgccatattcgtcatagctctgggacggcttttcttttttattccgctgtttgtaacagttctccacggcggtttgccctgatagatacgttttgcaggctcgatgtgccgtgtgtaatagtcggatatatcgactattggcacatttgggaacgcctgctttatataagtatatatagacatcacgttttcctttccgcatcgaagacattagtcatataggcttcggtgctgtattcttgtgcgtcaaggctatcaatatttatgcttccgtcatcaagacgtatttcggtcgtcacattcggcttccagatagcggtctggaacgcttcaatcgtatgcttgcagtgcgacatgattttatatctgtcagccgcaatcagacgattatagaacaatatacgattgttgattgaacctttccgtgcattgtggatattcacacggagctttctcctctgagcggcgagacgtacacctttaatcagtatttgctccgctgaatcaagatatatttcagtgcatttccatcgccggcatacaccttcaatgaaattacagaaatcattttcaagttcatacggtgatattgtttccttgcggtagtattcgtcaagcgttacgaccgactgaaagcctttagtgaatccggtagcgttaagggtatgagccgaaccgtttccgccgaagtctcctcctatggtaacaaacataagatcttcgggaagtgtatctacaatatatcttgatgggttgtcggcaaacagtgggtaaataacaccttccgccgctacccagttgccacaaatgaagcgttcaaaataaacacccgtgtattccttttttatctccctgacgtattcttcgggaagcgttgtgttatcatcgatcagaaatcgtaatacaagcatatcgaccttggcattgtctatatattccttttttagccagtgcgtcggaacatccgggtttgttgtagcaatcagctttgcgcccttgaccgacaaacgtgacaggagcatcgaaaaaaagtccttagggaatagcgtcagctcatcgcagtacgctccgccgagcgtcatgcctcgtatcttattctcggactttgcatcatttgctccctcaagcagtatttttcttccgaacaatctgccttctttggtagacaaagaatacttaaaattatcttcaccgacaagctcctgcagtagcatcaaacagttacgttttaatgtttgcaacgtttttgccgacatcagataggcgtaatcggtagggcggtttgctatccagaatgcccaaagaataagcgatatccatgtcttgccgctacggacggagccttcaagcagattaagtcggtgtagtttgttgtgctttagcaaactcatcagctcctgctgtttagctgtaaatatcaattcatttgacattcttcatagcctccagtatagcgtcaagcttgcctgcgccgtcttccgatatagcaaccggagctttgctgtaagtatcgcaggctttgttcgtcagaaagaactctaccgccgattgattcggaggaatatcacgagtaattatttcaacagtttttcttccgccgacaatacgctctctgcgttccgtaacggtataaccggtagcggcacggatcagtgcctgttcaacatctgcccgaacaagctcagggttgtcggctatcagctgtctgactccttcagaacggtcgataatctgttgtattgccttttgccgcttgctttcggatgtattcagatagcattcgaccagactttgaacggcattcactcgctgttcggtatcagcttttttgtatttgtcgagatcggttgcaaggctgtttatagcccttttgcgattgctttttctcacagtttgctcactcctttcgggcaaaaagaaaaagagccttataaaagcccttattctgcatttgattatgttgacgtgaaattatcccactttgttttttgaaacgttttaaacggcaattaaaacgcttttatcggtaaatatcccgttgggattatatcgggatatgcttcgccattccgattttgaaaaatcagattactttgcgtatgtatacagccgttccggtgcggagcgtatcgacgaacaccttagttactgcacttgtctatatcgaccgcacaggttatcctgtgtggctcaccgtaaagagtgatctctataacggctttatgctgtcttcgggagaatttcacgattttgtgctcatagcgtttgagatagccgctgtctatctttagtacgccattttctatgtgtcctttgctgaccttgagtatatcgggattgcgacataacccgatgatatattcttcttcagtgcaggacaggcacgttgttttgctgacaaaattgccgacaccgtgtattttgcgaatgatataataatcatcggctgtcaggcggtcggtctgaaagaatatgtaaccgtcaaaaagcggtttgatttcttcgtgccataccccctttttgcgatacttgtacaactctctcggcacatacgctgtataaccgagttcacgcatcaagtacataacagccgtttcagagcctgactgtacatatattacatatatcattcgccgtcaccctctttctgcttacccctgatatatgcggcaagctgtgagtacagctgaggattatccttagccatagcggcgaagatgtcttccttgaaaacatcataagccgcatccattgatgagcggttcttagcgtctgtgtcccgtttatatgttgccgcttttatcagcgatggcactgcagcaatcagcttttcgggcggaacatcttttaggctgtcatcgcttaaattctggattgcttccattactttatggtttgttaatcgggcaagagcctcggaaacatcaagatccggatatttggcaagctcctcgtttataaggcggaagttattgctaatgagcattacctgctccaaagaagcattcagagcctgtgcataacgtgctaccgaagatttcgatacctcataaccgttttcacggatgaaatctacaatgtcactgtagcgatattctgacgggttatttatcatcatatcaacggtttccctgatgtcgcacggcagcttgtcgactttacctcttttacgattacgttttttcatagtatcgcctccttacagatctatgcaaggatcttcgatagcaccgttaacaagctgaatgcccttagcggtcagcttacctgcaagctgtgtataatcgtcgccgatgcactctacagcctgttcggaacgtatcttcacgagccgtatatatccaccttcaagcagataattaagactgtcaagtgcttcgttttcagcaatctgaggctcaagggcagcagttacatctacgagattgacgtaatcggtacggagcagattgattgctctgatcacagccccattgttttttataaacttgtttttcctgagctgatcttttatattcatcaattgcccctcctgtccttatcggcaagattatctatctttgtttccagacgtgtcataacacggataaactcggaatttttgactgccgtatccttaagttcgtcaattgcactgtcgatcttgtctatagtgtgcttgatttcttcgacttctgcctttgtggcatatctgtcgttcaggcttttgatatcactcttacattcctttatcatatcaatatggctttcgagttcagatctggtaacgcatttgtcctgtctgtctattgtacgtttgacgaaatacgatataatgccgattgcagctgtgattattatgttaatagctgttgacggcgtttccatcgaggaaaacggcaagacctataccgtagaaaacaaagcaggcgttggctttatcaatgacgcacagaaaggctctctcaaaatcgtaaagacttcctctgacggtaaagttgagggcttctctttccgtgtgacaagtgctgacggctacgaccagacctttaagaccgacaaaaacggagaaatctttattgagggcttgcgtatcggtgaatacaccgtgtccgaagtcagcgactcggcttccgcaggatatatccttcctgccgacaaacaggcaaccgtcaaaacagactctactactattgttgaaatgcacaacgagttcagggatacgccaaaaacaggcgatgactttaatctgggcttgtgggtaagccttgcggctgcttccgttatcggtgcaggtgttctcggctttgtcggcttcaagaaaaagaaaaaggaggactgatttatggacgctaaaaccattatcgccattgtgcttgtagtgtttatcgtcggtgcggcaatatggcttaatatccgaaacagaaagaagaaataacccgatatgacaggaaaagggcggcttatgttgataagccgcccttttccatatatggaggcaatctatgaaaaatctgaaaaccattgaagctaaggtaaaggctattctgcaaaagaacgaggacgcaagaaacgatgatatgaccctctatctgattgtgtgcaacacctatttgaaaggtgcaggagcaatgccctttgcggaagtaatggaacagtataaatatcttggtctgccgagctttgaaagcgtgggaagaacacgccgcaagctgcaagcaaaatatccagagcttgcgggaaacgcccgtgtaagacggcttcgtgccgagggcgaaaaggcataccgcaaatacgctaaggaatgaggtgtgaaatggacgaaaaacgcataaatggcggttatgagattattgagagctgtactatcgggaacaacgagcttgtcatcggtcataactccaaagcccccaacccgtatgtgtgctggtactgcaaggacggctcggattatttctggggatattactgcaatcagctatctgaagcaagagaaaagctgaatgaacgctaccagagagagtgccgtatgccctataaccagcccgataaaaaacagaaaagccgtgatgaccgtgagcgataaacgaaaatatgactgcacgacctgtccttatccccgatataaggacgggtctgttattttctgtgatgtctgtatccgcaggattttagacgagcagaaagaggaaaagaaacgaaaggagcaatcgaatgagtgaagaaaaacgaatgctcggcaattatgaggtcgtgaacagcatttatattggcgacaaagaggttgttttcggtgtagataaaagcgataaataccctttccttgtaagctactgcgactaccataatccgtttggtgtgccgtgggcgacagaaagcgttggttgtgacgattatctggaagctatggggattttcattcagcgagtacagtcccagatagaacaaaccaaatccgaattatccaaattcgcttttgacaataccgtgttcacgaaagaccattgtattcccgacaaacgcagcagcagtattgtcggcaaggttgtcgttatcaatgcagagccgaaacggtatgaatatcagcaccctgcttttcagctcgttttggcggacggcggcaatggagcaacaggcggcagaggtaacgctgtctttggtacttgccttgccacaggcgaaaaatccagatgggaacggtacgatgtgttaggagaaatcaagcccgaatgtatgcctgattgggcaaaggaagctcttgcaaaaatcaaggagcagcagaaagagaaaaaacagaaaaatcgggaggaacgctgatatggagatacgagccttaacccctgccgaacagaaatacacctacgctcaaagtatgcagcttgagggacagacaagtaatatcggacacttgcgtggagattttgcatcttctggatatggcttttacactacttggtttgatacaagaccgcaatggaaaacggacgagtttaagaaagagcttgacgaggttatcaattcgcttcgtgaggacaagggacttttgcacaaccgctatgatatgagtgcgtttgcaaagcattatcccgaaagcgcatttgcaggaagctattgcaccgagtacggtttccgtgtggatacggaaaaacacgcctttctgtttcggtgcaatccgactaagggcgattacaatttttactgctattgctttgtgaaagaatggcttgataagcatatccaaaaagctgaacagggtatccgatttatcgacccaaattacaaagagctgtttcgtatcccagacggcggcaaaatcatcatcacatcatcgtggggagaaaaaaccgaacgcccctgccgttttattgacgagtatcataccgagattggaaataacattttccatatctgcgagtttgccgagcgtatggaacaaaacggagcgacctatgagccaaagcccacagagccgcagacggtaacaaaagccccaaagcataaagatttagaacgataggaggttttgaaaatggcactcaaccaaaaggcaatcaaggtgcttggtaaggtctttgaagcaggctttactgatgaaaagtcgattgccgctatgacaatggacgatattcttgcgatacagggtatcaccatagccgacattggtattatcaatgagctgcaaaagagtatcaaggcaaataaggtcatttccttttttagcggtgaaatgaaagaatgactatgacaatcagcgataaggaggtgtgcaaagaatggctgcgaagtatcagctaattacagagctgtatcggcgcacaggcgtggcggttgctaaaaatccgcaggtgtggcagagttttttgtctgccgcttgccgtaactataaatgccgatttgatgaacagctcttgatttacgctcaacgccctgacgctgttgcggtagcacagcttgaaacttggaacaagcagtttaagcgttgggtaaacaaagacagcaaaggcattgcggtgttcgacccaaaaggtcgcaggaacacgctgaaatactattttgatatatccgatacgcacgagggttattacggcagccgccctgttccgatatggcagatgagtgagcgatacgagcaggcagttattgaacggctttccgacagatttggcgatgtggaaagcaccgaccttgcttcggtgctgatggaaacggcaaaaaacgcagttgaggataatttgcaggattatatgccgcagctcaaatcctgtacgcaggatagtttgttagagggtcttgacgaatataatatcgaggtcatttaccgacagcttgcggtcaacagcgtagcatatatgctgatgagccgttgcggtgttgataccgaagcggtatttgagcgtgaggattttgcggaaatcattaactttaatactcccgccactatcaacgctctcggtgttgctacaagcgacatttctgaaatggcactcagggaaatctctcagactatccgagatgtgcaaattgcggagaaaagtcaaaatcgcacctttgcgccgcaatctcaaacacgctatgatgtaggcagagaacaagccgaaaggagtaatcataatgagcgaaatcacatacaccaaacaaggggactatcttattcccgacctgacattaccgacagagccagaaattcagcttggcagatacgctttgatgcacagggattatctggagcagcacaaacgagtgacctacctcaatctgctgacatcgggcgagctgaacaaacatctttacgaagtggaacagacggctcttacgaggttggagcttctgacaaaacagctttgcaaggagcagggcgtgacggaggaactgaaagaaaaagcaccgatgcaatgggtcgggctgatgaacaatatccgcagtcaagcggaggaaacgatactgaacgagctgatttacagctaaatgtcgctgatgaacagcaggtcacagttaatctccccaccgtagaagaacagattgaaatgttagctgaagcagaggacgaaaaatcctctgcttttgttatttctcaggaagatattgactctgttctcctaagaggaagcggctttcagaatggtaaataccgtatctaccgtcagtttcaaaagaatgaggacggcaaaagcaatattgattttctcaaaaaagagtacggcacaggcggcggcacgcattatttcccagacggtacgcagggacacacttggcacgatgggaaaggcattgcgattgaaaagtacggctcgtctgcaaaccccgaccttgttctttcttgggcaaaggtcgaaaaacggctgcgtgagctgataaagaatgaccgctacctgaatgaaaaggaaaaagaccactacgccgattatctcgaaagtgaggaagctccgcagtacgaaatcgacacgcaaaggaaaatggcaaggcagcgtttcatcgacgcaaaccgtgaccttccccctgccgataagagagatacccttgctttgcggctgtccgattttatccgtgatttagaccattatgagaaagacctgcttgaaaatgtggagcgtaccgaccttgcagatgtaaccgccgaacaaatggaacatcatttaggcgacccttctactgttcagcagctcattgattttcttgctttggtacagggaaagaccgccgatgtttacagccgtagcaatgcgtggcggttttcacaggagcttatggagctgtatcctctccgctatgtctatcacgaggacgatgttgtatatatcggggcagacaaatatgagattgcggcgtttgatgaaaacgctgtttccctgcgtaatcctgactttccattgttcggcaaggaactcagccgagctgattttgaggaaaagttaaaggaaaaccctgctaacgaccatttgaaagtagtcgttaccgaaaagcagagtgttcagacaccgtccgaagaaaagccagacggcataaagttctctatcggattttcggaacaccccgccttttatgacaggcagtttaatgaccgacataccgatttgagctttgctctgggtaactatcttcttggcgttctggacgaaaagcagcatagagagcgtgaaagcaaagataatgtcggttggtatcataagaccgattttgagattaccgctactatcggcggcgaagatttccattatgaaggacggtttgatattggcgacggcgagggcgaccttatctcccatatcaaaaacttttacgaatactctctgtcctcgaattgcccgtttattcccgaatggaagaaacagggcgaggattattaccgtgaacaaatagaaagcctgcaatggggacgagatgtgtttgtaccttatctggagcagcataaaacgctcaccccagaggacgaaaagctctatgcggagattatggcaacggaaagcgattggtttgtccctgttgaggataaacagcaggcttctgatttgcagccgcagattgtcgcttattataaatccgatgacgaaaatattgtcattgtgcaggcttccaacggaaaatattttaatcactacggctacgatgaggacagcaacaactttgcttctgcggcaggcggctttgatacctttgaagaagccgagcaaaccttatacgctcaccgcccgacagccatagatataacagaggaaaagcaaactccgcattataccgtagaactgacttccgatgcctttgccgacccgttcatcatacgggataacaccgtaccatacggagaggacgggcaatattacgatgtggacggtatttaccagacctttgaaaccgaggaagaagcacaggaatatgccgacaccttgaatagtgccgaaaatatcgtcaagctgttcgcccagaaagatgaggaacgaagccagcaggaacagcccgatatacaggataactctgacctcatcggtaaggaaatccttattgataaccgccgctatgtcattgaaagtatcagcgaaataagcggcgatgtgtcaatgcgggatatgacctttgcaaatgccgtgggctttcccataaaccgtgttgagaaaatcggctatatccgcagtctgctcagtaaggcacaggaagaaaaacaacccgaaaaggctgtatctcctgtccctgctccctcagagccacggcacaattaccgcattactgaggatactttgggtgtcggcggcgcaaaagaaaagttccgtaataatatggcggctatcaatctcttgcacgagttggagcttgaaaaccgacttgccacacccgaagaacaggaaatcctttcaaagtatgtcggttggggcggtctgtctatggcgtttgatgaaaacaatgcggcgtgggctgatgagttcaaagagctgtatgcaagtctttccccagaagaataccgtgcggcaatggagtccaccctgacagcgttttatacgccgcctgttgtaatcaaaggtatgtatgaagctcttgagcgtttgggattttccgagggcagtattttagagccgtcctgcggaacgggcaatttcttcggactgctccccgatacgatggcaggctcaaagctccacggtgtagaaatcgaccctcttacgggaaaaatcgcaaagcagctctatcagaaagccaatattgccgtgcagggttttgaagaaacaaagctcccagacgaccactttgatgtggttatcggcaatgtgccgtttggcgattttaaggtcaacgacagccgttacaacgcccagaagttccttattcacgattactttttcgcaaaggctcttgataaagttcgtgcgggcggtgtcgttgcgttcattacctctaagggaacaatggataaggcaagccccgaaatacgcaagtatattgctcagagagccgagctgctcggagctatccgactgcctgataacactttccgagcaaacgcaggcacagaggttacgagcgacattctatttttgcagaagcgtgaccgagtgattgacacagagccagattgggtacaccttgataccgatgagaacggtattacgatgaacagctattttgtgcagcacccagagatgattttaggcgagatgaaaatggaaagcacacgctttggttttgactccgcctgcaaagcctatcaagatatacctttgtcggagctgcttcataacgctgttcagaacattcagggagaaatcccagagtacgaaaacgagcttgatgaaatctctgacgggcaggacgcttctattcccgccgacccgaatgtgcgaaacttctcgtatgcgttggtggacggcaaggtttatttcagagaagatgaccgtatgacccctgcggcggcgtctgttaccgcagaaaaccgtatcaagggactaatccaaatccgtgattgcgtgagaaagctcatagagtatcagaccgaggattacccagatgatttgatacacaccgaacaggaaaatctaaaccgtttgtatgacagctttacgaagcagtacggactaatcaacaaccgaggaaactatctcgcttttgcatcggacgagagttacttccttttgtgttctctggaggtacttgacgatgagggtaatttcaaaagaaaagcggatatgttcacgaaaaggacgataaagccccaccgtgaaatcacttccgttgaaactgcaagcgaagctcttgccttgtctatcggtgaaaaagcccgtgttgacctgcactatatggaacagcttacaggcaaaccgaaagaagaaatcattaaggacttgcagggcgttatcttccgtatccccgcaaccgagcctgctcagtatgtaactgccgatgagtatttgtctggcaatgtaagagccaaactcataaccgccgaagccgcagcaaaggaaaatccagagtttgcggtcaacgcacaagccttaaagcaggtcataccgcaagacctgtcggcggctgaaatctctgtccgtctgggtacgacttggataccgcaggaggatattcaaaggtttgtaatggagcttttaactccgtcaagctatgcacaaagccgtatcagggtaagatataccccgattaacggcgattggtttattgagaataagagttccgattacggaaatgtaaaggcggacagcacctacggtacaaagagggcttccgcctatcgtattattgaggatactctaaatctccgtgatacccgtatttttgattatgtgtatgacgagaacggaaacaaaaaagccgtattcaacgcaaaggaaaccacggcggcgcaggcaaagcaggaagtcatcaagcaggcgtttcaggattggatatggaaagacccagaacggagaaaccgccttgtcaggtattataatgacacttttaattccgtccgccctcgtgagtacgatggaagtcatattactttcggcggcatcagcccagaaatcaccctaagaccgcaccaagtaaacgctatcgctcatattctctatggcggcaatacgctccttgcccacaaggtaggtgcgggaaaaacctttgaaatggtagccgccgcacaggaaagcaagcggctcggactttgcaataaagcgatgttcgttgttccaaatcatcttgtcggtcaatgggcttctgagtatctgcgtctgtatccgagtgctaatatccttgtgacacgaaagcaggattttgaaacgggaaaccgcaaaaagttctgttcccgtattgcaacaggcgactacgatgcggttattataggacattcgcagtttgaaaaaatcccgatgagcattgaacggcaacgggaacagctcgaacggcagcttgatgacattgagcgtgggattgacgatgtacaggcaagcaaaggagaacagttcacggtcaagcagcttatgaaaacccgaaaagggataaaagcaaagctcgacaagctcaacgataccaagcgcaaggacacggtaatcgactttgaacagctcggcattgacaggctctttattgatgagagccatttttacaagaacttgtatctctacacgaaaatgcggaatgtcggtggcattgcccagaccgaagctcaaaaatcaagcgacctgtttatgaaatgccgttatctggacgaaatcacaggcaaccgagggacaatatttgcaacgggtacgcctatcagcaattcaatggtagagctgtattctgttcaacggtatttgcagtatgataccttactgcggaacggcttgcagcattttgacagttgggcttctacctttggagaaaccgtaacggctctggagcttgccccagagggctatactttagtaagacgataaataatgcgttcctaaattgaaaataggatatcaaaatcggttttggaacttcaagaatttttttgattttcttgaaaaacagttccgctttgtacccctattttctcctattagtagagggagtaatacttttaatactaaacagattacataaggaaaggaggttaagagaatgtcaaggacttcaaagattacagcactttatgagcgtttatcaagagatgatgaccttaatggtgagtcaaattcaataaccaaccaaaaacaatacttggaagattacgcccgaagaaatggctttacgaatatccgccattttactgacgatggtttttcgggtgtgaatttcaatcgtccgagttttcaggagttgattaaggaagtagaagcaggaaatgtcgcaacgattattgttaaggatatgagccgattaggacgaaactatctgcaagtcggcttttatacggaagttctgttcccacagaaagatgtccgttttcttgcaataaacaacagcattgacagtaataatgcttctgataatgactttgccccatttttgaatataatgaacgaatggtacgccaaagacacaagcaataaaatcaaggctgtgtttgacgcccgtatgaaagacgggaagcgttgcagtggttcaatcccttatggatataaccgattagcaaccgacaaacaaacgcttgtcgttgaccctgtggcttctgaggtagtaaagcgtatctttctgcttgccaacgagggaaaaagtccgagagcaatcgctgaattgcttaccgaagaaaaggttttaattccggcggcacacgcaagggaatatcaccccgaacagtataatggaataaagtttacagacccgtatctttggggaatgtcaaccataagagggattttaagcagacaggaatatcttggtcataccgttttgcgtaagtcggtcagcacgaatttcaaactgcacaaaaggaagaataccgatgaagatgaacagtatgtattttataatacacacgagcctatcatctcgcaggaactttgggacagcgttcagaagcgaaagaaacgagcgaacaggacagcagccaaaggtacgcatagcaaccgtttaagcggttatctgtactgtgcggattgtggcagaagaatgaccctgcaaacgcattacagtaaaaaagaccgttcggtgcagtattcttaccgttgcggtgggtatgcaagcaaagtaaactcctgctctgcccattcaattagtgctgataatgttgaagccttgatattatcggctgtcaaacgattatcaagatttgttctgaatgatgaggaagcctttgcaaaggaacttcaagcgttgtggaatgaaaagcagacagaaaagccgaagcagaataaatcggaattgcaccgttttcaaaagcgatacgatgaactatccaaacttattcgtggtttgtatgaaaatcttgtttcgggattactgcccgaaagacagtataagcaactgatgaagcagtacgatgatgaacaggctgaactggaaacgaagattgaagcaatgcaacaggaactgaccgaagaaaaggcaaatacggtggatattaagcatttcatttctttgatacgcaagtgcaaagagccgacagaaatttccgatttgatgtttgccgaactcattgacaagattgtggtttatgaagcagagggtgtgggcaaagcaaggacacaaaaggtcgatatttatttcaactatgtcgggcaggtcgatattgcctatacggaagaagaacttgctgaaatcaaggcacaggaagaacagattgagatggaacgattggcaaaacagcgtgagcgtgaaaaagcctaccgagagaagcgtaaggcgaaaaaactcgctgaaaacggtggagaaatcatcaagacaaaggtatgtcctcattgccaaaaagagtttgtgcctacaagtaaccgacagattttctgttcaaaggattgttgctatcaggcaaggcaagaccaaaagaaagccgacagagaagcagaaaaaggaaatcattattatcgtcagcgtgtctgtgctatgtgtggcagtacctactggcctacacacagtcagcagaagttatgttccgaggaatgtcaaaagcaaaatcataacgagaaatctttggaattttaccacaagaagcaaaaggagaaatcagaatgcaaagatttattacagacgaaagaacgggtatccagtacgaactcatcggagattattactatccctgcttgacgatagaaaacgaagaaccgcctacgctcacgaaatacggaagaatgagggaaaaatatttaagagaacacaggaaagtcttatattgcaatctgcttacaagtggaaagttatatgaacaccttgttgaaattgatacttcggcgtgtaatatggcggagcatctgataaaggaaatggcaagaaaacagggtgtgacggaacaactgaaagcggaggatatgatgagatgggtcggattaatgaataatatccgagcctgtgcagatgagattgtattgaacgatattgtgtattcctaatagcataccagccgaaaaggaactgctgtcttaattgatggcagttttctttttcggcaagtattcaagaagtcataaagttgtgagtatagtcgaagtagtttgaagtattgaaaaaaatgatgacttttgttataatatttaatggaaggttatattttattaggaataacgaaatgaatttgtaggtgagagtatgaagaagaatagaaaatacaaaaagataaagataataatggtttttacaacagtcttgcttatggcgtttgtagcagtagttggattatataaaacagggatttatcgttttgatttttttaaggatgtgtataaaaaaatcgattttcaactgagtacaaatgagcttaacattcctcaggacgctctttcgttttctgtttatgatattgaacagggtgaatatttattttacgagggagatagccaattgcccacagtagcaagtttggcaaaactatttgtcattgactatgctttgacaaaagttaacttggaagatgttattgaagtaaatcaagaggtattggatcttgtgccggctgggtcatctttagcaaatctaaaagttgggaagtacacagtaaaagaaataatggaagctatgcttgttccttcgggaaacgatgctgcctattcgttggcatattatattgctaaaaatgaattaggagagggctatacagcaacggaatatataaattattttatgacagagctaagtgagtatttaattgaagaaggctattctaaaacaaatttgtataatgatccgagcggggcagctatgtcagccgatacacatttggatgatattaatcgtgtagccttgaagctttataattatgattttgttaaagaatgtgtagggaaaagcactttctcaattcaaactccacaaggtgaatttacttggaaaaataccaataagtttttagataaaaagtcaccgtactataatgaaaatgtaaaaggaataaaaacaggaactatggcatcttcctataatattgttgttctttataaaaaagatggcaaggaatatttgattacctgcttggcatcattatcagatgaaggaagatataaagcagtgcagtccgctataaatacaattattaaatgatgtcgaaatatcttttaattaaagcgttaaagtgtcgtggacaagataaagattagtttggtgaaacaacaatagttgaagtacgaaaaacatcgtagaaatacggtgttttttgttaccccaaaccctacaattttatacataaccacaggttagtacaaataccttgtgtgattttttgaaaggcttagaaaggcaattttgcccgattttcgccccgagaaatgacagaaacaaggcagtaagtatcttccctgtggttttttgttttcaggcggaaaggaggattgatatgccgagaatgagtaagaaacggaaacaagagtgggcattgtttctgaatgaaagaaatcgcattacctacaacgaactttgcagaaaatgcagtaatgactgtaagcagagtttccgctgtatcgtggtgctctgcccgaagtatttatcgaaaaggagaacgaagaacaatgatgaaaatggaaaatgagatgaatgtaaatgtaccgcttgaaattatcaaggcaagtgagattgaaccgaaagaagtgaaatggctgtggtatccgtatattccgttcggcaaggttacgctcttgcagggcgatcctggcgatgggaaaagcaagttaatgctttccatagccgccctgctctcaaagggagaacctctcccctttaccgaagaagaaacagagcctatgacagtcatctatcagacaacggaagatgatgcagacgatacggtagtcccccgttttaactctgccggtgggaacggagaaaatcttatcttcatcaaagaagatgaaaaatctttatcctttggagataaccgtattgctgaagcaatcgaaaggtatcacgcaaaacttttaattcttgacccgatgagttcctatatcggagagaactgttcaatgaacaatgccaacgaaacaagggcagagtttaatcacttgattgcagttgcaaaaaatacaggctgtgccatcgtgattatcgctcatatgaacaagatgagagataccaaccctctttatcgtaccaacggttctattgatattgcgggtgctgcaagaagtattcttgcaatcacacgcacaccgaacaaagaagcaccggcggcaagatatatggttcaagtgaaatccaaccttgccccgacaggctctgcaattctctttgaggttgcagaaaagggagtggactttatttctgaaatggaaatgacagcagaagaagcgttccagtcccttgcccctaaaatgggcagaccgaacgacaaggaaatcaaggcgaaagaatttcttttagaaatgctgaaagacggagaaatgctttcttcggattgcgaagaaagacttgaagccgcagggttcaagaaatcgaccatcaaaaaggcaaagaagaaagcaggcgttatctcacgaaaacgaggctttctgtggtactggtctttgccgatgggcgatataccgagagaataaaagcaggctgtctgatggcgggacagtctgtttttatgattgaggtatctaaaggaggtcaagggggaactcccttgcccacgacatctttgcagacgaagtctgaaagtgtcatagtgggttacacacattcaaagaatgttgtgtaatggcttcgccctgtctggaaaggagagcaaaatggcaaaaaacaataaggcggatatgagttgtgcaagggtaaaaaagtacaccgcttctgatgtgagtaaggcagaaagacacaacgaacgcaagaatgaaacctatgaaaatatgaatgtgattgtggaacgaataccctttaatgtgcatttcaaaaagccgacagccccgacctatatggaacagttaaagcagatggaaacagacggtcaggtgtcgcttcgtgggttaaggaaagacgcaacgctgtttaatgagattgtgattgatgtgaacacgatgtacttcgagcgtaacggcggttatgaatacgcaaagcagttttatgaagaagcctatcattttattgaagaaaaattcggtgcggacaatgttatatcggcggtaatgcacgctgatgaaatcaatgtagccgcaagcgaagaacttggaaaagaggtttaccactatcatcttcacgctatggttctgcctgtggtggagaaagaaatcttgtggagtaagcgttgcaaagacgagaaattgcgaggaacagttaaggaagtggttaatcagattagccattcaaagaaatggaaatcggatattccgatgaccgatgaaaaaggaaatccgttgctaagaaagaacgggaaaccgatgttccgagcttcgtacagcatactgcaagatgaattgtttcactatatgacggaacaagggttcaaaggctttcagcgtggcgaatacggaagtacagcagagcatttgacttccctgcaatatcaaatccaacaggacaaagagcgattggagaagttgcagaagcgtattcaaaaggaacaggttaagtatgagcctgcccgtcatatttccaaaaccttaaacgagattgacagtatgggacagaaaacattcacaggcaaaatggcaatttcccaaaaggactattctgagctgactgcccttgccaaagagggtatcacaagtcgtgcggaaatcaaaaaatttgagcagagtgcaaatttttaccgacagaagtatatggacagtgcaaacgcattggaacgaatgaaaaccaaatacaacgaactgaaagaaaagtgcagaccttttcttgaagcgttggaacatttccccgaagttgccaaactttttaccgaaaaagtgaagcaacttttttcttttaaggaagcacaggaacgagccgaaaaagaagcaagggaaaaagaaagacaggagcgtatcaaggcacgaaagagcaagcgaggtatggaaagataaccttttccattatactcacgacttaatgacttcttgatatgttccgatgaaacaggctgtatttgtggggtgttccaaacggaatgccccacaatcaatttatgaaaaggagaaaatgattatatgaaagagaatattttatcttatacaacacgaataggcaaaacaacttttattgtaaatgtgaagcaatcggaaagtgcgaagaagcctttgaatacggtgtttcaagagatatgcagacacgagatgttaggagatttttcagcggataaatatttgaatttagaaaacttacaaaaatcatcttgacaaactcgttcccgagggtacaaactaccgagccaagacacgctttgccaagttttttaatctgccagagctgatgttgatgttccgtgaggtggcggatatacagaccgccgatatgttaaaactccccgtgccgaaagtaaattaccacaatatcaagaccaagccgagcgagatacagaccgaaatggtagctgctcttgcaagccgagctgagaaagtcagggcaaggcttgtagagccgaatgttgataatatgctcaaaatcacgaatgacgggcgcaaccttgctctcgaccagagaatgattgacccgatgctgccagacgacccgaacagcaaagtcaacgcctgtatcgacaatgtgtaccgtatctgggagaaatacgccgacacaaaagctacgcagcttgtgttttgcgacctctccactccgaagaatgacggcacattcaacatctacgatgatgtgcgtgagaaattggttgcccgtggtatccctgccgagcagatacggtttatccacgaagcgacctcagacgcacagaaaaaagaactgttcgcaaaggtacgaagcggcgaagtccgtgtattgttaggctctaccccaaaaatgggcgcaggcacgaatgttcaggacaggctcatagccattcacaatttggactgtccgtggcgaccgagcgaccttgaacaacggcaagggcgtattgaaagacagggaaatatgttcccagaggttgaggtttaccgctatgtaactgagcagacctttgacgcttatctctatcagttggtagaaagcaaacagaaattcatatcccagataatgacgagcaaaagccctgtccgttctgccgaagatgtggacgaggttgctttgtcctttgcggaggtcaaaatgcttgccacaggtgacgagcgttttaaggaaaaaatggacttagacattcaggtttccaagctcaaagtgctgaaacaaagctatctatccgagcattacgaccttgaggacaggatactcaaacactttccccagaccattgcggagtatgaacagcgtattgtctgctacaaagctgacacagctcttaccgaacagcacaagccgcagggcgaggaaaagttctgtccgatgaccttgcgtggtatcagctacaccgaaaaagctgccgcaggcgaaatgctcattgcgatttgcaaggaatatcccttgtccgcacctatcgaaattggctcatatcgtggtttcaaaatagagattttctatgatacggtgggtactcattactgccttaacctctgcgggcaggcaaaatacaaggtagaattaggctctgaccctctgggaaacctgacccgaattgaaaacgagcttgccaagctccccgcacgattggaagccgcacagaccaaacgggcggaaactatcgcacagcttgaaaccgcaaaagtcgaggtacaaaagccatttgcctttgaggaagaactgaaagaaaagtcggaacggctgaacgctctcaacattgagctaaatctggataaaaaagaccctgccgtgcttgacgcagagccagaagaaactgaggaacagcccgaaagaaaatgtgcaaatcgtgagagataatcagatttccacatttgtgaagccctttttcgagatgtataatagggctgtgaaatgaaattcggaggtggttagatggcaaaggatttgagctttagcacatttcttgatgaatacgatactgactttttcgattatctcagcaaaacaagcacagcttgtcattccgaaacgaggtataaagagctgacggaaaagattaaaacactctatgaacaatatcctaatgtgcggaaagtccttgatgtagatagaccctgcgagctgtctgcggaagaatgtaccgctttgagtgaagtgctgaaatgcaaaaacgaaatagcaaacttagagctgaaagaggtttatttcaaaggctgtattgattgcgtcagctaccttaaaaagctaagtattctctaacccattgcggcattggcgtgaagctgatgccgcttttacatagccgagaggttttcttaacggaaaattcctcggctttttctattgtaaaggaggtgatttatttgaatgagaagtaacagaccctatgtgcagcttgaccctgccgtgattgagcaggcacggcaaatggacttgctatcctatctgcaacggtatgagccgaacaatctgaagcgtgtgacaggtaaagtttactgtacgagagaacacgacagcttgaagatttccaatggcaaatggtattggtggtcgagaggtttcggcggcgtttctgcccttgattatctaatcaaggttaaggaatacagctttgtggaagccgtagaactgcttacaggtatcacggcggactggaagccgccgcctgtccctgtttcaaaagatgagccgaaggaattgcttttaccgccgaaaaataaggactgcaaccgagtgaccgaataccttttcgggcgtgggattgacctttcaatcatacaggactgtattgtggacggtacgatttttgaaagctccaagtatcacaatgttgtatttatcggaaaggacgaaagcggaacacccaagtatgccgcctaccgtggcacgattggaagctcttttaagggcgacgcttctggcagcgataagcggtattcgttccgacttctggcagacaaaccgagtgataccgtgcatttatttgaagccgctattgatttactgtcctacgccacctatctaaagtgtgagggaaaagactataaatcggaaaatctgctctctctttcgggtgtgtatcagcctaagaaagagattaaggaaagcaaaatccccatagccctaaccacctttttggaagcaaatccccatatcaagactatttttctgcatctggacaatgacagaacgggcaggctttgtaccgccgccctcaaagaacttttgcagaaagactacaaaatcgttgatgagccgccgcctgtcggtaaggacttcaacgattttttattatcctatctggggattgcaagaccgatttcaagccgtgaaaggagtgatgcccgttgattgtccgcagattttgacccgaagaataacacgacaaacaaaaaaattaaatgttgaaagcgaggaaataaccattgaaaaagtatgatgtaaccctgactgcccattatgaaaagaccatttctgtttgtgctgaaagcgcagaacaggcaaaggcaaagaccgaaattaccctgttcgataccgaccttatcaactttaccgatgaggattttatctgcggtgaagccaaaatcaacgagtcttgcgaggacggtgctgaagataccgacgaagaagaagcgaacgaggacgaatgttgttcggactgtccgtacttctgtcccgtgtgcggagaatgtatgtatgaggacgagtgcgacgagtaatgtcttaccaagcactgaatttggttatccaaattcgcttgttaggggctgacccctaataccccacaggcagaaaggagtttaagaatgattgagcttatatttttcatcatcggcgtaatgctcggcggtctgactggcatcgtgattatgtgctgcttgcagataaaccgacttgccgagagagaggaagtgaaaaatgcgaaaacgaaatgtgcagatacttttccgcttgactgaggaagaagccgaacagctctactctctcgttcaaaaatcaggctgctcaaaagaagcgttcctgagaggaatggtaaaaggctatcggctctgcgaaaagcctgacccagagttttataaaatgatgcgtgagctgtccgccatcggcaaccgtatcaatcagcttgcggcaaaagccaacgccctgaactttgtggacgctccgatgctgaaagaggaagcgcaaaggtggcacgagtttcaaatcgctgtccgaaaaaaatatctgcttccaagaaaagcaccgtaatggcggtctgtgaaatatgggatgtgcgtggcaggctcgaccatcccatagattatgcggaaaatcctgaaaagacagccaatcccaaatacaccgaagcggatttgcaggctatggtcgatgtaatggaatacgccaccaacaaggataagaccgagcagcgttattttgtcacaggcgtaaactgcgacccgaccaccgccagagatgaaatgatgattgcaaaagcgcaatggaacgatgaaagcgagattgtctgctatcacggcttccagagctttaagcacggcgaggtcacgccagaacaggcgcacgaggtcggcgtaaaacttgctaagaagatgtggggggacagatttcaggtaatcgttgccacacacctgaataccgactgtctgcataaccattttgtcgtaaactccgtatctttcacagacggcaggcattaccacgacaacaaagcaaacctgcggcttttgcgccagcgttccgatgagctttgccgtgagtatgctctgtccgtcattgaacacccaagcggaaagaaaaagccatacgctttgtatcaggcggagaaaaacggtatgcccacaagggataatgtcacacggcaggcggtggacgaagctgtcagcaaatcgttcacgctgaaagattttgaccgcattatggctgaaatgggataccgtgtgagctttgacccaaaccgcaaatattggacggtcatcggtaagggctggaaacgcccgaagcggctgtataagctcggagaggaatatagcaacgagaggataatggagcgtatcagcgaaaactcatacgccgtgaagttctccagatttgccgagccgcaaaggacggtcagggtgttccgtgtcaaaagctctctaaaaggagctaagaaaatcggcggactgcgggggctgtatctgcactactgctacaagctcggtatcctgcctaaaaataaaaagccaaattacgcaaggcttcattatcttttgaaagacgacttaatgaaaatggaagccatctcacaggaaacaaggctgctgtgccgtaatcgcattgatacggtggagcagctcttgtcatacaaaggctctttggaaacggaaaaagccgacctgcttcaaaagcgcaaggaactctatcccaaatcccgcaaaacgggcggcgaagaaaaggaagccatacggtcgcagctttccgatttatccaaacgcctgagcgttatccgaaaggaggtcagactatgcgagggcatcgaagcccgtaacgccgctctcaaagaaaagctatccaccatacgggcagacgaagaacaacaacgaaaggagctgatgacgaatgaacacaggcggcgaagcggcagagcaaatcgtccgaatgagcttggagggatttgaggtcgcagccaaaatcacaggtgcaggtgcaaagaatatcgccgttctcctctattccattctgaaagaggaaaagaaaacaaagggcaaggcaaggcttaccaatatgctccgttctggcaaggagctgaaagtctttaccgtaaagaacggcgacctgaagaagtttacgcaggaagctaaaaaatacggcgtgctttactgcgtccttgcggacagaggaaacaaagaccccaatgcggaggtcgatgtgattgcccgtgcggaggacgcatcgaaaatcagccgtattgccgaacgcttcaaattagcgtcggaaaacaccgcttctattgtgaccgaagctgaaaaatccaaagaggaaaaaacaggtcagccagagccagacatcggcgtacaggaaaaagctgagaaagataagctgctcgatgagcttatgggcaagcctgttcaaaaggaggaaaacgctcaaaacccctcggtggcaaagaccgaaaaatcccctcagtccgagcctatctcagagcagccaaagaagtccgcagagggggctactttgactaaggacgaaaaaccgtccgtcagagaggaactgcggaaaatcaaggagagccgcaaggaacaggaagcggatacgccttcttcccttgacaaaagctctgcttctgacagggcgaagaagcagcccacaggcaagaccgagcataagcagccccagagaaagaaaaagaaaccaaaatctaaagaaacgaggtaaatcagaatgagcatttatgatgtatttagcggcggcagcaaaccgtttgataaagcggaatgggcagcccagaagcaggcgcagcgaaaggaagcctatgagctgattgacaacacctgcgccgaaatgatgataagcggcgacagcttccgtcagtatcttgatgtgcaggggcgttttgaccgttactcggttgcaaacgctattttggtatcggcgcagatgcccgaagcgacacagcttaaagactacaacacttggaagcagagccgtgtctatgtaaacaaggacgcacagaaggtcgttatccttgagccgagcaaggaatatacccgtgaggacggtacaaagggtatttcctataacgccaaagcagtctatgacatttccgaaacatcagcaaaagagagaatgcagccgcaggagcagaaatctatgcgtgagcttgtatcggctttgattgacgcaagccccgtgccttgcgttcctgttgatgacttggaactgcctgcctactatgacagctctcagcagactatctttgtcaaaaagggactctctgaggaagtgctgtttatcagtatggcaaaggaagtatctgcggcggtctatgacttcaagtacaatgagagccgtgacgcttccgatttcaaatccttttgcgttgcctatatggtaagctcccgttacggcgtagataccaaaggctttgatttttcccgacttcccagagagtatgacggaatggatacgcaggtgttcaagggagagcttggtacgatgcgtgatgttctgggcgaaattcagagcgatatgtataagagtatggagaaaaataagcctgcaaggaataaagagcaggaacggtaatcggaggtgcagcttatgaaagaagaacgataccatatcgcacttgacaggtacgataaaaatatcgttatcaatgcgctcaataccctgcggacacggcagatacaggaggaacgccccaccgagcctgttgacgagctgattgacaaggtagcgaacgcaccgaccagaaaggtcagggtcattccgtgcaggtgcaatgaggaacgatgacaaaaaaacgggcttaatcctttccgtctgcgggattgttcctgttatatggctcgccctgctgacagccccctatgtgggcggtggtctggttgaaatcatccgaggtctgcccgtggcattaggcaagccgcttgaaataacggtgtgtgaggacagcgcaaagactgtccttatttttttgcttgcctacgctatgggcatcggcatttatttctccacacgcaggaactaccgcaggcgggaggagcacggctcggctaaatggggcgatgcgggtgctttgaacaaaaaataccgtgacaaagacccgtccgcaaataagctgcttacccagaatgtccgcataggcttggacgggaaaaagcaccgccgcaatctgaatattttggtctgcggcggctctggtgcgggaaaaacaaggtttttctgtaagccgaacgctatgcaatgcaatacctcaatggtaattttagacccgaaaggcgaaatcgtccgtgacatcggcgggctgcttgaaaagaaaggctatgaggtgcgtgttcttgaccttatcaatatgcaccgcagtcattgttacaatccctttgtttatctgcgaaatgacaacgatgtgcaaaggcttgtaaccaatctctttaaggcgaccacgccgaaaggctcacagtcgcaagacccgttttgggacacggcggcaagtatgttgcttctgtctttggtgttctatctgaaatatgaagctccgcccgatgagcaaaacttcccgatggtgatggagcttctccgagcgggcgaagtccgagaggacgacgacagctatgtaagccctcttgacgagctgtttgaccgcttggaaatggtaaacccagagcatattgccctgaagtattacagggattatcactcaggctcggcgaaaaccttaaagagtatccagattacccttgccgcaaggcttgaaaagttcaaccttgaaagccttgcggggcttaccgccaccgatgagcttgacctgccctctttgggcgaaaagaaggttgcgctgttcgctctcattcccgacaatgacacgagcttcaattttcttgtgagtatcctctatacgcagttgtttcagcagcttttctatctggcagaccataagtacggaggaagcctgcccgtgcattgccatttcataatggacgagttcgcaaatgtttcgctgcccgacgattttgacaagatactttccgttatgcgctcaagaggcgtgtccgtatccattatcctgcaaaatctggcgcagttgaaggctttgtttgaaaagcaatgggaaagcattgtcggcaactgcgatacttttctgtatctgggcggcaacgagcaaagcacacacaagtatgtgtccgaactgctcggcaaggaaacgattgataccaacacttacggaaagagcgagggacgaagcggcagctattcaaccaactatcaaatatctgggcgtgagctgatgacgccagatgaagtgcgtatgcttgataaccgctacgcacttctttttttgcgtggggaacgccctgtaatggacttcaagtatgacattatgaagcacccgaatgtaaagctgacaaccgacggaggcaaaccgccgtatatccacggagagcctgtgcaggctgtcgcaacccttgtgtttgacagcgatattcctaagaacgccgtaagcgtaaaagctgtcagcagttcctatgagcttctctccaacgaggacttggaagaaatctttaacatctaaaggaggatttttatttatgaaactttttcagaagaacgaaagtaaggaaaccgtaaagctgccgatgtctggcaaggtaaaaaagggctttcgcttttactgcgtgaccgttatgacaacggctttggtggtcggcacatctatgactgcctttgcagcaagtgaccctcttaccgtagtcaataatttgtccgacttcattttcggcttaatccgtgccgtaggtatgattttgcttggcttcggcgtagtgcagattggtctttcgctgaaatcgcacgacccgtcccagagagcaaacggctttttgaccctcgcaggcggcgttgtgattacctttgcgaaagaaatccttacccttattacaggctgaaaaactgacacaagacaagataacgggagcagagccgctttgcggatttactcccgttatccaattatctaaggaggtggtcgaatgtcagataattggattgtgcaaaacttggagaacgctctgcggacttggaacgacaagctgtcggaaatatggcagctcattacccaatccccagagcagttcaagggcggcacaatttggaatgtaatcgtagatattcacggcgcagtacaggctatcggacttgcacttttggtgcttttctttgtcatcggcgtaatgaaaacctgtgggtcattcgcagaagtcaaaaagcccgaacacgccctgaagctgtttattcgctttgcccttgcaaaaggcgtcgtgacttacggcttggagctgatgatggctttgtttaacatcgtgcagggcttaatatcaaccattatgaatgccgccggcttcggctcggcagcgcagacggtattgccgcaggaaattgtcacggctgttgaggactgtggatttttcgagagtattcccctatgggcagttacactcatcggcgggcttttcatcacgatattgtcattcattatgattatgtcggtgtacggcagatttttccgcttatacctttataccgcaatcgctcccgttcctctttccacttttgcgggagagccgagccagaatgtgggcaagagctttatcaaatcttacgccgccgtctgtctggagggcgcaatcattgtacttgcctgtatttttatgcctctattttatcataaatatgtaaactatgtccttgcacattctgtaaactatgttatcacactatacagctcgcccctcccgaaatattgtagtgcctatcataaacaatttgcaaggaatttaagctttgggttacggttgatagttgacagattattaacttgatgaatggttagaggttagtgcaacgggaggggcaagccacctcccctacgaaaagagaagatgatagcttagcagcttttatgagcttagcggcaagaccgcaagcgaagaggtaatagacagaatattttcacgcttctgcgtgggaaaataagagtaataaaggcggtactcattatacgagtaccgccttttcctatctttcttagccattaacaagtcccaccagccccataataaacacaaacatcacaagtaccggcagaacatacgtcatatagcctttcataaacctctttatcttaagacccttgccggtattggcttcatttacgaagttatcccagccccagccctttttcgttacacagaacagaatgaatacaaacgagccgagcggaagaatgaagttgctgactgcagtatcctcaaggtcaagtatcgtgcttcctgcgccaagcggctgaaaaccgctgagaatgttgaatcccagacagcagggaacagacagtaaaaacagcagtatgccgtttataatgcaggccttcttcctgctgagcccccataggtcgattgtgttcgctattatacattcaaacacggcaagcaccgttgacagcgccgcaaatgacatgaatacgaagaaaagacttccccacagcctgcccagaggaatgttgttgaaaatgttcggcagagttatgaataacagcttcggaccgcttgtaacgtccactccgtatgccgagcaggcaggaaaaataataagtccggacgctaccgcaacaaacgtgtcaagcagcgctacatttaccgattctccgagaagcgacctgtccttgccgatataactgccgaatatagccatacttcccataccgatgctcagcgtgaagaatgcctgattcattgcgcttacaaggatatttgttataccgaccttttctattacgctgagatcgggcataagatagaacgaaagtccttccgctccgccgggcagtgtaaagctgtttacggcaagcaccaccataattgcgagcagggcgagcatcattatcttagtgaccttttcaagcccgttctgcacgcctataaggcagacagcaacgcctatcgcaacgactatgcccatatatgctataagcgaaacagggtcgcccagaacgtcaacgttgaaatggttctccacagccgccgtatccattccgacgatctctccggatgcggtcgaaacaaagaacttcagcatccagcctgccaccgttgtatagaacatcatcagcagataacagcctataagcgaaacctttccgtgcaagtgccacttactgcctttcggttcaagctgttcgtacattttcgcagggcttttctgagccgctctgcctatggaaaactccatagtaagcacgggtatgccgagtattacaaggaagaacagatatataaggacgaaaagaccgccgccgttttgacctaccacataaggaaacttccatacgtttcctatacctattgcacagcctgcgctgagcagtataaagccaagacggctgccgagtttatctcttcccatagttcctccgggttgttgaaatttttaaggtaataccgcataattattgtcgtgcgattgcgcagtcagatttttcgtcagattgtataaattgagtgtgggcaggctaacgcctgtcaagcaaaatttgtgcaagatgacggaaaatacgcaagcaagcgtgcggcaaaggcgatagccgttaattgtgcggtgttgccttaaagtgccgcatttacgcatcggttttcagaacctctctgtaatcccacagatatttgattcccgaaaccgttgtaagtatgcaggatatgtacataagtatatcgctgataatctgtacagggaaggtttccgcagtgacagtgccgaaatcgacaagaatatgcattattatgataacgcatatcgcaaccattgtagatgctgttttcagcttgccccatatacttgccgcaataactgtctttttctcgcttcctgcggcgataagccgtattcccgataccacgaattcacgggcgactattatagccgttacccaagcgcttgcccagccaagctcaacaaagcagatcagcgccgtaacgacaagcaccttgtcggcaagcggatctaaaaacttgccgaagtttgtcaccatattgtattttcttgcaattttaccgtctgccgtgtcggttatgctggcaacggcaaagattacagccgcccacagatagctgtagggaacaatatcgcctgcgagcataaagaacgcaaagaacggaacaagtatcacccgaagcagtgtgagcttattagctatattcatacctctgtcctttcagctttatacccgctcgccgagcagattgttttccagaacatcggtgatcttaacatttacaaagtcgcctatcgtaagcgagcttttatcttttgccgatgtgaagtatatcattccgtcaatttcgggagcaaagtgcatacttctgccgaaatacatatcggagtagcggtcaaagccctcacagactacctcgtaggtgttgcctaccatacctgcgtaatattcgcccatgcgtatttcctgttcgctcgtgattatatccgctctgcgctgtctttcgccctcgtctacctggtcgggcatttcggcggcgggagtatcttcttccgcagaataggcaaagcagccaagacgctcaaactttatatcgtttacaaattcggcaagttcgctgaactgctcctccgtttcaccggggaagcccgtgataagcgttgttctcagcaccacaccgggaatttcacggcggagctttgcaaacagctcacgcaggctctgctcgtcgccgccacggtacatattgcggagaatttccttgttgcagtgctgtatcggaatatcaatataattcagcaccttgtcctctgtctttattgtttcgataagctcgtccgtcattctttcgggatagcagtaaagcagtcttatccactttatgccgtctatcttacataactgcttaagcaaatccggcagagcatatttcttatataagtcaatgccgtatgccgtaacgtcctgtgctactataacaagctcctttacgccgttttcggcaaatttctttgcttcctctattatgttctccatctttctggaacgcattttacctcttataagcggtattgcgcagtaagaacatttgtttgaacagccgtccgcaattctcagatacgcatagtggggcagagtagactgcagcttgtcgccctccatattgtgacacagcttgtcgccgaaggtaacgactctcctgtccagcattacagagtttatgatttcaactatatcatcgttctttgcaatacctaccactgcgtctatttcggggaattcttcgtccatctgcttctgataacgctcggcaagacagcccgttacgattatctttttgttgataccgtcatttttgcggcttattgcctccattatctcctcgatggcttcttcctttgcgctttgtataaaaccgcaggtgttgataataacaacatccgcaagacctgcctcgtttactatcttgaagcctgctttcgctatctttgcaagcataagctcagcgtcgcactggtttttcggacatccgagagataccattccgacctttatcgtttctgccattatttttccttacctttccgttttccttatactctgaatattacgttctattcgtcatattcctcattttcgtcatattcgtcataatccccgtcttttatgcgggataatgcgagctttatatcatcatacgcaaagcctctgcgagcaagcgccgcagtaacacgctgtacgcttttatagtctgaaaaatccagcttgcttgcgtattttttatctacaagatgcattatctcgtcgataaaatcctccgtgtcgtattcttcttcctgttgcgatataaggctgtcgggtaagccctttctccgcagttcaaagcggattttggacttaccccaacccttgtttatatatgccctgtatagcttttccgtatacttttcctcatttatgaggtcatgctcgcacataagcccgactaccatctcgcacagatcgggcggatagttttttatcagcttgtcataaagctcttttttggagtggtcacgctgagcgagtatgtacagcgctctgcgttttgcccttattctttcgtcatccgtatatgacatcagccgagatcctcaggcgaaaattcctcgaagtcgctgtctgcctccacaacaacgctcttctttgccgcaccctttttcttgggagcgggagaaggtgcgggagcgtctgcctttgcggcctcatcgccgatttccataagctcgttttctgccgccgattctgaagtgtcggcattgtccgtgccttctccgtcctcgcttgccgacatatcaagctttgatatattctcttttatcttgccctcgatttcaaggcgcagatcgtcattttccttaaggaacttcttggtcttttccttgccctgtccgagcctctctccgttatagctgtaccatgcgccgcttttctttataaatccaagctcctcgcccatggttatgatctcgccgagccttgatataccctcgccgaatatcatatcgaactgtgtttccttgaacggcggtgcgaccttgttctttacgaccttgcatttagtagtataacctataatctcgccaccgtcaactatcttttcacccttgcggacctctatacgcacactcgcatagaacttgagtgcacgaccgcccggagtagtttcgggatttccgtacataacgcctatcttttcacgcacctggtttatgaagatagcgacagtattcgactttgatataacgcttgtcagctttctcatagccgccgacataagtcttgcctgaacgcccacaaagctgtcgcctatctcgccgtcgatctctgcctttgtgaccatagcggcaaccgagtcaagtacgacaatatcaatagcacccgagcgtgcaagcgtttccataatctcaagcgcctgctcgcctgtgtcgggctgagaaacgataaggtggtcaatatcaacgccgagcgactttgcataaacggggtcgagtgcgtgctcaacgtctatgaatgccgccataccgccgagcttctgcgtttctgcgatagcgtggagcgtaaccgttgtcttaccgcccgactccggaccgtatatctcaataattctgcccttcggcagaccgcctataccgagtgcatagtcaagacctatagagcctgtcggcacgctttcaacatccagctttttatttccctctccgccgaggaacattacagcaccctgaccgtagttcttgattatctgctccatagcggtatcaagagcctttttcttctcctccggagtggtaggatgatttacggtaggtgtcgccttttttgtgtttgcctttgccatattattttacccgtcctttctgtgttcggttttatcctgtgactatattctatcatcaaacgtgtacaataaaacgtacaataattacttttcatcgctttatagagcggactattctgtcgtgaccgctgtaatccctgataatttccggaacgaatcccgcaccttcgaatatcctgcttacagcctgtccctgttcttctccgatttcaactgcaaaaagtcctccgcttctgagctttcctgcccacatcggtatcagtctgcgataaaaatccagaccgtcctcaccgccgaaaagcgcaagctcaggctcgaatcttacctccttctgcaaggctttcatatccgcagaggagatatacggcggatttgacagcacagcataaagcgaatcatcttcgaaccgtccgagtatatctttatcgaaaatatctccgtttatcgcagtgaccgacctttcagctttgttctgctctatatttttcagaaaatatccgtatgccttgtcggagatttcgattcccgcagtttttatattcgcctcaagcgcaacagtgacagcgatacatccgctccccgagcataagtccaccgccgtaccgcccgtgtttttaagatgttcgattgctatattgcacagaagctccgtttcgggacgggggataagcactccctctccgacaaaatattttctgccgtaaaattcccagtttcctaaaatatattgcagcggctcgcccgttttacgtcttttcgccttatcctcgcactcggcaagctgtgcctcggatatttcctcaaacggcattttaccgccgctgatttcgcttactatttgtcttgcctcaaaatacgcatcgtcggtaacgctttcaagcatatcgcttataagccgtaccgcttgccttattaccactttgcgtcctccgcattttcggggagaacaggcttcattgacgcaatagccacctctatcatctcatcggcaggctcctttgtggtaagacgctgtatagcaagtcccggagcggaaattatctttgtcagcacattgtcatactttcctgcgatacggataagttcgtatgagatacctacgactatcggcaggaaaattatcttacagcatactctcagcatatcgccgataagctttgatacgccgaacgcttcaatgaacatctcgctgtttatcgggagcagggtatataccagtatgcttatcgcaagcgtcaggaatataaagctggtaccgcatctggggtggaaacgcttgtactttctgacgttctccacagtcagttcctcaccgtgttcatagcagaatatcgtcttatgctccgcaccgtgatactgatacagccttttcatcgttttcataagagaggtcagccacagatagccgacaaaaagcgctatctttatgataccctccgtcagtgagcggaatgcggatatatccgtatcgccgaacagcgtctgtatccctgtgaatataagcgtaggcagtatcgcaaacagtgcgatcgcaagccctacgccgagaatacccgatatgaccgcaaccgccgttgtcagagcggcactatcgccgtctttcttttcgccctttttatcttccggcttttcttcgcttacgttatctgccggtttgttctgctctttttcttttttcttcttgtccttttcgtcctcttcttcatcgaacattccgctgacttcgcccgacttgttaagatacttgtaaccgtcccccagctgtgaaacgaaatttatacagcctctgataaacggcgctttgttataccacttcggagttttcctgtcccacacctccgtgtatatctccctgtcgggctgacgtacagccatacagccttttttcggccccagcatcataacgccctctatgagcgcctgaccgccgaccttcgtttttataacttcttttttctgttcactcatgttaagccttaagcctttcttattgttcgtcctttttcgctacaggcagtgtgatgaccactcttgtgtaccgtccaagctcactttctatattcagcgttccgtcgtgtgcggctactatttcgtcagcgaccgcaagccctattcccgagcctctgacagtgctgttcgccttgtagaacttcgctttgacctttgttaagtcggacgacgcaatgccgcatccgtcatcctcgaccgtaattattacagccttgtccgttaccgccgtcgcaacgattatatgaccgtatgcggcggagtattttatagcgttgtctattatatttataaacacctgccttatacggtttctgtcgccgaatatagtaactatctcctgcggctcgtcataaagcagtgtcttgttttcctgtcttgccttttcggaatatattataacagcgtcggtaagctccgcaaacacgtccatatttgctttgttcagattgaatcttccgccctgtatccttgagaagtcaagaagctcctcaaccatatttgaaagcctttccgattcttccgaaattaccttcattccttttttggtgacctctttgtcgccgggacttgtggcaatagtttcgctccagcccttgatagccgtaagaggtgtcctcagttcgtgggataccgatgagataaagtcgttttttatcttctccgagttttcaagctcgtcagccatgtagttgaatacacggcacagctcgcccagctcgtcgtctgtcttttcttcgatatgcacaccgaagtcgccctttgctatctttcgtgcattcacgcttatctgtcttaacggcattactatcgactttatgaaataaagcccgagaaccagcatcagtattatgatagctccgcttatcgctataatgaatatcattattatgccgagctgtttatcgaccttcgaaagcgaggttatgaccctcaccgcattgtagtttgtattgcccgtttcgagcaggctcgtgacagccattaccttttcgccgttgctctgataaccgctgtatgtgcctattcccccttcgtcctttacagcatagtcgtagtcgggcatatcataggagttgctgggctcaaaaccgcttgacgtaataacgactttgccctcggagtttatcatcataagctccatgcggtctttctttgtgaagctctcgaccgtgtttctcacttcgtttgaatagtttgttccgcttcccgttgaactgctgttgtagtaccgtgtaagtacggtcgatataacgttcagctcactgcggagcgtctgttcaacggtactgtagaaatacgacctgaacatgcagtacaggactatatcaagcagtaccagaactataaccaccgcactgaagctcttcagaaaccatcggttagctatcgtcgtgcgtcttgccaaagccttttacccccgtttgtctacctgctgaactcgcctgcggcggcaagctcatccacacaccacttatagccgtagccccatatagtagttatgtatctcggatttgacggatcttcctctattttcattctcagccgccttatgttgacatcgactattttatcatcgccgtaatagtcattgccccatatatgagtaagaatgctcctgcggtcaagcgccgagccgctgttttccataaaatattccagcagctgatattccacctgcgttatctctatgcctgtaccgttctttgtgaaaatacggctcttggtgtttatcgagaacggaccggagataagcgttcttccctcgtcctcaggaggtcttgcaatgctgaggcttaccctgcggtataccgcatcgacccttgcgacaagctctgacggcgagaacggctttgtcacatagtcgtccgcaccctgcgtaagacagcgtatcttgtctacctcctggctttttgcggagagcatgattatgcccatagtatcgcttttctgccttaaccatctgcaaagctcactgccgtccatacccggcatcattatatcaagcagcgcaacatctataagaccgccgtaatgcacataagcgtccatcgcctgtgccgcattgctgacatctataacatcatatccgctgcgcttcagatttataacgacaaaatctcttatagcgtcctcgtcctcgcaaacaagtattcttttcatgcccggacctgcctttcttattataattttttatcataattttcttgtcataattttttatcggttgcttgccgtaaacagtacagggcttccgcttccttctggacggactttaagcgccgcctctatttcgtcgtcggtaagagaaagccccgcatacacgatgctcttgcagtaaacaaccttttcgctgtcctcgtagaacagtctgtagccgtcacggcttgcatctgtcgtatccgttgcgttttgcgcagaggggctgttatttttaagcaccgtctttatagtcagcagagcatattcgttttccttgagttcgccttcgtgcttccagaatgtaacggaattatccgatgagtttattgtagccgttaccatacctatccatcttcccgggaaaacaagcatatagttaagacccggatctataaacgtatatgccgtaagttcgatttttttgcagttttgtctgtaccacagcacagcgttgagctgttcggggaaagtgaggttttcatatcccggaagtgtggcagtagccggaacgtctataataccgtcgccgtcaatatcctgcgactgtaccttgggcgtgtagttgttcgtccttcttgagtagcttatattgcttgagtccattactatcgtatccgccgttgcaaatgagcttcccttatagtaaaggaccgccgtattatactggttttcggctgtcagataatcgaccgttatacacggcttttccttttcgagtataagacagcgtgctatagttatcttgtcaaattcggcaacgccttctccgaatgaaaccacgggaaacgccgtatgaagctcgccgttttcactgcaggagtatacgctcatacttccgtttttctttgcaccgttgcggccaaagcaggcgagatattcgcccttttcgtcaatgccgttcagaaagatataagacgaatatcctattgtaccgagctgtttggcaactccgttcttgtaatctatgaccgacagtatcttgtcggtcgagccgagtacggagtagcttactatcagcttttcctcatcagagccgagcttggaaaaggcgacgctttcgatctccgttcctgccgcaggaagctcataggtcgccttccagtttccgttttcgtccttgtcaagaaagctgatacgcaggtttcctaccgccgtatcattctgtgcaggctctttcgccgcatccgtcttgttctgctcataaaagactatcgcctcgtcggtcggttcattgtctatgttgcgtataacaaacgcactgcggtacgagcctgtatgcggataacgcaaatcaaccctgcccgcacttgcggtcagggcgttgtatatttctgtctgttcgtctgtaagtctgggcgatgtcagcagatcacctgagaaaaagcccgcagaacagccgcagagcatagtaacaaggcacagcactgccataagtgccgatgctttccggagtattttattaagacgtaatacagtgatgcttttcattttttctcctaagatgttacgattgtcagccttgagtgtcgtcttgcatatcgtcctgtgcttcttctgaagctgtgccgttttccgtgtcctcagcgtcagtgctttcctccgccgtgcttacggatacattttcaaaagcggtctgctccggttctcctgttgccgctctcttttttgaaaactgtactacagccgccagtaatgccggtacaagagcggtaaccattatttcaagatcgggcaaagtttcgggagaattctgagcgatgactgcccacttttcgctgtcaaccgcaagaagcacataacagcttatgatatatgccactgcgcttgcagagcagaaatagcccgatgcgataagagccgttcttgtcagcttcttttctgcgccgcataagaatcttcccgcattgatccagaaaagcacggtgaggacgtaaaacagcatcatcatcagcttctgcggcatacccgtgattatcgggcttgaaagatagaattttattgcaactataagatagttgattattatgaagattgcgcttatgcagtgagccggtacgatctttgcggatgccatcatactcataccgcctatgagatatgcgatacagcaggcaagcgaggttatggtggtaaatcctacgcttccgtacgaaaaatcgtttattaccggtaatatccacaccgcacctgcgatgatcattataataccgaatatgttactgcctttttccgaaagctcacctgccgctgtgaccttagcattctttacgtcaaagtatgccaggatgcttattactgccgccgatattatcagcagtacgttgaacactgtattgaacgcctcacagccgttagcatacaggagcgagggatattcggtgcaggaaacgagctgtatgattctcattacagtgaggacaacagccgaaaccgctcccgcaaggacagcttttttatcggaaagaaaacctttcattattacgcctttcaattgttcctgagatatgatcaacgttcgtcaagagcaatataatccctgttcttgataagcgttctgtaggcaggtcgcatgatacgcttgccgttttctatttcttccattctgtgtgcgcaccagccgggcattcttgcacaggcaaacagtgcggtatacatttctaccggtattccgagtagcttgtatacaagacccgagtacatatccacgtttgcacacatcgtctttatatcgcccttgttctttgcaaaaagctggggagtaagacgctcgatagtatcgagaagtctgaactcggcttctacctctgtacccttagccagcttgagcgccgacttcttgagctgtacggctctggggtctgacagcgtgtagacagcgtgacccataccgtatataagtccgctgtggtcgttttcttccttgttcagtatctttgtgaggaagtcagcgacctcgccctcgttctcccagttctttacgccgttttcgatgcagttaagcatctccataaccttaatatttgcaccgccgtgacggggacccttaagtgccgatatagccgaagcgtaagccgcataagcgtctgtgccggtcgaggttacacagcggcaggtaaatgtcgagttgttaccgccgccatgctctgcgtggagcataagacaaaggtcgaggagctttgcctcctcctttgtgtactcacggttgtcacgcagggttgacagaatgctctccgcaaggctctcgtcaaggtttatcgggtgcattaccatgctggagttatacagatagcggcgcattacctgatatgcgcctaccattattgcaggaagtcttgcaataaccgagatagccttgagcatctcgctttccatgctcttgttctcaggctctttatcgtatgtgtaaagtgccagcaccgactgcgccatcttgttcattatgttagatgacggacagcgcataagtacgtcctccgcaaaataagggggcagagtacggtagtgggtaactatcttcttgaagtcctcaagatgctccttgtcgggaagattaccgaaaagaagaagatatgccgtttcctcaaagccgtatcttccgtccttttccacgccgcttataaggtcgcatatatcatagcccctgtatataagctgaccgggagcgggacgcttttcgccttcgtcgataacatagccgtgtacacagcatatatttgtaagacctacaacaacaccgcttccgtcgttgttacgaagtcctctttttacgttatatttgtcatataatctcgggtcgattgccgtctggattttatagtcacggcatagcttctgaaatcgctcgttcatataattattattcctttcctgtgtgttttaatagcctcctgaattctataccgcaaaagcggtgaatataatgaattacggacgaaccggtttaccgaagtgtctattctttattattatactctatttacagcaataagtcaagaaaggaaaagcagacaaaatgaaaaagaagcatctgtatctgttaatagctatgctcaccgcagcggctgtactgcctataattatccttgtgtgcttttcttcggcaaacgaaccgcaaagaccggtcacgataatttaccgcaacaccgaatatgcgtataaggaatttcttgccggttgcgtgcttagctgtcttaaaacgctggacgaaccgccggcggacgatgaaagcgagggtataaatgccgtagccgttgcgctcgactgctcattgaggtatctgcatagggcagggaagtcttttgacagcggttacccttatgttgaatatatggacgaaaaggaaagcatacagcacttcggagcggagacaggcatatacagaaaatatgccgaaagctccgcagaatatgccatatcgcttaaccttaccgtacaggaagggacagcctttctccccgtctgccgtatttcgtcgggaataacgatctcaccggaggacagcggaaatccctttgtaaaaaagctctattgcgaaaaggacagatcagccgaatactatcacagcacctgtcagcttacggcagacggaatagccgagataatgctgacagcgtacccctctcttataatccctcccgatgaatcaaagtggataagcgacatccgccgagatgcagacggaaacgcactcaggctgaatgtgtgtgggatagatatgtcctgcgaggagttcagacggctgttcgacatacgctcgcctgcgtttgaaatgagatatacacagcgcctttacagctttgatataagaggcgacggctgtaacagcggaatgagcgtatattcggcattgatgctgtcaaaacgtggatactcctgccgggagatactgaatgaattttacgctttgtaaaaacagattgtaattatactaaaagaaataagcagtcacgcaatcccccctctccgtctaaccctctcaaaactgcactttccttcgaaaagcactatatccttgcctcccttgtcaaaggtgaggtgctgtcgcccgaaaaaattcgggcgactaccggagtgattgcttttctaccgcaccctttccgtttctcagacacctccgttaacaatccctcaatagttggcagtgcttcgcactgcaacagaagctcacctttacacaagggagctaaaggtgatggtgctttaccaaccattctaaaaccccactatccctcgcctcgcactaaacttgcctcccctcgaaaaaggggaggtggattgacggcaaggcacaagcctaaattttacagcgttttttgggatatatccgacttttataattgctaagtcggtctgccgtcaagacggtggggattgaatttgatagaacttctatccctaaaacttcaaagcattcgctctgccacaattcgccccgcaccaaccattccgaaaccgcactatccctcgcctcgcactaaacttgcctcccctcgaaaaaggggaggtggattgacggcaaggcacaagcctaaattttacagcgctttttgggatatatccgacttttataattgctaagtcggtctgccgtcaagacggtggggattgaatttgatagaacttctatccctaaaacttcaaagcattcgctctgccacaattcgccccgcaccaaccattccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaatttgatagaacttctatccctaaaacttcaaagcattcgctctgccacaattcgccccgcaccaaccattccaaaactgcactatccctcgctccgcaccacattcttgccatatgaacgctctgttggtttcgcatcacattgcctcgtcagccattagtgccgttgcatcgtgcaacggctttgcgtggctgactttaagcatccatgcttaaaactctgggcgttcaacttcgggcatccatgcccgccctcgaaaaaggtgaggcaagaatgaagtagcttagcaagaaatcgtagctcttttaccgtgtcggagtaagttataaaacaacagccacggttttcgccgtggcataacataataattattaattttctgtttatatccgccggtaacggaggttaagcggatcgctgatcgtcagaacggcgaacagtttgcggcgactcgccgccgctcgccgtaaaggctttgccttttcttatgtagtaattgtagaagaacagatctacaaccagcgcaagcacccaaccgacaggccacgacagccatattccgtccgagccgaagaacggagagaggatataggcgaaaataacacgcaatgcaaggtcaagacaggtgcttatcataaacggcgtcataatgccgcagcctcttacaccgccgtcaattactatctttatgcagacaaagaaatagaacggggaaacgatagtcagaaacttactgccggttgcgattatctcagcgttagcctgtgtcgcaaacaggtttacaagcgttccgccgaaaagcaggaagcacactacaaaaggtatcgctataacaagacacatcagcatacccgacttcacacccgttttaatccggtcggtcttgtctgcgcctatgttctgagcgcagaagctcgacacgctgtttgaaagcgttgagaaacaggttattgcgaaagtattcagcttgatagcagacgcataaccgcctattaccgatgaaccgaagctgtttaccaggctctgcacgaacagatttcctaccgatacaaaactgctctgtaatattgacggaacggaaatacggcttatctgcttgagtgcgtcagaagagaacattttaggcttttcgggagaatccgactgtatctttccgacacgtcttaaaagtacgaagaacgccgcaacgcctgccacaccctgagcggcgaatgtagcccatgcaacgcctgcgacgcccatctgaaatactattacaaacagcaggtcaagcccgatatttccgagtgaagatgctataaggaaaaacaacggtgttttcgagtcgccgagggcggtgaatataccgttgcaggcattgtagataaacagaaacagcagtccaagtacatataccctcagatatatgtcgctgtctgcaaatatatcatccggtgtgccgagcaatgtcagcatcggtgaacataaggcacagcctatcacggtaagcactccggcgattgccgcaaacgaaaccagtgccgtgtttatcgccgttttcatatatgtatagttctttgaaccgaaaagccgtgcaacaacgaccgacgcaccgacgcttccgcctgttgccactgccatgaatatcattgtgacggggtaacttgcgcctattgcacccagcgccatatcgcttacaaagttgcctgcaataacgctgtcaacaatgttataaagctgttgaaatgcaacgctgagcagcatcggcagagagaatttcagcagaacggaaaaggtcctgccgctagtcatatccgtgaccattcttttataatcgcttccttattttttcataaaaccttttggagcggctttagtcatccttcccgcatagtcttttatcagctccgcaaactgcagctttttcacaaatcccgacggaatctccgaatatccgagcagtgcgcctttcagagcacccgctataaatgcgcatatatcgcttataccgtcctgatttgcggcaagctgtaccgcactgagatagtcgtaatgcacgcaggcgcagtatacgcctatggcaagcgcagaatctgccgtactgccgtttccaagctccgctacatcggtcagcggcgaggtttcctcgtcaagcagtgaaagagccttgtcgagcgccgcaaagcactcctcaaagccgtcatgctccttgagtatcttcatcgtgttcagtaccgagcgttcaatggtattccccttgcagataaatgcgataatggcagaaagacagcctgttgcaaggtatcctgtcgggtgcgaatgtgtaatggcggcaaggtcacagcctaccgagaatgcaagctcagggtcgctgtaaaaatacagccccgcaggaatcgctctcggcagacagtcaaacagcttgttctgatttatcggacggcgcttcctgccgtagtcgttttcggattttatccctgcaagcgtctgtacaagctgtttcgtgggattacgcttcttgcagaatgcggatattccgagcagatcgcacggaaaaccggtttcgttgtcatcaagtatccactgcaggtcgattgaagaagtaccgcctgtctgcgaataaagccactgctgaagcgcaaggaaaacataatccgcacagttcgcttctcccgttctcagtcctgccgcatcagcccacagtataccgtgtgccgtaaacagcatcatttgtgtctcgtctgatatacgggcggttttctgtcgcttctcgggacttagcttaagtatgccctttttgccgtacagatccttgatctgacttattgtcaatgtctttacgggagaaccgagtgcgtcgcctgcggcggcacctacaatacaacccgaaaacctttctttcttgtacaatttcttatttgccataaaaatgaactccaatatctgcggcggatcgccgctgacaattccgaccttgtgaaaacaaggtgcttatcttagctttgcgtaacggtcgggaataaatgataattatatttataacgctgtacagcgtttcagcttgtaaaaaagtctgtttttgaaacaaacttctaacttactatccctatccccctgccccctttccccgggaaagggggattttactggggctaccgcccctagtccctgtcgggggctccgcccctgcgaccccttttttatcaacggaagaggtttttcgacagtctgtaacgctgtacagcgttttattcacttgcctgcattttttcgtagcttatcatcagatccacgaatctgccgtaagacttcttgccgtccgtctgcccctgcgacttaagataggtatcgttcaccgttgtggcgacagcagcgaccggcgtttcatatttcttccagtattcgctgtttgctttaagctctgcctttattctgttgtccgcatagctcataagctcgctgtatatttccgcccctgccgcagaataaagtgcatttgcggcatagataagagcatatacccaccccgcatattgcagatacacattgtccgagcctgtgcaggcaagataagcgatgaagttcgcctcgtcctcacgcataaagcccttcaggtgcgacagctcgtgacacaccgtgaacggtttcgcaaagtccggcgcatttgcgttataattagcctctatggtaaacggcgcatacataccgagtattttcatataagacataccctctgacgcaattacagcctttgcgtccggataaaaccccgacaggctgtcatacctttcgccgagtcggttcattgcctttttacattcttcatcgagatcgattttatcgtcaagcgataccgtcagcgtttcgtccgtttctatttttccggcagcgtcgtttgcgttcttcagaatatacacgcaaagatccgcaagctcctgagccgtatatgtttcaacggtaaatccgctcaccgccgaaaaggtaaaacggttatagtttattccgcagaaaagcgtaaacaccataaacacgcttaccgcaaagcataccacgaccgcaagtaccctcatcaacagctttttccgcttgcccttgccctttacaaagcgtatcacggtaaagataacgccgacggcggcaagtatgataaccgcataaagcagtatctcgcacagcgaaaagggcagtacggatgaaatccgtcctacagtacccacaaaaaacgggtatatcgttgtgctgtaccactgcgcaaagtctgccgtgttcttcgcaagcagtgtgagaacaaacgacagcaggaacgcaggaacggcataatacagccatttcggcagctttttaaaaaacgctttgattgtcgctgacaatgttaccacagcctttcggatcaatacatttctctgaggctgtcgataaaagcgacaaagtcgtttcttgccgacaacggctcgattatttccgcctttacacccagctggaacagccagccgtaaaaggtcgggcttacgtttatatcctttgatatatagaagttattctcgtccagcttgtgcatggttatatccgacccgaatttatccataacaacgcttgtgagcgagttgtcgaatctcagctttattcttatcgtttccttgccggcgaacataccgaatattttccgtgtatattccgcaaggttgaagtcctccgagattatcgcaggctcgtctgacacctcaacgtcttccatacggtcaaccctgaagtttgaaaccgagttgtatttttcgtaaaagcctatgcagtagtagttttcgtcctcccacgcaagatgatacggcgacatagtataacgtccgtccgcatttctgaatatctttctcttttttatatcgtagttgaagtagtggaaggttatctttctgccgttttcaatggcttcgtgtatcttgtttatgctgtagtatatcttcttgtttacggtttttacacggtttgcgacaataacgctccgctgaagctcatttgcacggaagttgcttgtaaggtgggcgatcttgccgataagcgcccttgatttttcttctgaaatgaatttcgagcaggccacagcgtccgcaagcagctgtaattcctcaaactcaaaatcacgggaggcaagataatacgttccgttcttatccgagcatatatccattccgagaatgtcacggagcgtttcaatgtcggagtagagcgccttgcgttccgccgttattccgagcctttccagcttttcctgtattccggcaaccgtcagagcgtgaagctcgtccgattcctcacggaacattttttcgatataaagaattttctgcttctggttggatgaacgtgccataacataagtcctttctattcgtgctttatctgcattacaaccgatattaccagcaccgccgcaagcaatgcggatattatcacggtaaaaacgttgaacgtcattataatatacggtacagccgacatcgcaagagcaatggcggaaagcaccgtaatcggcgtctgccgtttcttcccgaagaatatccacagcagagaaagcatagccgtaatagtagttgtcacagcgcatatcatatagtggaacattgcgtatccgaacggcgtgacatcgaaatacgagtaattttcaaatctgaaaatcaaataaccgctgtcggacatcaatccgtacttaagcactgcgccgagcggcaaaagctctgttattatcgccgcaaggcagataaatagccgtataataccgagttttttcataatatttcacctttaaagcagggaaaataccctgcatatctcacttcacccttacaaaatgtgcaataaacgacctgaaatccccccacaacgacggaatgtcaaatccgctgttcatcagaagctctgccgaataaacccttcccgtctgctcatgcctgtaataacagcccttttcaagccccttcagctttactctgtgcaggaacacgctcggttccttgagaacctgtacatattcgaggagcgtttcgctcttgtcctttgcgacaaactgccatgcgtcaaagcggtcgtttgcgaacggatctccgattctgtaataatcgcccgttctcacaagcggattgtacttgttgaattcttctatctgttcctttatcgcatacttgtcatcgtccgaaatcttcgtaacgtcaagctcatagccgaacgtacccgacatcgcaacgtgtcctctcgtttcaaacggagtgattctgcctacacagtggttcgggctgtccgaaacgtgagcgccgaagcaggagcagggatagcacatagaagtgccgtactgtatcttgagcctttctatagcgtcggtatcatcgcttgtccatatctgaggagagtagtagagcatacctgcgtcaaagcgtgagccgccgcccgcacagttttcaaggagcaggtcagggaagtctgtcagcagtctttcctgcatttcatatacgccgaggacatatctgtgccatatctcacgctgtctttcgggaggtaatacctcgttgccgacctcgctgagctgtctgttcatatcccactttacatattctatgtttgcgcttgaaaggatagccttcatctgctcatagatatagtcacgcacttcttttcttgaaaaatcaagtacaagctgacttcttacagtcgtgcggtgtctgccgggaatgtgtatgcaccagtcctgatgctccgcatacagcttgctgtcagggcttatcatctcaggctcgaaccatataccgaacttaagacctatcttgtttacctcgtctacaaggtgcttaagaccgccttttatcttgtcctcgttcacaaaccagtcgcccagggaagatttatcatcgtttctgtgaccgaaccagccgtcgtccatgacgagcatctcgattccggctttcttagcctctcttgctatatcaaggagcttgtccgtgtcaaagttgaaataggtcgcttcccagttattaataagtataggacggcgcatattcttccactttcctctgataaggttgttcctcattacatcgtggaagtttctcgacatctgacctaagccctcgccggaataggtcatgatgacctccggtgcctgaaaatcctctcccggctctaagtgccacgagaagtcatacggatttataccgagcagagcccttgtcttttcatactgacctacctctaccattccgaggaacgaacccgaatacaccagagcaaagccgtatgcttcaccgaagtcctctgttgcggtgtggtcgcacagcgcaaagaagttgttgtgagcgtggcttgtagcacctctgttggaatcaatagactgcttgccgaaacgtataggaaaacgctgtacatggcgttctcttgcccatgttccgtgcagtgttatcatatcgtagtccattctgtcaagatcaaggctcattgatatgatacggcgcaggtcgatagcggctagaccgttgttttcgacctttacgcttcttgtaataacgtcaaatttcgggaatacgctgtacataagcgtaatatcaagaccgctgtgcggatcgtagcagaacacctcaagcgtctgcgcctcatcatctgcggcatatgtagcgggaagcccctttaatttcggcttgccgtttgaaattctgtaatccttgtagtagcattcacaggcggacataccgtttatatccattacctgcattgccggttctctgaaatccgcaacgcccgatgtcggaaattcgataggcgcgcagtcaaagctgtgaggtcccatagcgtcgtgtaccgcaggtacaaacggctcgtcattcggtatgcggagcatatgagttatatcagtttccggaatatagccgccgtagtacaagtggagcaggtttctgctgtcggtgatatgaaatgcgtagctcgatttttccgtgtcgagcttgaatacacgcttgttttcgtcaaatacgatagacataattttttccgtccttttaatttttcgggtatacggtaagttcccatatacaattaatataacatatttcacggcttttctcaatccttttaagtaaaattttaagcatttttcatttttgcaaaacaatccccaagcaatccccggacaatcccccaaacaattccgttgtataagaggtatattacagcaccgttttatccaccctcttaatcacaaaaacacaatataacagactgtcgataaacctatataatttttgaaaaatggggtttggggcgtagccccaagcggggtgagggcggcagccccacactcagccccggcacggacgccgggcgtgtatgcccaaaggctctatgcaaggacgcatacaagtggtcgaacaaagtcggtgcaggacgcaccgacaacaaacgaccacagttgcacaggggcaaagccatcagagtgtcctaaaggggatagggataataaatcagaagtttatttcataaacaggcttttctatcctataagctgaaattacagcaccgttccactcaccctcttaatcacaaaaacataacataattcaccgttaatcttaaatttacttaaattatagccttattgctgtgtaatgccgtgagtttcaataaattttcacatatattttaggcataatgcacattgacattaaaaaaacgaaatgttacaataattgtgtaaagttacataagtatgtaacaaaacgaaaataagttttataggaggatttttccaatgaagttaagaaaaatcatggcaggcgttgtagctactgctcttgcagcaagcacattagccgtagcagcaagcgctgcttgcctcacaaaggttgaaggtacagaatcaacattaagcacaggcacaggcatgtggcttctccagctctacaacaagggcaatgaagctgagggcaagcccgaaacaaagctcgacatcgactactcaaagatcgctgctcttacatttactttccaggtaaatgaagaagataaggaactgtgggacggtacaatcggcggttctgttgtattctcatgcaacggtgaaaagctcggcgttcagaacgatgaagaccctgcaaaggcagcactcttcgataagtataactggcccagctgcgaattctggggcgttcttgatgaagagttactcggtcctgtaggcgaaggctctacatacgatgatacaaagcccggtaaggtagaaaaagtcggtgattacacatacgctgtcacaaacgaccagctcgttaaccccatcacagcaggcgacgcttcttctatcgaagatatgggttgcatgcaggttggtcttcaggaatggggcagcggtatcgcagcagtaacagttacaaagcttgacgttaaggatgcaagcggtaacgttctcgtttcattcgatgaaaagggtgttcccacaatcggcggcgcttcaactcccgctgacacaacagctcctgctgatacaacagctcccacaacaggcgattctacaaagcccaacacaaacacaggtgttgagagcgttgcagtagtagcaggcatcgcagttctcgctacaggcgctgttatcgttgctaagaagagaaagtaatttcggctttaagcaataaataagcaatttatcccccgcagaaattgcgggggatttttgtcgtttctttcacttttgcactatccctcgccccgcactaccacattcgccgtatgaacgctctgttggttttgcatccgcactgtcccttcgcccctcaccaaccctcccaaacccgcactatcccacgaaaatcgccaccacccttgcctcccctcgaaaaaggggaggtggcacggctgatataattttttggcctgctgtacagtattcagatagtcctacctttatgattctgaaactattccgagccgtgacggtggggattgctccccatccgcaccatcaatgagattttccgcactatcccctcgcctttttttttttttttgtttttttttttttttttcaagcagaagacggcatacgagatttcgcggagtgactggagtttagacgtgtgctcttccgatctaacaaaacagtcaaaaaacggtcagtaaaaaacaaaccgcacaacaatgcggtttcaggctgtcgataaacccacgcaccgcaaaaatgcagaaaagtaaatcggctcaaactaaaaatctgataaataaaaagaatttcacacagctgtaaaaatggctgtgtgaaagcatttttgcttacagcgtcaaccgctcctcaacgtacctttgtacgcctgtcggagcggtttccttgtctgcgcttgtttatcaacggctgcatcgtgtcggaaaatactttttcgacacgatgaaaccgcacaacaatgcggtttaaaaaatcaaattcttatactgccctatgcagctttaaagtcttagctataaagcctcctgttttgcggtctgaagatactctgataaaacatcccttcatatttatgagctttctttctgaataaaagtccacggcaacacctcggacgtaacctccttgccgttcagaatatcaacgagcttctgagccgcaattctgcctatgtttctgtcctcataggaaagcgatgttatcgtgaccggagagatccggctaagattactgttgtcaaagctgactactgcaacgtcctcaggaacacgtctgccggcagaaagcaggcacttaataagtccgaacgccacctcatcgttatagcatacgaccgccgtattatcgccaagccgatttaatacctcctgaggattattgaaaagatcctccttcgtttcggtaatgtaccagaacacattctcatcggggattatcagaccgttgcgaaacagctccgaaataaagcctgaataccgctgatgaccttgaatgtcatcgcttttgaaaaagcctgcgatttttgtgtgaccacgttcaataagatgccgcacaagctctgcaccgcctgcctgattatccgcacatacagaatatgtgccgctgagcgacgggtaatatccgttgaaaaatactacaggtatatccatttctatcagcttttcgtacagatcgaaattaggattcggcatagccgattttgtaccctctatcagtattccgtcaacgggattcttgagtatttcttcaagtatcgcacgctcgttgcaaacacagttgcgtgtcgcagaaagaacagcggtatacttgttttcggataatacatcattcactgcccgcagctgactcgggaaaatatagtcgctgatgtatgttgcaacaacagctatcttccctgtcctcggattaagccgcttcggccgtaccaccgagccgctcccctgacgctttattataagattgtcctctacaagaagcgacaacgccttgcgtatcgtctggcggctcacatcatactgagctgtcagcagctcctcggtaggaatcggctgtccctctttatacacaccgttttcaatatcgtttttaattgcctgtgcaacagcttcatatttagtcataattatcacctctatgcaaagcacaagttcgtacaaaagaatacaaatttattcacatatataatacaactttgtccgttgtttgtcaagcagtttttactcagcacgatattggtaagtcagaaacatctgttttgtgacaaatgcacaaatcgttccggcaaaaatgttcaatttatacattgcatttacttatcttttgtgttacaataaaaaagcaatacagacaaaacttaaatttgtaacagatttatctataacttgtcttttaaatttacagcagaagatatacgtctgtttgcaaagataacgaacacggagcttgttatgattgatggcaagaccgacataaacagttttgagcagcagcttgaatcgcttgatgctactgcagctctcaagaggtgataatatgacaatacaagagaagatacaaaacgcaaagacatatctcggaatcgaattcggttccaccagaataaaggcagtgcttatagacgacacatttgccccgattgcttcgagcggtcacgagtggcagaaccgctatgaaaacggcgtgtggacttattcccttgatgacatcacaacaggattacagcaatgttatgcggcactcacagaggatatacggcagaagttcggagtagctccgactacctacggcgcaattggtatttccggaatgatgcacggttatatggcatttgacaaggacgataacttactcgttccgttccgcacatggcgtaacactatcacagagcaggcggcatccgagctgtcagagcttcttagcttcaacattccacagcgttggagcatagctcatctctatcaggcaatactgaacggcgaggaacacgtcagacatattgctcatatcaatacgcttgcaggctatatccactaccgtcttaccggaaagcgacaggtcggcatcggcgaagcgtccggcatcttccctgtggacagcaccggttacaacacagactacatcaaaaaggttgatgaggtgctttcggcaaaaggtttctcagtaaagctggcggaagttcttccttcagtgcttaacgcaggcgcaaaggaggcgtttctgaccgccgacggcgctaagctgctcgacccgacaggtacactgcagccgggagttcccttatgccctcccgaaggtgacgcaggtacgggaatgacagcgaccgacagtgtgcttccccgaaccggaaacgtatcggcaggcacctcgatattcgctatgcttgttctcgacaagccgcttaagggctactacccggaaattgacgtagtgactactccctgcggcgctcccgttgctatggtgcattgcaacaactgctcctccgagcttgacgcatgggtgaagatattcggtgaatttgcacagctcagcggtcaccctatcgcaaagcccgcactttatgatatgctgtattatcacgcactgacgggcgaccccgactgcggcaacaccgttgtgtataatttcctttcaggcgagcctgttgcaggagcggaaaacggcagaccgatgtatttccgcactcccgacggaaaattcaatcttgcaaatctgttccgtgcggaaatatactctactatggcagcactgaagctcggaatggatatactttttgaaaaggagcaggtttccgttgaaaaaataacaggacacggcggtctgttcaagacaaaaggagttgcacagcagttccttgccgacgggctgggttgtgccgtttccgttatgaagaccgccggagagggcggcgcatggggaatggctctgcttgcggcatatactgtatgcggcggcggaaaatcactatcggaattccttgacagtgaggtattcgtcggtatggaatccaccacgcttcagcccgaaaagaacggtgctgagggttttgcagaatttatggaaaactacaaacgtggacttgcggcacaatacgcagcggcaaagtaagaaaggacgcaatatgttagagaaattaaaacaagaggtgcttgaagccaatcttctgcttccgaaatacaaccttgtaacgttcacctggggaaatgtttccgcaatcgaccgtgagagcggaatgatagtgataaagccctccggtgtaccgtatgaagaaatgacagccgaggatatggtggtggtcgaacttgcaacaggaaaaacagccgaaggcaagtggaagccgtccagcgacacgcctactcatctcgagctatatcgctccttctcagctatcggaggtatcgtgcatacccacagccgctgggctacttcgttcgctcaggcaggtgcaggcattcagccgatgggcacaacacaaggcgactacttttatggtgaaataccctgcacccgtgccatgactcccaaggagattcgcggcgagtacgaaaaagaaacaggaaaggtcataatcgaaacattcaacaacatcgatcctatgactatccctgcagtgcttgtcaaaagtcacggtccgttcacctggggcaaagacgcacacgaggcggtgcataattccgtagtgcttgaggaagtcgcatttatgaattaccatgccctcactatcgcaccaactgcaggaagaatgcagcaggagcttcttgacaagcattatctgcgcaagcacggtgcaaacgcctattacggacaaggctgaaagtgcttgtaatctgactgcgatgctaaaacaaccgaccgttttaaaagaacaaaataacataaccgcaggactgctcagctttaaatgagcaagtcctgcggatttttgttatttttaggaataattaaaaagtgcacacccccttgccgaaaatgcacacacttacgacctttcgttaaatagcataaaggtaaaaaatagaaaaggctctgccgtgaccgtttttcagtcatcgcagagccttctttagttaaattgtgttgacaaatcccattaaacaaggatttccggataaagaaaacggacaccaatcacgatacccattgtatcaaaatcggtgtcctaatatgcgtctgccgggaataaaagatcgggtgttgccataatgttatcctcttttcgtgaagtgttgcctgataattcgattgtatctgctgtttcaattctatcacaggcaataaattgtgtcaaggattatgcattttaacaaagtatattgcagaagaaccgcaactccaattctcgtaaatcgccgttttctattcttgattttctataataaatatgcgctatgtgtccacattacatttggtttatccttgacaacgcaagaaatttatggtaaaattttgtcaaagtaatatgtattcgaggataaacatggagatagcaatttgtgatgacgatgagcttttcaacgaaataatgagcgaaaagctttcgacagtaatgaataaaaaccaaattaaatataatattacaccgttttttaacggctctgagttaatcactgcgttaaatgatccattaaaccgttttgacgttgtttttcttgatgttgatatgcccggagtaaacggtgaaaatgtcgcacagtatatcaactcttcaaaagcgtcaatccctgtcatttttgtcactaatcatgacgactttgtgttttcatcgtttaaatacaggccgttcggattcttaagaaaaagccatgttgacagcgaacttgaagaagctgttatccgccttgataattatcttttcaaatcagggcaatgctacacttttacctttcagggtaaactgatttctctgccgtataacaaaataaagtatatcgaagcatacgggcacgaggtcgttatacatacaaccgataccgatatccgaacgacaagatccttatcggaaacagaaaaagccttgtcgtcttacggatttatccgcgtacataaatcattcattgtaaatacacgcttcattttttcggtagaacgcaataatattatccttaccgataacagctcgctccctgtcagcagaacaaaaaccgaagaaatcaagcaggctatgataaaatttgcgagggattagtatgggactactttcaaccgttacagaaattattgcaacaatctgcgaaaatgttattatcctgtggttccttacatcttttttcggtgcaaaatatacaggcataaagaaatattcggcatttgttgccacagtcgtaattacaacagcattcacatcatttctttcaaacatactgcctgataagtttcttctgtgcacagcaggatttataattttgcttatactatattgccacttgtttctgcacggtacacttctttgtcatattctgttcccggtaatagcagaaactacactcatgctagttgcgataagtatcaacgccctgtcagtcaattttctgccattgtctccatcggaagcaatcgttgacagaagcgttcttcgtgtggtgattttgattatatcaaaagccattctgttcggattgttcggactgatactgcttttcacccgaaaaaataaaaccgaactgcatagcaacgaatggattgcattcagtgccgtttttgccgctacactgctcagtggtatatgcgtttatgaaaatgaactcggcggcgaaaacaagataatcttcttcactctgacagtagcaggtcttatcataataaacataatatcattctatatgctggtaagaatttctcgcgagcataaagaaaatatcagaaaatccatgctactcgttcagataaatgagcaaacgaacaatcttgatgaaatgcgtagaatgtatgatgaactacgcaagatacgccacaacatcaaaggtcaattaggcacagtcagcgaacttatcagaagcggcaagaacgagcaggctttatccttccttgaaaatgcgggcatttctcaggcagaaatgaatgtcctcgtctacaccgacaatgatatacttaatgctatactcggttttctcagtggtaaatgctccgcttccgacatagctctcagaaccaatgtactatcatcggatataatttactttttacctgtggatatatgtataattcttactaaccttatcacaaacgccatagaagcaagcgtttgctcccaaggcaaggaaatattacttgaactgtacgtacagcgcaattattattgtatcagagttgcaaatcagatcgaaaaatccgtcctcgaaagcaacccaatgctcataaccacaaagaaagacaaaacagctcatggctttggtgtggcaagtataaaaatgcttgccgaaaaatataacggtatgacatccttctatgaaagaaacggacagtttatagcagatgtttggctgaaattatcagatttataaattgacacttttaaagtgaatatcttattttatccccgaaaagcataatttcggggatttttgttgcaatttttgcatttcaggaagaaaaacatacagtttgggaaaaagccattgaaaaatgacgaatgtttcaattataattacaaaatgaggggagtaatttatgataaatgctattgcaaaacgaattgctaattatgtatgttataacacagaatcatctgatgacaaattatataattatgaaatttatgtgtacggatttgagatcatcctatcatctatagtagctttcggaatcgtattacttttcggattactgttagataagttaatggaactgattgttttctttctgtgcttctattttataaggcaaagaaccggtggctaccacgcagacacatattttaaatgcaatctgatatttacgttaaatatagctatagtcgcgctcataatttccgttgaaacggcgcaaatatatcaggttattttcaacggaatctcatttgcaatatgttctctgcttacatttatgaaagcaccaatatctaaccctaataagccgatagttgaatcaaaacataaaacgtttaaaattactgcttttattttggtcttaatatccgaattgatttctattacaattatgaatatatattcttactctatgagcatatcattagcactgttttcgatatcagttgctatgatgataaattctaaaacgaaagaaggtgtaaataaatgaaaaaaactgctttagctaaagtgttgagtaagatcggaacaaccgccgcaaaaaaagctgccggctccgcatcacagttcggttatcaccaggcaaaagagccgactaaccttaaaaagattagtaagtaatccctcttaaaaacgttatcattatctgatggtgacaatttttaaggaattaatcacaatcaaagtcatgactccatcgtgagtagaaaggaatttatcatgaaaattaaaaaagtattttgttctatctttataatgttaattttatcattaactattttgtcgttagcagtttccgccgatgttgctaatccgatgagaatatacagtgattcaaacctattccgtacttatatatccggagaattcactccatcgtatgctactacaggtgcttacggaacgacaaaaggaaaacatatcgagcaaatatacgttaaggctcacgaaaacgcatggcccaattctcaaatggagaaagcgactttaagaaactcaagtgtatcttctaatacaaggcaatatacttattatacttgcaaatatttttctggaggcggaaacagaactgtaaaaacaagtgataaaacaaactctgcagaatgttgtttctatggtgtaggtacattgttacaaggatattccacaagatacaaagtgttttgcatgaacaaataaacaaaatcttataattatttttcaaatcttgtatctgatttagggtacaagatttgaattatgaggtgataatatcagacaattatttaacaaaagcggcatgatgataacattctttgccgtaacgtattttctttgcgcttttctcatttccatgtttttaaattcagtaagctcaggcgtcgcaggcaggctttcggataatgcggaaataataacagttaatcaggacaacaactctgaaagcgcccttacctacagcgatttaggcgatatactgtcaaagtataaagctgtcggtgcaataaaactcgtaaccaaatacaattccggctacgccctgtttgactacgaaaaaacatcttctgaaaacagcgcaccgaccgccgtgataaagcccgaacttgagccgtactgtatgacgataaacggaagaaaaacgataaacttcatcggacagaattacaccgtcagcagtatcaacatatacggaggtaaagacagcgatttcatattgcagtctgataagctcagcggcagcacggtgcggttttcgggactgacacttataattgacaacaaagataaaacgccctcagtcaccgaaagcataaaatcagatataaccgggaaaaatcccgataccaatatcagaaccgatgatatatccaagatagcgggaaaaggcaatctctttacatcaggcaatatagttatcatcattgcgatattgcttatcggtctgcttattcttatgaattcgggcgtgttcacatggtcatggataaactccaagtgctccgaaataatggctcgccgtatatgcggtgcagatgatgcggacattaaaaaaatgatattcataaatttccttatgatctccgcagtcggcatacttatcggctttattgtcacactgctccttactcttattcctgccgtttcttattatctcggcaatatcagaatttccgcaggacttatatccgtagcgttcatccttcttatcggcggtataatttcctacagtctgagtgacaagtattcgcacgaacaggtcatttcgttaaggagagtgttatgaacaagcaacttataaaaataattcttttcgatataaaatcgaacctgctttcctgcctgcttcttacattccagatgatagtagcattctttgttataggcaatctttgcagtatcaccgcatataaaactgtaactgtgaatgcccttgacggctttgattttcccaaaaactgctacagcccgtcaagcaccgatatttacaccgacggcggaatagtggttgattatgacgacatagaaaaggaaagaaacctcagctattacatagccgaaaactataaaaccgaggggcgttccgaattctgtgaagaaaaagacggcacagactattctctgacggtaattacagagcattactttgatatattcggctttgaagtaagtaaaggacggctgttccaaaatacagaatacggcaaatatctgtcagataatccgcccgtagttctcggcagtgactttgaaaacgactataacatcggcgacttgtaccttgataaatatgaggtagtcggtatactgaaaagcggcatgaaaacaacctttttgaaaggcgacaaaagctctatcatttccgccgacgacgatgtatttatacctgtcatgagcattgaaagcatgaaagcacaaggcattgattaccccacctcacttatctatgccgatgataaatccgaccttgccgcaataaatgattacgccgcagaaaacggcatgaatacatataacttcatatctgccgatgaaacaaggcagcttattgaccttgtttctgcaaaagccgatatttcgctcatcgtcatatcatcaataatcattattcttgcggtattttcaatgatacagtcaaccctgctctatgtcagaaaaaatatccgtgaactgctcatacacatgatttgcggtgcttcacagtcggatatcctgctcaggataagcgccgaagtgctgattataaaccttgtcggcgttgttggttcatctcttatatttatgtcactccgtacaacacttgtttttatgctgacaggcattgcaacggcagtgatagccattttgcccgttatggtgagcattaagagaaaaccgcttattatgcagataaaggaggaaaagtaaatgatcagactcgacaacatatcaaagactttccgtgacggtgacacacaggttcaagcattgaaaaatatcagctttgaagtaaacaagggcgagcttgtcgcaataatcggaaaaagcggaagcggaaaatcaacgcttcttaatattctcggacttctcgacaagcaaacggacggcgattattatatcgacggcaaaaaagtatcttccataccggagcgtgaaaaagcaaagctcaggaacagtcatataggctttgtaatgcaggatttcgcccttgttgaaaagtacactgtaaagcagaatataaatatccctcttatatacacagataagcctatcaataaggaaaaggcgataaacgatgtattaaaaagcgtcggactgtccgataaaacaaacacgcctgcctacaaactgtccggcggtcagaagcaaagagtagccatagcaagagcggtggtaaacgaaccacagataatccttgccgatgaaccgacaggcgcacttgacagcatgaccgcagatgaaataatgcagattttcgaacgcctcaatatatcgggaaaaaccgtcataatcgtaacccacgacaaagacattgccgctcgttgtaagcgtgtcatcgagctttcggatggggaaattgcgaaaggcacaaattaatcaattcatgcagtaatgaaaaacgagtgtttctgcttgactttttcaacattctgagggttgccgcagcagcccttttattatgtccgaattcgtaaatacgcaaagctaaagttcagagaagcggataaatgtgacataacggtattgttataccggaagctgttgatattcggttttaaatatagtataataacctcacatgagtataacacaataacatcgtctgcgccggtgacgatataaacaaaggcagtgccgttgtatcagacgaagatattgtaatgatattcttcgctcacgggcatgctatggatgatattgcaaaataatcgaagaaaaaagaaaggcacttagtaatatgttgaaagacggactgtatgagcaaattatcaataaagggctggaaacagagctttcctctacagacaagctctctgccactgcgcctatcgacagtgcggaggcatccagagtgctggcaaaatacattgccgaagttgtagaaaaaggccttgataatgttgccgacaacggcggagatgtaaactcgcaagttgctcttgcaaaccgtattatttctacaattatcaacgaaaccaaagaaaacgagcttgatgaaatgacggtcgcagagcgggcagaacagcttctcgccctctttgacaaaaagaacagcattcttgccatagatgagaaggcggcgattatccgcccagaaacatccattgcgcaaagctcattatttacaggtgcaatccacgaaccgcagatgtttaccgagctcaagaaagaaattatatcctgtaaccgcattgatatgcttgtatcctttatcaagtggagcggactccgtcttataatggacgagcttgccgcctttacgcaaaacggcggtgaactccgcattattacaacctcctatatgggagcgaccgatgtaaaagcaatcgaagagcttcgcaaacttcccaacacaaaaatcaaggttagctatgacaccagacgcaccagacttcacgctaaaacgtacgtcttttatcgggataccggttttactactgcgtatgtcggttcatcaaatctttcaaacgccgcaatttccagcggtcttgaatggaatgtaaaggttacaagaaaggatctccccgaaacgattgacaagatcgcagctacctttgaaagctattggaactccaatgaattcgaatattacagcgaggaacaaaaggaacgtttagcccgtgcgctaaaagccgaaaaatactttgacaataacagtgccgaaatttatacgatggatattgccccgtattcctaccagcaggaaattctcgataaactggacgcagagcgtaaagtgcgtggttataaccgtaatctcatagtcgccgccacaggcaccggaaagacagttatatctgcgcttgattacaagcggttttgcaggcaaaattccgataagccttgtcggcttttatttgtggctcaccgtgaggaaattctgaagcaaagtatgtacacctttcgtgccgtactgaaagatgcaaacttcggagaaatgttcgtaggcaactataagccggagagcatagataatctatttatatccatacagacattcaactcacagagcttcacagataaaacgtcgccggatttttatgattatattattgtcgacgagtttcatcacgccgccgcacccacatatcaaaaactattatcatattataatccgcatattcttctcggtttgacagcaacgcctgaacgtatggacggtaagagtattttgccgtatttcaataatcgcatagcggccgaaattcgtctgcccgaagctatcgaccgtaagctcctttgcccttttcaatatttcggagtgaccgattctgttgatcttgataacttgaaatgggcggcaggaggttatgacaagggcgagctttctcgaatttatacgctgagcggtatgatagcaaatcgccgtgccgatcttgtaatctcatcattgcttaaatatgttaccgatattgatgatgtaaaaggtctcggattttgcgtaacggttgagcacgcaatatttatgtcggattattttaacgctcactcgataccgtcaatgtatctgaccggacattcgcccgacgaagaaagaaaagaagcaaaaaaccgacttgtaaaaggcgaagtgcgctttatatttgttgtcgatatatacaacgaaggtgttgacattcccgaagtcaacacggttttgttcctgcgtccgaccgaatctttgacggtatttttgcagcagctcggacgtggactgcgtttatccgaggataaagaatgcctgaccgtacttgattttatcggacaggcaaacaaaaaatataattttgaggataagttcgcggcgcttctttccaacacaacacgaggcgtaacacgtgagatcagggacggatttatttcacttccgaaaggatgctatattcagcttgaaaagaaggcggcgagatatattctcgataacatccgctcatcctacggaaacagtgccggtcttgtcgcacgaatagcaacctttgaagaagatacagatcaaaaacttactcttgagaattttctcgaccattatcgtctggatcctcgatcgatatataagttttcttctttctcccgcttatgcgctcgtgcagatgtgacagaaaatttcgaggaaccgattgaaaatgttatgacaaaggcgctcagccgttttgcttgcgttgattcaagacggtggattgcatttatgctccgtatcttaacaaatcccggctatccagactttgcaaagctcacggaaatagaaaagcgtatgttacggatgttctacataacaatgtggggaaaagcaatcgaagattggaccgcagacgaagtatcagaaaacattcacgcacttttaaacagccccacgatgctttccgaacttatcgcattgctcagatataactataatcgcattgatttcattgatgagcccgttgatctcggatttgactgcccactggatctgcattgctcatacactcgtgaacagctgcttgtagcaatggattttatgaaacccagtatagtccgtgaaggtgttaaatggctgccggataagaatatcgatgtattctttataacgctgaataaatccgataaagattactcaccgacaaccatgtatcaggattattccatcaacgaaactctatttcactggcagagtcaaagcacgaccaacgcagaaggcaaagtcggtcagcgatatatcaaccaccgcaaaaacggcagtaaggttctcttatttgtgcgtgaattcaagaacgatatttacggaaacactgcgccatacacttatctcggcacagcaaattacgtttcgcataacggttcaagaccgatgaatataacgtggaaattagatgaccccatccccgcaaaatacctgaagaaaacgaacaaactggtggtcggataacagtaaaagccgtgtaagctgttatgagataaagaggaatttcgatttttcaacatacaaaagaatgcaagaaggttcgaacgcattaatgttcaggttaccataaacatatattttcacctgtttcggcagtaaaaagaacgtgctgtaagcatactcaacaaaatttttgaaacgaagttgtgacatttttacagcgcccatttttgcgatcaaagcagcagaaacatcactttctattaaggataaaaaggaaaatcatcatgaattatcacgaaaattatcatgattttatcatgcccaccctacaaggtcatcaatatttgatgtaaggcaacaccgcacaattaacgccccattgccataaaaagtgacatgctgtggaattcgtgtgagttacccctcatgctcgccggggcgaacatgatattcaatttagcggtctgtttttgcagaccgtcggcgctgctattatcgttgaatctactatcgttccattttttaggatcagtccttttgctgtgagttgctctaccacctgtgaaaaaagcttttcctgcagctcgttttttgagatggcagtcttatttttttacagcgcctcggtctgtcgtttattgatcatcacaatattcttgccgtcactgcagtatcttttttctgtattctgccggagaaaatccggtcacctgcctgaactgccgtgagaagaatttttcatcatcgtaaccgcagcttactgctgtcgcatagatgctcatggcggtagaatacagtaagtagcaggctttcattacccttgaatttatgcagtcgcggttgtaacttacatcaaagcactgccggtaaatcaagcggaaatgcccctcgctgacgcacatttttctgctgacttccgaaagcttaggcatcttattaggcattgaaattatcctgtcccttatgtcggcaagttcgttataatgcggaagttttcttcgttcgcttatcagactgacatcttgctctgcattcagcgatacggctgagcgcagttcttcgaccagcgtattatcggaaccgtggtatgtgataataacctgccgttcatcgtgccgtgaataaacctcgttgtggagcgatattttcagtttctcaggaaacattccgttttcccttttgaacaggataagaaatgtgttgtcatcggtccggcagcatatttcatgctgagtgcatacacgttttattgctgacgctgtttctgcgattatatcgctgtggtggttttcgccaaacaggtattctccgccgtccgggaaactaagccttaccgcctgaatgcaaaagttatgcccggcttcctccacaatgctttcaaattcacgaagattgtagaaccccgtcagcgaatcatacagtgcggattgccgctggcattgcgtgagatagtggatatcattcttcattcgcagaaattccagcgtatccgcaacagtcttgttccagtcgcggaagctgaaatcatagctcgccgggcggttgtattccagcaccgtatacccgtaaagccttgtctgaaagcacacgggattcacatagaaaatcgcaggggaatcgtgctccgtaatgaacggcacgggagtttcgccactgctgaactttatcggaggttctgaataatcgttacctatcgcacagcacaggaactcaccaccgttgaaacgttcactgttccatgcgctgtcaaggcacagaaacagcctgtcagcgccgtgcagcaggtagaaaaactcgcttaccgctccggtgtattcctcaagagtacgcgatgtggtgagcctgccggaaaactgtgccacggtgctcataatggtgtgatactggtctatcttttccgcgacaagctcatctaaaagatgcaaacggcagacgccgcaggagcaggtgtttccgcttacgaacctgtcggaattgtcttgaataggactgccgccgagaatagcatccacagcgtcccgtcccattttacggcgatttctgcggtaagtcgtcagcagcggatagtgatatatccttcctgcggtatggtcgccgccggtcaggtcgtagcccgttactgtcagctcgccgggaatatccactcctgcctccgaaagaacatcacacagcccgaacgccatgaaatcgttggtgcatatcaccgcctgaggtcgcggaatttcaccgctgagataccgccgggcaagttcctcacctgaatcgttccagaagtttccgtaatacactctgatattatcaaagcttattccgtgctttccgaatgcgcgcttgcagccgttcagacgcttttgcgaagcggcattgtccctgcttcccgtcagtatgtcgatgtctgtgaaaccgtgaaccgttatcagatgttccgtcattttctccatgtcggtttcatcgtcggaataaacgctcttaaatccatccaactccccgtcaataacaatggcggggatttttgcagctcttattttatcgattgtatcgttgattatttttatatcccggaatgcctcggctgtgacaataacgccgtcaaataaatccggctcaatcagggagtaaattatgttctcataattcagcagattatcgtcctgccagtggttgtatatgtttgagtagaccacaacatcggtgtcttcccggaatgcggcttcgaatattccatatagtatatcgcgctgttcggacgcgtcggctcttgcggtaatgaccgctattcttctgcgcataatatcaccccgtttacagtatagcttaattccgcactaaagtcaagagcaaaagtgcatattatgactaaaaagtggattaaacgaatatatgctgttgaatttctgcattacaatgtgtataataaaataaaagcaatactgggcaaagattgtgcgtgtattgtgcaatatgacgaaaaaaaatgtcagcaagacacgtacaaaatccaataaatggtttttgcgcggtgttgccaaaaaaacaatgaggtgatgctaatgaaaataagcgaaaattgctacaagctggaaaatacggctaatccaatttctccgaatgtattctgcgccgacccgacaggcgttgagtacaacggcagactttatatttacggcactaacgaccatcaggaatacgaggcagtcggcgatgacggaaagaacggctatgctcacataaaatccatcgttatgctgtcaactgacgatatggtgaactgggaataccatggcttcatagacgtcgcaaaaattgcgccttggatagtgaattcatgggcgccgtccgtaacttccagagttgaggcggatggaaaaactcatttttacctttacttttcgaacagcggctgcggtgtaggagtgcttacggcggaacaccctctcggaccgtggagcgaccctctcggaaagccgctaatctatcagaatatgccggggcttgaaaactgtcctgcgccctttgacccgggagtatgcatcgacgaaaacggcacaggctggcttgcgttcggcggaggtaccccacctgacggtaatacgctgcacacaaacatacctaagatagtgcggttgggaaaggatatgctttcgtttgacagcgattttgttccgatagacgctccgtatttcttcgaggcaagcgagctgaactacgaaaacggaacttttatctacacatacagcacggactggcagtcaagagaaaactggaacagaacggacattccggcgccgggaacatgcagcatgggctgtatgacgagcaaaactccccttgacccggaaagctggcagttcaagggcggattcttcctaaacgccggtgattccggaatggactggtgcaacaatcacacccaccttatcgaatataagggaacaaagtacattcttcaccacacacttcacattcaggagcgcacgaaaacaaagggaggattccgctgtatgtgcgtggatctactgccttacacggatacggaattccccgtcacaaaggcaacacgcgaaggcgtcgcgcagactcagccgctcgacccgtataaagctcacagcggtgcggagatgttcacctgcgcagatatgtggtacgaacagatatccaccggcaaaatggctgtgaagtcgctggcagagggtgcatggacttacataaagggcgtggatttcggcaatggcacagaaaagctgctcgttaccgcaaagggcacgggcgttatcgagattcgtcttgatgacaggaatgccgaaccattgggagtgatcaaactcgcaaatgatggatttgataaaattcctgtggttcttcccacaaaaataacaggaattcacaatgtatattttgcattttcaggcaaggacatctgccttgaaagatggcaggctgaatgaaaggagtaactatgaacaagaagataacggctttgatttgtacagctgctatgctgcttgtttcaggctgttccgagcagaacggctcgaatgattcacctgtgcagacagaaagctctgccgacagcgtagacagtgtgagcaaagcggaaacaagcgacaaacctgacaacgaaacaataatcgacagccttaataacggaataataatcgacgaggtaagcggaaatgtctacaaaaacgagcgtaacgccaatcccatttcgccgagtatattctgcgcagaccccaccgcggtggaatatgacggaaggctttacgtttacggcacgaacgaccaacagcagtcggaagagggaacaaagaacgactacgcccatatcaaatcgcttgtggtattttccaccgatgatatggtaaactggatatatcacggcaggatagaagtcgacaaaatagcgccgtggataacaaattcatgggcaccgtcaattgcttcccgcgttgaggaagacggtcttacgcacttctatctgtacttctccaacgccggcggcggtgtgggagttattacctccaccgacccggtaggtccgtggactgaccctctcggcgaaccgctggtttatcagaatatgccggggcttgagaattgccctgcgccgttcgatccgggcgtatgcattgatgaaaacggcacaggctggcttacttttggcggcggaaatgctgcagacggcggtgttgtacataccaatgtccctaaggtagcacgtctgggtgcggatatgctttcgtttgacagcgagttcgtttctattgacgccccgtatttcttggaggcaagcgagctgaattacatcgacggcacctattattacacctactgcaacgactggcagaaccgcaacaagtgggatcgcaaggacattcctgagccgcctacatgcagtatggcatacatgaccacaaaaactccccttgacgcagacagttgggaatacaagggtgcatatttctacaattccggtcagaatgccaacggcgaatccggaatgcgctggggcaacaatcacacgcatttctgcgagtttcagggaacgaactacattgtccaccacacgctccttcttgaagaactgacaggcggcacagcaggttaccgcagcattatggttgattatctcccgatgaatgcggctgacggagagatcccgataactgccgcaacgcgtcagggcgtatctcagataaagcttcttgacccctacgctgaaaacagcggcgcagttatgtttacgtctgccgatatagggtacacagatggtaacgaccctgccgcaaagagcaaggcaaacggctcatggatctatgtaagaggtgcggatttcggttatggtgcttccgctttcaccgctgatgttaaaggcaagggcagaatcgaggttcgccttgacagcatttccggcaaggcagtatcttacattgaatttgacaacgctgattatgctaaggttcgttctactgaattcagtaagtttgacggcagaaatcacaatatctatctggtattttccggtgcggatattgaactgagatcgtggcagttcacaaagggcaacgaggaactccgtcccgaggagaacatctcagataccgagataaagtacgaaactcttatacttaccagtcaggctgtaaatcccggcccaagtccgtcggcatatctcgaaatgaccggtgacggtgagtattccgtgaagtccacctcatttgaaaaagagagcgagttgcttaacttcggtttcatcaacgttaacccggacgcaaaatacaaagtacttgtcaagtccgtaggtcttgaaacggaaaacggtatcgttgaagtccctgtaaacgcagagcttgacccgacaagcagctccgcaaatggacttgctaacggctggatgggcgctgagataggttccgtggtttacggcaccaaggaatgcggaatagttgccgcaaaaaccactgtcgactggataggctaccgttttgcgctcataaaaaacggtgaggaaattccctttacatcaataacctacaatcttgaaataagtgggcttatccttgattaaggtgagaaaatcataatttgggaggatcttcaatgaaacgtgtttctgctgttaaaatcataggaagcataggattggttatttcaatgttattaaacggatgtaccacaaatagtattacggataacaatgtgtccggaaacgaccttaccgcaacggaggttatccggctcatgggcaacggaataaacctcggcaacacgctggaggcatacaatcacaaaagctatgtggagttaggggtagaccccacttcctttgaaacgctatggggacagcccgtcaccacaagggatatgatagacgatatgaaagctatgggctttgatactctccgcattcctgtggcatggaccaatggcataaattacgagagcggagattacaccattgacgagcggctcatgaaccgtgtcgatgaggtagtcaattatgctcttgacgctgatatgtatgttatactgaatgaacactgggacggaagctggtggggaatgttcggctccgccgacgaggcagttcgtgaaaaaggaatggcactttataagtccatgtggacgcagatatccgagcatttttccgattattcctacaagctgatatttgaatctgcaaatgaggaactttgtcacagactcaacgatagcgacgtcaccggaacagaaggagttctcagcgaggacgaatgctacgaaacaacgaacagaattaacagcgaatttgttaagctggtacgttcgaccggcggcaaaaatgcagacagattcctgcttatcgcagggtacaacaccgacttcaggaaaacatgcgatgacagataccaaatgccggaggacactgcaaaggacaagcttctgctttcagtacattattacacgccgtgggactattgcagtgacggcaatgcaaaacggtggggaactcccggcgattatgaggagcagaattccctttttcagatgctgactaaattcacagacctgggatacggtgtggttataggcgaatatgccgttatgggtgcggcggataaacccgatagggataagttttacgccaatcttctggataactgcgacctgtataattactgccccgtcctctgggactgcagcgatttttacaaaagggtcctcagaaaaactaccgatgaaaacatagcaaagctgtacagcgacagacgcgcttcgaccgaagaaggcaaggattattccgagattcagtctgccgcaagggagagaatggacaagtcaacaaaggcggctgaagacgaatttatggcgggcgtatccattccggcttctgatgataccgcagtggcatggataatgtaccagagtcttgattcttcagttcagtactgtgtcggcaacaagtacgacccgacggaaaggaccttgggtatcgttgcaaacaatgctgagataaccggtgagggaacctacaccgtcagtctggatttctcggattgcggtattccaaagggagtgcttttctcggctctcggaatttacaacggcgagaagttcttcccggattatactatctctattgatgaggttaaggtaaacggcgaagtccgtgagctatccggcaaggaatatacctgttccgacgacggtaactgcacgagagtaaacctctataaccagtgggtaacatctatccccgatgactgcagatgtgccgatggcgacaattccggtctgtccgcgactgttcttccagtcaaagacaatgagatactttcgacgctggaaataacatttacttattcagcgccataaatcagattaactgtgatattcaaaatcaaaaccgacggatttcaccagcacagtgatccgtcggtttatgtgtaaaggcattggaggaaccattatgaattatacaaaatcagttgaaaaatggggcgttttcgagttttgctccgagggaaccaccgctggcaacccatttctggaacgcagtatcactgcgctatttgaaagcgattccgagcgcaaaaccgtaaatggtttttacgatgggaacggaatatacaaagttagattcatgccatcgtttgaggaagaataccattttacggtctgcgggaatttttctgacagtaaatacgaaggaactttttctgtcacgccgccgtcggaaaataatcacggctgcgtaaaggtacataacaaatatcattttcagtattccgacggtacaccttattatcctgtcggcacgacctgttatgtatggaatctgcaaagcgatgaccttatcgcacaaactcttgaaactctgaaaaattccccgttcaacaagatacgtttctgcgtatttcctaaaagctactgctacaattcacgtgagcctcgctcctatccatacgagggtactccggttgacggaagtgctatcacagaggacaatgtgtggggctacactccggattccaagggcaacaactgggattttgagaggtttaaccccaagcattttcagcatattgaatactgtatcaccgagcttcaaaagctgggtattgaggcagatattatcctctttcacccgtatgaccgctggggcttctcaacaatgacaccggagcaaaacgaactttatctgaaatacacagcggcaaggttttcggctttcagaaatgtatggtggtcatttgctaatgaatatgacctgataaaaaacaagagcattgaggactgggaacaatatgcgcagataatcgtagaaagcgacccgtatgatcacctgcgatcaatacataacggtaatcagttttacgatcatacaaagtcatggataacgcactgcagcattcagcgttctccggagggaacatccgagtggagaaaaagctatggcaaaccgatagtaattgacgaaatgctatacgaaggaaatattcagtatgcgtggggcaatatttcgccgcaagagcttgttcggaggttctgggaagcactttgccgcggcggctacggtggtcatggcgaaacctacatagatgataaggcggtatggtggtctcatggcggagagcttaagggtgacagcccggaaagaatagcttttatgcgaaaaatacttgaggaagctccggacggcggattgcgacccaaaaatatggaatgggacgagctatgtgtggttcctgaagatgaaaatctggctgatgaaaccggttatcacctgttttatcacgggatttcgcgtccgggattcagatattatcatattgacgataataatttatacactgtcgacattatagacacatggaacatgacggttgagaatgtcggaagttttaagggacgtttcagaattgatttgcccacaagagagtatcttgcggttagaattaagaaagctgagaatgggatagaataatgttcgccccgatatgtttggttctgaaaaaagaactgtgtaaatgcgaataatcccgaaaaatatagagtaacatacgcaatcctaatggcaagcacacaaaacacatcgtccagcaaaggaaaatatctgcaatacgtcaaagtattatctaacagaccgcaatgtaacacggaaaacaaaactgtactctgcgggtatacttgcttagaggacgatattttcggtgaagtggagagtttgctatgtatgagttattcaaagaagccgtgcttgcttcaggacttgatgttctaaatcaaaccttggatgttacgaaggatgactactgtcgaattaagaatgcctttttgccgggggcaagttatgagcaattcatttcaaaagcagcagatgggctgctgccaggtgctggaattgatcgttgcataacacactgtgttcttaatcacaaatgggtaaagctgtagcttgcagacggaacataaatttaagcccactcggtgaacttcagtatgaaaacgatctgtacgccgacagcatatatcaaaggctgatggacgggcttcgaaacagtgaatgttaatatggacataccacctaaaaaagtggacatatctacataccaatcgttaaaaggtttagcctgagaaaatcaaactggctctgcagcgaccgttttgagatcgttgcagagccttctttcgttaaattgtatcaataaatcccattaaataaagactttcggataaagaaaacggacaccaatcaagatacgcattgtatcaaaattggtgtcctgttatgtgaaagagcgccgtaatgatacgaaaaccaatggaaaaaagccaaaatgataaccgccagcaggatgtgcttttcccgctggcggctcgttttctcatttcacatattcctgtctgaaagacctctgccgatttctatatcgtatgagtcgtctactatctttttaagttcacagaaaaatttcattgttattcctcaaggtaccttgtgttcgcctgatattctgtcacttctgagctgtccgcaggcggcggatagctcagtgccgaattcttttcttcgtgtaacgtttatcctgttctttttaagctcgtcgtaaaatgccgtgatattttcctcactgctccttttaaactcgctgtcgggggacggattgtacggtataagatttacaaacagccgtgcatttccgataagcgccgctaactgacgtgcattctccctgctgtcgtttatgccgtcaagcagtatatattcaagcagaaccttgcggtttgtacgttcgacatagtatttagccgattctatgacttgtgagatactatacctgcggtttatcggcataagcctgtttcttatctcatcatcaggagcgtgcaggcttaccgcaagattgcacggctctttacgctttgcaaataattctgtcttgtcgcacagcccgcaggtcgatacggtaatatgctttgttcctatttcgattccgcccggaacagttactatatcaagaaaatcgcaaagtgcgtcatagttgtcaaacggctcgcctatacccatcacggttatattactaatcgttatattttgatacttttcgacagtaagtatctgacttaccatttcaccggcggtaagatcacgctgttttctgagccttccgctgcaacagaatttgcaacccatattgcatccgctctgcgttgagatacagatactgttgccgaacttctgacgcatcagcactgtttcgaccctgcacccgtccgatagctcaaaaagatacttagaagtatctacagattgtaatatttcgtcgatttttaactttccgaagaaatatttgtcggataaaagcgcttttatatcggctgatgtaagcgtcatttcgttgaagcctgtcgctttgcgcttatatatgtcacggaaaatgttggcgcactgagtagctctgaatccgttttcggtcagcagcttctccgcttgttcataagtcagcgaatatatgtccgtcattggctgtcgcctgtatcggcttcttccgcaagcgattcctgctcgatgtcctcgattatttcacggatttcttctacgccctcgccgttcatagcggaaaactctatcatatgaatgtcctcggcacagggtatctcattcataagtgattctctgcgtgcggcacgttccttctttgacagcttatcggctttcgtcagcacaacaacaaacggtatcccgttgtcaataaggaagtttatcatcattacatcgtccgcggtgggagaatgtctgaaatcgacaagctggaatacgagcgtcaggtttctgtcatcggcaaggtagccctcaacaagccctgcccagcgctgtttctcggattttgataccttagcgtagccatagcccggcagatccgcaaaatagatattgtcaaccgaatagaagttgatagtcaccgtcttgcccggcattgagcttacacgggcaagcgactttctgttcagtatcttgtttataagggaggattttcctacgttgctcctgcccgaaaaggcaatttcggctttttccgatttcggaatctggctgaaaagcccgtaggacgtataaaattctgccttgttaaaattcatgttatatttcctttacggcgttcttgcccgtctttcttgaagcacggggctttgctgacgggagcttttcgttgcttttctttgcggcggtaacattcggctttacaagcgctgtgttaagcaccgtgtcaatgttttccgcaagcacaaagctcatattgctcagtataacgtcatcaagctccttcatatcggccttgttctcatcgggtatgactaccgtcttgatacctgcggaatatgcagccatagtcttttcacgcagaccgcctatcggaagcaccttgccacgaagcgttatttcgcctgtcatcgcaacatctctgcgtacagggatacccgacagagcggaaacaagagcggttgtcatagtaacacccgcagaaggtccgtccttgggaacagcaccctcgggagcgtgaatatgaatgtccttgttcttatagaaatcggggtcgatctcatacttgcgggagagcgatcgtgtaaggctgaccgcaatttttgcagattccttcattacatcgcccagtgagcctgtaagctcaatcttgcccgtaccctccattacaagtacctcaagcggtaaaagagtaccgccgacagaggtccatgcaagaccgttcacagcgccgatttcatcctgctttgaaatagtttcgcccgtatattttcttgcaccgagatagccttcaatgtccttagccttgatatttattttatcagcctcgcccgatgcgagctttttaagcgtcatacggcagattttagctatgtttctttccagctttcttacgcctgcctctttggtgtaaaagtcgattatcgagtatatcgcatcatttgcaaaacgaacctgcggctttatgccgtgctttttaagctgtttaggaacaagatgctcctttgcaatatggaacttttcttctcttgtatagctgccaagctcgataacatccattctgtcgagcaggggagcgggaatagtatcaagcgtgtttgcggttgtgatgaaaagcacattgcttaaatctatcggtatttcaagatagtgatccctgaacgctacattctgctcgctgtcaagaacctcaagcatagcgcttgcagggtcgcccttatagtcagtacccatcttgtctatctcatcgaacaggataacggggttcattgactttgcctgcttcaacgcattgacaattctgccgggcatcgcacctatgtatgtctttctgtgacctcttatatcagcctcgtcacgcacaccgccgagcgaaactcttgcatattttctgcccagagccgttgcaattgatttagcgacagaagtcttacctactccgggagggccgacaaggcagattatctgacccttcttgtctgcgtccttccattgattgagcgcaactatttcaagtatacgttcctttacctttttcataccgtagtggtcatgatcaagctgtttttcggctttcgcaatatccgtcttaccgtgtgtgtaaatattccacggcatatcaagcactgtgtcaagatatgttctgacaacagccgcctcctgtgagcctggagaaaggtgcatcagcttttcgcactcttttatcagcttttcttcggtatcctcgtcaaaaccgcattcttcaatcttgtccatatattcaaacgcttcagactgcggatcgtcaaattcgccgagctgacgggaaatagccctcatctgctcacgcagataaaaatcacgctggttcttgtcaagtgcttccttgacttcctcgttgatatcctgttcaagacgtacaatgtcaacctcttttgcaaggaactttacaagaagctccgcacgtttacgcagtgaaaggcaggataaaagcgcctgcttatcctcaactcttaaatatacgttgaaaactatcagatcgataagttttgaaagatccttttcagcgagtatgcctctgtaaagctcaatgggcattctgggcgacatttcgctgtactgcttgaattctgtgtggatagtgcggataaaagccgttttttcggcggcactcagtgtgtcgctgagtgcaggcataggagtgatgtccgatacaagaaacggatcatcctgagatatgccgcacagcttcgctgtataaagaccttgcacaagcacacgtcttgcaccgtcgggtgtattcagcgtctgtcttatttcggcaaccacacctgttttgtaaagattttctgccgcaacctcgtcaacgtcctcgtctatctgtgtcacaaggaatattcttctgtcgttgtgttctatcgcttcttcgaccgcatttatcgaccgatccctcgctatatcaaagtgcagtatcatacccggaaatattacaagtccacgcagtgcgagcgccggcatagttatgtgttgatttttcatattagtctgtcctttcttgtcgttctgtataaataagtcgaaacatttctgttgtttactacccatattatgctgttttgtattgcaaatgtcaatacattattatactatatccgtcggaaatttgcaagtagtagccggctgtaaataaaaaccgccgtacatctctgtacggcggtcatactttatatccttatgtcaaaaaagctccggattacttgctgaacttagcgtctgcaatttcatccatagacttgcctgcatcgtcattccatgcatacagcttacggatttccttaccaacctgctcaagctgctgttcgctttcgatacgtcttactgcattgaagtgtgaacgacccatcttgttctccatgatccagttgcgagcgaatgtaccatcctggatttcgccgagaaccttcttcatttccttctttgtttcgtctgtgataagtctcttaccaacctcgtagtcaccgaactcggctgtatcggagatagaatatctcatcatctggaaaccgcccttgtagataaggtcaacgatgagcttcatctcgtggatgcactcgaagtaagcgttctgaggatcgtagcctgcttcaacaagagtttcaaagcctgccttcattaaggctgtaacaccgccgcagagaacgcactgttcgccgaagaggtctgtttctgtttccatcttgaatgttgtcataagtacgccggctcttgaaccaccgatacctgcggcataagcaagacctgtgtcaagcgctctgcctgtagcatcctggtgaactgcaactaagcagggaacgcctctgccgattgtgtactctgaacgtactgtgtgacccggtcccttaggagcaaccatgataacgtcaacgtctttgggaggtacaatctgaccgaagtggatgttgaagccgtgagcaaatgcaagtgtcttgcctgctgtaaggttaggctcgatgctctgcttgtaaaggtcagcctgtctttcatcgttgataaggatcataatgatgtcagccttagctgctgcctctgccgctgtgtatacttcaaaacctgcagcctcagccttagcccaagactttgagccgttgtaaagaccgatgattaccttaacgccgctgtcctttaagttaagagcgtgagcgtgtccctggctgccgtaaccgattattgcaactgtcttgccgtcaagcagagaaaggttgcagtcttcctgatgataaagttttgccattttaaagatctcctttaaatttgttttcggagttttgcctccgtgtattaaagcgtggcttttacagcttcatagaagccccgcctttttgcattgctatagagcctgtacggacggtttcctttattccgtacggacgtaaaagctcctcgaacgtttttatacggggaacgctgtcggataattcaagcgtcatcgtatttaccgttatgtcggaaatttttgcctttgctatctcggcgagcgagataagctcagccctctgtgacggctggcaggctacctttataagcacaagctctcttgataaaagctcctccgcaggcagatgacgtacttttataacgtctatcagcttgttgagctgtttttcgatctgctccaaggtatatgccgttccgtctgcgataattgtgatacgggagattttctcgtcctctgtaacgcctaccgcaaggctgtctatattgaaacctcgtcttgcgaaaagtcccgcaactcttgcgagaacgcctgcgtggttttctacaagtattgatatagtatgcttcataggctcaccctttacagtatagtcttttcattttcggctactctgacttcaagcagataacagcctttcgacgagagcatctcgtcaatcgccttgtccgcatcggctatatcggtaattctttttgcaggtatgccgtagctgtcagccagctttataaaatcgggactgccgtcaaggaaaaccgctgtcagcctgttgtcgtaaccgtttgtctgaagctctcttaccataccaagacgattgttggtcataacaattacctttaccgcaatgttatgctgtatcatcgtcgcaagctccataaactgcatctggaagctgccgtcgccgcatattgcgacaacctcgctgtccggacgtgccgcctttgcaccgagagcggcaggaacggaatagcccattgttcccataccgcccgatgttatgaatcgtccgtttttaagaccgatattgttgacggtccatatctgattctgtcctacatcggcgcttacaacggaattgtcggggagtttctgtccgagaagccttatgaaagccttgggattaacgcatccgtcaggctcgttgccgatcggcttgtcctgtgttttctttatttcactaagttcctgcttccagtcgtagtggtcgtaattcttcacacattcaagcagctgttcgagtatattctttacatcgcctacaacgggtatcgttgcggcaaggttcttgcctatttccgcagggtcaacatctatatgtattaccgttgcgccctcaagtctgcttattgcggtgaccgctctgtcgcctactctcgcaccgagaagtatcagcaggtcgcagttgttgatagcgtagtttgcactctttacgccgtgcatacctatcattccgtagaacaagggatcgtccgcaggaacactgctcatacccatcattgtgttaacaacaggtatatccgtcaccttcataaactctctcagcagatttaccgcacctgcggtaaagatacctccgcccgcacagataagaggctttttgctcttttctatggcggcaacggcacgctttatctgcagcttgtttccctgaatgctgggcttatatgagcgtatatccaccgttttcggatattcaaaatctattactgccttctgaacgtcaaaaggcatatctataagcacaggtcccggtctgccggagcctgcgatgtaaaatgcgtttttgaagatgaccggcatttccgcagggtctttgacaagatagctgtgctttacgaaaggctcagccgcacctgttatatctgcctcctggaaaacgtcacgtcctatctgttcacagcttacctgtcctgtgataagcaccataggtatgctgtccatatgggcggttgcgattgccgtgataagatttgtcgcacccggtcccgatgttgctatagcaacggcaggctttccggtcatacgggcataaccgcttgcggcgtgtccgccgtttacctcgtggcgcacaagcacatggcgtatatccgagcttataagctcgtcataaaacggacatatagccgcacccggataaccgaatacagtagttataccctccgcttcgagagcctttaccatagctcttgcaaccgtcattctttctgacgccatctatcgacctacccctttataagtgttgatgaatatactgtatttttatacagcaaagccgcacggtaatttttgtgcttataaataattataaccgctttacaaataaaagtcaagatttctttgcatataaatagtcgccttgagggtggttttcagtatatttttcacataaataccgctgtcggtgacgtgatgtatattttgcatacgcttacagccgtatttttttgccgataaacttaaattcaactgtatatctgccgataaatatacagagtaattttgcctgcggcggtaaaatgcggttcaggcggaaaagaggcttttaatggcgtttgaacatctgtgcggtcaggtcatgaccgacagtaacggaacgacttacataatatccgataatttttcggtcatatatcccggtgatgcccaccccgacgtatacgagtgggctgatatttctgcggttaaaatcgacaaaagcagtatcactgtcactacaggaaagcagacatatcacatacccgacagggcgtttacgggcagggcgcagtttacagcggcaaagacgctgatattgtcgcaggtatccgataaggaaacagcctgtgacgttagcgtagaggtgcttccggacaagcgcttctattcaaattacgatatacccgattcagctgtttttgcaaaaggcgaatacaatcccaaagagatacgttcttccgtgctgtcgctcgttctgggtaaaatgggcagactgctctggtgcatagggatacttgcgtgcgttgccactgcaattatttttcagatgtatatcggttttgcacaggatacatggtggtatctgtccataggcacattcttctgcgccgtaggtgcggtagtgctgacctatcttgtaatggtgcttatcgcaaagataaaatactcgggtcttatcagaagctgtgcggatagcgatgaaacgataacgtttgccgtatgccccgcaggagtatccgccgcagaggagagcgtatacagcccgcacgagataattcgcttcggaatgaatgataattatatagaaacctcgtcaatgttcatagtcacaagaagtaatgcaccgcttgtatggataccgaaatcgcttttcgacggagcggctcttgacaggatagaacagtaccttgcgctcggaacgcaggataaataagcggaaaggagcaggggataatgagtgaaagaatacccgaggtcgtttgtgaacggataaatataaacgaaagcgaagtgcttgtgttctcggtcaaaaacggactttcaaagataggcatctgcaggattaattccgaatatgataaatactgtctttattctcacgatgagccggtaatggcaataagcggaggaatgaatgatgatgacgcagacaaggtaataagcgaatacggcagtgcgtcgggcggctcgataattgccgacagcatagacagagcgtatgaaaagctggcggcgggaggctctcccgaatatgcccttgagccgcttatgagattgctttctgacggactttatgcggtaagctatgttgaaacatatcccacggcaggagaaaatatgtttttctggtcgggatacggcgtgtcaaaacagctcagaaacagcagcaggaatatcagattaatcggcgataaggcgtacagcgcaccgtttctgattcctaccgaaaagccctcgtcctatgacccctcgctgataaaaaaggcaagcgtgaaaggaacgagaaacggagatctgttcggaatatcccttcatttttcgggcctttactcattactgctgaagggacattatgcggcttgtgcggcggctatagaaaaccgacctttttatacggtacagatacagccgcttaaaaatatatggaagataacggacgaaaacgaggagattaaatccataggtttttcctctgcgtcattcagagtaccgtttgaatctctgacaaaggaacagctgagaatcggactcaccgcaagaaaatacgttaccccggatacctacgatacgataaagcagaagctggggatagtgccgaagtcaagccagaagaggataccgaagcagcttgacatattctccgagcgttatcccgatgcggatatggtagcctgcgcacaaggcatagacgagcttacaaagcctatgcttgacgctctgcttgcaggtcagaccgagcttgacggcaaggtgataatttcggaaaattattataacagcgtaactgccgcctgcaactacctgcgttatcacagcaaggacgattttattgattttgcgctgaacgttatgcgaaatccggagctttccgccacctacgcatacgttgcctccagtcttgcaaaggtgcgtgacgagcgtgtaaagcagttcttcacagaggtgaagaattcgggcgatgccggatattcaaagataatcggcacggcacgttcctatatcgacaactatgacaagtatgaggaaatttcatcggaggatttcttcaacgcactccccgagccgaaacaggaaagaaagcgtaaggaaataattcatctgaccggcgacacgaaaagtgaaggcatgataagctccgaaaccgcaaaaatgatggctgcccacatagccacaatgatggataataaaagcaaataaaatcattaccgccgtgtacatttccgtacacggcggtttgctgttgtatgtgcttttccgtaccgcacggcaaagctgtttaatgattttacttttctgtgcggattccgctgccggccgcagaagcacttgcacagatcaggcacagcggctttttcagcttttttccgctcattttatagtctttatccagttttcgagcttagccttgtctgtcatcagctttgcgccgttgaaatgaaggtcaagaccctcttttactgacgcacctttacattctacagcaatatcctttagcgtatgaccgatccagccgccgtttgtggcaaaaggatatattgtttttccggcgagattgttgctttcgataaatgtctttactgcaggtgcgaatgtgtaccaccatacaggtgtgccgagtattatagtgtcgtactgcgacaggtcaacgtttatcggctttataggaggtctgaatccttttctgatttcatcgtgaccctgttccacaacagcgtcgtaatctccttcataagccttgactgtatcgatgactgctgtatccgcatttagtgcttcggcaatatgtaaggctatatttttcgtgtttcccgaataggaataatatattacgatcgctttcattttactttccctccgtatagattttctttgcatagttgaaagctgcccacgccttaggccagcctgcatagaatgcaatgtgagttatggcctccgccatttcttccgcagtaattccgttttcttttgcgtgcataatgtggtattcaagcgagctgtcaagtacgccgcttccgataagagcggctactgttacaagacttctgtcacgggctgagagtttgtcctctcttgaccaaacttcaccgaataatacatcatcgtttagctctgcaaatttcggcgcaaattcaccgagtgcgtttcttcctgctgtctgctttttcataaataagatcctcctttatttaaattacagtgcattgtattctttgtccgaaacctgttcgcaccattcgtttgaacattcctcgccgggcatttcaatcgctatatgagaaaaccagctgtccttctttgcaccgtgccagtgctttacgccctcggggataacgatgaccgtaccgggtacaaggcttactgcggccttgccgtattcctgataccagccctcgcctgcggtacagataaggagttgacctccgccttttttagcgtggtggatatgccagttattgcggcatccaggctcaaaggttacatttgcgaggaataatccgtcctctgcctttgtcagaggattcaaaaacgaatccccgataaaatattttgcgtaagccgtgttagctgtgcctgtaccgaatacgttgagtttttcgaattcttctttggatgatattttcatctttaattcctccctttttggataatttatcgttttgcagtttaattgtacaacttggagttaactccatgtcaataggacacagaaaactttcaccataatttcacaatactaattttggacaattgccgatattctccgcccaccacgcattttttcttgactataagcattaattagtgtaaaataaaattgtataactaaggcaacaccgcacaattaacggctatcgcctttgccgcacgcttgcttgcgtattttccgtcatcttgcacaaatttcgcttgacaggcgtcagcctgcccgcactcaatttatacaatctgacgaaaaatctgactgcgcaatcgcacgacaataattatgcggtattgccctaaaaaacgggaatgaatccggagggtataatttatgcttttacatcaggtaaagctgccgcacttcaaacattccgccgaaagcgaaactgtaaagctacccatgcccgacaaggtagtgataagtatggctcagcatctcggcgcaccgtgtacccctaccgtaaaggtcggcgacaaggtgaagataggcgatgtgataggcagcagtgaggcggctatgtccgcacccgttcacagcagtatatcgggaacggtaacggcaataaccgatgtcctgcatatatcgggcaggaatatgcagtcggtcgttattgagaatgacggcctcgaacagattagcgacagtgtctgtccgcctactgtagaaaacagggagcagtttttacaggcggtaagaaacagcggctccataggtcttggcggcgcaggctttcctacctcgctgaagctcggctttgaccccaaagaaaagcagcccgatttccttattataaacggtgcggagtgcgagccttacataacctccgactaccgttgctttatggaggagggcgaggacgttcttgagggcgtgctgcttatgctgaaatatctcggtataccgaagtgcgttatcggcattgaaaagaataagccaaaagccatcgagaaaatgacaaggctatgcgaaaagcacgacaacatcacggtaaaaccgctcaaatcaagctatccgcagggtgctgagaaaacgcttatctttagcacgacaggcagagtggtaaaggaaggcacactgccacttgcaagcggctgtatagttatcaattcctctactgcggcatttatcgcacagtacataagaacgggtatgccgctcgtaaaaagaagaataaccgttgacggaaatattgtgaagaagccgtcaaacttcattgttcccgtcggaatgtcgataggcgagatagtgtattacgcagagctttccgacaagcccgacagaataatactcggcggacctatgatgggtgcgtgtgcattcgaccccgattatccgctttccaaaacaaacaacgcagtgcttatgttcgcagacagccccgtgtatgagccgtcagattgcatacgctgcggcaagtgcgtaaaagcctgcagtatgaatcttctgccgacagagcttgaacacgcatttgatatgagggacgcaaggcaacttgaaaagctgaaggtaaacctctgcgtcaattgcggcgcttgcagctttgtctgtccggcaaagcgtaaccttgcggaaaagaatcagctcgcaaaggcatttctgcgtgagcagtcaacaaggaaaggaaagtaagggtataatatatgtctaaacttataatagagccgtcaccgcacataaagtcgggtgttacgactcagaagataatgctgagcgttattatagcactgctcccagccctgtttgcgtctgtgtggatctttggactcagagcgctcataatgacagtaatatgctgcacgtcctgcgtgattttcgagtgggcttgcagaaagataatgaaaagaaacaacacgataagtgatctgtccgctgtggtaacaggtatgctccttgcgttcaacctgcccgtcacattgcctttttatatggcgataatcggttgctttgtagcaatagtaatagtaaagcagttcttcggcggtatcggtcagaactttgcaaaccctgcgataacaggcagaatagtgcttatgctgtcgttcacgtcttatatgacaacatgggcagagccgttctattaccgaaatgcaggagagatagtaacgacatcgacacctcttgtaagcgaaacgcccgcttcgcttgccgacctgttcttcggaacaacaggcggctgtataggcgaaacctgtgctcttgcactgcttataggcggaattttcttagtggctgtccgtgtaatatcgcccgtaactcctctgtgcttcatcggtacggtgttcgtgctgtcgatattctcaacaggaagccttgagggtgcgttagcgtccgttctttcgggcggacttctgctcggtgcaatattcatggctaccgactatgcgactactcccatcaccacaaagggcaggataatattcggcatcggctgcggacttgtgactatgctcgtacgttgctttggcagtatgcctgagggcgtatcgtactcgatactgcttatgaatattctctctccgcttatcgaccgcttcacagtgccgaaggcattcggtgcggcaagtgagcagaaaggcggtaagaaatgaacgtactgaaaaaaatcaagcccgtgcttgtactgtcggtcatctgtactcttatctgcgcactgctgatagttacatataatctgacttatgtcgatacgtccggcatactgacggataatctgaaagcaggctgtatcgccgcagacggcgagggcgaatatgcgcttatcaccgataaggcggcggcaaagctggacggcgaagaattcggtaatatctcaaagatagtaaagaacaagacaaaaggcacgttcctttttgaaaccgttgttgacggctatgccgcagacggtatcgacgcagtaatagcgatagacaaaaacggcgcagtaagcggtataagcattatcgctctcggtgaaactcccggtcttggctcaaaaataaacgacgatgcattcctgcagaggttctacggagtgaagtcggatatttcgatagtcaagtcagagccgaaaaacgaaaacgaggtacagggaattacaggctcgacgttttcttcaaaaggtatggcgaaggctgtaaatcttgccgtaaaggcatactcggtaatggataaggaggtacagccgaatgagtaatctgaaggaatttaccaaaggacttataaaagaaaatccgaacatggtaatgctgctcggtatgtgtcccacgctcgccattacaacaatggcggcaaacggtgtaggaatgggactttccacaacgtttgtacttgtatgttcaaatatagttatctcacttcttaaaaaagtgattcccgacacggtaagacttcctgcatatatagttatagtagcaggctttgtaacatttgtaagccttatattacaggctttcgcccccgacatctattcaagcctcggtatgtaccttagccttatcacagttaactgtatcattctcggcagagcggaaatgtttgcatctaaaaacaaggtcattccgtcgataatggacggtcttggaatgggactcggctttacactgacgcttgtgcttgtaggctctgtccgtgagatattcggttcgggtcagtggttcggaattaccgtaatgcctgaatttatagagcctatgacgctgttcattctccccgcaggcggattctttgtactcggtgccgttatagccgttgtaaaccgccttatgaagaaaaagccccgtgagatcggctgtcacaactgccccaacgcagagggctgccccggtgcctgcgacaaggcaaacagtaacggaggtgagcagtaatggaaatcgcaaaaaatctgatgataatactgctgacaggcattctgaccgagaacttcgtattatcgaaattcctcggtatctgccccttcttaggcgtttcaaagaagctcgacagctcaataggcatgggtgcggcggttacattcgtaatggtctgcgcaagccttgttacctatcctatctactacggtatacttgttccgctcggaatagagtatatgaatacgatagcgtttatccttgtaatcgccgtattcgttcagcttgttgaaatggtgctgaaaaaatatatgccgccgctttataagtcgctcggcgtgtatcttccccttatcaccacaaactgtgccgtactcggtgttacactgctcaaccttacaaaagactatgaccttttagagagcgttgtaaactcgttcggtgcgggtcttggctttatgatagctatgataatattctcaggtgtacgttcaagacttgaacgctgtgatatacctaaggcacttcagggtgcgccgataacgcttatggcggcttcgatagtatcgcttgcgtttataggcttcggcggcgtagttgacggaattttcggcggttaagcgaaaggaaagacgatgaaagaatatattttacctatacttatatttctcggcttcggcgcactttcgggtatattactgctgatagcgtcaaaggtgctggctgtaaagacagatgaaaccgaggcaaagataaccgaggcacttcccggtgcaaactgcggcggatgcggttattcgggctgtgcaggctatgccgccgccgtagctcatgacggcgctccgactaacctgtgtaagccgggcggagcggatgttatgaagaagataaatgcaataatgggtaccgagggcggagaatttatccgtgaggtagcctatgtggcctgcaacggctgtgaaaaagcgactaaggacagatttacattcacaggaacaaagtcctgcgccgctgttgagaaattctacaacggcaagggcgaatgccgcttcggctgtgacggctacggcgactgcgcagcggtttgcggtaatgacgcaattacgattactgacggcgttgcggtggttgaccctgctaagtgcggcggttgcggaaagtgcgttaccgcctgtccgaatcaccttatattcctccgaaaagaaacaagcacagttgctctgcgttgctcgtcaaaggacagcggcaaggtcacaagaacggtatgtacaaacggctgtatcggctgtaagatatgcgagaaaaaatgtcctcacggtgcggttatcgttgcggataaccacgctgttatcgactatgacaaatgtacctcgtgcggcacctgcgtatctgcctgtccgagaaagtgccttgtcaatataacctgcacacattccgaaaaggcggagcaggcggacaattaatccgattatttcaggcaaacgaaaggaaaccgacaagagatgtcaaaagcaaagagaaagaacagttcatacaagacagaacctaagaagcccgtgataaacagccgcagtgacagaatacgctatgcaaatcagaagctgtacgattatccgctgtctgtcacttggtttcgcatattcaagaccgtgataacggtactgcaggctgttatgtcgggctactcggctatagtatgcgttgtgtcggtatttgcgtcattcagcgatgaagtgcagaaacaggcaaatgccgccgcaatacccggctttattgcatacaatatcgtaatgtcggtactgcttgcggctgttgttcctctttgcgtcataatgttcagacagctttccgagctgacgcagaaatcttacggtttccttaaatttttcctcatctatacttctgcggtaaacgcagtcagcacttcggcaagcgagcttttcagagttgcgctgttcagcggtgttaaagactatgacatcagcataacaaatatacttttcgcaattttctcagtagtatttatggcagtatggctcattctgaatttaagatatttcaaaaacagaaggagccttttcagtgattgaaaggacgtaacaaaatggatgaaaacgcaaaaaagaatgaacgtgaattaagaaaatatcgtgcaaagctcagaatggattattatccgttgccgctcaggtggtttaaatttttccgctatgtgtcgatgatactcaatatcataagctgcatatcgggtataatcagctatattcttatagccgccacaattaacaattccgaagccatcgaaaagatacaggttgcctttgccgaaatatccggaatgaatatggaattattcacggtaattgccgtagcggattttctggtaacggtctatcttcttgtgctgtgtgtgcttgtgttcaaacgaatgggtacgcttgcagtctcgggatataatctgatagttacctttctgatttctgttcctgttataaacggcgtgcgacagcttatgtcaggatgccttaatgttatggtcaatccggaggtttatacattcggagatactgtcagaaatatgatagtgatgatagcattttcgggtgtcgcatcactgcttaattacatttatttcagaaagcgtaagagcctgtttacagacaaccccgaaattgacaatattgaaatcgacaacggaagcgttcagcttcagcactatgacgaatgcccgttctgccacgcaaagataaacggcaattcgtccttctgcgagcattgcggaagaaatttcaccgaaccggcggataatggtgaggataattcccggaaggaataaaaaataatgaaagttacagagttgttttcactcggagcaaatgaaattaaaaaccgtctgcctatggcaactgcggcaaagttttctactcagaagatagagggcaaaagcggaaaaagcctgctcgccgcctgtatatcacggtataactgccgtatcattccgatagcggcgatcataatgataatctgcacgtttatgtcggttctgtttgaaaatgtaattaccgacggcggctcggctgagattgcaggagaggtgctgatactgttcaccgcagtgtgcggtgtcggcttcggattttatttcagcggaaaatacccgtcatattatccttatgtattctggggactttatctgatttcatactgtataaaggtcaccggctgtatttccggggcggcgggactttcacagacagcggtaacaataatggttttcgccgccgttcccgttttcgtacctgccgcatcggcgttcttcctcggaataatccccgtgtggtatacgatactctgtaatataaacaatgtttcgggctattacccgttcacagtgtggggacttgctttgctcggctttttcatatcctgctcgatgtacagtctttacaccgccagaatgataaattcaaagcgtataaaggacgacagagagaggatgaagatgtctgcggtaatggacagccgtacagacctctataacagggcatacggcatagaaaaggcgaccgagcttctcagaagcggcaacagcatttcacttttacttgtcgatatagacaattttgcggaatacaaccgcatttacggcaatgaaaaagccgatgaagtgctttttgccgtagccaactgcgtaaagataatatcaaagcctaagacggatattatctgcagatatgagggcgatactatccttgtctgccttacggtaaaagccgataaggaggcaattgtactcagcgaagagatacgcagtgccgtaagggatatgaagataccgttccccgaggcaaaccgttaccgtaacataacggcgacagtaagcgccgcaagaggtatgcccggcgatacctatgacgatatatatgtcagggcgatgcgctcccagagcgttgcaaaacgcataggcggaaactgcatagcattcaaggaacacaccttcagacccgacggagaaaaataaacacaaaaaaaccgatgctttttggcatcggtttttcggactgtcgataaactgattgttattaaagccacacagttaaatatatcgccaccaccgccgaaaacattttcagtgccgacagggcattaataatttcgtgagtgtatcagtgcaactgcactgacattgactcttcaaaaaaacgccactaacctgagatatatgtactaacctgcggacatgtagcgttaagcgtccctgtattgacaggatatacaatgttcaggtggttattcgagtttgtccaacaccccgacggggtgggggtgtgagtaaggaaagagggagccacgagggagagaacctaagagtatagggctaagtcttgcttgcgcaagcactcggacgtttcgctttgcttcactgggctgtcaagtccagcggagctttagcggagtgcacgagccttgcgtaagcgaggctcagacttgcacctagtctctttggttctttccctcgttaatattgacaggtgtattaattcgaatagcgaacccgagaagtgttatccgacaaacagaaatatcggtagcttgctatcatagcctgaacttaatgatataacagaagtacatcaaatacaagactttttctaaagctaaaaccgatgctttttgggcatcggtttttttaatctcctgctttacagcacctttataagctcgtcataaatcggcgcataatgctcgtccgttatgccgaaatccatttccttgtacgaccataccgcacgggcgatatgaagctgttcaaatgcttcgtttatcattctgaaccagttcagtgtgctttcggggtcagctctgtctattacgccgtattcaccgcagtaaagaggaagctccagcttttcagctacctttacagcgtcggcaaacatctttacaaagaagccgctgtcaatcatacctgttataccgtcaaaatccgaagtgaaatcctcaccgaaatattttctgctgtctgcaagaagcttttcggctgtagcagggaattttgtgcggtatgacttatcaaggcgatctacccagccggcaccctgatgagtgaaaacaagcggattgtagcagtggaacgtcagcactatgttttcatcccaatcaatgtcaaggagcgtcagcccgtaaatgctcgagttgaagataccgccgatgactatttttgtttcgggcgctatttttcttatctcctttacggtacggcttgctatcttgttccacgaatctgtgaaatctgcgcttgtgacttcgttgagcagttcgaacgctatatgactgtcatttccgtaacgccttgctatctcctgccacagatatacaaactgatcctgcagcttttcgttgccgaaaaatccgcaatagctcggatcgtcaaagatatatccgcaggtcttgtgcagatctataacgatattaagaccgtgctttttgcaccagccgacacagctttcaatgtaagccattccgctttcgatgatttcgccgtcatccgtctggataacattgtaatctacaggcatacggacgtgatcaagtcccattgtggctatcttttcaatatccttttcggttatgaaggtggaataatgctcgttattgtacttggttccacactgcgagatccaaccgcccaggtctatacccttataaaatccgtcaaaatttctcatggttttcctccttgttcttttcggcaccgtacagggtcaccccctgcaatttcccttgtttacagctttattataacagcaggcaggaaaaatcaatacctgaattgtggcggattttatatatttgtgtgattattttctgccgagcgcttttgcaagatccttttccggaatgtcggtcggcgtgatgttgtagttctttacaagtatatcaagcactcccggcgaaacaaacgcaggcagagtaggaccgaggaaaatattctttattccgagatataaaagcgtcagcagtatgcagacagccttctgctcataccacgacagaacaagcgtcagcggcaggtcattcaccgaacagccgaaagcgtccgcaagtgcaagtgcgattcttatagcgctgtatgcgtcattgcattgtccgcaatcgagtattctcggtatgccttcgatcgtaccgaggtcaaggtcatttatacggtactttccgcaggcgagcgtcaggataagcgtatccggcggtgtcgcttttgcaaaatccgtatagtagcttctgctcggacttgcgccgtcacagccgccgataaggaagaagtgctttatctttccctgctttacaagcgctactatctcatccgctcttgacagtacggcattatgcgcaaatcccgtcataaccgtatgaccgccgttcatgccagtcatttccttatcctcgtcatagccgccgcattcaagagcctttgctataacaggcgaaaaatccttatcgtcaccgatgtggacaagctccgggtaagatactacagaggttgtgaaaaccctgtcgctgtagctctgccttaccggcataatgcagttggtggtgaaaagtatcggagccggaatattgtgaaattccgactgctgattctgccagcccgtgccgaagttgccctttaaatgcttgtactttttgagttcgggatacccgtgcgcagggagcatttcactgtgggtgtagatgtttatacccttgccctctgtctgttcgagcaacagctttaaatcatgcagatcgtgaccgctgaccactataaacggacctttttctatcgtcaaaggaacgacagtaggcacgggattaccgtagctttcggtgtttgcactgtcaagaagcgccatgcacctgaaattcacttcgcctgttttaagcacaagccctaacagcttgtccggatcgctttcgccctcgattgcccttagtgccgtgtagaagaaggaatttacctcgctgtcggctttaccgagtgcaagagcgtgatacgcatacgccgccatgcccttgatgccgaacagaataagcgatttcagcgagcgaatatcatcgcttgcttcccatagccttgaaagctcatagttgtcaaccttgctcttgcatatttttcgtttctcatcctcgacctctgctgtcagttcatttacagtttttgtattgaagctgacattggtgatagtcgtgaaaagtcctttcaaaacaaggcggtctgtgctgtccgtaggagtaccgcactccgccgcttttgcaagacctataagtgcacctataagctcgtcctgtgcttttgcggtatcgctttttttaccgcatacgcctgcttttccgttgcatttttcgttgtgtgccgtctgctggcactgaaaacaaaacatttcgtccataaaaattacctccttgtcctattctgcgataattgaggaagaatatacaccgataagatattcttgacatggcagacaaagagttctataatagttaatgtcggttatataatgctaacggataattccccgcaaaatgcagagaatatcggggaaaccgtaaaccgacggaggttacagatggataaaaatatgttaagtgaatatgcaaaattgatggtaaaggtcggcgcaaacgttcagaaagggcagaaggtacgcctctacgcagaggttgaccaatacgagcttgctacccttgttgcgaaggagtgctacaatgcaggcgcaagctatgtcgagatgttctggagctgcggcgctgtagaaaggcttcattacgaaaacgcttcggtagaaacgcttggtactgttcttagctgggaagaagaaaggcagaagcagatggttaaagacctgcctgcaaggatttttatagaatctgccgatcccgatgagctgagcggtattcctgcggatgtaatttcaacggtcggcaggatgcgttcaaaggtgctcaagaagtaccgtgacgagatagacggtaagcaccagtggctgatagttgccgccgcttcacccaaatgggcaaagaaggtgttcccggacgatgacagcgataccgctgtggaaaaactctggaacgcaattttctcctgcgtttatcttgacggcaataaaaactgggagcaggtgtggaaacagcataccgatactatgagggaaaaagccgattggctcaacagcaagcgctttaaatccctcagatacaatagcagtaacggcacagatttcaccgtacagcttattcccggggcgaagtggtgcggtgcggctgacataaaccgtgtaaacggagcggcttacgttcccaatatgccgacagaagaagtgttcataagcccgatgaagggaaagtgcgagggcagacttgtcgctacgaagcctctgagctggtcgggcaacctgatagacggctttgaggtggaattcacaaacggcagggtatccggctgtaaagcaaagcagggcgaagagatactgaagaagatgttcgctatggacagcggcgcttcaatgctgggcgaggttgcacttgttcctaaggaatctccgataaaccgttccggacttctgtttatgaataccctctttgatgagaatgcctgctgtcacgttgcggtaggcgagggcttccaggaggttatcgagggagccgaaaatatgactcttgacgaaattcacgctcttggcgtaaacgattctataatacacgttgactttatgataggctcagatgaccttgatataacaggaatttgcgaggacggcacagagatacccgtgttcagaaacggaacgtgggcgtgaacgtgaaatgataaaccctcagtatatgatttgtcgaatttattgaattcccaaattgcattgcgttagtattgcattgctgtcaaaaatatgctaaaatataagcgtagataatttccaaaacggtaaaggaccaatcagtaatgacaatagcgatatgcgatgacagtgttatagactgcttactgtctaaatttctgataagtgaatatttcaaaaagcacagaaagacgtgcgacatagtcacctatgaaacaggcgcaaagctgatttccgactttgaggacggagcggttttcgacattgtttttatggatatatatgtcggggaggagctgggcatagatattgcaggaaggctcagaaatgaaggctacgataacctgctgatattttcgactattactcccgaatacgcaatagcgagctacagcgtcaaggcaaacgggtatattctgaagcccttcagcaccgaaagaatagaaagcgttcttgacagagtgcttgagcattatgtgaaggactatatccggataaaagtacgcaacagctatgtcaatattatgtacagcgacattatctatatcgaaagctgcaataaccgctgtatacttcacactgccgatgaggaatatccgctttatatgaagctcgatgatatagagcagcagattgccgatgaaaagtcacgctttctcagatgccacaggagctatatcgtcaatatggatcacatcacagcagttgatgaacagttcagattggataacggcgacagcgcactgatacggagcagaagcagagcgcagatcaaaaagacttatctcgcatactcgcagtcgggtaaagtaaagcataaaaagcaataagcatccggataaaaccggatgcttcagtctgtcgaaaaacctatatcgttgataaaaatggggtcgcaggggcggagcccccgtacaggtcgtcagccatttgtgccactgcatcgtgcagtggctttgtgtggctgactgcaagcatccttgcttggactaggggcggtagccccagtaatatagccccggcttacccttaccggtaagcctgtttgctttttaccctaggaacaaacctgtcctttttatagtccacctgctatgatatactcaagacaatacaaaaagaaagcggcactttctttttgtattttccttatttccttatttcccgatgacagcctgctgttttacagtgggctgtcattgttttccgaaatatataagatgagcgttttgtgatataacggcaaaagtcttgattattacgacaaattgtgctatactaaattcgattataaactacttccgctcaaaagcggtttcaaggatgtgtcgtattgaataaggataaagaaaaatacaaacgtaccgctcttatagtagatgctctggtacttcttacatgggaaacctccaccttcggcattatatggctgaattactataacagcgagatggctttcagcttctttagaaaaggaaactggctgttattcggattgtactttgcaattctttatgttttctcaagaatatacaagggacttaagatcggctctcataagaccaccgatattatagtgtcgcagattcttgctacactttgcacaaacttcataacctatatccagatatgccttatatcacgatctatgcttgacccccgaccgcttcttgtcggaacgctgtatcaggcggtggtcatagctttgtgggcgtttataagcggaaagatattccgtgccttataccctgcaaagaacgtgataatgatatacggacttgaacagcccgcaagaatgcttgttgaaaaaatgagcaagcgttatgacaaatacaacattacccggatgatgaatgtttccgaggggcttgaagctatcactgcagagataccgaattatgacggcgtggtcatatgcgacacccctaacgagataaggaacgatatattgaagttctgcttcaagacatcaataagaacctatcttgtgccgaaaataagcgatattatcgtaagaggcggagataatatggagctgttcgacactccgcttatcatctccaaaaattacggactgggtattgaacagcgtttcttcaagcgttgctttgacattctcctgtcctcgataggcattattattgcttctccgtttatgctgataacagctattgctataaagctgtgcgatcacggccccgtgctttataagcaggtgcgtcttaccaaggacggaaaggaattcaagctccttaaattcagaagtatggttgtaaatgccgaaagcgacggcgtggctcgacttgcaagcgacggcgataaacgagtgacccctgtcggaaagttcataagaaaagtaagacttgatgagcttccgcagttgttcaatatcttcaagggcgatatgtcggtcgtaggaccacgtcccgagcggcccgagatcagccgtgagtacgaaaaggaaatgcccgagtttgcattccgccttaaagtcaaggcaggacttaccggtaatgcacaggttgtcggcaagtataacaccaccccttacgataagctgaagctcgatcttatgtatattgaaaaatatacgcttgccaaagatattctgcttatacttaaaaccgtcaagattatctttatgcccgaagaaagcacagagggcataaaggaaggatatataactccccttcaaaaaggcgaggatacgcaaaacaaggaaggaaatgacaacaatggaaactttcagtaatcttatcgatctcgattcatattcacctgatgagtggaatatgatagttgagctggcacagcagattcagaagaaccccgcactttaccgttcaagatgcagcggaaagataatgggtactctgttctatgagccgtcaacaagaacgcagatgagctttcagactgcaatgctgaggctcggcggtacgataataggatttgataatccgtcaacatcttctgtttccaaaggcgaaaatatcaaggatacaacgaaaatagtcagcagctatgccgatattctcgtaatgagaaatccatacgagggcagtgcaaaagcggcggcactcacagccgattgccctgttataaatgccggcgacggcggacatctgcacccgacgcagacgcttaccgatatgctgacgctgaaaaacgaaaagggcaggcttgaccacttgaagataggtctttgcggcgatctgcgttacggaagaacggtacactcacagcttaaggcgctgtcacgctatgagggcaacgagttcatacttatatcaacacccgagcttgctctgccgtcatatatcaaggacgtgcttaacgcaagaggctgtacttataaggagatatattctcttgacgaggcgataacaggcgaatcgctcgatatgctctatatgacaagaatacagaaggagcgtttttcaagcgaggaagaatacaacaggcagaaggacgtattccgccttgataccgaaaaaatgaagaaagcgccaaaggatatgatagttatgcatccgctccccagagtagacgagatagcaatggatgtggatgacgatccgagagcaatgtactttactcaggcaaagaacggaatgttcgtgcgtatggcacttataatgtccgtgcttgagggcaggctcggtgcgcctaagctgctgacaggtacgataaagaacgatgttgaatgcacaaaccccaagtgcatcacaaagaccgagcattatctcccccacagcttcaaggtacagggcgatatatgcgaatgtgaatattgcgacgagcgtattctgctcgactaagcaagaggaaatatatgatggatttttcaagcgtaaagagaattgttataaaggtaggcacaagcacgcttgcccataacacaggcaatcttaatataagacgtgtttcaaagctgatagaggtaatgtcggatctgaaaaattccggcaaggacgtgatatttgttacatcgggcgcacagggcgtaggtgcggcaaaggcaggacttcactcgaagccaaaagagatgccgaaaaagcaggcttgcgccgctataggtcagtgcgagcttatgcacatttacgaccgtgaatttgcaaactacaatcacacggtcgcacaggttcttcttacccgtgacgttatcagcaacaagacaagaaaagagaacgttataaacacgttcaatacgcttcttgatatgggcatagtgcctataatcaacgcaaacgataccgtttcgatacaggagcttgactttgacgagaacgatacgttatccgcaatagtggcggcgctgtgcagtgccgacctgctgataatccttaccgacgttgacggcttatatgataagaaccctaaacttcccggtgcaaagctgattcctgaggtaaagcagataacaagcgagatgataagctctgcaaaggacaagggcagtgagtttgcaagcggcggtatgataacaaagctcgaggcggctactatcgcaaaggagcacggcataccgactgtaataatcaacggtcagcgtcccgaaatactttacgatctgtttgagaataaggctgtctgcacagtattcaccgcagacgaggactgaaaggaaaaatatgagctacatagacgaactcggaaaaaaggcaaaatcggcggctaaaaactcggcaatgctgtcgcagtcgcttaaaaacgatatactcgccactatcgccgcaatgcttgaaaacggcagagatgaaataaaaaaggcaaatgagcttgatataactgcggcgcacgaaaataatatggcggcttctatggtggatcgtcttacccttaccgatgccagaatagacggtatggctgagggtgtaagacaggttgcggcattgcccgaccccgtaggaaaaattctcggcggaaacaccttgcccaacggtcttaccgtaataaaaaaatccgtaccgctcggtgtaatcggcattattttcgagtcacgtcccaatgttacggtagacgcaggatgcctttgccttaaagccggcaatactgtaattctgcgtggcggcagtgatgcgataaattcaaacaagtgccttgtcggtattatgagagcggcggctgaaaagcacggcgtcaatcctgacatcgtacagcttgtagaggacacctcaagagataccgcaaccgagcttatgaaagcaaacgaatatgttgacgtacttatcccaagaggcggcggcggacttataaacgccgtaataaagaacgctacagttcccgtaatacagacaggcgagggcaactgccacgtttatgttgaccgcttcgccgatattgatatggcagtggatatagtggataacgcaaagacacagcgtccgtctgtgtgcaacgccatcgaaaacgtacttgtgcataagaatatagctgagggctttttgaagaagctcgctgaaaggtggaacggaaaggtgacctttgtcggtgatgaagcaagcagtgcatacatcacgcttgaaaagatagccgatgatgaagactaccgcagagagttcctcgaccttaagattgccgtaaagatagtagatgatatagatgaagctatagctcatatcaaccgtttcggcacaggccacagcgagtgtatagtgaccgagtatctgcgtaatgcagagaagttccagcgtgaagtcgatgcggcggctgtatatgtaaatgccagcacacgctttacggacggctttgaattcggactcggagcagagataggcatatcaacgcagaagctccatgtacgaggacctatgggccttgaggctcttacaacgttcaaatatcttgtcaacggaaacggtcagacaagagggtaggaggaacgcttataaatggcaaaaaagaggattaagaataaaagtcgcatagaggcaaaaagcgagaacaaggttcttcacggacttgcaggctctatagaggaggcgctgtcggaggatccgagcgagatcgagcaggacgaggtcatcgttgtcgatgttcctgaacaccgccacaaagggcttgcaaagaagatagcctactttgttgtcgggcttcttatcatcgtgttcgctgtagtcggtgcggtaaataccgtaatagcgatcagcggagggataggcagaatagccaatcagaccgaccttaaggaagagttcgccctttacctttatcccgttgtcgcaaccgatcccccaagctttgaggatgcttcaacgcttacacaatcaactataataaagatagccgtttcaaaaatacttctcacgggcgacacgtccaactacgaaacggacacgggtgtaatgtatatccccgaatttgacgttgaaactgcggcaaagaatgttttcggaagcagtattgaggtaaagcaccagacggtaggtcatgtgcaggacctcgcaacctacaattctgagaaaaaggtatacatcgtggcagacacaaaccgtatcccgaactactaccccgtagtttcgaaaataagcaatgtcggcgaaacatacacgctcaccgttgattattatccgcctacggtatctatacccggtcttgtcaacgagcaggtttcaagcaagtctatgacttatgttatcacaaagagcggagataaaaagattataacatcaatcgctcttgataaggtaacaagggaagacggctaagcaagatgtaatcttgcatcagtctgtcgaaaaacctcttgcttatttaaaaatggggtcgcaggggcaaagcccccgacggggtctaggggcggtagccccagtaatatagccccttcccgaggggaaggggtttggggatagggatagagaatttgctctatttttataaatacagactttttctacaaactgagcaagatgtaatcttgcataatttccccttacctcttttgtaacaaataacaattatttaaaaccctcctgtcatttgcttgacaaagagggttttttcgtatataatcattttagccgtttaaagtgacgtaacttgaaagcgataacactttaaacggtcataattatttcttttataaggggacagaaaatgatattagcaatactcatcctgtacattctgtcggtagtcggcataggcatatactgccgtaaaaagacttccacagttaatgatttcgtactcggcggcagaagcgtaggaccgtggttcacggcttttgcatacggtacatcttatttttcggctgttatctttgtcggctatgcaggcaaattcggctggaacttcggacttgcttcaacctggataggcataggaaacgcaatactcggctcgcttctgccgtggctcatcttaggcagacggacaagagtaatgtcaaagcatcttgaatcagccacaatgccggaatttttcggcagacgcttcaacagcaaggctatgaagataatctcggcgataattgtgttcgtattccttatcccgtacacagcgagcgtttataacggcctgtcaagactgttcggaatggcgttcaatattgattattcgttctgcgttgtcggtatggcggtaattaccgcagtatacgttattgtcggcggctataaggcaacggcgcttaacgacttcgtgcagggaattataatgcttgtcggcatagttgcggtaattgcggctacgcttgcctcaaagggcggcttcagcgaggctttgaatcagctgtcgcatatcagcacggagggcacggcttctcccggtctcaacggcggattcatttcgttcttcggacccgacccgataaatctgctcggcgtaattatactcacatcgctcggaacgtggggacttcctcagatggtacataagttctatacgataaaggacgagcgttctatcagaacaggcacgatagtatcaactgtctttgcgcttgtcgttgcgggcggaagctacttcctcggcggcttcggcagaatattcgtatctgatgaggagtttgcgcagataggctcggacggaattatcccgaagatgctcgaatcgctccccgaaatacttatcggtattgtcgttatcctcgttctttccgcatcaatgtcaacgctgtcctcgcttgtacttacatcaagctcaacgctgacgctcgaccttataaatccgctttgcaagaataagctcgacgagaaaaagtcgcttatagtaatgcgtgccttcatagctatcttccttgcaatatcggtaataatcgccctcaacaagaacgctcttatctcagaccttatgggctattcgtggggtgcgcttgcaggtgcgttcttagcaccgtttatgtacggccttttctggaagggtgttaccaagataagcgtttatgtcagcttcggcgtaggcgtcatcggcaccgtactgcatatgataatcaagcctgcaggtactatactcggcttcaatgttgcatctcccgtaaacttcggtatgttccttatggtcgcaggacttataatcgtaccgcttgtgagccttgtcacacctaagatgaaaaagcttgagcttgatgagatattctcctgctacaagcagaaggctgaggtagaggtaacagatgccataccagatgccgaaaagctgaaataaacagataaatttatccgcactgccacagatgctgcacggcagtgcggatattttttatcttccttttcaaagcaaaagcggaaccacacggctccgcttcagtctgtcgaaaaaccgattattaaaacagtataatgaaatgtattgccaacaccgctgaaagcattttccgtaccgacaaggagttaatattttcgtgagtatatcagtgcaactgcactgacattgacccttcaaaaaaacgccactaacctgagatatatgtactaacctgcggacgtgtagcgttaagcgtccctgcattgacgggatatacaatgttcagacggttttacgggttcagccaacaccccagcgggtaagggtatgggtaaggaaagagggagcaagagggagaaaacataagggacagggataggggcagcagtccctctccctgatccctttggttgtctccctctttcatattgacaggtgtacccactcgaatagcgaacccgagaagtgctgtccgacaaaaagaactatcggtagcttgctatcgcaggcaaagctgaatgatataacagatgcgcattaaaaaactttttctataagcaaaagcggaaccacacggctccgcttcatacttttattgattacttatttgcttttcttcgtctgcgactcaggggctgaactacagccgtggcattcggcgcagtgaccgctgcatccgacgcagccgccgcacgagaacttgccctttttcttgtcgcttaccagcttgtgaatgatcagtatgatcaccgcaagtaaaattaccgctacgattattgaacctacaacaggatccataaagatcactcctttttaatatctttcagaatttactttgtaaccttgaccttaacgccgagcttcttgctctccttgtaaggacgaacgagaaggtagataagagcggcaaggagaaggaatgcaacgataagaccgattatgtcgcctgcacctgcaagtgcgcctgtgaacagcttgccgaagtagtttatcataagagcgattacataagcgaacccgcactcataaccgattgcaaaccagaaccacttagcgttgttcatttcacgcttgatagcacccatagcagcgaagcaaggtgcgcagagaaggttgaatacgaggaacgacatacccgttacagctgtgaagctgcttgcaagcgtctgccatacagtagcgtcgccgcttccgtaaaggatgcccattgtcgcaacgatattttcctttgcaacaagacctgtaacagccgcaacagtcgcctgccagtcgccccagccgagaggtgcgaatatccagcagatagccttaccgatattagctaagatactgcaatccatctgtgattcatcgagcattgtgaatgcaccgtctacccagccgaagaatgatgtgaaccagactacgatagttgaaaggaggatgatagtacctgccttcttgatgaatgaccagccacgctcccacattgaacgcagtacgtttccaactgtaggaatgtggtatgcgggaagctccattacgaacggagcaggatctcctgcgaacatctttgtcttcttaagaatgatacccgaaacgatgatagccgccatacctaagaagtatgcacccgttgcaatccacggtgaaccaccgaagatagcgcctgctatcattgctatgaacggctgcttagcgccgcaggggataaatgttgttgtcatgatcgtcatacggcggtcacgctcgttttcaattgttctcgatgccatgataccggggataccgcagcctgtgccgacaagtatcggtatgaacgatttacctgaaagaccgaactttctgaagatacggtcaagcacgaatgcgatacgggccatataaccgcaagcctcaagaatagcaagcagaatgaacagtacgagcatctggggaacgaagccgagtacagcgcctacaccggcaacaataccgtcaaggataagaccctttaaccagtctacgcagttaacagcgtcaagaccctgctcgataagtacggggataccgggtacccatacgccgtagcttgcgggatcgggttcttcaaatgcgctttcgccgccttcttcaaagtactttacagcgtcaagatatgtgatgccgagtgtcgtgtctttatctgcgtttgcagggatttccttgtagtaaactgtaagctggcttacttcaagtgtttcttcgtcctctacatctatctgcactgaaggattctcgccttcgggcttgtatgacttgagcgtttcaagagcagtacccggctcaaaatcgtcactgtcaggctctatcgtaacgaaaccgttaacagcctccaaagcgtcagagtaagcgcccgatgcatcctcataatctgccgagcctattccgaacaagtgccagccgtcaccgaacagtccgtcattagcccagtctgttgcggctgtacctaccgttaccattgaaatatagtaaacgaggaacattattacagcgaatatcggaagagcggcaaatcggtttgtaacgaccttgtcaatcttatccgaggttgtcagcttgcctgccgatttcttcttgtaacagcccttgataagctcagctatgtaaacgtatctttcgtttgttataatgctttctgcgtcatcgtcaagctctttttcaacgttcttgatgtcctcatcgatgtgagccattacagcgctgtcaagattcagcttttcaataaccttgtcgtcacgctcgaacagctttatagcgtaccatctctgctgttcttcgggcatattgtgtactgcggcttcctctatgtgagctatcgtatgctcaacaggacctgagaatgtgtgcataggaactgtcttgccgttctttgccgcttcaaccgcagcatctgcggcttcctttattcccgtacccttaagagccgagatctcaactactttacatccaagctcccttgaaagctcctcaatgtttatcttgtcgccgttcttctttactatatccatcatattgatggcaataacaacaggaatgccaagctctgtgagctgtgttgtaaggtaaaggtttctttcaaggttcgtaccgtcaatgatattgagtatagcatcgggacgctcctcgataagatagtttcttgcaactacttcttcaagtgtgtagggtgacagtgaatagataccgggtaagtcggtaattactactccgtcgctctttttgagcttaccctccttcttttcaacggtaacgccgggccagttacctacaaactggtttgagcccgtcagagcgttgaacaatgtggttttgccgcagttagggttacctgcgagcgcaatttttaaactcatcgggataattcctctctttcataaagccataaaagccttagctttcactaaccatttaagtttattacctgatcaaattgttgaaacgcagagattattcgacctctaccatttcggcgtcggcttttctgagcgaaagctcatagcctcttaccgttacttcaacagggtcgcctaagggtgctaccttgcggacgtatacctctacgccctttgtaagccccatatccataattctgcgcttgatagcgccctcgccgtgcagcttgacaaccttgacggtttctccgacagttgcctgttttaatgtcttcatcggttatcctcctctataataagaatcatatcatgattctttgtgccatttccttgcttatcgcaacccttgcctctttgacattcacgataaggttaccgtttacagttgtaacgacttttacgttgccaccgactacaaatcctaagttttcaagatgcttcttgacctcaggacttccgccgattttctttatgatattttcgtcaccctcagatgcgagtatgagcggcatcatagaacgtcatcctttcttttgttccgactgtctgcttatagtcttggctaaccttattagttaatgctaattaaattagaacaagctaactcgattgccaaataaaaggttagcacctgctaacaaaaaatattgtactcacagcagagcggtttgtcaagcgaaaatcaaaacgactaacgcaaatacaaaaagtttgtttattctaactcaaatcgttagtatattctaactatacgtttgtgaaaatttccgaatacccgatttacaggtgctgtaattttatccgcaattttgttatttgcgttttttcaaagaatcggatataagcaacagcacagaatgctctgctataatacgcaatgtagatttgtaatcaaaatttaatctgtttttagtttattagcctaaaaattaagtaaaaaaatttaacaaaaactcttgcatttgaagaatggctatgatatacttaatacaaagagcgatttacgcttcttaacggaaatatgacttatcaaggagaatcaagtatgaacgtaaaagttatcaacggtacatctttaccgaacattccctggcaggacagacccgcaggctgtaaggacgttatctggcgtgcagacaacaaccccataatcccccgtgaccttcttcctaccagcaactctatcttcaacagcgcagttgttcctttcgagagcgaaaagggcaagttcgcaggtgttttccgtgttgacgacaaggaaagaaacatggctatccacgcaggcttctccgaggacggcgtacactggaacctcaacgaagaaaaggttgaatggataaacgacgatcccgaaactgcagaagctaacccctggcagtacggctacgatcccagatgcgtatggatcgaggacagattctggattacatggtgcaacgcatacggctggaagcctacaatcggtgtgggctggacaaaggacttcaaggagttccaccagtgcgagaacgcattccttccctttaacagaaacggtgttctgttcccccgtaagataaacggcaagtacgttatgttcagccgtccttcagacagcggtcacacacccttcggtgatatgtacctttcacagtcgcccgatatgaagtactggggcgagcacagacacgttatggctcctatgaagggctgggaatcactcaagatcggtgcaggtcctatcccgatagagacaagcgaaggctggctggtattctaccacggcgttctccagagctgcaacggctatgtatacagcttctcagctgctatccttgacatcgacaagccctggaaggttaagtatcgttgcgctgagtaccttctcaaccccagagagtattatgagtgcgtaggcgacgttcagaacgttacattcccctgcgcagcactctgcgacgctgatacaggcagaatcgctatctactacggttgtgcagatacctgcgtaagcatggcattcacaactgttgacgaggttgtagactacgttaagaagcacagcagtgtttgacttacagacaaagcataaagctatcccctccgcttttgcggaggggatttttgcgtttatatgcggcttaaatcctgcggattatatacccattatctctttttcttcggcagtgagctttgaagcgtatactgaatacccttcttctccgtaactgttcagaactatatccataacctcacggaaaatgtaccgccttgctttttctgaatttaaaaacagctttttgtcaagcgtttcgccgccaaccgtgtgacagcatacataaaatataaattcacgcttcgccgttatcgtgaaatgttcgcagtagcaattacccgtgaacgaataaaccggcggaatatcaagctcccgaaaacgttcttcgagagcctttaattttttcggcacacttttatgcttggcaggcttatctgtaccgtaaatttcacggcacatacttctgtctgaaatatgatttttgtaaagctgaatgatgacacagacaagcgccatgaccgctatgaccgagccgattataagcagtacagcgcctaaaggcgaatcggttatccttgagccgtccatattatacctcaatgattgttaatgcgtgtttgtgtttgttgtatctgttgtgcttgctgtactcgtgccgttatgtacgggaacagtgtaatcctgcggctgaataggtgcgccgcagtgagggcaggcgttgcagctgcctatggtatagacgcctccgcagtattcgcaggaggcctgtttcattacgacggattgcggctgcggtgcagtctgctgaggaggagcatagtagccgtcaagaggtacttcctttgcacccttgtatttatttgcgttaggtcggaagaataccataaagaatgcgtgtatgcagacgaacaggagcataaagattcctattccgaaggtttcgccctcaaatctgaacttcattacagtaggagtaagtgcgttaaagctgtcggtgatagcgtcatttacctttgttccctcgacaagcagcctcttgtgcagatcgtttgtaaaatcgtatgctacggatgaagtaatgatactgtcggtatcatcgccctgcataccctcccagtaccagttgttgaattcgtcgtcgggatctttcggctgagaatacactatcagccagtgcttttcgtcatagaaccggtttacataaagctcataagcgtacttctcaaggtcggtatagttatcctcccagtcggagttgtacacagtcattaccgcaggagaaatacccgttgtgttgaagaaatcctcaagtgcgtcgccgagcttcgttgtatctccgagtacgttagcgtcgtcctgtataactatctgcgagttataatcgaccttcagcttttcgggtacgccgaaagacgtaaatatcatcaagaacgccgccagaacaaacggtacatagaatatgagcattaaaaatctcagcttgctcggaccttttgaaaggtcggtatccgagtagacgtagttcggaacgccgtttctgtagtagacgaatcttcttgcaccggggaaatatgtgcggctggtccttattctgcttgagcttcctcccgatgatgaacggtgtgacgagctgtgcgatgaggaggagtggtggcttccgcccccgtgagagcctccgcccgatgagtgtggcatattataccttctttcgtgtgacttttgatattattctaccataaattaaccgtcaaatcaagatataaagctattctgagtgacggctgaaaactgtaaagcgttaaaaatcgaatgtaaagttgcacggcaaaaatgtaaagtcggtgtatagtttggctttgctgtgcggaatatgcggctttacaaaaactttacctactttataccattccttgctttaatgtaaagcccgttgtgactataatatgaaatgtagtcgggagggaaaccgaacggcagataaaaatgtacataaatattatggagtatcaggaaaactccgaggggtatcacccttaagaaaggaaacaacatgaacaagaagttactatcacttatcgcaggcgcagcaatagttgctgcagcaacaggctgttcaggaacagcaacaagcagcgtaacaggcacatcttccgcagcaggcacatctgcaagcgaagcatcatctacagctgcagaggagctcagcggcacactgtcaatgaacggctctacatcaatggaaaaggttatcaaggctgttaacggcgcatttatggaaaagaacaagggcgtaacagttaacttaaacctcacaggttcgggtacaggcatccaggaagcctcagagggcaagtgcgacatcggtaactcgtcaagaaaactcaaggatgaagaatctgaaaagcttgacgctacagtagtaggacttgacggtatcgctctcgtagtaaaccccgcaaacaagcttgaagacatcacacttgaggatctcgctaaggtttactcaggcgagatcacaaactggaaggagcttggcggcgatgataagtcaatcgtagttatcggccgtgaggacggttcaggtacaagagacggtttcgagtctatcgtaatgggcgacaaggaaccgaagtacgcacaggaacttgagtctacaggttcagttatcaacgcagtagcaacaacagacggcgctatcggttacgcttcacttgcaaacgttgacgaaacagtaaaggcacttaagattggtggtattgaagctacagaagaaaacgtaaagagcggcgcttacgaagtacagagacccttcatctgtgcaacactcaagggttccgataacaagctcgttaaggcttaccttgacttcattctctcagaagaaggtcaggcactcgtacttgcacagggtgcagttcccgtaaagtaaaaaacaagtcgataattcctatacagtaagcacttttccggtagcaatccgttaccggaatttgctgtataagtatgtatagccctgaaaggatggtttacttggaaaagacaagcggcgcagcagttgcggtaggctcggtcggaaagcagagatctgctataagaagtaaaaaatcgggattcacaaacgttacagaacgtgtaatgaagtacatatttaccgtatgtgggatcacagcggtagcgtgcgtcctgatgataacaatttatatgataatatcgggtgctcccgccataggaaaaatcggattgaccgattttctgttcggcgacacatggtacgcaaagaaagaacagttcggtatccttccgctgattctcacgtcggtattcggtactctcggcgcaatagtgatcggtgttccgataggacttctcacagcggtgttcctgtccgagcttgcacctaaggcgatgaagaacgtagtaaagcctgcggtcgagcttcttgcgggtatcccgtcggttatatacggtttgctcggcgcaaatcttgtaaagccgcttatgtacgcactggaggagattatttacgcaaatgatcctacacatcagttcacaggcggcgcaaacctcgcaagtgcaataatcgtacttgccataatgatactccccactatcataaacatttcggagaacgcaatatccgccgttccttccgaatacagagaggcaagctacgggctgggagctactaggatacagactatcttcaaggtagttatccccgccgcaaagtcgggtattgcgtccggtgtcgttctcggtgtcggcagagcgataggtgaggcaatggctatcatccttgttgcaggcaacagcgcaaatatgccggagctgttctcatcggtaaaattcctcacaacaggtatcgttgccgaattcccgtattcgagcggacttcacagagaggcgctctttgcgataggacttgtgctgttcgtgttcattatgataataaatctgatactcaacggtatactcaaaaagggcggcaaaaaggaaaaagcggcaaagaccgcaggaaaggcgtgatagattatggcaaaagcagttacgaattctcttactaaaaagcgcagaagagtaagcgacatagtgctgaagtctctgatttttctttcgtccggcatagtcgttgcgctgacgctcggtatgattatatacatagccgtaaaaggcacagagggaatgagcttgaacttccttacaactccggcgttctcatatccttatgaaaactacggcgtactcggcaatataatcaatacgctttatcttgtagtgattacgcttatcatcgcaacacctgtcggcgtaggtgcggcaatatatcttaccgaatacgcaaagcagggcagacttacaagaataatcgaattcactaccgaaacgcttgcaggtatcccctcaatcatatacggacttttcggcagtgtgttcttctacaatatcttcaaggtaaactactcactgcttacaggtgcgctgacattgtcaataatggtactgcccaccataatccgtaccacgcaggaggcgataaagaccgttcctatgggctacagagagggtgctgtcggacttggcgcacctaagtggcatactataaggaccgttgttcttccaagctgtatagacggtatactgacctcggtaattctgtccataggcagaatagtaggcgagtctgcggcgcttatcttcacagcgggtattgccgctgaggtaggtataaattcgctcggcgatattttcggcaaggtgatgaatcagggcggctcgctcacggttcagctttaccagtacgcacagcgtggcggtgccgaaatgaagtacgcattctctacggcgcttgtactgcttgtaacagtacttataatcaacatatgcgcaaagctggttgcttacagaataagaaagaaacgctcggtataatgccgtgaaaagaaaagaggataaacaatgtcagatataatcgtacctcagagcgatgtgaagctctgtacaagaaatgtgaatctatattacggagaaaatcacgctctcaaggacataaaccttgatataaagacaaataagataaccgcctttatcggtccttcaggctgcggcaaatccacatatctgaaaagccttaaccgtatgaacgatctgataccggattgtaagataacaggccggttcctgcttgacggcgaggacatctacgctgacggcgttgatactaacgtactgcgccgcaggataggaatggtgttccagaagcccaaccccttcccgatgagcatttacgataacatagcatacggaccgagagtacacggtataaagagcaaggcaaagcttgacaggatagtcgaggagagccttatcggtgcggctgtttttgacgaggtaaaggacagacttcataaatccgcactcagcctttcgggcggtcagcagcagaggatctgtatcgcaagagcgatcgccgttcagcctgaggtcatccttatggatgagcctacatcggcgctcgaccctgtatcaacgcttaaaatcgaggagcttatgaacacgctcaaggaaaagtacacggtagctattgtaactcacaatatgcagcaggcaacaagaatttcggattacacggcattcttccttgtaggagaaatggtcgagtacgcaccgacagaagaactgttttcacgtcccgttgataagcggacggaagattatatcacaggacgtttcggttgattttatacgttatgtgtgatattatattagaaagggtaaacagaaatgagagaaacatttgaacataagctcggcaagctgaataacgatcttatccgtatgggcggaatgatagaggaggcaatagcttcagctatcacagcactgcgtgacagcgatgccgttcttgcaaaaaaggtagtagacggagacagagcggtagatgaggaagaaaagaacatcgagagccagtgcctgtctataatactgcgtgaacagcctgtcgcaagagatcttcgtaaggtttctgcggcgctcaaaatggtaactgatatggagcgtatagccgacaatgccgcagatattgcggagatcagccttaccgcagacgtatccgctatcatgcacatagtaaaagagattcagactatgagtgaaaaggtaataataatggtttcacactctatagattcattcgtaacaaccgatatggagcttgcgaatgaaacgataaaggctgacgatgaggttgacgagctgttcgtttctataagaaaccgcatagtagagcttataaagagcgagcattgcagcggcgatgttgcggtcgatgcccttatgatagtaaaatatcttgaaagaatagccgaccatgcggtaaatatctgcgagtgggtggaattcttcaagacgggagaatacaagaatacccgtattatataaactttggaggctgatataatggctgaacgtatctatattacagaggacgacgacagtataagagagcttgtgacggtagctctttcggcttattcatacgaggtggagagctttgtcagtgctgaggattgccttgccgcagccgaaaagcaggtgccggatatattcctgttcgacataatgctgccgggtatggacggtgtgcaggcagtgaagattcttcgtgaaaacgagcagacaaagaatacgccgatacttatgctgacagcaaaatcggccgagatagacaaggtgttcggacttgaaaacggcgcagacgattatctcacaaagccgttcggcattatggagcttgccgcaagaataaaggcgcttttaaggcgttccggcagaagcacatcagacagcgcttccgataagattactgcaggcggcataacggtaaacacatctctcagagaggtgagccgtgacggcagaccgatagagcttacgctgaaggaatacgagcttcttttgtatcttcttaagaacagggcaagagtagtcagccgtgaggagcttctcacgaaagtgtggggtatagattttgtcggtgaaacaagaacgctcgatatgcacataggaacgctcagaaaaaaactcagcgatgatgccgagaacgctcatcttatcaaaacggtaagaggagtaggctacagatttataggagaataacaggagggcgtacagatgaaaaaagcacttatagtacgttttcttatagtaattgcaatagttatgtcagtgtgcgttgtatctgctaccgcacttctttcaagcacggagcagaacgtcagaaaaagcgatatgctgacttctctcggacttatccgtgtgatatatgaggacgaaaccgaccacgactatgaccttgcgaacagattaagctcacttgtcggaaacgccagagtgagctttatcaataaggacggaactgtatttgtagacacctatatcgacggtgagccggacgataaccacagcacccgtgaggagataaagcaggcagagcttacaggaagcggagtagccgtaagatattcaaagacgctcggcaaaaatcagatttatgccgctatgaaggttaaggacgacgatataatcagaataagctacaatataaacagctatatggattttgcgtcaatgttcatggcgcctatgctgatagccgccgcaataggcataatagcagggcttatagcggtgagcagtgtcgcccgccagataatgaagccgataaacagcatatcaaaggctatgagcggtatgaaatatgtcggtgacgaaaaaatctctgcggagcttgacgagataccctcgcacaaataccccgagcttgatgaatttgtcacaatgttcaattttatgcgtaaaagcatacaggataatatgaagacgcttgaaaacgagcgtgaaaaggaacgcttcatacttgaaagccttcaggacggtgtaattctttacgataacgatctttcggtaatttcgataaaccgtgcaggtcttaagctgctcggtgcttctgaggaaagcggcgccttgaccgtacccgagcttgcaagaaagcccgagataatcagcggagcggaaaaagcggcaaacgaagacaggacggtaactatagaaagcaccgttgacggaagaattttgctcgtgcaggtattccccgtatccaagagcggaatagatgcaatgcacggcggacttatggttatccgtgacgttaccgacaagcgtatgtccgaacagctcaaagccgacttcttcgcaaatgccggtcacgagctgaaaacgccgttgacggcaatttcgggctttgccgagcttcttgaaaacggacttgtgcctaaggataagaaggattattacatcggaaaaattcttaccgaagccaagagaatgtcaacgataatcagcgacattcttgaaatatcctcccttgaaaataagaccacagccgaggaagtaaccgactgcaagctgtccgagatatgcacagcggtaaaggaatgcctggagcctgcggcttgcgcaaagaacgtcacgatagaactgtcaggcgacagctttaccgtccgtgccgcatacaagcacatatacgagcttgtcgaaaacatagtcagcaacgctataaagtacaacaaggacggcggcagagtagagataacgcttcacaatgtgggcgagacaggctgtatctatgtaagggataacggcataggcatccctaaggagtcgcttaaccgtgtatttgagcgtttctacagagtggataagggcagaagcaccaaagagggcagtaccggactcggcctttccatagtaaagcatatcgtcaactgctacggcggcacggtgacgcttgacagcgagcttggcaaaggcactcttgtctgcgtaagactgccgattgcaaagaatatttcggagtaaccgcatatttgatttttcgcttgacacagcgttgcatttatgatacactaaacatataatgaagcataagtgcaaagaccgtgtatggcaagagtaaccgggaaaaaagtttcacagagagccgtgtaaggtgaaagacggcagactgatttacggtgaagtgcggctgtacggattttttatccgggtcggcagagggaacgttagacttatcagtatctctgcccgtgtagtctgcgttaaagacataaagggagtgtaagctccgaagcgaagtggaaccgtgatagaaatatcgccttcgtctgttatgcagacgagggcgtttttattttcggagaagggtaggaaacatatgttcgataaaattaaagcggatataaaatcggtcagagaacgagatcctgccgtaaagagcgatctcgaggtgtttttcctgtatcccagcttcaaggctgtaagggcataccgcagggcgcataaatggtaccttaaaaagcattatttcattgcaaggtggatatcacagcgtgctttgcggaaaacgggtatagagatacaccccggcgcaacgataggaaagggcttgttcatcgaccacggaagcggcgttgtaataggcgaaactaccgagataggcgactactgcacgctttatcagaacgtaacgctcggcggtactggtaaagataccggtaaacgtcaccccacgctcggcaacaatgtaatggtaggctcgggagcaagggttctcggtcctttcaaggtgggcgataacgcaaagatagccgcaaatgccgttgtgctgtcggaggtaccgcctaactcaactgcggtcggcgttcctgcaaggatagtccgccgtgacggtcagagggtaaatgcctgcgaccttgaccagatacacattcccgaccctgtggcacagcagatatgtgccttgcagagcaggcttgaaacaatgcagagcgagatagatctgctaagagaagaacttaaagaaaacaatattaaataaaagcgaggataagaaaatgcagttatataattcactgtcacacaaaaaggaagaattcgtgccgaatgtcgagggcaaggtaaatatgtacacctgcggacctaccgtgtaccactttgcacacataggaaatctgcgtagctacattatggaggatgtgcttgaaaagtacctgcgctatgtcggctatgatgtaaagcgtgtaatgaacattaccgatgtaggacatctgacaagcgacggcgacacaggtgatgacaagatgctgaagggcgcaaagcgtgagcataagacggttatggagatagcgaagtattacacagacgctttcttcgaggactgcacgaagctgaacatcaagcgtcccgatgttgtagagcctgcaactcactgtatcgcagatttcatcaaggtaatttcttctctcattgaaaagggctacgcttacgaagcaggcggaaatatctattttgatacctccaaactcgaaaagtattatgttttcaacgatttcaaggaggaagaccttgcggttggcgtccgtgaaggcgttgaggaggacggcaacaagagaaacaaggccgacttcgttctgtggttcacaaagtcaaagtttgacgatcaggaactcaagtgggacagcccgtggggagtaggctaccccggctggcatatcgagtgcagctgcataagtatgaagcatctcggtgaatatcttgacattcactgcggcggcatcgacaacgcattcccccaccacacaaacgagatagcacagagtgaggcttacctcggtcataagtggtgcaactactggttccacgttcaccacctcaatacaaacagcggcaagatgagcaaatcgaagggcgaattccttacagtatcactgcttgaaagcaagggctacgaccccgtgatataccgtttcttctgcctgctgtcacactacagaaagtcgctcgtattcacttacgagaatcttgataatgcaaagggcgcatacgaaaagctggtcgctaagatagcacagcttttaaaggcggagcagggcgaggttgacaaggcggcttacgataagctccgtgagggcttcaccgccgctatggacaacgatataaacacatcgcttgcaatcactgcgctgtatgacgtattaaaggctgacacaacacccgcaacaaagctggcgcttatcgctgacttcgacaaggtgctttcgctgtcgcttatcgaaaaggcaaaggcggtaaacgaaaagcccgctgatacaaatgatgagcttcctgccgaaattcttgagcttgccgagcagagaaagcaggcacgaaaggataagaattttgcacttgccgatgagcttagagataagataaccgcaatgggctataccgtagaggaaacaagacagggaacggttataaaaaagaagtaagcaggttaatatggcaaaaacgagaggctgttctttattcaggagcttcccacattaacattcaccgcagtgtttccactgcggtgtttttgcgtttgtggttgcactgtcggcgcagttatggtaaaatgtaagtacaaaataatacgggaggcagttatgaataatattgataagctcacgcaaaaaatattcagcaaattcaatgacgattcgttattctattgcaatatatatctgaccggaacggaagaaaacaatgcggttgttctctttgatatggaaggtttcattttaaaggtttgccttgacaaagttaaagccgaatatacaatgcctgaagacagctatgtgcttgttcctgagatgtgcattgatgaaaatgaaaatgtgattcatttctcagtatggagcgaagaacgaggtgaagaagattttgaactgaagtttgattgcgcaaatgcggaaatgatgccgtgcaggaaaacatattactccgatggcgtatgggatatagtagtctgtatggcggctaatatatatgacagatacagctttgatgaaacttttatcagcgaagctgagcgtaattacctaccgcttgtgcttgaacttatggaaattacagacagctctaaagcgaaacctgaattgccggttcttacagcacgttttgttttttcttcctgttttgcccataaaaatatgcacctccaaatgtgtctaacttttggggtgcatatcaaaaagagtatccgtttttttatgctattttttaatatcaacaaacacaagctccggtcggttgaatatcctcggtaccgctatcaatgttgacggcttccaaagccctctgctgacaatatgggcggtgtcgccgtgcatataaacgcctgccgtgtatttcgggaatactccctgaccgggcgcaaaaacgccgtcaataagtccgggtattctccactgacctccgtgagcgtgacccgacagaactatatcaaagttgccctttaagtattcgtctatctgttcgggaaagtgagcgataagtattcttgtacgcttgctgtctttttccgaagtcacggcatcaagctggtttacaagctcgccgtttacctcgtcataggtgtgagcatcgtatattccgcagatttcggtttcgtttccgttgatattaatgaccgtaccgtttccttcaagcacggtaactccgaagtccgacatctgctgttttatccttgcgctgtcgccccttgcattttcgtggtttccgatagtgtagaagcacggataacgctttacgagatatttcacaagaatgtatgaattttcgggcaggtcgtcctgcgttttatccgcaagatctccgccgaatacgactatatcgggttttgcaccgtctatcgcatttttaagctccgactgacttttcccgaaaaggctgttgtgcaggtccgaaacaaatgcaatgcgtacaggcgatgatactttcccgctttttatctcgtaggtcattgtctgcagccgcatatcacaggcgacaagtccaaaagcggcaagagccgctccagcaacgcctgcggcacagcctacagctattcttttctttgtcttttttgtgagcgtaaaatcacctcttagtatccgcccgagccgtcaaggcgggggtcattttctatccagctttcaacattgatgaccttgtattcgtttgctgaggtgcggataaatacatccttgatacctgcgtttattataagacgcttacacattgagcaaggctcaacctctccgcagagcgtgccgcctgaggtcatatcgtgacaggcaaggaaaagcgaagaacctatcatatccgtccttgaagcactgattatgcagtttgcctctgcgtgaaccgagcggcaaagctcataacgctgacctttgggaacgttcagcttttcacgggtgcatattccgaggtcggaacagtttttaaggcctctcggcgcaccgttgtatcctgtggcgattatctcatcgttgtgtactattattgcaccgaaattcctgcgcaggcaggttccacgctcacataccgtttcggctatgtcaaggtagtaatttatcttatctcgtctttccatagtttaacctttctgaaatagggctgagcttgtatcaagtctaatataacacatataccgcctgtttgtcaattaaaagtcgggcgatgatatgaaaaaccgccgtggaaaaatcacggcggtagtctgttgtaaacctcttgtttactaaaaagtggggtcgcaggggcggagcccccgacagggactaggggcggtagccccggtaaaatccccctttccgggggaaagggggcaagggggatagggatagtaagtcagaagtttatttcaaaaacagacttcttttacggacttaccgccgtgaaaaaatcacggcggtaagcattaatctgttttctttgcgtcggggagcatatacttctcactgaaaacagtgaactttttgcggaactcctcgttgtttgtagccttgaggtcgctgatatagctgtgtgtgtcaaagctgttgtcatgtatctgtatcatacagactgcaatatttgagcagtggtctgccactctttcgtaattcgtgataaggtcggtcagcacaaagcccatttcaatggtgcattttcccttacgcagacgcttgacgtgtctgtttctaatctcggtacgcagattgtcgattacttcttcaagaggttcgaccgattttgcctgctcaatatctccatgctcgaatgccgtaatggcggtatcgagtatttcgtttaaagcaccgttgaaaatgtgtatttcctcaatagccttcttcgagaacgaaaggcccttcgtatgcatttcctttgcacattcactaatattgacagcgtggtccgatatacgctcaaagtcgctgatgcagtgcagcagcatatttaccgtctggctgtcgccgggggtaaggttcttggaacccagctgtaacaggtaactgccgagcttgtcctcatagacatcgactttttcctcgttctcgtttactatttcgacatcgcgatcgttatatttggacataagccccattgagagcttcaatgtatctcttgcacagtctgccattctgacagctattgacttgcactgctccagagcaactgagggagttgcaaggaaacggggatcaagtatctggaactcgtttgccggagcactatcgttcttcttgtcacgcactgagatatatgcgagcttttcgagcagcttcataaacggcaaccagattatcgttgcaaagatattgaatacgctgtgcattatcgctatgcctgcctggtttgcagactgttcaaagaactcgaaggggaatatagcgtttattatatagaacagtatcataaatactatagtgccgatgaggttgaagtaaaggtgaacaagtgcggcacgctttgcgttcttgtttgcaccgattgcagaaagcagtgcggtaacgcaggtacctatattctgtcccatgattatcggcagggcagtgctgtaagtaaccgctcccgtagcgcacatagcctgcagtatgccgacagacgcagacgaactctgaataacggctgtaagcacagcgcctgcaataacgccaagcacgggatttgagaacatagtgagaatgctcttgaactgttcgttgtcagccagcggcgcaacggcggaactcattgtttccataccgaacataagtatcgcaaaacccataaggatagtacctatatcctttttcttgctggattttgacatcattataaagaaaatgccgattatcgccagtataggcgtgaaagatgtgggcttgagcagctgcatgaaaatgctttcaccctgtattcctgtcagtgacaacagccacgatgtcatagtagtacctatattggcacccataataacaccgatagcctgcgacagcctcataatacccgagtttacaaaaccgactaccattactgtggttgccgatgatgactggattactgctgtgactaaagctccgagcatgatggctttgaaagggttggaggtcattttttcgagaattcgctcaaggcggcttcccgacagcttttcaaggccctgtcccattgcgttcataccgaacaggaacagcgcaagtcctccgaccatagtcagaatgccgaaaatatccatagttttcctttccagacttgtcttcttttgattttttttgctttgccgtcggatatgcggcaagcgttttcttttgttcttatgccgtatccgtcttactttgccgttacatctttgtaacggcgatattatagccggattacagcttctttacttaaaatacatacacagacttatccccgtgaataaggttttcgtcttatacgggggtccgctttatatcagattttatattacggcaagcgtgaatacaactgtgccgaacgtatattctacgggtattgtaagcgtgaacttcgattttataccgcttacagccgatgatgtggccgtttccggcggattaagtcctatttccttgcctgtagtttcggaaatattgacgttataaagaccgttgctgaggtttaagaattcgctgatagcgtcatttgcatagtccatatcggttatttcttcctctgcaaaacggcttgcaaatactgcggccgccttgttgtcggctgttatagccgatactgcgttgaaatcgccgcaaaactcctgtatgaccgccgtatcgttgctgtctgtaacggctgactgtaagggggtaaaatcatcgcctacaaaacggataagattcttgaacagaacatttacatattcagagcaataatccttgtattcgccctcgatagcgaagaaagaagaaataacgttttctgtcttttcgttgcttttgctgctgaagtccttgtcggtaagtctgttttcttttttgtagtcgttgagaacggtttcaaactcctcgtttgtaagacagcccatatcaacgagcgcctgtccgagtaaaaggcatccggtcttctggctcgaaagaagctcttcgacttgcgcttcggtaagatagcccatatcaacggcaatatcgcctattctcttgtctactgttgcctgcttcttatgtactgcatcaacctgctttgccgtcatatagccagcgttgatggcaagcacgcccagctttactcttgttgtgtccttcttttcgagtgcaacacggagatttgcgggtgaaacgattttcctgtttaacagatagctgccgaaaaactgtgtgaacatcgcttaagcctcctttttgaaatagttgtcaaggagcttgtaaagctgttcttcgtcaacaggtttctgtaaaaagtcgttagcgccgagcttgatagcctcggagagattacctacggtgccgaccgatgtagccataataacaacggcgtcgggcgaatttgtcttgatcagcttgagtgcctcaactcccgaaagctcaggcattacaatgtccataaaagtaacatcgggtacgatgtctgcaaacttttcaactgcctgcgcaccgtcgcttgcttcaaaaatctgagtgaagccgtatgcggtaagaagttttttcatcttgtttctgaccatcattgagtcatcgcatacaagaacctttgcttttgaaatatttttttccatatttcttttccttcctgacctctgaatttatatcataataatatttacccgttttaaacgccgaatacaaacagatagctcagcgcaaaccattcccgtacccagtaaacaggaacaagataccacggtgtagcggcgctgacgcatttaacgtcatagccaagactttcggcttggagccttgcccgccactgatgaaagccgtcggtcacgatggctatcctaagcggcttcccactgtcttcaagtatctgttttgaaaacaacaggttttcgtaggtgcttgaagacttgtcctcttttgtgatacggttttccgatatgccgtcatttacgagcgcctcatacatagcttcggcctcgctgatatgctcgttatcgcccttaccgccggaaacgatgcagtcggctttagtatccgccgacagatagctgcaggctgcgtcaaggcggcgtctgagcataaggctcggaccgtcacgtcttacctgacagccaagcactattaccgtgcgtgagccgtccttttcgggtgcgtcgttcatatttgcaatcataaaagccgagagcgttatcgcatataccgcaagcacaccgtatatgataagcacggcacggaagatatatctcacagctttttttgcgttgctgaacagcttcggggtgaatatgccgagaagcacagttacaccgcctatcacaaacccgaaataagagcctgtgttaagcgttccgctgaaaagcggtattatgaacattgccagtaccgccgcacctgtgacgatgagcgtatatgacagtatccttaccggttttgatgagcagtccgatattctgaccatatcgcttcttactttgaaaggagtttctttactctctgcatagcttcaaccgtgttttcgtgagtgccgaatgcagtaagtctgaaccagccgtcgccgttcttgccgaagcctgcgccgggagtgccgacaacctcagcttcgttcaggagcttgtcgaagaatgtccagctgtccattccgtcggggcatttgaaccagatgtacgggctgttcttgccgcctgtatacttgattccaagctcgtcaaacgtttcgctcataacctttgcgttctgcatatagtaagctattgtagctcttgtctgcttgtagccttcttctgtgaatacagcctctgcggcacgctgaacgggataggaaacgccgttgaacttgcttccctgtcttctgcaccataactgcataaagctgatttcttcgcctgtgggagtttcaagcataagctcctcggggataacggtataaccgcatcttgtaccggtaaagcctgctgtcttggaaagcgagcatatctctatagcacactttcttgctccttctatctggaaaatcgagcggggaagtgtttcatcggagataaacgcttcataagccgcatcgaaaatgattaccgatttattctttatagcatagtctacccataccttgagctgttcttttgtataaacagagcctgtggggttgttgggtgagcaaagatagataagaccgggtttcatggattcgtcgggcatagcggcaaatccgttgtcttccgtagagtttacataatgaactgttcttccgcccattacgtttgagtcaacatatacaggatatgcggggtctgttacgacaacgtcctcgttttcgctgaagatgtcgcctatgttgccgcagtcgctctttgcaccgtcgcttatcagcacttcttcgggagaaatggttacgccgaagctcttatagtagcctgcaaccgcttcacgaaggaaatcgtagcccttaccgctgtcctcgtaacctctgaatgtttcctttacgcccatttcatcagcggccttcttcatagccgcaactacaacgggagccaaaggctgtgtaacgtcgcctatacccatctttataattttattatcggggtgagcggcaatgtactctcttactctcttgcctatttcgataaaaagatagcttttcttgagatttaaaaagcccggattcatctttgccatttgcgttaagtttcctttctttctgtaatcggtgtgtctttatatcgacacagatatacacaatatcattatatccgctgtaatctcaaaagtcaagaaataacggcacttaaaactatccaaataataagagcgttttacggtaattttactcaaaattcagaaaatgcgggcagaactacacttatttaatataatttctgcgatacatcttgaaattcctgcgtaaatagtgtataattttgaatgtgtggcgttcccgaaaagttaatattacgttaaacggaacgtggcataattacagtcagaatcggcatatagccgtataaattcccggaaggaaaaaaacagatgttgcatataggacttgacgtaggttcaactaccgttaaaattgcggtgctggacgatgaaaataatgccgtatacaagaattatcagaggcattattcggatataaaaaagacaattgcagaggttctcggcggatgccttgaaatcatagacgagaagaatgtgaccgttgcggtaacaggctcgggcggtatctcggtatcgcactggctcggaataccctttgtacaggaggtttccgcaggaacaacggcgatacagacatttattcctcagacagacgtagctatagagcttggcggcgaggacgcaaagattacatatctcacaggcggtatcgaacagcgtatgaacggctcgtgtgcaggcggtacaggtgcgttcatcgaccagatggcttcacttctgaataccgatataacaggcataaacgagcttgcaaaggactacacaactatataccccattgcgtcacgctgcggtgttttcgcaaagtcggatatacagccgctgcttaatgacggtgctaaaaagagcgatgttgccgcatcaatattccagtcggtcgtaaaccagacgataagcggacttgcctgcggcaagccgataagaggacacgttgcgttcctcggcggaccgcttcactatctttcggagctcagaaagcgtttcatcgaaacgttacagcttgacgatgaacatatagtgttcccgcccgatgcaaatctgtttgtcgctatgggcgcatctcttgcggaaaaccgtgaggagctttctgtggacaagctgagggacgatcttaaggcgcttgctgatgtcgaggtacacgaggtagaaagacttgcgcccttgttcaaagatgagcaggagcttaaagaattctgcgacagacacgcaaaggcagttatccctgtaaaagaactgtctgaagccgaaggtccctgctatcttggtatagacgcaggctctaccacaacaaaagctactcttataaataaagacggcgatattctctattcccactacggaaacaatatgggcgatccgctcaaatccgtgattgagatagtaaaagacgtatattcgaaaatgcccgaaaaggcatatatagcaaaatcaaccgctacaggctacggcgagcatcttataaaggcggcgcttggtgttgatttcggcgagatcgaaacaatggcgcattacaaggccgctgagaagattctgcccggcgttgagtttatcctcgacataggcggtcaggatatgaagtgtatgcgtgtaaaggacggagaaatagagagcatacttctaaacgaagcctgctcgtccggttgcggctcgttcatccagaactttgcaaatgcgctcggtatgcagcctgaagaatttgctcagataggcctttcagcaaaaagccccgttgacctcggttcacgctgtacagtatttatgaacagccgtgtaaagcaggctcagaaggagggcgcaagcgttgcggatatatccgcaggactttcctattctgtagttaagaacgctctgttcaaggttatcaagatccgtgacccgaagcagatgggcgaaaagataatagtacagggcggtacgttccttaataactcggtacttcgtgcctttgagcttacctgcggacgtgaggtagtacgtccggataaggctggtcttatgggtgcatacggaagtgcgcttgtcgctctgtcccgtgacgacggcaagggcagtacgttagccccgcttgaaaagctcgaaaactttactattcagaaaacaaccgcacgctgcggcagatgttcaaataactgcctgctcactatcagtaagtttgcagacggaacaagatacataacgaacaaccgctgtgagcgtggcgcaggtctcggaagcaagagcaaggagcttttacccaacctgttcgactataaatacaagagattgttcgactatgagccgctcgaccccgaaacagcaccgagaggtgtggtcggcattccccgtgtgctcggactttatgagaactatccgttctggttcacgctgttcacaaagctcggctacagtgtaaagctgtcgcctaaatcgagccgtgagatatacgacagaggtatcgaaacgatgccctcagagtcggtatgttatcccgcaaagctgtcacacggacatataatgtcgcttcttgacgagggcgtgaagtttatattctaccctgcgcttccttatgaaatggataacggcggcggaggagataaccattataactgccccgttgtcgcaacatacagcgaggttataaagaactccgtacccgagcttcgtgcagatgatataacttttatgaacccgtttttgcctatatatgacgaggacagaatgcttgaacgtcttatcgaggagttcatgccgctcggaataggcggagcggaaataggcgttgcgctcaaagccgcctatgaggaggacagacgcttcaaggacgatatacgctcaaagggcgaagaagtgcttaagatgctcaaggaaaagggcaagaagggcatcgttcttgcaggcagaccttatcacgttgaccccgaaataaatcacggtatccccgaaatgataaacggctacggctttgctgtgcttacagaagacagcgttgcacatttaggcacggtagtacgtcctatccgtgtagtagaccagtggatgtatcacacaagactttatgcggcggctacgcttgtaggtcagactcccgagcttgagcttgtacagctcaactcattcggctgcggacttgacgctatcacaacagacgaggtacaggagatactgcagggctacggcagaatgtacaccgtactgaagatagacgaggtaaataatctcggtgcggcaagaataagactgcgttcgcttatctcggtaatggaggagcgtgaaagaaacggcataaagcccgtaccgaagtacaagggttatatccgtcagcctctgttcacgaaggaaatgaagaaggactatacgattatagctcctcagatgtcgccgtatcattttgaactgcttgaacaggcattccgctactcaggatataatgttgagatacagaagaactattcaaaggaagtagtagacgagggattaaagtacgtcaacaacgatgcctgctacccggctattatcactataggtcagcttctctatgcgctcaatcacggcaagtatgacaaggacaaggtagcggtgcttatcacacagacgggcggtgcctgccgtgccacaaactatgtcggtatgctcaaaaaggcgctgaaggacgcaggacttgacaatgttccgctgatttcgctgaacgttgtcggaatggagaagaatcccggcttcacgctgactcttccgctgatataccgtgcgttcatatcggtaatttacggagatctgctcagccgttgcgtataccgtgtacgtccttacgaggctgaaaagggcgcaacgaacaagatgtacgagaagtggaacgaaaagctgaagggcgagataaagagcctgtcgcttgcacgtttcaacaagaatgtaaaggctatcgttgccgattttgattctattcccacgcttgatattgaaaagccccgtgtcggaatcgtcggtgagatacttgtaaaataccaccccgccgcaaacaacaacgttgtagagcttgtcgaggctgagggtgcagaggcggtagtacccgaccttatgggattcatctactttatctgcgaccacgcaaattcacgccacgagctgcttaccgtttccggcgcaagatataagctgagcaatatggctataaagctgattgaatttatgcagaagtcatataagggagcgatagaaggcactaagttcggctcgtttatgaagataagcgatatgagaaagctcgtcaagggcgttgtatcgacaggtaacatagcaggcgagggctggttcctgtctgctgagatgatagaacttatccacagcggagtaaacaatataatctgtatgcagccgtttgcctgcctgcccaaccacgttacaggcaagggtataatcggagaactgcgcagacagaaccccgagtctaatatcatagccgttgactatgaccccggcgcatcggaggtaaatcaggtcaaccgtatcaagctgatgctgacgcaggcattcagacagatgcgtgagaagaagctcccgacagaagaaaatattgtcgcaccggaagcaaaggtgaaaatcaacgataaatattccgcactcgatgtttaagtgcagttaataaccttgtgttattctgtgaatgtaacataaacccgacaaaagaaaggcaaatattatggcagaaatgaaattcagtacaagctcatcggacactaaggaattcaacgggaagaaagcaggaaagatagctgttatcgctgttattgcggtagcactgattatcgttttgttcaactgcttctcgatagtaaatgaaggctttatcggcgtaaagtacacattcggaaagataacgcaggacaatcttgcgcccggccttaacttctgcataccctttatagaggagataagacaggtcgatacaagagagcagatctattcggtaacggacgacgcttatacaagcgacacgcagacggtacagtcgttacagcttaaactgaactacagatatgacagcgcaaagctctccgatataataagaaatgtcggaattgacaacgtagagtcaaaactgcttgttcagaacgtagcgaaaatatcaaagaacgaaataggtaaagtaaaggcggaggagcttgtacagtcaagagccgacgttcagcagactatacagcaggagcttacaaatacgcttgctcccagcggaataatcgttgtttcattcgcaatagagaaccttgcgtttgacgaagcgtttgaaacatccatacaggctaaggttatagccgcacaggacgctctcaagatggagaacaagacaaaggaaaaagaggaagaagcaaagcaggtcgttatcgctgcacaggcaaaggctgacagcacaaagctcgaagcggacgcacaggcttacgctatccaggctgtacaaaaacagcttgaaacaagccccaactacattgattatatgaagataaacaactggaacggccagttacctcagataatcggtgacggtgtaaatcctttcgtaaatcttgacagcagtgcaaacagcacagaaagcaagagcgacaagagcgacagtacatctaagagcaactgacggtcttgcacggcgaaataaggaattttgaatttttcattctttatttttcgtttaaaatcaggggaggggaataccctccccgttcttgccgtttaaacggcataatatcaaggggtaattatggactatttaacactgaaaaaacaggtgctgaacaagtatttcagccgtacaaacgatatgcagaaaaaggcggtgttccgcataaacggagcagtgcttatagtagcaggcgcaggaagcggtaaaaccaccgtgctttgtaaccgtatcgcaaatatgctccttttcggtaatgcgtataacagcaataccgtaagagagctgtccgatgatgatgtcgcttttgcgcagagttttcttgcaggcgaaattgacaactttgatgcggctgagcgtctttcggagattttcggcgaggacagagtaaagccgtggaacatacttgcggtgacctttacgaataaggcggcggcagagcttaaagaacgtcttgaaaatatgggcgcagatgttgacggtatatgggcggcaacgttccacagcgcctgcgtcagaatactgcgacaggatatagagaaacttggtatgggctataagtccaactttacgatatatgataccgacgatcagcttaaggttatcaagacggtaatgaaagagcataatatttccgacaaggcggtaactccgaaggcagtgcagaatttaatatcacgctcaaaggataagctgataactcccgataagttttcgacaaagggaaagaacggcagtgacgattatcagctttctaccgcaaagactatctataccgactatcaggcaaggcttgaggcggcgaatgcgctcgactttgacgatataataatgctgactgtaaagctgtttgcacagtgtcccgatgttctttcgcactggcagaacagattcaaatacataatggtcgatgagtatcaggataccaatgcggcacagtataagctggtgtcactgcttgccgagggcagcggaaacctgtgcgttgtaggtgatgaggatcagagtatctatcgtttcagaggcgctaccattgagaatatcctctcgtttgaggagcagttcggcgcagaggttataaagctggagcagaactaccgttcaaccgctactatacttaaagcggcaaatgcggtcatagcgaacaacactcagcataaggacaagaatctgtggtcagacctcggtgacggtgataagataagaatggatcgcttttctaccgagcaggaagaggcaatgtttataacagagcgtatccttgacggagtaaagcagggaaagaagtacgccgatcacgttatactctaccgtaacaatgcccagtcaagaacggtcgaaaccacgcttgcaaagagcggcataccttataagataatcggcggtgtgcgtttctatgagcgtaaggaaataaaggatattatcgcttatctttgcgtgcttaacaataattatgatgaagtgcgcttcggaagaatcgtaaacgagcctgtaagaggaataggtgcggcaacgcttgacgagctgaaccgtgtcgtatcgggtatgggaatatcctatgtacaggcaatgtgcgagagcgacagcctgccatcgctgtcaagaaaggcaaaggtgcttgttccgctcggtgaaaccttcagcgagctttcacagcataccgatgatatttcggacggaagccttattgacgatattcttgaccgcttcggctacagagaggcaatgcaaagacagggacttgagggcgaggtccgccttgaaaatataaacgaacttaaatcaaatatgataaccttcgcaaaggaaaacgagggtgcgggattatcggaatttttagagcaggtagcgcttgtttctgatatggacagctttgaagccgatgacgacaaggcagtgcttatgacaatgcactcagcaaagggtctggagtttgacactgtatttgtagtaggcgcagaggaaaacattttccccggctaccgttcacagtttgacccgatggagatagaggaagaaagaagacttgcctatgttgctataacaagagcaaagcgacatctttatttcacctgtgcaaaacagcgtatgctgtacggtcagactatgaggaacaaggtttcacgctttgtggtggagataccgtcacagtatatggcttatgacgatcattcggctgtaacagcgtcggcggcggcaagaagcgcagagcagatgaaaccccgtacaagctatttacagcaacagcagagatcgtaccgtgccggacagcgtgaaatggaaaaacgtgtcgagaatgtaagctatgcgccgggcgagcgtgtgcgtcacggggtattcggtgacggaactgtgctttcggcaaaggcgatgggcggagattggctgcttgaaatagcgtttgacgataaaggcaccaagaaggttgccgcaaagtttgcaaagatgacgaagatataaggagtagtattttgttataaaaggggtcgcaggggcaaagcccccgacagggattaggggcggtagccccaataatacagccccggcacggacgccgggcgtgtatgcccaaaggctctgcacgatgcagagccaaccaagcatacacagtccttcaccgtggggaaggggtttggggttagggttagagaagtttctacaccaaaaacgactttttctatgcctgaataaaggagtaactatgaagataaaggctgtaatatttgatatggacgggcttatgctcgataccgaaaaactgctcgtcaagtactggtgcgaggcggcaaacaagctcggctttcctatggaacgcagacacgcacttgcactgagatcattttcaagaaagtttgccataccgcagctcaaggagtggtttggagaagattgcgactatatggctatacacgatctgcgtgtaaagctgatgaaggaatataccgatgtacacggcatagagaaaaagcaggggcttgatacactgcttgactatcttacgtcacacggctacagaacggcggtcgctaccgctacaaatatcgagcgtgctgaggagtatcttaaaaagataggtgtttatgacaagttcgaaacgataatctgcggtaatatgctcgaaaacggcaagccctgtcccgacatctatctttatgcctgcgaaaagctgggacttgagccgtcgcagtgcatggctcttgaggacagcccgaacggcgtaaaatccgcaagcagtgcaggctgtgtcactgtaatggtgcctgaccttactgagcctgaggaagaacagcttaaagctgtgtatgcggtcgcaccgtcactcgataaggtgatagacgtacttgaaaatatgaagtaaataaaggctgtcggcacgcataagccgacagccttttatatttacacaccgccgtgtgtaccctctttcccgtaagtctttttcttgttcttggtatacggtaccccgtcactgtccggcacggcatagggataaacattacggtattcatcagccgccgtttcgctcgtcgggtcggaaggaataagccccgtgcagtccgatgaggaacagcatccgcagaaattatcaagaattatttcttccgtttcactgcgttcctcaggcgtttttgggacaggctttttcataagcctgttttgtttttttaaattgttattatccatagttgttcctttcataatgtaaaatcggttgccgttttaaaacggcacagcgttgcgtgagttgcgtgaatagtatgcgtaaaaatccgcatcattattacgacagaagttatcgcaaattctaaaaaatgtaaatgcacaaattcgtacacagaaattaataataatttgtgcaaattttattaaaaaatctcttgacaaagtgctgaaagtgtgttatattgtgtttagcactcagagaggtagagtgctagcagataaaaattatgagtgctaaccagccggaaacagcggagtaccgctgaaagaagggaaaaggaatatggaaaaccgtacactcagaatccttgaagcgatagttgacgaatatatacgcaccggcgaggcggtcggctcaaagctgatagccgaaaagctggataatgcagtttccagtgcaactataagaaatgagatggcggctcttgaacagcagggctatcttgagcatacgcacacaagctcgggacgacttccgacatatcagggactgaggctttatatagaaaaggtaatgtcacccgcacagttacccgatgaagaaaaagaggagatagaccgtatatttgataatatcggcggagcgaccgatgacgagataatcgacaatgcgtcaagggctcttgcggatattacgaaatgtgcgatagtttctaccaacaccgtaaacaagttttcggtaataacaaaggtagacgttatccccacaggcaaaagaatgtatgttcttcttctgataacctccgagggcaatatcagaaacagggtatgcaggctgagctttgatcttacaaacgagcagatgaatttcttcacgcagtttgtaaacgagaacctcaaaggcgtaaaccttgatgagctgtccgatgaatatatagataaactgacgcaggcaatgggcggatatatgatgacgttatcgccgcttctcaaagcggtagtcgatatatcggctgaaatgcagcagcaggtagagttcagcggagaaaagaatctgctgacctgttctgatttctcgaacactcagatagcaacgatacttgacggcaagaacgagctttgcagctggcttgacgatacgttctcaggcatacagataaagttcggagccgaaagcgatacattcgccgttaccaattccagtctgatagcggcaagcttcaataaggacggacgaaaggcaggctctttcggagttataggtcctgtaagactggattacaagaagctgatcccgtatattgaatatttctcgtcaaaggtcaccgatgcattgtcggcaggcaatgacgaagaagaaaagaacgaagaaaaggaggcggattcagtttgagtaagaaggaaaaggaaaccaaggaagaaactcagcagaccgcagacacagccaccgaaaaggtagctgaaacaaccggagaggtgacagaagaaaaggctgaagcaaaagccgaagaaatcaaggtggatcccaaggatctcgaaattgccgaccttaaggataagctgctcaggactatggcggaattcgacaactacagaaagcgtaccgccaaggaaagaatggagctttcccccgagattacggcaagaaacctaacggagtttttacccgttatggacaatctcgacagagcgcttgcggcggagtgtaaagaccccgactacaagaagggcgttgagatgatacacgagagctttgttacggctcttcagaacttaggcgttgaggtgattgaatcggacggcgcacagttcaatccttcgtatcatcaggctgtacagcaggttgaggatgacagcaaggaagaaggcactatagccgccacattccagaaaggctataaaataggagaaaaggttctccgttttgcgatggtagcagtcgtaaagtaaaaagcaatcaaatgggcttaagcccgaagaataaacggttctgtaagaaccttacggtaaggagataattatcatgggaaaaataataggtattgacttaggtacaacaaattcatgtgtagcagttatcgaaggcggcgagcctactgttatcacaaacagcgagggctcaagaacaactccttcagttgttgctttcactaaggacggcgagcgtcttgtaggtcagctcgcaaagaaccaggcagttacaaaccccgacagaacggtcatttcgatcaagcgtcacatgggcagtgactacaaggtagacattgacggcaagaagtacacacctcaggagatttcagctatgattcttcagaagctgaagacagaggctgagggctacctcggtgaaaaggtaacagacgctgttatcaccgttcccgcatacttcacagactcacagcgtcaggcaacaaaggacgcaggtcagatagcaggccttaacgttcagcgtatcatcaacgagcctacagccgcagctttagcttacggcattgataaggaaaacgagcagaagatagttgtatacgacctcggcggcggtacattcgatgtatccgttatcgaaataggcgacggcgtacaggaggttcttgccacagcaggtaacaaccacttaggcggcgatgacttcgaccagcgtcttatcgactactttgtagcagaattcaagaagagcgacggtatcgaccttaagaacgataagttcgctatgcagagattaaaggatgaagcagaaaaggcaaagattgcactttcaaacgctccttcggtaaacgtaaatattccttatatcacagcagacgctacaggccccaagcacctgaacgttcagctcacaagagcaaagttcaacgagctgacagccgaccttgttgaagcaacaatgggccccttcaagcaggcaatcagcgattccggtctttcaatgaacgaaatcgacaaggtactgttagtcggcggttctacaagaatccccgctgtacaggaagccgtaaagaaatatacaggcaaggatcccttcaagggaatcaaccccgatgagtgcgttgctatgggtgcggctctgcagggcggcgttctcaacaaggaagtaacaggtctgttactgcttgatgtaactcctctgtcactcggtatcgaaacagcaggcggtgtctgcacaagaatgattgagagaaacaagaccattcctacaaagcacagccagatattctcgacatactcggataaccagccctcagttgatataaacatcttacagggtgaacgtgaatttgccaaggataacaagtctatcggtacattcagacttgacggtatcgctcccgctccccgtggtatcccccagatcgaagtaaccttcgatatagatgccaacggtatcgtaaacgtatccgctaaggatctcggcacaggtaaggaacagcacatcagcatcaccgcttcaacaaatatgagcaaggacgatattgataaggctgttaaggaagctgaagcatttgccgctgaggataagaagaagaaggaagaggttgaggctcgtaacgccgcagatcagatggtttaccagactgaaaagtcgatgaacgaattcggcgacaaggttacacaggctgataaggattccgtaaatcccaagctcgacgctcttaaggaagctctcaagggtacagacgttgaggctatcaagaaggctcaggaagagcttcagacagcattctacgcagtagccgagagaatctacaaggaacagggcgctgcagcacagcaggctgaggctgctcagacggatgttcagggcgaaggcacaaatgccgcaggcggttcggatgataatgtggttgacgctgattacacagatgccaactaatcaataacattgcgtatgagccgggaactctcggctcatattgctgattttgcaatactttataaaacggcagataattctgtcgggaaggttagaccattatggcagaaaaaagagattattacgaagtgctcggtttgcagaaaggtgcgaccgacgatgaaataaaaaaagcctaccgtaagctcgccaagcagtatcaccccgaccttaaccccgataatcctgaggctgaagccaaattcaaggagataaacgaggcaaacgacgttctctccgacccgcagaaacgtgcaaagtatgaccaattcggccacgcaggtgtagatccgtcatacggcggcggtgcaggcggattcggcggcggattcggcggattttccggcggattctcgtcagcggacggcatagacctcggcgatattttcgattctatattcggcggtggcggcggccagcgttccaaccccaatgccccaagacaaggctcggatattgccataagccttgacatcagctttatggaagcgtgcaagggtctgtcgcacgaggttgagataaaccgtgccgaaacctgtgacagctgtcacggctccggcgcaaaggcgggcacaactcccaagacctgccccgattgtcacggaagcggtcaggtaagagtacagcagagaagtatgttcggtatgatgtcctccacacgtccgtgctcacgttgcggcggtaagggcaagataatagaaactccctgtcccacctgtaacggtcagggcagagtacagcgccgtaagaaagtcattatcaatgtacccgcaggtatagataacggtcagacgctctgcgtaagaggcgagggtaactgcggtacaaacggcggccccaagggcgaccttaatgtacgcattacggtacgcaaagacccgatattcgaacgtaagggcttcgatgtatggtgcgagataccgataacatattcacaggcggttctcggtgacgagcttacagtgcctacaatagacggcaacgttaagtacagcataccagagggtacacagccgggtactgttttcaggctgagaggcaagggtataaagaagctccagcgtgaaggcaggggcgaccagatggtaagggtagttatcgaagtacccaagaagctgaacaagaagcagaaagacgcattgatgagttttgaaaaggagcttactccgtcaaactatgaaaagcgtaccagcttctttgataagataaagaagttcggcgacgatcttaaaaagaatttccagtaataaatataagctgtcatgcggtaagacgtatgacagctttttcttttgcccgcaaaacaaaaaaatcccccgttgcttgtcattttcttccggacacggacatataattcttcagatgaaaaagcgaggaggatttattatgttcgttatgactatgaccaagcgtaagctgatccgtgcggtcatgtttgtgttagtgctgattaccggcatcgctataggagtattcgccatactctcgtctatagacaccggtgcggaaaacgtaaagctgccgatatataacgtaaaacgcaccgacaataaaatcagcattacgtttgactgtgcgtggggaaacagcaacaccgacaagctgatttcgatacttgccgaagccgatgcgaaggctacattctttgttacgggcgaatttgcggataaatatgccgacgatataaagaagctcagcgatgcaggccacgagatagcaaaccacagcgacaagcatccgcatatcaagggtatgaacgtaaacgacctcatagcagatacgaaggaatgctcacgcaagataaagatgataacgggcaatgcccccacgctttaccgtgcgccctacggagaatatgacgacaaggcggtaaccacgcttttcggaatgggaatgagcgtcattcagtggaacaaggacagcatagactgggataagccgacccccgaaacaataatcgagcgtacaacaaagaatatttcgggcggctcgatactgcttttccataacgaccttgaaaacacgactcaggcactgccgaccgtgcttaaaagtcttaaggaacagggctttgagctttgcaccgtgagcgagcttttgcttgagggagattatactatcgactcaaacggaactatgatgccgaaaagcaaagcaacggtaaatccgataatttacagcgataattacgatgcgaatctggcgtttgaaacgcttgccgaaaagctgagcataagcgatataaacgcattgcagagcaaggacgtttcgattgaaaccgcccgtaaattagcgtcatatcttacgcaagagcagatagcggcgctgaaggcacttcccgaagaaagcctttacaacggctttgaaaagctgaaagaggcagtatatgcccgtgaaaacgccgttccgggaagctctaccgagccgataatcaaagactgataaataatatttcaccgcacggtaaaaacgctgtgcggtattatttttgcgtcacagttgaccgacagttaaaaatcgtgtaatataatataagaaaattatatcggaggaattttaatatgaaagccttactgatagtgaatcccgtttcgggaaaaaggagaataaccggtgagcttgtagagataatcagccgtcttgaaaagggcggatatgtaactaccgtacacgttaccgaaagacgaggcgacgctaccgaaaccgcaaggatacacggcggcgaatatgatgtgattgtctgctgcggcggcgacggaacgctcagcgaaacggcaaacggtatgataaagggcggacacaagacaaaaatcgggtacattccgtccggcacaactaacgattttgcatacggcataggactttcgtcagatattatgacagcggctgacgatattgtaagcggagcgcccaaagcatttgatgcaggaagattcaatgagcgtgaatttatatatatagcctctttcggcgcatttactcaaagctcttacgacacaccgcagaatctcaaaaacgcattcggtcattttgcgtacatcttaagcggaataaaggagcttgccgagataaagccgtatcatatgagcgtatatgattcggacggaatactgcacgagggcgattatatattcggtgcggcttgcaatgcaacatctgtcggcggaataatcaagcttgacgagaatcttgtagatctgagcgacggagtttttgaagtgatgcttgtgcgttgcccgaaaacgcctgtccagataagccttatggcaaaggcacttctcagcggaaattacgataatgaatttcttgatttcttccatacaaaacagcttgacatccacagtgacgaggctctgccgtggtcgcttgacggagaagaagcagacggcggaaaagatactcatatcgaggtactgcacgagtcggtgaatattattcttcccaagaaaagaggataggcaacggtatgatagagtatattcacgagcctactgacttgcagtgcggccaggctgtgcttgctatggtactcggaaagacggttgacgagatagtgacatttctccaaaatgaccgtgaaactacccttgccgagatgaaaaaaacgttcagagaacacggcgttcatatatccgatgagcgcatagcggtacagaaaaaggagcagctgcctcccctttgcctgctcagccttgaaacgccacgttgctggcactggtcgctgtacgcagacggcacattctacgatccagaacacggtgttatgagtgatttcccccgtgcaaacagaaaatattattggaaactggaaaagcagtccgttttataggacacaacctctgttataatataaacataacgagggagcgaaaagctccggacaataatcacattctttcgttttgcggtcatcggctacggtgactgcaaatcaaaaattatcatcagtccgttttatcggacagcgaagatgttacaatataaacataacgagggagcgacaagctccaaaaagttgtacataaatccttccttttctgcaacggcagtgacgctgttaccgccgttgccccgacaatgagcattccttgcggaatgttgaaataaaaccgatattttacctccttctcccttctgtgtttggctgtcttggctttcccggtcattgcagaattgcccggaatatcggtatcggttattccgggcagatctgcaatacgaaaattacttatcaagtccgttttatcggacagcgaagatattataaatattacgaggagcagatgctccgatatacattgtatacctttctttccaaacggcggtctgcaaaatacagactgccaaccgaaatttacagtccgctgcggcggatatgaacgttaaaggctgatggtctgacaacccatcgtgaaaggtctttatctgttcactgtttacatagttctgtgctgttttcatcatttttcggcacagaggtattctcctttttaacttcccgtatcatactttaccgatacgggaaacggaagatacgatgcccgttaaattcttcgggcaggcgttttcgataaatccctttcagtattttggttaccggccattttatgtatttggcaaacaggccgatttgcagatagacgaaaacacctccggctgtgcccctctgaagccgtatatcgactgctttatatctccgacaacagcaacggcaacgtatcccagatttcccacaaaggtcataacaggcatcataacaccggagaaaaactgcgacttccacgcagacttatataaaatatcatttgcctcgttaaaatcttcgataacacgtttctcacggttgaacgccttgacgatattgtgaccgccgtagatttcctcgacctgtccgtttatgtgaccgagatactcctgctgcgacttgaaatacttctgagaaatctttacaacgaaaagcacaagcaccatcgaaacaggaagaataagaacggcgataagcgtcataagagggcttatcgacagcatcattaccattacgcctatgatagtggtaaccgaggtgacaagctgtgtaatgctctgattcagattctgtgccagagtatccacatcgtttgttactcttgacagtgcctcaccgtgcgtgcttttgtcaaaatagttcatcggcatgcggtttatctttgcgataagctccttacggagtctgtagctgaccttctgtgaaatgcccgtcatcagccaaccctgtataaacgaacagatactgctgataagataaaatcctataagcaaaagaagtatagcgccgagcgcatcaaagttaacgtcgcccgtaccgttcaccttggcgataatgccgttgaaaatctccgttgttgcattacccatcagcttaggaccgataatattgaatacggttgatgtaattgcgaatatcacaacgaaaacaagcgaaatcttatattcgctcatataccttgccagttttccgatactgcccttgaaatcctttgccttttctacaggagcgccaggtcctcctctgtgagaattacgcatttacagcacccccttttgcattatctatcgccgcaaggtctttttgcgacaattgcgagtgtgctatctgcctgtatacctcacagcttttcataagctcgctgtgagttcctatgcctgctattctgccctcgtcaagcacaactattttgtcggcattcaatatcgtgctgatacgctgtgcaacgattattatcgtgcaatcgtgaatattgtcggcaagtgcttttctcagcttcacatctgtcttgaaatcaagtgcggagaagctgtcgtcaaacagatatatcttaggctttttggcaattgcacgggcgatagacaaacgctgtttctgtccgcccgaaacattcgtaccgccctgggaaacaggctcgttgtatttttgcggcttgctgtcgataaattcggacgattgcgagatttctgcggcaagtcggatagtttcatcatcggcattttccgcaccgaatcttatattgctgtctatcgttcccgagaacagtacgcctttctgcgacacaaggcctgtaacgtcatggagagaatgctgtgtcacatctctgatgtcggttccgtctatagtaatgctgccttcggtaacatcaaagaatctcggtatgagatttataagcgttgatttgccgctgcccgtactgccgataacagcggtcatttcacccgcctttgcggtaaagcatatatcggtcagaacatcttcctttgcatcgggatagcggaacgaaacgtgatcgaaagtaacatcgccccttagcgacgctttatcgaatgttgccgcatccggcttatcagtgatgctcttttcggctgaaatgacttcgtttattctctctgcggaaactgccgctctcggaagcattattgaaatcattgtcaacataaggaatgacattacaatctgcatcgtatatgtgataaacgccatcatatctccgacctgcaaagagccgtccgaaatctgtcctgcgcctacccatatgataagaacggtgacaaggttcattatcatcatcataagaggcatcataaacgtcattgtacggtttgtgaaaagcattgcggatgtaagatccttattggctttatcgaaacgttcttcttcatatttttcacggctgaaggcacggataacaggcagaccggtaagtatctcccttgcaacaaggttcagcttatcgacaagtttctgcatcagcttgaatttaggcatcgcaattttcatcagaataagcaccaccataagaataacaattacggcaagtgcgataatccacgccatacccgtgccggtagtcattaccataaatacaccgccaatgccaagaataggcgcatatataaccattctgagcagcattacaataaccatctgtatctgctgtatatcgttcgtgcttctcgtgataaggctggcagtggaaaatctgtcaatctcggcgcttgaaaagctgacaacatttctgaacactccggctcttagatctctgccgaccttcgccgctgttgtcgccgcaaagaaacctaccgtcacggataccgccatcataagaagtgcgataagcagcatttttccgccggctgacagcagatagttctgctgtaatacgttcatatcaacgcccagcgatgaatattcgtcttttacaaagcgtactgcggactgctccgttatagttcccggcatttcagatattttgtcagacaatgccgacagatcggtatctcccatgccgcctttttccgcaagtgccgtaataatcgtaagtgcatttgcttttctggaagaaataccgagcatttctcctgcctgttcaaaagaagtaaagggcagtttaatcccctgcttttcggtcatagatgacaaatcttcaaaggaaagctctttcatcatctcagccgccgtcataggtatatcgacagtattaatgagctgttgtttttcatcttctgtaagctcgttcagaaaataaacgtcattatcggcagacgcaggaaagcgatctttctgagaatcggccgctttgcctttttttacaagagtatagctttttgcaagtatgcttttctgctcgtcattcataaatgtttcaagcgcattatagccgtctacgctcagcgcatcagccgccgcattttctataccgccgttctgtatacctatatccacaatatcagatgtgtattgcggtaaagtaaggtcgccccacgcctgaattataagcagtacaattatcagcaaaacctgcggtatgctgtttttgagatacccgaatattttgaacaaatactatgctccctttccgttacttcagctcagccgacttttcgtaagcgtccgcaaaacgcagaacaagctcaatcagcttgtccgtatcctcttcaccgagtattttagctatattttcaagtcttacaaaaatctcgtcgtattttgcttttgccgttgctttgccgttctctgtaagtctgatatatgttactcttctgtcatccttaagaacgactctctcaacataacccttatcctccagcttgttgatagtctgggaaagattcggtctggtaaaattaagatagctgttaagctcgctcagtccgaacagctcggtatcgggtttttccgcaataatctgcgtcattgcccagaaaactcctgtttcactggcattaagcccttccattattctgtactgtcttggttgtgcggaaaatttaccaagtgcgattataagtctcattattctgttgtccataattcttctcctttatatttctcacagttcttcccatactacctgcgaaaatcaatcattcctcaatcaggtaaactacttgcttacccgatgataatatggtatacttcttatgttaacagattataaatttaattaacttctttgaacggagcagaaatgaaaataattgataccgaaacagcaattataggcggaggtgcatcggggcttgccgccgccattgccgcctctcgttacggatgcggcaatgtgaccgtactcgaaaaaatgcagagagtaggcaaaaaaatactttcaaccggtaacggcagatgcaacctcaccaaccgcaatataacccctgctgattataccggcgatacggagcttctatcatatatcagccccgatattgacaacgctgaggatttcttttcttctctcgggcttatctgccgtgcggatgataacggcagagtatatccctacagcaatgccgcaacctctgtgcttgacgctctcagatttgccgctgattcttccggcatcagaacagtatgcgactttacggtatctgaaataacaaaaaccaaacacggttttatcataacaaacggcgaaacacaggtaaaagcaaagcgtgtaattattgccgcaggaggaaaagcggctccgtcgctcggctcaagcggcgaaggctatgagctttgcagaagcttaggtcactcggtgacaaggctctttcctgcccttgcgcctgtaagaacggatattgaacttgttaaatcgcttaagggacttcgtgtgacggcagacgctacgcttatttcgggcggaagggtgatagacaggcaatcaggtgaggtacagtttaccgacggtgcattgtcgggaatatgtattttcaatctgtcagcaaaagcggcagaatatataaacaacggtgaaatttcactcgatactgccccaacgctcagcaaagacgagttatacgggcttataaaaagcactgccgaaataagagcatcactgccgtgcgaagagcttctcacgggaatataccacaaacgtgtaggacaggcaatgctgaaaaaagcaggtattcctttttctgtaacctgcggcgaaatatcggataaggacatttcagtgttatgtaatcttgcaaaggacagccgctaccccgtaagaaacgtatcggactggagccttgcacagataacctgcggcggtatacctgcaagcgaggtttccgacaagctggaatccctcaaggcaagcggcttgtatctgtgcggtgaaattctcaatatccagggcaaatgcggcggatataatcttgactgggcgtggaaaagcggatataccgcaggtatgaacgcaagtctttctttatcggagtagaaaatgataaaatacagcaatatcaaaatgccgccggagcatacaataaacgacatagcggcatttatcggcaaaaaactcagaacatcacagcctgaccagtcacggctgaaaatcataaaaaaatccgttgacgcacggcacaaggacgacatacactttgtttataccgttgcatttgcctgcgaaaacgaaaacgcagtgttaaagaagaactcaggcaacaagaacatttcatcatataaagaaataccgtattccttgcctcaaagagcaaagctttcaaagcgtcccgtggtagtcggtttcggtcctgcgggtatgtttgcggcgctctatcttgcacagtgcggtgtacgtccgatcgttcttgaacgtggtcttgatgttgacagccgtaaagagaaagtcagaacgttctgggaaaaaggaatacttgatacagaatgcaacgttcagttcggcgagggcggtgcaggtactttttcagacggaaagctgaacaccggtgtcaacaatccgctttcaaaaacggtatttgaagaatttgtccgtcacggcgcacccgaagaaatcatgtatgaggcaaagccgcacattggcacagacaaattgtccgaaaccgtaaagaacataagaaaaaatattatatcgcttggcggagaggtaatattcggagcaaaattctgcggctatgataccgaaaacggcagaattaaagccataagctatataaaaaacgatactgaaattaccattgaaaccgacaacgtgattcttgccataggtcacagtgcgagagatgtgttctatatgctgaaaacccgcaacgttactatgcagcccaaaaacttctccgtaggagtaagaatcgagcataagcaatccgaccttgaccgcagtatgtacggagaaatgagcggtcacccgtcacttcccgccgctgactataagctgtcggttcacgacaaaaacggcagaggcatttatacattctgtatgtgtccgggcggagtggtcactgcgtcttcctccgaagaaaacacggtagtcacaaacggtatgagttattacgcaagaaacggagaaaacgcaaacagtgccgtccttgtcggaataactccggatgattttgaaaatgatgatattatggcaggaatagaatttcagcgcaaaatagaaaaagccgcctttaaagcggcaggggcaaattacagcgcacctgtatgccttgtaggcgactttctcagtaaacgcacctccgaaaaattcggcaacgtaactccttcctatcctataggcacaacatttgtgccgcccgatgaatacctgcccgatttcgtatgcgacgctttaagatacgctttgccgcagtttgccgagaaaatcagctgtttcggctctcctgatgcggttatgacaggccctgaaacaagaagctcatcgcctgtgagaatagtaagagatgaaacactttcatcggtcagtgtgaaaggcttgtatccttgcggcgaaggtgcaggctatgccggcggcattgtgacagcggcaatggacggacttaaatgtgcaatggcggcagttggcaggaacagcagaagcacctaactgcacaggctttccatttcctttttgagcctttttataatacgcttttcaagacgtgatatataactctgggagatcccgatcatatcggcgacctccttttgtgttttttcggggcggttattaagcccgaaacgaagttccattatcagcttttccctttcgtccagcttttccaccgcctcaagaagcattcttttctctgcctcagattctatatccacgctgacagtatcatcatccgttccgagaatatcggataggagcaattcgtttccgtcccagtcaacattaagaggttcatctattgaaacctccattttttgcggattcgttttcctcagatacataagtatttcgttttctatgcaccttgaggcataagtagcgagctttatgtttttctccacgctgaatgtgttcaccgctttgataagccctatagtacctatagaaataagatcctcgattcctataccggtactttcaaatttctttgcgatataaactaccagtctcagattatgtacaatcaacgtttcccttgcgttttcaaagtccgtgtttagctttgcaagcgtttttgcttcctcttcctttgaaagcggaggaggtaaggtttccgcaccgtttatataatcgcactcgcattttccgtttgccgaattacgcagttttgaaataagattgctgacaatttcaattatcttgagcattttacacctcacacaagtattttcggattgaatatcgcttcatattcctgtcttccgcctatcactataccgataagcgcattgacgggatatttttcttcattcgtttcatcgtcaataacaacactttccgctttgaacatacagataagtccaccctttcccactgtggaaaacggcattattctgacgccctttatcatctgcgtgcctatatccgaaatatcgctgttattttctatcatttcgattgcaggaggtgaaacatcggcgcacatatcacgtctgcacactatcacaggcaatccgctgaaacaatcaaccattccgtttccgctgtctgcgagtgccgacagcctgcattccctgccgttattttttatgataacagtatacttgccatcggtttttccgtttttatcgagtatatatcttattattctgacaactccgtaagccgcacaggtagacagaattatcgtcatcgtatcaacaccgaaatatacagtgccgtttataaacagcatcttcataggagcggcaaacagccacacacaaagcatcagccccgaaaagacaaagctgacaagcatcaaaaacagcacgctcaccgcatatgcacgaaatcccgtataaccgaatgcgacaaaagcaatcaaagcacaaagaaatatcttaagtaaagtaagagtcaaaaccatttcctgcggaatgaaaatactcagtgatgccaccgcacctatgcctgccgcagacagctttctgtaccatactgtttttctgtgagtaaatactgatacggcaagaatctgaaaatatgtaacataaagatttatcagaatcagcacatcaagataaataaccatttttatgcccctcgtttattataggacaaacggaagtaaaaaagtgtcggtttgtgatacggacataaaaaaacagcctgagtttcctcagactgttcagcttgtataaaaagactgtttttgaaataaacttctgatttattatccctatccccaaacccctttccccggaaaggggctatattactggggctaccgcccctagtccctgtcgggggcttcgcccctgcgaccccattttcaaaaaatataggtttttcaacagactgttctgtaatttatatcacgttttttcttagcagcagcatttcggcattttcaagcgaaatcggatcgttttcatcaccggaaataatccttgctatttctctctttctgccttcaaaatccagctttgtaatgcccgtataggtgcgtttttcatcgctggtcttttttatcagaagctgtgtatccgccattgccgcaatctgtgcaagatgcgttacgcaaagtatctgcctgttttccgccgcctcgtgcagttttaatccgaccttggcggcggctctgccgcttatacccgtatcaatttcatcaaaaatcatcgtatgcagtttgtctgtttcggcaagcacgttcttgacggcaagcattattcttgacagctcaccgcccgaagcaatcttgctcataggcttcaaatcttcgcccttattgacggagataagcatttccaccttatccattccgctgagagtgactttatcctgcgatatatcgaacacaagtcttatatccggcatatcaagaaacgtaagctccgcagaaatccgctttgcaagctcgtccgccgctttttttcttctgcttgtaagctctgtggcaagacgctttactttttctcctgcttcttttttcttttcggtaagttcttctattatatcgtcgccattatctatttcataaagttcgttgcgccatttctccgaattttcaagtatctgcgcaaggtctgtgccgtattttctttgcagacgcaatataacgctgagcctttcttcaagaacaccgagcattcctgcggtatcctcgtcttcatcgggtattctctgcactatttcttctcttatatcctcaagctctaccaacatatccgatatacgctctgccagtttatcaagctccgggatagtgtcgctgagagatgaaacgctgtttttgcaatgctcgagcatagaatatgctccgtcagtatcatcgtctcccgatattgccgtctgtgcattatacagattctcgcttatgtattcggcattgcgaagttcctcaatcttttgttttacggtttcttcttcatctgcggaaaaattatacctgtcaagctcctcaagacgttctctcagaagctccgccctttcaagcgattcggttttcttacggctgacttctttaattttccttgataaagccgaaaactccttgaaagcggtcgcatattccgacagcaacccgctgtttttgccgtagctgtcgagtatctcacgctgattatccccgtccataagcagacggttatcgtgctgtccgtgaatatcaataagttcagacgctatatcacgaagtattgctactgttgttgctctgccgtttattcttgcggtgcttttaccgtccgcatgaatatcacgctgcagcaaaagctcgtcatcgacagcaaaaccgttatcactgagtttagctttgacgctttcgggcaaatcgtcaaaaaggccggtcacaacagccttttctgtgcctgctcttacaatatccttgcttacccttcctccgagtatcgcatttatgccgccgataagtatactcttacctgcacccgtttcacccgtaaacacattcagcttatcatcaaaggctatcgacgccttttcaatcacagcaagattttcaatagataattctctgagcaaaacgccgacctccttatcttaaagcagttccttcaggtgacgtgtcagcattcttgcatcaccctccgttcttgtcagtacaaatatcgtatcatcgcctgcgatagttccgacaacataggaaagattcatcatatcaagacctgcacaagcagcatttgcaagaccgctgtggcattttattgaaactatattcattgcgtaatctatattgacaaccgcttccgaaataatattatgaaacttgaccgtgtgtaccttttccgcttttgcatagcagttgactccgtttgaagaaaccgttttttcaatattgagttcatttatatcacgggaaacggtcgcctgagtcacatcatagcccttttgcttcaacagattaagcaacatttcctgcgtttccacttcgtttgaagatatgattctgagaatttctgcctgtcttttctttttcacaatatcaccccttgtaagattttatttgagcggcctcatcagcttgttgtgtaccgctttatagaaactgctgccgtttatatcaataatagaaagctgctgctccgagcgtcttatctttattatttcgccctctttgaaatccatatcgtcattaccgtcaatactgagcgaaacgccgctgtcttcatatgcggaaaaacgcaccgttatttccgaatctgctgaaaatatcataggtctgccgaaaagcgaatgagcacacaacggagtaaattcaatgcactgtgcatcaggggatataataggccctcctgcagataaagaatatgctgtagagcctgccggcgtactgaagataattccgtcggctctgatttttgtcacctcgtattcttctaccgaaacaataaactcgggcagctttgaataacggcatttgctgaacacaacatcgtttatggcactgtaattgcctttgccctcatattcaatatcgagcatcattcttctgctcaccgtatattcgcctgttttaagacgttccagtgtatcaagctcgccgctctctatagaagtcatgaagcccagcctgcccgtatttattccaagcaggagcttattgcaggcggcggctttctgtccccacttgagaatagttccgtcaccgcctatagtcataaacatatcgcagtcggttataaggctgtctgtttcagcgtatacggcgttatccacctttatgatattttcgtactgcttttctatcatgggcagaaagcctatttcattcagcttagcacacgcatctgccgccgcttttctgctccgttctttagcgagattggcacatatcattaccttcatgatatttcacctgcctttgtaagttatatgttataaacgtctgagatatataagatactcggtattgccgtcaccgccggttatgggcgaagatatgacctctccccgttcaaacccaagagttgaggcaaactccgatatatcatcgcatacttttttatgtactttggaatctcttactattccgtgtttgctgagatggctttttcctgcttcaaactgcggcttgataagtgctacgcactctccgccgtctttaagcagtgcataagccgacggaagaacgagcttcagcgatataaacgaaacgtctatgccgataaaatccaccgccggcaaagcacctacgcagtttcttatatcggtcttttccatagaaactactctgggatcgtttctcagtttttcatcaagctgatctgttccgacatcgacagaatagacttttaccgcaccgttttgaagcatacaatcggtaaacccgcctgttgacgctcctatatctatacacacagagccgtcaaggtgaagtctgtagtgggataatgccttttcgagcttcaatccgcctctgccgacatatttcggcatctctccgattattctgatattatcgttgtcatcaacggcaaacgatgcttttgtgcatatcctgccgtttacctcaacgcttccctgctttatgagcgatgcggcaaggctgcggctttttactgtgttgttttcggaaagataaacatccagtcgtttctgcatcttattctcctgtaatttttctcattccgtctgcgtcgagcattgcgttatgcagctgtgccgcaacatcggcatgacggacaaatccgtcaaccgccgttatggtaaacctgcctttaaatccggcaagagccagagcggtacacagcttctgagcaattccgccctctctttcgccttcctcaaaggcatatatttcatcataagcaagacaaatatcaatcatttcatcggcaatagggaaaatttttattgcctgtaaaacatcgacaccgtgaatggtataagcgtaggcggatattctgccgtatgtgaaaatcagctttctgcttttatttgaaacgtgcctgaagtcgctgtacgccttcgtgcctgaacggtatagctcgcatcctcttgggtatcttacggcaactatgcctttatccttgtaaagagcctgctcaagacactgcgaaagctccgccgtatctgacggcgaatacacggtaacgccgggtacggtcgtaagcatcgcaacatcaaacaagccgtgatgcgtttctccgtcctcgccgacaaagcctgctctgtctattccaagcacaatatgacgtttttctattgcacaatcgtgtataagctggtcatacgaccgctgaagaaatgaagaatacaccgcaaacacgggcagcttaccctgacttgcaagtcctgccgaaaaagtcactgcgtgctgctccgcaataccgacatcaaagaaacgctccgggaaagccttgtaaaaatgctgaagccctgttccgtatttcatagcggctgtaacggcatatatgctgttgtctttatcggcaaatgagagcagagcttttccgaaagcgtctgtaaagcactcacctttgcaattgttatcatcgtcttttttaggcggcaaaccgtgatattctcccgaattatcctctgcgggagcatagcctttaccttttttcgtataaatatgaacaaggcacggacgctgcatcattttcgcaaccataagcgcctctgtcagctcatcaagattatgaccgtctataggtcccaaatatttaaagcctaaatcttcaaacaggtttgaatgataaatcgcatatttcagcagctgcttagtgccttttaccgcttttccgatgccttttcctattatcggtgttttatcaagaacattctttacggaattctttgtgctgtaatattttcttgtagaacgtatctgcgccagatacaaagcgagcgcaccggtatttttggagattgacatctcgttatcgttaagcaccactatcaggttacaacggctttttccggcattgttaagaccttcgtaagcctctccgccggttaatgcgccgtcgcctataacagcaacaacgctgtgatcgtcgccgtctgacctcatagcctcggcaataccgagtgccgcagaaatagaaatactgctgtgaccgccgataaaagcgtcatgctcggattcttccgccttcggaaatccggaaataccgccctcacagcgcagagtattcatttttcccgctctgcccgtaattatcttatgtgtataggactgatgccctacatcaaaaacaaatttatccttcggagagtcaaacacggtgtgcattgccaccgttagttcaactataccgaggtttgacgcaagatgaccgccgtttaccgttaccgttttcacaagtaactgtcttatctccgaacacagcttttttctttgttcgggagtaagcgatttcaaatactcggcggacatatcgtttttcagtatcaaattgtatctcccgatattattttatcagccgaccacctgtatcggtacagccatagctataagtattccgagcaatgcgccgcagagcacctcgagcggcgtatgtccgaggaattccttcagttcgtgtatttcttcaggcttcttttcttcaatctcgtcaaccttatcgtcgaacttgtccataaattcctcgtcaagctcattgacgacacgcctcagacgattgatttccttagcctgaagtcctgcggatcgtcttacgcccatagcatcatacattaccaccatagcaagtatcatagcaagcgcaaactcgggcgagcatattccgcagactctgcaggtggttattgcagtcgcacagacggtagccgaatgtgctgacggcataccgcccgcacccgtaagacgctccgctttaaagttcttcgtctttatgaaatgtatcaacgtttttaaaatctgtgcagtaccccagctgataagtgcaatcagcaggataacattgatctgatcagttctcatttatgtctgaccctccggggttatattccactgtcaattttttctgtttaaaagcaaatcggtaagccggcacaaaaactcgttgttttcaaatgccgaaagtgccttttcagccccttcggtatattgttttgcaagctcccttgctttatcaattcctaaaagagtaacgcttgtagtcttttcctgctgtgcgtcactgcctataggcttaccgagttcttccactgtagatgtaacgtcaagaatatcgtccacaatctgaaaagcaagtccgacatcgtgcgcataggctcttgccgccgatattttttcctcatctgcgcctgccgctatacatcccataacagaagccgcagtaagaagctcggaggttttcatttcgtacattgacagcaatccgtcaagcgtgtcgaatttcccgtccgtatctatcgtctgcccctctatcatgccaagcgtcctgtcatacagctcttttatcatcgccgtctttttttcggcggataagttgctgtcgcagatatatttacctgcgtaggcagataatgcgtcacctgccagcagtgccacagcctcgccgtgtgccttgtgacagctcggtctgcctcgtctcatatcgtcgtcgtccatacaaggaagatcgtcgtgaataagcgagaatgtatggatcatctcaacggcaacagcggcaggcacggcatcgtttatatctccgccgcacactctgcacatttcaaaagcaagcacgggtcttatacgttttccgcctgcctcaaggctgtatgatgccgcatcataaagagccttgtattttgcaccgttatcacagaatgaatcacataccgttctaagctgtttctcaaaaatcgcacggtattccctgaacacagcgtcaaattcgccgtagtttgcaggaaatgtgtacttctctgctgtcattttaaacctcttccagtttctgtaccgtcagctttgcttcatcaatatacttacggcaaaaagctataagctcgaccgcttctttataacacttcatcgaattgtcaagtgttatatcgggctgttccatctgtactgagatttcatcaagtcttttcatggctgtttcaaagctcatctaaaacgctccttattattttcgtgtatttcctttatctgtgctgtagccgtaccgtccgcaaataatatctcaacggtatcgttttgttcaatatcaccgatactgtttacggcgctgttgtttttggttactgcactgtatccacgtttcaacacatttatcgggcttaacgcctctatcttgtccgagtaattgtcaagcaacacgctgctttttgtaataactgcatcggttgccgttctgattttaccgcttataagcacaagctccctttcggatctttctattctttgtccggggctgtaagctgaaatgtgcctttgtatactgtctataagctgttcgtagctgtctgtctttgagtggataatatcgctgagcctgtcgtaaacaagctcgatatgctccgaaagatcatcgcaggtaaccgcagtagctatttcagccgccgcagacggtgtaggcgctctgaaatccgctacgaaatcggaaatggtaaaatccgtttcgtgtcctacagcggaaattgtcggaatctcgctgttgtacagtgccttcgcatatccgacatcattaaagcacgacaagtcctctgccgagcctccgcccctgccgatgataatcagatccgaaccggtactctgagccagagccaatgctttgataagagttgacggtgcatatgctccctgtaccgttacgggaataaaaaccacttccagtataggtcttcgtcttgcaatgatattcagcatatcctgaagcgccgcacctttttcagcggttataaggcaaacctttttcggctgtttcggtatgggacgctttttattgaagtatccgcctgcctcgagctcacgctttgccttttcatacgcaagagcaagctcgccctgtcccctttcgatcatatcagtgacataaatctgattagctccgtcacgctcgtaaacattcacgcttccgtgaacgattacgctctgaccgctgtacggagtgaaatcaagactgcgggcattacctgcaaacataacgcattttattgaagccgtttcgtccttcaatgtgaaatacatatgtcctgacgctttatgcaaagtaaaattcgaaatctcgcccgaaacatacaaatcgttcagagccttatcgccctttactatcatcgaaagccgtcttgtcacctgagaaaccgttacggtaaaaaaatcaggcatcaggctgttcctttgtcggattgtccttataatatgaattgagaacgccgtttataaagcgtacatctgtcttgtcggcatattcctttgcaaattctattgcctcgtttatggctaccttatcgggtacggacgggcagtatttcatttcatacagggctattctcataatagcaaggtttatgtacgaaattctgtcgagctttcttgaaggtgaatagctttcgattatgccgttcagctcatcttcatgctctgcaacacccttcaccagcttcacagactgggaattgtattccatctcaaaggactctttgcaatcctccagtatctcgtcaagcgtttcggggttaagtttcatctgaaagagaatgagcaaagccgcttctctcatttcgtgacgtgtaagttttctttctgtcatttaatctgtttcctttatttaatcagctgattttgaaagcataatatcagcaatttttacatttaccttagatacggatatgcctgccatattctgtatagcagactttacgctctcctgtacggaacgtgctacattctccgccttgaagccctgcaacacaacaatgcttattgtaacctcgacagcatcgtttttcagcaccgccttgaccggtgactgaggcataatttttcccgtaaactgagccatattcttgtcgcagataacaagatgctcaccctcagacgcaacgcctcttatttcggttgccgcaacctctgcgatttttgtaagcacatcatttgatattctcagacttgcgcctgtattattaacttttttattcatagattaactgcctttcccgcaggcaaatatgcactgcgtaaccgtaaataacagtatccgtgccaaagggcacacttaactactataatgctattatatacattatacaccagacacgagaaaaatacaagtgcataagctatattttattcatctctttaatgcactttacacttcttctatgatcgaactgtcgccggtcagcagacgcaaagctgtgaccgccataatctcgtacaggctctcagagccggttctctttacgggtatttcaaacggctgtatttcatcgccgccaagcgtggttaccgttcttccgaatgaaaccgatatttcctcatcggtaatgcttgtatatgaaaccgtatccattattagatttccgcacgttatcacattacacgtcagatatgacaaagttttcatctgttctttattcagagcgtttgctattattaccgccgtgtcgggtataagtcttggaatagccgcagtattttcacccattacaacaacgcaatcatccgttacaagcccatggagcgaatcggtacgccacaagttcactgcattgccctctcccgacagatacattgaattcatattataaaaccgtaccgaaaatgaacgtgaaagagtttccgctataagcagggacagtgattcctcactgtcaattacaattatatccgtcataaattcctccgtactatatcaatataatttacagtaaggcatattatatgcaaaaaaatccgccctgacaaaatacgtcagagcggccccgaaattccggaataattctcctcttaattacttaaaacgataataataattgcttatctgcattcaacgatgaacttcatcgcagtgcgttcctcaccgtcaatgctgacagttgtgaaagcgggaatgcaaacaagatccacgccggataaagccatatagcttctagatattgcaatagcttttactgcctgattagaagcacctgcgcctacagcctgaacttcaacttcgccgttttcacggataactgctgctatagcgcctgcaaccgactttggaacggattttgctgaaacttttactacttccattttaaacctcccggtaatttattcagtatctgattctcttgatagaggtgcagataccgcttttttcatcaacagatacgacaacgccgcaaataaaatagtcgccgtctgcgtattcatatctctgcggatagcctgtcatcatattgctgataataatctcttttttgattcccagtacggaatctgttacacctgtcattccgacatcggtgatgtaacctgtatgaccgccaagaatttcttcatcggctgtctgaacgtgagtatgagtaccaagcaccgccgatactctgcccgtcagatagtgtccgagcgctcttttctcagatgttgcctcggcgtgaaaatcaacgatgattacctttgatttcacttcactaagtatcctgtcgatacagtggaacggattttcaaggttctgcatgaaaaccacgcccataagatttatgacacacacggaatatctcccgtggtcaagaatcgtatatcctttaccgacaacatcatccggaaagtttgcagggcggataacaaaatccgacgtttcgtaaaaagcgtccatctcttttctgcggaaacaatgattgccggtagtaataacatcggctccgctttcgagaaggtattttgcggtaacgggagtaatgccgttaccgtcagcagaattttcgccattcacaataacagtatcaatattatactcttttttgagcaacggtaatttttctctgagattagcgcaggatttctgtcctactacatccccgataaaaagtatattcaataaaacacgtcctacagtattgttatcgcattagttatctttcgattatctgctctctgtcggggcctacacctaccatggagatgtggcagtcgcagagttcttcaagtctttcgatgtacttcttgcacgcctcgggcagctcgtcaaaactgcggcaggaagatacatcatcgtcaaagcccttgagagtttcatatacgggtacacaatcggcaagttcttcaagcgctgcagggaagttctcaataacagtgccgtcgggcttcttataagcaacgcacaccttgagatcgccaataccgccgagcgtatccagcttgtttatagcaagcgaagaaagtccgtttactcttacggaatgacgtacaataacagcgtcaaaccaacctgttcttctgggtctgcctgtcgtagtaccgaactcgccgcccttgtttctgattgtttcgcctatctcatcattaagctctgtcgggaaaggacccttacctactcttgttgtataagcctttgcaacacctatgatgtttgaaataatcataggtcctacgcctgtacctacacaaacacctgcagaaagcggatgagaagaagtaacataaggataagtaccgaagtcgatgtcaagcagtgttgcctgtgcgccctcgaacattatcgtcttgtttgcctttgcagcctcgtatacgattaccgatacatcgtcaacgtactttgcaagacgcttaccgtattcggtatattcctttatgatagcttcaatatcgtgaggctcgccgccgtaaacttctgtgattatcttattcttgagcttacctgtcattcttaccttttctgcaaaaacttcgggatgaacaagatcatagacacggataccgcaacgctcgtatttatccatatagcaaggacctataccacgctttgtagtacctatatcggagttgcctctgaatttttcggaaagtccgtcaagagtaatgtgccacggcataacaacgtgcgctctgggatcaatcttgaggttatcgaaagaaatgcctcttgatgaaaggtcgtcaatctcggataaaaaatccttaggatcaagtaccacacctgcgcctataaggcaggccgtatttttataaagaatgcccgaagggatcagatgaagtttgtaagtctgaccgtcatttactacagtatgtcctgcattgttaccgccctgtgaacgaacgaccacatcggctctggaagcgataatatcaataattttaccctttccttcgtcaccccactgagttcctacaactatatttgctggcattggaagtccccttttcttttaattaaattagtatcatatccgcaaaggaaacctgtcctttcgcatagtacattgttattatatcaaagaccgtcgcaaattgcaagtattttttgtttcttttgcagaaagtatactaaaaatgcggcaattttaacttgccgcattttttaaacgcaggtatatcaatatgatgatacgccgcttcttgttacatattcctttattccatccacaatagcctgtgctataccgtcctggtcggtcgaatttgcaagagccatcgcatcctcatagttgctgacaaatcccatttctataagtacagacgggaaatcctgctgttttgttgtccacatatagctgtactgcgctcctctgttgcagtttgctccgtccgaataaacattattgctgaaatatgaagaaacgtgccttgtgagcgactcagcgagcggctgagagtacgatgtgtaataatagcactctgttcctctcggactttccgaacccgccttgtttgaatgaatggctatgtataaatcacagccgtaatcacgggcataataaggtctgcgttttgtgtcgtaaaattcgctttcggtcttgagccttacaacatttacgccgagagccttgagctttgattcaaccagctttgctaccgcaaggtttgcgcctgcttcctcaatatgtcctatcgcaccgggatcgtcatagccgtactcggtcacgccgtgaccgggatcgattactatagtcatattcctaatgtcgtttgtaagtatctcaaacttgaacagcagattgccttcgctgtcgtatgtggcgctgtttccggcataaactcccggttgtcttaatttaagtacaagccggaacttcataacgccgtcaacgtctacctgctgccactcacccgcactgaacactgtacagttgtcaaaatcgggaagtgcagtaaccgaggttatattatcaaacgtgatattgatatgagtagccgtgaaatcgtcaagattgaactcgccgtcataaccggaataatagtcgtttccgataggcgtaacggtaaatgacgagcgatcctccagcgccatctgtatgaacgaatctccgcccatatttcctattgcattgacaacaagaggattttcacccattccgacaccgcttgtaaggtcggcatcttccttgaggaatcgcttgcccgatgttgtgacataatattcgtcccattcactcttataatagtcgagtgtgccttcgggaagctgacccacattcggagggttgacagaatcggtatttgagccgtcatagatataagcaaagttcttgttcagctttacataagtaacgcttgtatcctccgaaacggcggcagacagtcgtccgactatctctcccgtaccgaaagagctttgatccgtcggaatcttatcgattatctctatgttcttatcgggcagctttactgcgtttacaatgacctcggcacctatatatgttcttgaatatcctgcatatgaagcggaaatttcaacatttccgagatactgttcctcatcgactatgccctcgggaacgacaatttttcctgtgaatgccgcatacgatgagttaatgtcaacaacatccgattttgcgttttcggtaagctcgattgtagtgccgccgagcgttgctgtagcataagagcctttataggcgaccgcaagcacggataccgccatacctccgtcgaccttaagtgtcttgccctctgctactgagcttcctatagatttaagaacgttgattgtgcgttcgatgttataatatatggttttgcctttgtgtgttataacgaaagtgttcattccgacttcaagctgtttttcaaagtagaagtttcccgcctcgttaagcgataatttttcaccgtcaaaatatacgtcaaaattctcgtcaaacgtacccatgaacgctaccgatgtatcatccgtcgaataattcgtgtaatacggcgatgtcatttcaaggtcttcaaaaaggctgtcaacatttatctgctcgttgaaatacttcgtgagcgtatctgttgttcccatcggattttcctcaagagatttctccgaatagaacacgcttcccgaataattatcaagctcatcggcttttgcaagctgtttgagaagctgatcctcaacttcccaaccgtcttcgtctgttcctattttttcgttatgatgaacaatatagaacggtatcttcgcagatttagcaacattgctccaccaggaacaaacgttctcaaatccgacagtttcattgtcaagcgaaccggacgcattgactacaataaaatccgtaaggcccttttctacaaaagacttggtatcggcatagccgctatagaaagcagtgtattttgcggacgtatcactgccatttttattcttcgaagcgtttgcccagacatcctttgcgtcaatgccgaccgctatggaattgtccgacagacgaataacactgctcacggttgagaacttatattcaaccgtatcataaagccagttcttataacctatgcccgaaccgttcttcatatattcttcataagcgctgttattgttcgcaccgtaaaatcccgtaagtattataccgttgcatctgtatttgagcgcaaatttatgagcctcgctcacaagataatcatagcagtcctcgccatccgggcaagccgccattgttttgtttatgtcgaaatagacatatctctgcattccttttttagtagccgcctcaagagccttttcaagcctgtcgccgctcttgttcatatttgtggtataatatgtaccgtcttttccgtaaggattgatgtacactccgttcataccataagcaatgagggtatccagcttttttgaaaaattttcgccgaacttctcagccgcaaaatcccctaaatttatcaacgttgctttaagctcgttcgataaagtcagcttaggctcggctatctgcggagttgtctgttttgactgctcggccgattctgccgatgcggatgtgttttcacttgtgttttccacagcaacggcagtcagctgtgacaaaagcataaaagccgacagcactcctgccattattctgataaatttatttctcatcttctgctcttccttccgattattacggcacttactgcgttagaagcggcttgaatgccgctatttccttattaacagctgttttaacattgctgtcaggctcaaaaatgaactgatagctgtaaagaataacgccgccgtaattcgacgttttctgtgattttaaaatctgccttttaataatttctttatcgttttgccattcgtatcttccgcttcctgcccattcgtcctcagtgcctatcttgtacactgctagaccgggtataagcgattttccggtaccggcgagcattttatcccactgctcgaccacctgttcaaacggctgaccgccgttatcaaagccgtaatatatctgaggagccatgtaatcgacatagccgtcctcttttgaccatttctccacatctgcataaagctgtgtttcattgtttgtaacattgccctgtgcgctgaccccgaacaatgcggtaggattgtgcgacttaacagccttatacatatccgctaccatacggctgcaattatccagtctgaactgtgacagactgctatatgatgaagcattgaacgcaatgctgtcaaaatacgcttccgttgtgggatagaaataatcgtctatatgtacgccgtctacatcatattttgaaacaagctccgccgctccgtttgcgataaggtctgtaacctccttataggcgggattgagccaccagtaagaattgaccttgactatatagtcgccgtccttcgtgtcataccactgacccgttttatacgttgtgcttacatcaggtgcgtcatcttcgtaagtgctgttcttgatattggtgatgataaactcgccgttttcaagcatagcaagcaccttgtcggtttcttctttattgagtgccttgaacttctcgccctttacctctgtcagctttgcagggaatgcacgtctgctcgaagcggacaacagctttgcgtctatgctccagtattcctgtgcctcaaagctctctatctcctgctctctgtcaacgataagccttaccgcaaccgactgtacacggcctgccgaaagacctcgtctgactttcttccataagaacgggcttaatttatagcctactattcggtcaagtatacgtcttgcctgctgtgcgttgataaggtccatatcaagcgttctcggatggctcatgcccgccgcaataccgctctttgtgatctcgctgaacgttacacgcacaggtgcgtccgggcttatcccaaggacgtgtgccaggtgccacgaaatagcctctccctctctatcagggtcggtcgcaagatatactatgtcagctgcctttgcgtctttcttaagctcttttataagagccgccttatctttcttgttctcatacttaggctcaaagttgttgtcaacatcaactccgagcttcgacttcggcaggtcacggatatgacctacagatgctactacggaataatcctttccgagatatttctcaattgttttcgccttcgcaggcgactcaactattaccagatgggacaaatttttcgtcttcctttccgtgccggcaatatgccggttcaaattcgcctttcaaactgtttgcgtattgccgacagtttgtgtacggcgggcggctctcgccgcacccttttaacattttatctttgcttttttattttgtcttagcaaaacggcaatgtgccgctctgaattcgccggcaatgtaccgtttcaaatttgcctttcaaaccgcttgtgcgtttctacacctcgtctgacggtgggcggctctcgccgcacccttccggcaatgtgccggttcaaattcgcctttcaaactgtttgcgtattgccgacagcttgtgtacggcgggcggctctcgccgcacccttttaacgttttatcttagctttttgcttatataatgaaggtgtgctatcatcttccgttgcactatctttcttggctcccttgccaaagggagctggattgcgacaagcgaagccgttatccatacctctatgttcagcgattatttcaacgttaaaatcattcccgtttgactgtcgcaagactgagggatcgttgctacaaaccttattgtcgcttctgcgttatacaagcaattctcaacaattaaattacggcttgcaatctcaacgctgaattataaaccgcaattattaaccgtatttaacgttgagcttactctctgacctttgacatttcccacgcaataaccgatgccgcaaccgatgcgttaaggctctccgcactgcttatcggtataaacagtgatttatcgcacagctttttcacggtatcgctgaccccgttgccctcgttgccgataacaacagcggtcttttgaggcagcttttcttctcccagctttaccgacctgtccgaaagctccgccgaatacacggtaaatccgcccttttgcaaaagcgttatcgcttcttcggtatcacagcagtatatcggcagtctgaacaacgagcccatcgcacttcttaccgttttgggagcaaacacatccgcacaatctcctgcaagtatcaccccgtcaatcgaaaatgcgtcacaggaacgtattatcgtaccaatattacccatatcttgtaaattttccaatattataaactgcctgctactatctattgtacttaaattcagaattttgtcaagatgtcttaccgtaataaatattccctgcggcgattttgtgtcggaaatgctgtccgccacctcctcgcttatttgtatcatcttacagctttccctcagcagacttatacattctggatatttctcggcggcggcggcagtataatatgcgttttcacctaacgcacatccgcttttgaccgcttcaaccgcgagcttcgccccctcgcacacgaaataccccgtctgcctgcggtacttcctctgctccgtcagcttgcggtattcctttatatatgtgttctgtttagatgtaatttccatatttctccttaacactcagtttcttgacttttgcgtgtccttatgctaaaatttcattatccgtaacggacaagaaaggatttttttcatgatattttccgagctaagccttattgaaaaggaaacaggacttaaatacgatcccgaaaccgccacgctcagcggtgtaaagaacggtgtacccgttgtcgtttttgacaacgataaaaagcacagatttgatatagtatgcggtgcggtcatcaccgagcgccagttcggcagaatatacattatggctgaacgctttcccaagaaaactatgctcggcatcgaaaatgtcgatggctgcgtaaacatttactgcaagggatataatcttatgcaggaaaatctgccgttgctcattgaatttttggaaaaactcacagcctatttaaaaagcgaaatgcgtaaaaccactcccatacaggtggcaaaagtgcttgagcttgaggattacacaattctcacaaagcatatacgctcagacggaactgtccgccctccgtataatataaggggtactgtcaaaggtatcttaggcggtctgctcggacttctgatcggttgtgccatattcgttgtgtttattatgatgtcggaccttgtcggctggataggtggtataatcatgtccgccgcagttatttcgctctacaccgttttctcaaagaagctaaagacggttgactgcattatgacagcaattctcacctttgcgggctgggcattatcaaacggcttcgcatacctgttccagatattcttaaaggaacaggaggcaggaaacacggtaaacataaacggcattcttgccgatcttgcgaactactcaatgaagtacaccgagattgcaggcaaccttatgaaccgccttataataacattcattttcgtggtcgcaggcgcaataggcagttatattttctattacaagcatcacacaaaggatatgtactgataacggttattatgtgcctaagcacagccgcatttcttccccgttatataaaaaatcacacgcccatttattatgggcgtgttgttttctcttaaagagcagccttagccttctcaacaagtgcagtaaaacctgcaggatcgttgatagcgatttctgacagcatctttctgttaagaccgatattagccttctttaagccgttgatgaatgtagaatagtttgtaccattcatcttgcaagcggcattgattcttgcgatccagagctttctgaaatctctcttctttaaacgtctgctgatgtaagcgtactgacctgacttccagacagcttccttagcagtcttgaaaagtctgctcttgccgccccagtagccctttgccagctttaatgttttatttcttctcttacgagttgctaatgcacctttaatacgagccatcgttaaattcctcctatagtgaatattgcgccgaaacggtcgcagttagtttttatttgtaaggtatgagcttcttaacttctgcaacgttcgtcttgtcgcagtatcctgcagcacggttgatacgctttctctttgtagccttctgtgtcagtctgtgacgacggttcgtcttctggtacttgaccttaccgttcttggagatgttaaaacgctttttagcaccgctgtgggttttgatcttgatcttctttgccatgagtggaatcctccttatttagtttccgccgttttatcggcgtccttctttgctttcttaccgcctgcagcagccttgggagctacaactgccatatagttcttgccctccagctttgcaggcttctcacaagcaccgtactccgaaacagcctcaagaactctctgcataagctcctcaccaagatttgcgtgtgaaagctctcttgctcgtctgtaacgaaccttgatacgaaccttatcgccgtttttaaggaactttatagcctgattagccttcgtgttaaagtcgttggtgtcgatgttcagcgacatctgtatctctttaagctcagcttgtttctggttctttttagattccttttccttctttgactgctcaaaacggaacttgccgtaatccattatacgacataccggaggagtagctgaaggagcgataagcacgaggtctaagtcagcctcaatcgccatatcaagagcctgcgccgaagacataatgccgagctgctcattgtcagctccgatcacacggacctctttttcatttatctcttcgttgatgagttgttcttttgtgctgattgtaaagcaccgcctttctgaaaacaaatcgttttatgcaaaacaaaaagcgtgataaactgcaatgcagattctctcacgctgtacaaatattacagacagatttataacgccgtacagcgtcataaatcgtcggaaatttctgtaattacctcattgaacaacctttcggcgtaaatgggtgagagtgcttctctgcttttgtttcacaatttaatttacctgctgattatactacatttatccgccgttgtcaatagggaaaatcaatttttttgttaaaacctataaaaaagcgtaaaagcagcttgtttccctttgccaagagcaatcagcggaattatttctcagcctttatcccgatacattccgccttgcacgctttctttcctcgcctctccgttataagatacgataccttccgtacaacatcggatatgtcaatttcagcattcattttatcacttgcaaatttgatatgatatggatatatcgtagcataggcgaacggatatttcaactggtttatacagatgttatgtatgttgacaataccgaaagcatcaatctttctgaaccgtccgtttcaacctaacaggatatatctcaataacaaaatgcggtttatctatgtttgttaaagggtgactgtcggttatgtcaacagttaccgtatcaataaccgttttaataaagccatcggtatttccgataacaatgtactgagaagaaagatactcaatacctcctgtttcatcgggttcaagcggaattgtttcaaacggcttttctatatcaacacctaaagcaagcagatattccgcaactttcggataggcatttctgatttcacggatatagttacggcaatacgcacagttacacagatcttcggcggttaaactgtcgtaatactgttttgtttctttgatactcaatgttgacacctctttcatctgctacagagctgtataaaatacagcaacatcccctctctttacagtgaaggcaaaatcaacgccttgattacatcattttttcagtctgacctgcaattcagattaaatcgtacaaaccgacaaaacccgaaccgccaacagcttacttaagcttacttatccgtagccgccttaacgcttgcatactcactgaactcggttgtacttcccgtctttctgaacgattttattctgaaagaataagtagtaccctttgcaagccccttgacagtaaacgtaagcgtggtgttgttctttgtagtagcaagcgccgtccactttccgcccttatactgctcgataacgtagcctgtagccttgtcattcttgctccagtcgagctttaccgcacttgcagaaaccgcagaacctgtgaatgcagccacattcggtatcctcgtcttgcctgcaattctcacataatcgctgtaagctgtaacaccgccggcagtcttatatgcccttattctgaacgaataggtggtatcattcttaagtcccttaacagtaaacttaagcgtggtattattcttcgtggtagcaattaccgtccacttaccgcccttgtactgctcgatagaatagccggtagccttgtcattcttagcccactcaagagttatccacgagcctgttaccgatgtaaccttgagatcggacacaccgtcaagaagcgtagccgcctttatagccgtatactcactgaaatcggtcgtacttcccgtctttctgtatgattttattctgaaagaataagtagtaccctctgcaagtcccttgacagtaaatgtaagtgtagtgttgttctttgtggtagcaattgccgtccattttccgcccttatactgctcgataacgtagcccgtagccttgtcattcttgctccagtcgagctttaccgcacttgcagaaaccgcactgcccttgaacgaggcaacattcgctatccttgtcttgcctgcaattctcacatagtcgctgtatatctccgattcgcccgaaatagcataggctttgattctgaaggtatatgtcgtgtccgccgcaagtccgtttacagtatatgtaaccgctgtgttactgctcgtctttgcaatctgagtccacttaccacccttgtactgctcaatgatatatccctttgcatttgcgttcttatcccacgcaagagtaagcgagacagtgccgtgcgtctttaccttcactccggttaattctgtcggctttaacgcaggcgtataattatctttgtagctgtaaccgcactttgtacaggtatgaagagtgtagccttgagccgtttctgtgggtttaactaccgtgcttgtaaaactgtgaatgtgcttttcagagcttgttcccggttcttcggtcatatcataaacaaagtatttatcgggaacagcatcagtatttctgtctaccttaagtgctttgacctcatccggtgtcagcgtcaccatatcaagatactttttatccaactgacctttttcgacaaactcttttattttgtcataatatgcgtatccgttttcaaacgagccgtagcttgccgtccatatattatcatcagaagaataattaaataaaacattattctttttaatttcaacagaagtgaccgtgctatatgacacatattttcctgtatcatagttgtatttgtactcggtcttgtattttacaagaggcagatccgtctttatgaaaatactgcttgtaggatgattctcgaatttttctcccggaacaaaattctcatatgcatcaacatatcttccgtctacccatacatctgaagcatatccgagatctccgccccagtatatttcaccgccggcatttccggcattttgggtgctgaaatagtctccgtcgccgtccttataaagatagctgtatccgatacccaagcctccgaatatgccggtgattgttatcagacgcacccatgagccttcccctacagtatcataaatactcttccatgtaagtgcatcctcacggggtacatcgtcctccatctttatcgaggcataatatttcagcagttcccttaagctgtccgttgtcagcttggcagagctgtttgtgaatgtaaaatactgctttatcttatcgttgcttataccctgtcccttgccggttcctgcgcctccgtaagaacgtgtttctccgttatacgttacgtctacaagataatgatagtcttcgttccacgacacctcagccgtgttgtcaagcctttttgctaccgttgacattacgctcggaaagccaagtgaatcatagcggtaaggataggctgtcgatgcaaaaagcggtttactgtttttgcgcttatacggagattgaatatagaaaagctgatccttgtgcggagaagtggacattccccagtaatcaccgactttgtacaattcaccccgtatatacgatccgctgtaaaggcatatcgaagaaaaaccgctctctaccgcatccatattatcgaaaaaatccgatttcgtcgcatatgtgtcaataagataatcgacatcgtcttttaatgtcggaagtcttagcttaacaccggtatcttcccatgtcgaagaatagtagctgcccgtgcttacgttactctgaagttcgacctctccgccatcagtgtatgaccctctgaaaatatatcccccgtcaactcggcctgtctgaatgttctcatactttatatcttcatacaaatacggaccgtcattgcgataatcacggttcggactgatatttccgctatcgccgtagattgacgatttatcaataaatctgaacgagcagggatcgggattatccgtctttacaaagaaatattcgttgaacggctcaaggagcggagttaccgtataactgtaatcggtaacgctcttttgggcagatgcgctattcactttttctgcgccggcaacaacagcgacccctccgcttgctaacggaagattatcgcaaagcggagaacaaacggctgtagcaagcattatagccgccgtaatacccgaagcggtttttctgattctcatactatctcctcctgaaatttcgcaatatacaaacaggcacagcccctcgcaaaagagctgtgccaaaatatcaattatttcttattcgccggttgatatttgtctgaacatctctcacgaacgctgtaaattaagctgtaataatttatcctaagtatatcattgataaagtcgattgtcaagccatcggctcactgtttatgcatcattatgccgccttatcgccatcactgcttaccgcttccccatatattctctttcccatctacatattatgcaacaacaaaagacacggcagcttacgcaggccgtgcctttatttcttaaccgattggatttgccgtctttcgacctcacttcccgccgaacacaaaaatcgccaatatgataattgcgagcgaacctatgcaaattatccagtttctgttataggtccggttcatcttcttctcgtgttccatacgctccagacgctttttcagcttgtaatcgggttcacgtttcatactttactcctttcatttcacgcttatgagccaagctccttttccttttgattgccatctcgatccacgcctcattttcctgctctataacggttttcccgacttgctttgccatatctcttataactttctgcaaatcgaaataatcattgtaatcgcttattttactccaactatttcctttgtaataaaacgtatctgctgagcaggttactccttccgcctttaaattccacaacttctgcaatatataactgtcaatcggggcgtgaagccgttcctcttttatgtcattcggcaaatccccaagcagccataaatatttgagcgccatattgagccatttctgcgcatttccgtatgtaaagatgcttttattgctgttcactccatcataacagcctataattttcccgcaagttttttcgtgccatttgtcaaaactttcctgcgtcgaacgattgactttttcgttgtaaatttctcccattatcaatttcgttgctttgcaataagctgaatatgatttatcagataactctttacttatcaaagtattataagcacccatcatagtcgcatcgttatatgcctttttaagtatattctgtattaagtcattatgattgttttcgcattctttagtcttaaaatatgtaaatataaaaaattctcttaatgccttgctctgcttgtcgaactgttcgttactcataagctccctcgaatttccatataattacattcaagcttcaacaattttcacttacagtttattacttttattgcaatattcggataaaatcagcgttataattcatcgaaattcatcacttgtcgctcaaagcgtgatttctcactttttcctgattatatctattatctgcgtcatcggatcctcgttgtttgatcctattattacatcagctgatgattttacctcgtcgtgcgcattacttacagcaactcccaggtcggcactgcgtaccatttcagcgtcattcggatagtctcctgccgccacagtgaacctgtcctcgcttcccgtcaccctcagaagctgcttatatccataagccttgctcacgccctcgggcagaagctcgtagaagaacggcgcagacagcaccctgttcgtcccctcggcacaatgctcatctatgaacctcgcaagctcaggcatcttgtcctcagggtaggcgaacagtaccttaagccagccctcatgcggaatatcgtcaaggctgcatacatctccgtgtacgttctccagtgccatatgcgccctctccacatcgttcagtgccggcacatataccgtgtgcttatgaagcacctctatgcctacatcgggaaacctgtccataaccagctttatgtaatctctggctttctgcgtaacctcgctctgccacagaaattcgtccttgtcaaagtcatacactgccgacccgttgaagatgaccgcaggtatcctcagcttcagcttttgtgcaactggccgtgccattgaatagcctctgccggtagctatcgtgaacattccgcccttgtcgcagaattcgtttatagattccatatcccttggagaaatctctttcttatcgtcaaggagcgtgccgtcaaggtcgctcattattatcacatttttgaagtccatagtttctttcctttgttcaagccgtttatatctctgtcttttgcgtttcaaggttagcgagcagctttttgaagtagtcgggcagatcgctgtcaaattccatataccgcccgtcagggtggataaatcctatcttttttgcgtgaaggcactgaccgcaaagccacttcggactgccgtttccgtacacctcgtcacccgtcaccggatgaccgatatatgccatatgcacccttatctgatgcgttcttcccgtttccagacgcagccttacaagcgtattgttcctgtatgtctgctcgacaaaatagtgggttatcgcctctcttgaattctcggtcgtaacgcacatcttcttgcggtcggtcttgtgtctgcctatcggcgcatcgaccgtcccgtcctcttttataacgccctgaacgaccgccatatattcccttgtaaagctgtgtacctttatctgttcggcaagtatattgtgtgcggtatcgttctttgctacgataagaagtccgcttgtatccctgtctatcctgtggacgataccgggtcttataaccccgtttatccccgacaggctgtcgccgcagtggtacataagcgcatttacaagcgttccgctgtagtgacccggcgcaggatgcaccaccattcccttaggcttgttcactaccagaagatcgctgtcctcatagactatatcaagaggtatattttcgggcagaatatccgcaggctgagcctccggcacatcaagcgtcactgtatctcccgttttgagtttctgattcttggcggcaattttcccgtttacaagacagcagccctgctcaataagagcggcggctgctgatctggttattcccgtatcctgcaatgcaagaaacttgtctgttctttcgccgcctgttttacaggtaaattcgtaatgcaacattaccctccatagcggtgttatttatcttcgtttgttgatttctctatttccccggctgctgtatttttctttgccgagcgtttgttcttctgctcttttatctcgtctgctacaacaaaaagcagtaatccaagcgctccgagaacggcgcatatatccgcaatattgaacacggcgaagttgattatccttacatcgataaaatcaactacctcacctcttatcactctgtcgataaggttgccgataccgcctgccactataagcgacatggaccatatatacgtcggcttcttcactctttttgaaagcatcagatacagcataacaacgataaccacagccgtaaacagtatgagaaacagctgttttccctcaaggatactgaaagcggcacccggatttctctcgtaggtgatattcagtacatttgtatctccgaatgatattatcggtatcgactggtgaagctccatattactgtcaatcagtatctttgtcagctggtcaagcccgataagtcctgcgattgccgcaagagcgatatatagcattaattccgattcctttcgttgtccggtatttttctgacgttatttcagttattataattacttgttctttccgaactcaagctcggatgtgggaacgttcttttcttccttttcgtttttaaggctgaacaggacagaatcgcctgttaccttttcttccgacttcttttcgggagcgggagcaggctttacttccggagcgggtttagcttcgggagcaggttttgcctgagcgggctttgccggagcgggtgcaggctttgcttcgggagcgggcttcttggcgaaggcgctgtcctcaggctttcttgcctcaacttccttaacggtatttatcacgaactcattctcgcaagccttcggcatagccttaatattctcaatatgtgcgctgtatgcggcaagaatcttgtttgtatagtcctgcacttcttttcttgttctctgaagaactatctgttctctctcggtctgctgcatcataattgtgtgaatctcggcagcctttgcgttggcatcgtcaacggtctgctttgcttttgcgtttgcttcggcaagattcttctcaccgagctccttcttctttgccgcaagagcgtccgcatccttgatagtcttttcagccttttcctgagcgtcttttcttatcttttcggcatcttccttagcctcgtttactacagctataccctgctttttcgcaatgagcagagcatctctcagagcatcctcatccttacggtactctcttatcttctccgcaagaacctccagcttcttttcgagctcctcgttttcattctgtagcttcttgtattcaatagatacgtcctttaagaaagtatctacctcggcggcatcgtaaccgccacgcttaaccgtctcaaattctttggatactatatctttagcattcactggaaagtcctcctaaatgtactctaaatatattttttaacagtaatatgtatattaccttttctgcctgtttcaccgatacactgcaatacgaacttgccttttcctctgacggaaaacacatcgccctcgcttagctgctttgacacatcggtacataccgtgccgttcagcgtcacaagctgtggcgtaatatacttttccacagcgcctgttcttgacgtacaggcgacgcatctgacaatattgtcaaggcgcattgacgctaccgaaaaccgcagctcctcatattttcttgcgggcaaagtaaagcctgccgcaatgcccgtctgcacctgcactccgaccctgcctattttcgttatactgtcagaaataagcggcgctaccttttcatagacaaacactgccgccttccggtcggtaacgaaaatatcccccacagtgtcacgctcaataccgagcgccataagcgaacccagcacatctctgtgggtcacactgtcctcttttctgaaggtgaacgtcaccgcttttatcgggaactgttcagccgtgttttcatcggacacaacggcataggatgcgtcggaaattgcactgccgtcaaaataatacgacgggaaaagcccaagacagcatctgagcggatcagcatttcctgcgcctgcgcaaagcaatgccgtaagccctttcgggataccgacagctcttatctgtgcaagctcgctttcggacaggaaacgggtaaaatacgggcgggatctgtcaaggcagtccctcgccgcattttgtatatctttgacaagttcacggtctgccatatcagtccagatcgtcgaaaatatcctcgcccgaaatgctgctgatttcgtctatgaattcgcctgaaatatcaacgttgtaaggtgcgagaacgtatgttgtatctgcgattctctttatctcgccgcccgttatgtagcttacaccgcctaagaagtcgatgatacgggtagctatatccttatttgtgttgttgagcataaggataaccgttgtcttgttcttgtaaagctctgctatctcggctgtatcggacagcttcttgggtctgtttacaacaaggtgcagagttgtgcttgcattataagtgtatatcttatttgcgtttgaagcctgtgacgagctgcgtgaaggaacctcctgcacaggttcttcctttgcagattcaagctcgtttgagtagctctcatcgtcatccgatccgccccatcttctgattgaatttttaagtccttctaatgcgctcattgtttgttcctccgttttttatattttcgaataatttctgtagccgaaaagaccgctgcctatcctgactaacgttgagccgtactttacggctgttgcataatcgcccgacatacccattgacagcgtatccatgccggacaggaaagaatatttctgctttgaattttcaaaaagctcctgcattgacgcaaaatacttttcgtcgcaattcaccggcgggatggtcataagccctcttatcctgacgttttcaagcccggatacagcttttgccgtttcgataagctcagacggtgcaataccgccctttgactcctcgccgcctatattgatctcaaggagtatgtcctttacaagtccgtgacttcctgctctgcggtctatctcagccgcaagctcgacactgtcgaccgaatgtatcatactcaccttatcaattatatactttactttgtttttttgcaagcccccgatgaagtgaatttcggatttttccgaataattttcgtattttccgagaaattcctgtactctgttttcacccagcaggtctatgccaagactttcggcatagtttatcttttcgcagggtactgtttttgtgacagccataatacgaaccgtatcacagcgtcctgctttatccatagcttcggctatattctgttttatagccgtataattgagctttatatcctcaagcgttgtttcttcggcggatttagagattctttccgtcataaagatccttcccttcaactataacatcatcgtaaagcgacagatagcccgactgtcccgaagtatcacggacaatgacataatcctcgcttgaatatatgcggtctacctgtacgaagtaagcctgagagccttttttcacatagactccgatgttgttttccttgtcaaaatggatagcggacgaagctatgcgtatgccgttatagctgtctacaagcagcttgaacctgccgactcttgacgaggcgataacggaattcagatcatctgcagagaatatcgcaacataatcgttgtcgtacttttcgacattttcgacctttgcggttatctccgtctggtctgtgccgagaatcagccgtacctttgtattttccgtaaggacagccgcctgaccttctgtaaaggtcgccgccagcttccacttataatcgtctatcatctttccgattatgtcgccggaagctgttgtaagctcgggcgtctttaccgtttcggaaatttccgcaggcgttatactgtcgatgttatcgtatgttatcttgctctcgtacccgtcgatgctgcttacgaaatagcctgtttcatcagccgtgacctgaacgggcgaagccgaaatcctgccctcaagcgtctttatctttgagttgagcgccgaaatcaccgatgaataatcattcaccttgcccttgaccatatcacgcttgctctgcaggttgagcatttcatatttaagctgtgaaacggcggtataatcaccgctgtttatagctgttatcagcttgctgtgcttttcggttatcagcttgtcgaaagcctctatctgagaattatcggtaccgacaaggctctgtgcgtccgtcagcgtatcaatcctcgttttcagcttatttatatccgcagtaagcgatatatcggccgccgagccgtaagcattggctataacgctgttcttgccgacctttgagccgtcctcgtgctcatactgtatcgtgccgtttatcttacggctgacggtatgctcgtttcgtgcaaacacgccgtaaaactcgatagtatcctgagaatcgtacttcagcgccacctctgttttataagagtgctcgcttcccgcaaaaagctggcctgcaatggtcaggagcaggaatacggcaagaaccgcagttacgagcttggttgttatcgtcctgtccatatatccttattcttttacgtcttcgctgtcggtcctgtcgaatgcgtcaaggatagatacagctctgagaggtgttattgtcgagatagcgtgcttgtatatcagattctgctttccgtctgtatcaaggatgacagtgtaattgtcaaagcctcttacaagtcccttgaactgaaagccgtttgtgatgtagatagttacaggtatcttctcttttctcgcctgatttaaaaatacgtcctgtaaattgagttcctttgccattttgattacgtcctttcttttctccgctttttgcggaacataaaataaaataaaatcataactgtttttgtgataaatcacagctacagatagcttaacttatattgtaacacatattgattgaaaattccatagctttatgacagtttggggagattttttcgacaagtgagaattttacttgcttttgtttcttacactgccgatataatctattgcctcgtcaacaatctgcgaaaagttcttttctccgtcagccttgatataatggattctgttatcacggcggaaccatgtaagctgacgctttgcgtattttctggtttcctgcttcagccgctctacgcagggtgtaagctcactttcgcctttaagatacggcataagctccttatagcctatcgcctgcgccgccgtaggataatcgtcaatatcaataaactgccttgtctcctcaacaagtccttctgcaagcattatgtcaacacgcctgtttatgcggtcgtacagcgtttccctgtcatagtcaagctgtatcatacacggctcatacggcgaaggggcaagccttgaaaggcgctgttgctcgctcattgtctttcccgtagtcttgtagacctcgagcgctcttattatcctgttgagattgttctcgtgaagcttttccgccgtttcgggatcaatttcacggagcattccgagcagaaagccgttgcccttttcctgcgccagcttacgcagttcgtcacggtatgcgtagtcgcactcggtttcctcaaagctcagattgtcgataagagagcttatataaagtcctgtgccgccggttattatcgggagctttcctcgtgccgctatatctgcgataataccgtgtgccgccttaacatagtcggctaccgaaaagctatcgtgagggtcgagaaaatccataaggtaatgcggtatgccctgcttttcctcctctgtgggctttgcggtggctatgttcatacctctgtatatctgcattgaatcggctgagattatctcgcccgaaagcctttttgcaagctcgaccgaaagagcggtcttgccggatgctgtaggtccgcaaactactacgataaactgtttatccataactcaactcctgttgaagaagcgttctatcctgtattttgaaagagaggtcataaccggcctgccgtgcgggcagaagcgtattgtcctgtcattcatcactctgtcggcaagcgcctgcaattcgagaatatccgtatcatcgtgtgcctttatcgccgacttgcaagccatcgtatgaagcatatcgtcaaagagagcgcctttctggtcggtggcagtattcataagcctttgtgcgacatcggatacgatttcctgcggcgagcatttcactacggacggcattgcggttatctgcactgtgctgtcatcgcagaaaacaagctctataccgctttgctccacatattcgtaatactcgtgcagtgcctcgtattcttcgggcgacagcttaagctcggttttgtcgataagaagctgtgaggtggtcacaaactcctctttcagcttctcaaacctgatacgctcgtgggcggcgtgcttgtcgattattataagctcctcgcccgcctcgcacagtatataggtctttaaaaattctccgataacacgcacacttgttttttcgggcttcggctcgtctattctttcaaccgttaccggctttgcgtttataaatctgaagccttcgtcagtttgcggtgctgttacgggaatatcgtccgtatcatcgtcaacggtgacaacaacactgctgcttaccgccttatatgacgggatgtgcggctcttttggcaaaggtatttcgtcaatagcttcacctgtgttttcttcgggctttgtgctgtagtccgagcgtgtgctgtgcagtgaaacgggctttattgtgctgtcgccgtatattttttcagcctttaccgtttcggacggttcttcgggctttatatcaacgaccggacgctcctcagacaaaagcggaagcgttactgggatatgtgcgagtgtctgctgttcacgctttattatttcggggttgtgcctgaaataatcgtctgcgttatcgtatttcttcggcttttcaagctctatctgccgtttatcgtctgcggcattcaccagtgcgttctttaccgcaaaatacaccgcatcgaacacaggcttttcataagcgaagcgtatctcggtctttgccgggtgtacgtttacatcgacagtttcgggagaaagcgatatgttcagtatgcaggcagggaattttccgaccatcatactgttacggtatgcctcctcaagcgccgccatacaggtggtgctttttatatatcttgtgttcacgaaaaacgtctgcatacttctgctgttacggcagaaaagcggcgatgaaacataaccgcttacatctatgccgttaagcgaaaagtcaacgggaataaggctgtcggcaaactgtctgccaaataccgcctttgccgcagataagagcgagccgtcgcccgatgtcattctgacgcttttgttatctcttatgaatctgaaggaaatatcggggtgggaaagggcaagtctgtctaccgttgccgctatgaaattgccctcggatatgtcttttttgaggaatttaagtcgtgcgggagtgttgtagaaaagctcctttatcacgatagtcgtgcctgtgggacagccgcaggattcgtgctccttttcctcgccgccttcgataatgtaacgtccgccgagttcatcgccgtcctgccgtgacatcatctctatctttgcgaccgccgcaacggacgctaacgcttctcctctgaagcccatcgtcataatgcccgtaaggtcgtcgcctgtgcgtatcttgcttgtggcgtgacggagaaaggctgtcggcatctgatcgtaagctatgccgcaaccgtcgtccgttatacgcatatagctgataccgccgtgctttatctcaacggtgatatgccgtgcgcctgcatctattgaattttccacaagctcctttattacggaggacgggcgttctatgacctcgcctgccgcaataagctccgctacgcttttatcaagcagtctgatttcgggcattggttttccttttctttataacattgcttttagttcttcgagctttgcgtaagcctctctcggcgtcatatcgtcaaggtcgaggttttttatctcggctatgacgttctgcctgcctgttgcctcaaagtctatctggctttcggattcctcctcggctctcagttcaagctcacgctgtattttcggcgctttttcaagttcggcaagaagctgttttgctctgtcggtgaccttcttcggaagtcctgcaagacgtgcgacctctatgccgtagctgtcgtccgtgccgccctcgactatcttgtgcaggaactttatatcctcgccgcttcgctttacctttacgctgtagttacgcacaccgtcaagctcgttttcaagcgaaataagctcgtgataatgcgttgcgaaaagcgtcttgcagccgatagcctttgagcttatgtactcggctaccgcttttgctattgatacaccgtcgtaggtcgatgttcctctgcctatctcgtcaaggataacgagcgagtttctggtcgcttcattaaggatagttgcaacctcggtcatctcgaccataaaggtggactgacctgcggacagatcatcgcttgcgccgacacgggtgaatatcctgtccactactccgagtcttgcgtagcttgcaggcacaaagcagcctatctgcgccataaggactatcacggctacctgccgcataaacgtggatttacccgacatattcgggcctgtgattatcatcaggcggttgcttttaacatcaaggtaaacgtcattcggggtgaaaagtatctcgttgaccatcttctcgacaacggggtgtcttccgtcctttatctctatgacgctgtcatttgccatcatcggacggcagtagttgttttctatagatacaacggcataactgcacagcacatcaagcgccgcaacagattcggcggtctgctgtatgaggtcgagccgctgtgcgataaattcacgcacctcggcaaatatcgccgcctcaagtgcaagtatcttatcgtttgcgccgagtatctcgttttctatcttcttaagctcatcggtaatgtatctctcgccgtttgtgagcgtctgctttcttacatatctgtcgggcaccatcgacacgttgccctttgaaacctcgatataatagccgaacacacggttatagccgacacgcagattctttatgccggtagcctctttttcctgctgttctatctgagcgagcaggtccttgccgccgcccgtgatatttctcaggcggtcaagctcctcattgaagccgttctttatataaccgccgtccttcatcagtgcgggcggttcatcggctatcgctctttctactaaatccgcaatatcgtcaagagggcttatcttcttatcaaggcttcttgtaagctgtgtgcttatctgcgacaggtcgcttttaagctgaggaagtatcctgcaggtagcaccgagcgcctttacatccttagcgtttgccgccttgtagattatccttgtcataagacgttcaaggtcatagactttcgcaaggtcggtctttatatcatacagtgccgcagaattgtttatgagcgcttctaccgcatcgtgtctgcgtatgatagccgccgtatctgtaagaggctgctctatgcactgtcttagctttcttcttcccattgaggtatcggtcttatcaagcacccacagaagcgagcctttcttttcgccgcttctcattgtcgatgtcagctcaaggtttcttcttgtggcaagtccgagctgcataaattcgccgctgctgtgtacgttcagctttacaaaacgttttgctccgcttctttgtgccttatacaaatagcgcagcaaagcgcataaagcccttaatgcgttgtcctttccggcaaggcctatttcatctgccgtgccgccgaactgtgcggttatctcggatacgtcatctatggaaaaatcctcatcggaaagctgttccgcagagcattttccgtaacggttcctaataaaagtatatgcctgtttccgattcagaaactccgcattgaatagtagctcaacgggggtatactgcgagaactgtgctattatatcctcgtcggtcttttttgaatttgccttttcaactgcgtgtacctcgcccgttgaaatatcggcaaacaccatacctgtgccgttttctccgacatagatacaggaaatatagttattcgagccgtcctcaagcattgacgcttctataaccgtgcctgcgctgacaagccttactatatcacgctctacaagtccctttgataacgcagggtcggttgtctgctcgcagatagctaccttgaagcctttatctatcagcttttttatgtagccctccgcagaatgatgcggtacgccgcacatgggcgtacccgctcttgatgtaagcgtcagctcaagctcctttgacgctaccattgcgtcctcgttgaacatttcatagaaatcgcccagacgatagaataatatataatccttgtaatttgccttgatttcaacatactgctgcatcataggcgtgagcttttctccgctgtttcctgctttcaagagtttcattcctttcggttttattgtttaatcttacaacgccatactatcaatgccattcagtcaaggcaatcagtggcatcctccgcaggtcgagcatgagcctgagcatccgccagcctgtacctcgcaggtatcggggtcttcaccgtcacagcacagtgcgataatgccgttgatctcgtgtaacagcttatccatatcagcctttgccattgtgaaatcagccatatgctcgttctgcataacgagagtgtataatctctgcatctccttgttctgtgtgtcgagcttttccttgttctgctcttcctttgacttgctcatttcaagcgctacgttctgacgtgcaaggttgaattcgcctataagctcctgaagctccatatcggcatcgtttgccttcattgcctcgttataacgtacataacgctcgtctgcctgtatagccttgccgagctctcttgctgctttgattgcgtccatttatttttttcctttctttccgcttttgcggctgttaaaaatatatatctgacggggattcccgaccgattgtgaaaattcagtcattcacgcttacaagctcgcctgtgactgcccagggcagagccttttgtattcttaccgtgacgtactttcctatcatatcccttgtgccgttgaaatcaacgataacgccgtggcgggaatggcctgtcataagtccgtcagccgttctgccgatgccctcgcacagaacctcgacctcatctccgataaaacgttcgtaagccttttcaccgatagaattctgcacatcaagaagctgtctgaaccactttcccttatcctcatcgcttatggggtcgggcatagccgccgcctttgttccctcacgcttgctgtagataaaggtgtatgcggaatcatagcgtaccttcttcataagctccacagtgccaagaaaatcctcataagtttcgccgggaaagcctactataatatctgtagtgagcgctaccttcggtatgcgtttttttgcatattcgataagttcaagataatgcgccgtgtcatagtggcggttcatttcctttaaaattctgtcgcttccgcactgtacgggcaggtgcagatgatacgatatatgcctgctgtcagctatcgtatctataagctcgtgcgtgcagtccttagggtgagatgtcataaagctgagcttatattttccgggtatcttatcaagctcggaaagcagttttgcaaagccgaaatcatattccttgccgtaagaattcacgttctgtccgagcagtagtatttccttatatccgtcatttataagcccttttacttcggctatgacctcttcgggtctgcgtgaacgctctctgcctcttacaaagggaactatacaataggtacagaagttgttgcagccgtacattatcggcacgcttgcctttaccttgctttctcttattacgggaagtccctcggcaataacaccgtcactctctgggatagacagcgttctgcggttctcgctgagcttttcgtatatcatctgcggtaaggtatgcataacgtgagtgccgaaaataatatcgacctgcgggaacgattttctcattctctgtgctatatgctcctgctgtaccatacagccgccgaccgcaattatgagatttctgttcttctctttcagctttttgagtgcgcctatattgccgaaaactctgtcctctgcgttttctcttacggcgcaggtattgaaaagaataagatccgcaaatgcggtttcgggcgtgaagccgtaacccatctgtgcaagcataccctttattttttctccgtcgctcacgttctgctgacagccgaagctgtggacgtgtgccagcggcatctgctcacgctttgcgtttatcgcttttactttttctatatattcctgctgaacaagcagttcttccttgtttatctctttagtcaagctgtttctccgtttcttatccaaagtcctgtttcaaagacagtataccataatagattataacattattttaatccgccgtcaaggcgaaacagcggattaaaataatgttaaaacgttctcggacggttgcgtgagcaaagccgcatttttatgcggcacagcttgtagaaaaagtcttgtatttgatgtacttctgttatatcttttagtttttatctatgatagcaagctaccgatagttctttttgtcggacagcacttctcgggttcgctattcgaatcaatgcacttgtcaatattaacgagggaaattttttttttcaagcagaagacggcatacgagatttcgcggagtgactggagttcagacgtgtgctcttccgatctcattatcttataaaaaacagactttttctacaagctgaggcagagccgcagctctgcctttcgtatttctatccggttattctttaataaaactgtaaccgttatctgtcttttcaaccttaaaaagccttaacaccagctgatattgttgtggatagcaatcaagcaaatttatctgtacagccgcaacattgagcgtcagctcattcatatcatacattccgtacactttaggcagatattgatacattcgatcttcaagatatgccctgttttcttctgccaatgcctcaagtttgctgtttattgtatcatcggtacagaatatgttgttttcgtcaagagctgatatgatttcacggtactcttcatcgctcagttctgtgtttataatttcgttatacgtctgttcatcacaaaaaagagcgttgaaatcatcgtatttttctaaatacattttcttgtcaagccgctccgatgacattgcaacataaggttcaagctcatctgtaaccaatccgcaggtcgttatcggtttttcttttgtcacactgcatctcagtccgttttcggtattgatgaaaacgtaaaagtcaagcgaaaaactgtagcttgacgaatcaatcatctccggaacagcgacaaagcaatatatcacactcggatcaacattatcatatataatcagatactgaccgagttcaacactgtgaggaggtttacctttttcaccgagcccatgatctttcgatatacagagtttgccgtcaacttccgcataataatacggtataaaagacttgaaatcatcataatcaaagcctgtgtacagttcgcttgccgcatcataaaagcctttcatatccgaaaaaccgaaaaattccggatcagcttcgaaatattcaccgtttatcagattttcccgcgtgaatttctctatatcttccgatgttgacaaatcctttgcaccttttattgcataatatccagagccgaaatccacgatattatcaaacagccactgccttttgaccctgtcgataatttcgttacttattgcttcatcggtacataatttaaaatcgtcaaagtcgtttataaaatcaaaccttaccgtgctgtactcataatgatacggtccgtattgcttgcctatttccgcccagaattccttgtcgttacgcacctgcgcctttaaggtgcttatatcgggatatatcgtattgttgccgtttgcggaactgttgtcggcgtgtgatggattttcgtccgccttgcttaccacgtccgaaacatcggatttgttgtcattcactttgcttgcagaagcatcgacagcgctgtcagcgcccgatgaactgccgctgacggtgtaatcaataccgttgccctttgtcacaaaatgcacaccgactgccgccgttccgacaaccaatactgccgcagccgcaaccgatgtgtagcgaataacctgatgtctgaaatccgtctttaccttactgctttcttctatacgtctgaaaatatcttttttctgcttttccgtaggatcgattttctcaaattcgtttctgatactcatactatactcctttccgagcttaaatgctcttttaaccgctctctagctttctgcagccgtgaacgcaccgccgatgcgctgatatgaagcatactgccgatttctttactgttatagccgtcgcaatagaacagataaacgggtatcttaagctcatcgggaagagccgacagttcaatcattacatcgcttaccgcagagttgtcattcactgcaatatctcctgtcggtgattcacgtcgtctgctgttcgccctgagcatattcttgcatacattctgagatacccgtatcagccacgctttttcatgctcggtactttcaaagcgcttttgcttttcaatcagtttcataaaagtattatgtactgcgtcctcagtatcgtgtacatttctgaggtacataaagcacactctgtacactgtgacaaagtgccgctcatatatttctcttatattttcagaagaataatccgacataaaacccctcccttttttctttttgccgaaaatgcacatcttcatacataatacaccacggcgaagataaatgtccatacaaaaatctaatattttgtaaatttggtgtggcgctaaaaattcccgccacatttttgttaatatcgccaaaataagcagtgaaatattgcatttttttaccgcgagtgctataataaaaatgctaattaaaattgtatcttttgcaagggtacggaatcgaggcagacacttatgaaatctataagcaaaaaaatgacactgtttacagtattacttataatcatctcgcttcttgtggcgacgattgcatctgtaggaatcatttacagcaccacaaaagcgttgaccgatcagacgctcacagaaacggctacagtagccgcagacagagtttcctgggaactgaaatcaatgcttaatgtcgcaatacaggcaggctgtaacccgaaattatcatcggcagtatattccaaaggtcagaagcaaagcgaaatagacttgattgcttcaaccttcggccttgacagaggcactgtaattgataaaaacggtcaggcgtcaaacggcaacgaatattccgaccgtgaatatttcaaggcggctcttgagggcaaaacaacaataacagagcctatgataggcagatcaaacggcaagttaagcgttataatcgccgctcctttatggaagaacggcgtgcttaattcggaagttgagggctgtgtatatttcgtacctaacgaggaatttctgaatgatattgtccgcgcgctcaagataaacgaaaacggcgcttcatacataatcgacaagaacggtaacacgatcgctgattttgatatgcagcttgtcaaggacggagagaacatacagaaaaaagccgaggaagattcaagctatgcggcacttgctcagacacacgaaaaaatggaggccggtgaaacaggctcagccgagtacacatcaaacggcatcgcaaaacatataggatatgcacccatacccgaaacaaacggctggtctatcgcagtaacagcatacagcagtgattatacaatacattgtcttaagggacttctggtgcttgcgataatctgtgccgcatcagcggtagtaggcggtataatcgcaggacttatcagccgtaagataggcaagcccataaagctctgcgctgagcgtatcgaaaagctctccgagggcgatcttacaagtcctgtacctatggttaaatcacacgatgaagtcgagatactcgcaaagtctgccgcaaaggtagtaaatgaacaaaatgctatgatcagcgatatcggcaacatcttaagcaatatggcacagggcaactttgatgtgcacagtaaagatgccgataatacatacccaggcgattacaaggtacttattgaatctgtaagagatatcaacacaaagctcaatgatactttaagccagataagcattgccggcgatcaggtatccagcggttcacagcaggtatctgcaggcgctcagtcactcgctcagggtgctaccgaacaggcggcatctgtagaagagcttgccgctactatccacaatatcaatgctcatattgaggctacaacggaagattgtcagagaggaaaacagcttgtcagcgaaacagccgggtatattggtgcggcaaacgaaaagatgaacagcctttcaagtgctatgcaggatatcagcgatgcttcggcagagataagcaagattatccagactatcgaggatattgcgttccagacaaatattcttgcactcaacgccgcagttgaagccgcaagagtaggtgaagccggcaagggatttgccgttgttgcagacgaagtaagaaatcttgcaggtaaatcagcagatgcggctcatgatacgactgttcttatcgaacgtgctatagccgcagttgaaaacggcaacaacattacaaacgaaaccgcacaggctgttgccgaggttgaaacaaggtctggcggtgtcagcgacatcgtaaacaagattgccgccgcaagccttgaacagacggatatggtaaagcaggtcaatataggcgtagaacagatttcaaatgttgtacagacaaactcggctactgccgaagaaagcgccgccgcatccgaagagctttcggcacaggcacagacgcttcagaagctggtaagtcagttctccttcaaggatgcagaaaacgcctgaaacagataaataagcaatgtatgcccccgtctgaacgggggcattagtttgtcgaaaaacctacataatttttaaaaatggggtttggggcgtagccccaagcggggtgagggcggcagccccacactcagccccttcccactgggaagggggttttcggcaaggatgccgaaataaggacacaccaagctttgcacgaagcaaagccatcagagtgtcctaaaggggataggggttgaacaagcactttttgaaaaaaacatactttttctacaaaccgttatgcccccgtcttaacgggggcatttttccttattatattgacattaaaccgatgtaatgatacaattgaaatataatataaatcggagtgtgaaattttgctatcatcattaatcgcaacggtcgattccccgaccgataaagaactgataacacagctttacaatacatataagcaatttatgtacaatatcagtatgtcgattctcggaaagcgtgaagacgccgaggatgccgtccaggattcatttgtgaggattattgataatcttgacaagataaacaatccgtattccagaaaaacaaaatcctatataaccgttataaccaaaaacgtctgtcttgatatgatacgcagaaatcacaacgacgaagagcttgaggacaaggatattccgtttgaggacagctatacggattttgaaaacagcaatgcgacatacgaacagattatcaaaaatctaaagcagctgccgccaagactgaaaaacatagcattcctgttttttgtacaacggctaagccctaaagagataggcgaaatgctgaatatcaacacaaatacggtttatgcgtatgtttcaagaataagaaaaatcctgctcgatacaaaggatgaaaatatatgaccaacgatgaaaaaatcgccatagcgttaaaaagcgattatctgtccgaactgtctgtttatgagatgctcccgaattcaaggataagatccggattcgacagacggatgaaaaaaatgataaacgaatcatataccgacaccgcaaaaacggtaaggcaccgcagagtaaagctgaggctggcaattgccgtgataatagccgctactgccgctctggcaacaggcggaactatcctgctgaagcactgggatacgtttgcggtcaaggaaaatgacaaatactcggtcatactgataagcgatgccgagaattcgcctcagtgtatcacacgatattatgagcctgatctcgacaaaaccgcctacgccacacggcttatagaaaaaaccgaatatgcctatattgtcgaatacataaataagcacggcaaacagctgatttttactcaatgtactcgatcacagatggaaaatgcacagatcggaacggaggatgcgcagactcctcccgaaaaagtcgaactgggggataaaagtgcgatgtattgcgtttccaaaaaaggtatggcatttcttgtgtgggataacggcgagtatatgttccatatcacagcgaccggtttcggcagggacgaactgttccgtaccgcaatgtcgataaaagagttaagcgcagattaaggctgaaattaacccgataaaataagaattataagcgaggagcaaccatgaacaacagaaaggcaattgtacttaatgataaatccgtaaaaacgatcggaagaacctatttatataacgatacgctgtgggcggcattttccggtgcgggtgcggaattcattttcacgggtaaaaaactcgaaatcaccgttacgggcgactttgcatcgacagcgggcaatgacgagaattatgcaagaatcgcaatatatgtcgataatgaacgtgttgtagacgatatgctcgatgaaaaggaaaaaacgtacaaggtgcttgaaagcgaaagcaccgaatgcagaaatgtaaggataatcaagctgtccgagtgcgcaatgtcaacattcgggataaagcccgttatgattgcggaggatgaaaagatagagcctgcgcccgcaaaaaatataaagatggaatttataggcgattctataacctgcggatacggagttgacgatcccgataaggagcatcatttcaaaacagccacagaagatgtcacaaaagcgtatgcgtataaaacggctcttgcgctgaacgccgactacagtatggtttcggtgagcggctacggaattatttccggctttacgaatgacgggaacaagattccggaacagacaataccgcaatattatgacaagctcggcttttcgtataataagtttgcggacagcatcacggtttcggaaaccgagtgggattttgaaaggtacaagccggatattatagttataaatctcggaacaaacgatatgaactatgcgacaacagatgagagaaaagctgaattcgaagacggttatctcgattttctgaagaaggtacgctcgctcaatcccgattcctatatattccagacctacggcgtaatgggaacttcgcttgaggaaaatatcgaaaacgtccgcagaaaatatatgagtgaaacaggcgacgaaagaatcacgtttattccgcttacgatgcaggacgaggacgctgacggaatagtggcggactggcaccccagccccaggacgcacagcctggtttcccaaaaggtcacagcggcaataaagaaaactctcggttacaaataaccgttcggctaagcctgacggcactggcatatccgcattatttgaatgtttgcggctgtcagaacagacaattttcaaaaatgacttgacatcggcaaccgattaaggtataatatttaattgcataggcgcaagacaggcacacatcggtgccgagtaataacaggaggaagaaagaaatgaaaagaacataccagcctaagaagctccagagacagaaagaacacggattcagaaaaagaatgtctacaagaaacggacgtaaggttctcgcaagaagacgtgcaaagggcagaaagcacttaagctactgattctgtcaatgaatgagtatgcaaagaaatacgtctgcataaaaaaggacaaggaattcagattcctgttcaaaaaaggtgacagtattgttaccgatgcattcgtatgctacgcaagggaaagcaagaggcgggtaaaccgcataggaatcgttacaggcaagaaggtcggcaatgccgtaaaacgcagtcgtgccaggagagtcataagagaagcgttccgccttattgagcccctgctccgtgaaaagacacaaaaaagatacgactttattttcgttgcaagagcaaaaactcctgcgatgaaatcgacagaggtatatcttcggatggaaaagcaactgctgaaaagatatgccacaccggcgaataatcaaccggacaaaatacaaaaataaaatgaaatatgtacttttatttttcgtaaagatatacagaatgactttgtcaaaatggctgcctcgttgttgccgctttactccgagctgttcggaatatgcgatgatcgcactccgccgcttcggtgcggtaaagggcagctatttggctatacggagaattatcagatgcaaccctttttctgagggcggctatgactatgtacccgaacaattttattttttcaaaaggactaagccgtaatatcggcactactaacggagggtgatttccatagatttcttatacaccataatcggtacgcctctcggctacattatgtggcctatttatcttcttttacagaacttcggttgggcgatactgatattcactgtaatagtcaaattagcaatgctgccgcttcagataaagcagcagaagaatatggcgttttctcagctgtttgctcccaaggtaaaggaaatacagcagaaataccgcaacaaccgtgataagcaggcagaagaaatgcagaagctgcaggcacagggctataaccctgccggcggctgcggacctcttgttctgacaatgataatactgttcggtgtcatcgacgttgtatataagcccatgacacacatggagcatctgtcatcgtcggatatttcaagcaccataacggtagcacaagaaaccgaatatgcaaagatattcttaaacgaatacaacaagcaggatgccgagcttattttaaagtataagaacggcgataaggatgcaattttcatttcggaatccaacgacggcgctcagctgacgcacgagttcaaggatgacgagaatttcaagaacaattacaccgataaggatcccgaaacgatcagcacggcagacagagaaacctacggttcattctctgccgagcagtacagtgatttaacaggtgataagtcaagacttacagctgaaacaaagaacagacttgcggctgttgcaggcaagtacaaaggtatgcagatggagcttcttgctctgcaggtttatgagcagtaccccgatacgttcaaggaaagcaatatactttcagataatgtaaagggcagacttgcatcactgtcacacaatatgatgttctgcggtctgaacttcggtacaacacctaagcttgctttcgagccgctgataatcataccgatatttgcattcgttctttcacttgtacagactgtactttcccagtatctcaacaagaagaacaatcccgaaatggcaaacgcaggcggtgctggtatgaaggtaatgctttatatcatgcccttattctcactttggatttcgttcagcgttcctgccggagtaggtttctactggggtgtcaactatgcactcggcattgtgcagtcactggtaatgcagaagctgtacagccctgaaaagctcagagccgaggctgaagagaagatgaaggaaagaaagctcaaggaaagacaggtcacaacgaccgctgttgttacagatgccgatacaggcgaagaaaagaccgtaacaaagacagaaacactttcacagaaggaaatcaacagacgtaagctggcggcggcaagaaaagccgatgccgaaaaatacggcgaagaataccacgaagaagacgacgattgagaatcgacggaaaggacggacttatgaaaaagatatatacaggtaagtcacttgacgaactcaaggcgcttgccatatcagaaatcaaggaactcggtgttgatgaagctgacataaagataaccgtagttgaagaaccggtcaagaagctgttcggcaagaagggcgactataagatagaggttgaattcgaaactgttaccgaagccgctcctgctgctgccgatgaaacggctccggcagaagccgctgaagccgctcccgccgtaacagacgctgaccacacagaaaaggtagctatggctgcggcttatcttgaaaaggttcttactgctctcggcgttgaggacttcaaggtaaacataatcgaaaaggaagatataactgtccttgatatagtaggcgaaaagctcggtatcgtaatcggcagaagaggcgagacactcgactctttacagtaccttgcaattcttgcaagcaaccgtcacgatgagccttactgccgtatcacagttgattgcaacggctacagggataagagagaggaaactctcaagtcgctcgcagagcgtaccgctaataaggtgctccgtcagggcagacgcattacccttgagcctatgaatccttatgagcgccgtatcattcacagcaaggtcgctgagattgaaggcgtatacagcaactctataggtgaagagccttacagaaaggttgttatctcggcttctcagccccacagagataacaacagaagaaacgaccgcaagggcggaagaagaaacggcaacggtgcaaaccgctcatacaagcagagcaccggtttctcgacttcttttgaaagagagtacaagcgttcgcagactgctgttgaaaatactgcgtctgatgcaggcgaattctctaaggaagcggttgaaacagaaagaaacgctacgctttacggcaagattgagctttaagacttgcagaaatcgacggtttttcaatgatttttatacaattttgaattatcgcacaggcaaactttcaaaatttgtgcaaaatgacctattgacaaatcagccgaaatagtgtattataataactgtaatcagaaacgaggacgttttgagggatcaaagcgtccttttcttatttttcaaagaacatctaacgaaagtaggaggaaaaggaaaatggcagagaaaacttatgatgtaacggagctgttcggctcggacgtgttcaacgaggcagtaatgaaggcacgactccctaaggctatcttcaaggagctgatgaaggtaatgcacggtaatgctgagcttacacttcccattgccgaagtagttgccagcacaatgaaggactgggcagtagaaaagggtgcaacacactacactcactggttccagcctatgacaggtatcacagccgaaaagcacgacagctttatttcacctgtaggtgacggtacggttattatggagttctcaggcaaggagcttatcaagggcgagcctgatgcttcatcattcccctcgggcggtcttcgtgctacattcgaggcaagaggatacacagcgtgggatccgacatcatacgcatttgtcaaggacaacacattatacatacccacagcgttcttctcatattcaggcgaggcgcttgacaagaagacacctctcttaaagtcaatggatgctgtatcaaagcaggcattaagaattttaagacttttcggcaacaccacagcaaagagcgttgttgctacagtcggtgccgagcaggaatacttccttgttgacaagaagacatacgataagagaaaagaccttatcttcacaggcagaacacttttcggtgcggcacctgtaaagggtcaggagcttgaagatcactacttcggcgttatcaagcagagagtaagcgactatatgaaggacctcgacaagcacctctgggcgctcggcgtttcttcaaagacaaagcataacgaggttgctcccgctcagcacgaatgtgctcctatcttcgagtctgcaaaccttgcggccgatcacaaccagcttatgatggaaatgatgaagaaggtcgctcttgagcataatatggtatgcttactgcacgaaaagcctttcgcaggcgttaacggttcaggtaagcacgataactgggcactctcaacagatgacggccagaatcttctgaaccccggcgattctcctatggagaacgcacagttcttgacattccttgtcgcaatcatcaaggctgttgacgaatacgcagatctgctcagactttcggtagccacagcaggcaacgaccacagactcggcgctaacgaggcacctcccgcaatcatctctatcttcctcggcgaagagctgaacgatgttatcaatgcgcttgttgcaggtacaaacgtagaagcaaagcacgcacagttcgatataggcgtaacctcactgcccaagttccccaaggatacaacggacagaaacagaacatcgcctttcgcatttacaggtaataagtttgagttcagaagtgttggttcttcactcaacatttccggacccaacatcgttcttaacacaatcgtagcagaggagcttgaacagttcgccgatgagcttgaaaaggctgacgacttcaagaaggctcttaaggaactgctcgtaaagacaataaaggagcacagcagagtaatcttcaacggcaacggttacgatgccgcttgggtaaaggaagctacagaggtaagaggtctgcctgagcttaagtctacggtagacgcacttccgcacttccttgacgagaagaatgtcaaggtgttcacaaagcacaaggtattcacagaagttgaaatgcactcaagaacagagattctgcttgaaaactacagcaagaccatcaatatagaggctctgacaacagcagagatggctacaaaggaaattctccctgccgttatggcttacgagaagcaggtttgcgatgtacttctgtcaaagaagaacgcaggtgttgcttataaccttgagcagtctatcgcaaacaagattgattctcttgctgaaagtctgaactccaagatagcagagcttgacagcgcaatagttaaggcacagggcatttcggatgtttatgaagccgctaagtgctaccacgatgaagtattcgctacaatgcagagccttcgtgctgttgcagatgagcttgaaacaatcgtcggtgaaaaatactggcccttcccgacttacgaggagcttctgttcaacgtataattatagagatacgcttttaaaaacggcttagagggattttaccctttaagataatctgcacccttttcctatggctatggcacttcggtgtcatagcctcttttctttgcaaaaatctattcaaaacagcgatatttaccgatttttcgtcatattttcacattatacgctttacaaatcagtaaaaatggggtatactgtaacagtcagattgaatcgacaaagctacgaaaggaatttaacaaatgaccgaatataacgatatactatacattgtagtaccctgttacaacgaagaagaggtacttcacgaaacatcaaagcggcttaaggaaaaaatgacaactcttatcaacgacagaaaaatatccgacaagagccgtgtgttattcgtggatgacggaagtaaagacaggacatgggagataatcgaggagcttcacgaaggcgatgatttgttttctgggcttaagctgtcacgcaacaagggtcaccagaacgcccttcttgcaggccttatgacagcaaaggaccttgcggatatatcaatttcaatggatgcagacctgcaggacgatataaacgtggttgacaagtttgtagacaagtatcacgaaggctgtgacatagtatacggagtacgttcttcaagaaagaaggacactgttttcaagcgtggaacagcaggaatgttctataagttgatgcgacttctcggtgttgatataatcgacaaccacgccgattacagacttatatcgaagcgtgcgcttgaagcactgtcacagtttaaggaggtcaatctgttcctcagaggcatagtaaagcagataggcttcaagagcgacatagtatattatgaacgcagtgagcgttttgccggagaatcaaagtatccgcttaaaaagatgcttgcttttgcgtttgacggtatcacaagcttttcggtaaaaccgataaggcttgttaccgtagtcggatttttagtgtttcttgtaagcgtagcgatgataatatacgctattgtgcagaattgccttggtggaaataccgaagcaggctggagctcgcttatgtgctcgatatggttcttaagcggacttcagataatggcgcttggcattgtcggtgaatatatcggaaagatttatatcgaagtaaaggcaaggccgaaatacattatagacaaatttataaataagcaataagaaaagagccgtcggacaggaaaagaccgacggctctttgatttacttcttctttgaaattacttttttcagcttttttctgccgtttttaagtgacgggaatgccttgtaaagacgtttatgctttgctttaagctctgacagcttttcgttaagctcgttaaagcgtgctgtaagcacctccttgcgttccgaagcattgccctttaattcactcaagcgttccgaattacgttgtttaacgctgtctgaggctgtttccagcttagctttgaacatatccgcctttttttgcatttcttccgctgtgattctgtgttcctttgtaaattccacagcctgtgcagtcttatcggacagatctgaaccgatagcgtcggatacggcggtaagctgtttttcaaggtcgtctataagccttatttcgtttctcagcttctttacttcggggaaggtcagtataacgtctgttattattgccgcatagaacaggcacagtgccgctatgccgacaggcttccagataagccctacggcaaaagctatcgcaggctgtaccaccttcattataagcaggcaggcaagcccccacacaaccgtgaactgcggacagatgtaaccgccgatgttgaacttcttgtcgctgtagtcccaccagcgtctgccgaatagcttatcaagcacaaagcccgttataaattcaagtacggtcgtaagaacggcagagccggcaaaaagcagaagccatgaatctttaatcggtgtaaggcagacgataaccgttatcagcccgaagccgtatataggacaataagcgccgtgcagcattccacggtttacaaactttccgtggcgcacagttgcaaagacaacctctccgcaccagccggcaaacgagtatattgcaaaatagaacaaaaggttgtaaaagtactccattattacctcacagttttttattatattataccccgattttgcctacaggtcaacctcgtgcaaaagcaaaacgaggtaaaacaaatatccgccgaccgtttttgagccgacggatatatttctgttcttttgacagcattactgctgttctacttctgtattctttcctacaagcacagctatcgctccgcctacaataagggctgctgcacctgcgagcgtttcaaggttgaagccgaagccgtcagggaacacagcatacagcgagcctattacaagtcccataattgcactgtaaacaagcagagaatagcgtttcataagcgccgaaatcagctttgcaccgaatacaatgccgataaacacaccgatagctgtcggtatcagtatcataaagtcaaggctcttgatagcactgatgaccgtggtgtataaaccgagcagtaccattacaaacgaaccgctgacaccggggattatcatagctacagccgccacggtaactccgagcagaagcgttatgaacagcacaggattcatcttataggtataggtgaagctgtcggtctgtattgaatcaatatccgtgctttcggggagagtgagcgtaatgcttccaccctttgcgatagcgctgttttccgttcctgtgaggacggtagtatcggctgaggatttctttacaacacagccggtaagttctccttctaccttgccgttgacctttaactgccagtttgatttaatatcataagagccgttgtttgtgatagtcaccgtgcagtcggtagcgttatgaacagcattgacagtgaagctctcgttctggggaagcttatttatataagtcattcctaccaccagcgcaagtgcggggatgaatgcaaaaaggcatttcggcgtgatttttctgccgccgacggtcatattcctgtaaataagcgggatactgccgatgataagtcccataaagaacatattcgttgccacagggaagttgtcaaacagccatgttatcacaaacgaaaagccgagtataccgataacggcgccgattccgaaaaagacgatgaatctgatgttctttttgatagccgacaatttcaacgtcagcacgtctaccaccttgtcatacacgccgaaaaccaccatcatagttccgccgcttacacccggtataatatttgccacgccgaatacgataccgtaaacgatattcagtagatgtgagatcatatttactccttacttatgttcttatttgttgaggtatttctttatctgaagccctgcgggaagagcgactcctgcaagcactgctgctatgcttgcaagcggattcggcaccgcaaagccaaacagcaagtttataaacggaatatacggcaacagcaccgatgctgccgatgtaaccgctgctgtaaccgtcatatatttcggtattgctccgtttttgaatgctcctgtacgtttgtctgtgacaacaaggcacattgcgcctgtcataaccgtgagaagtgtaagcattaccgatgaaacctgctgtgctgacataacccctcctgcaagagtgaggaacagagcggatattgcaccgcagataagtccgcaaacagcacttcttataaagaatttcttatccggctttccctgcgaaatgaagcccgacggggtcatattacccttaatatccgattttacgtttctgaagccggtacagcaaagaggtatcactgccgctgtaagaacagccgcaagcataggggtaattataccgtatcccgttatcatatcggcaagagaagtgcaggcaaaagctataagcgttgacaggagaataaatatacagcgtttgatgtttctgtgaagctgtcttgcctcttttatcatttcaacgactgatgagaaattatcgtcacggacgataagcccgctcgcctcataaacgcttcctgtcgtattttcgagcgatgttatgccgagatccgcatgggcgacaaggtcgtaatcgctgtcgctgtaacccacagttgctactgtttcgcccgcttccttcagcttttctataatatccacacgctgagccgcatttacacggcagaatatctcagccttcttataatcaagcggttctcccgttacagtgctttctgctatttcatctccggaaatcattcctgcgtcggaaagtcctatttttttgcccattgagcttgctgtttcggggctgtcagaggaagtcagcacaagccttactcccgctcttttgcagccctgcaatgcaagaggtatcatatctcttgtcgcattcataaaagaaacaagccccatataattatattgcactgcgtaaagactcttgggtatttcttcgccctcaggtattatataatatgcaaccgtccacacttcaagtccacgttttgcaagagccgccgcacgagcggttattctgaacatttcttcagggctcatattgcaaaggcctgtcaccttttctacagcgccctttacgcacacaagatgagttccgcccatattatagatatttccgcctattctgtcggcatcattataagggaactgtgctgtaagttcgtttctttttaccgttgccacatcggttccgcccagagctgcattaagcaggaatgcctgctctgcaagcgtcggttcatccttatcgcacgcaagcaccgttaccgttgtcataaggtctgtatccttgctgtatattcctgcaacctcaagtgtattaggtgctacaacagcggatttatcaatgacaagcacggacaggctgttgagcttttcgggaacggtaagattttttatgacagccccctttagctcggcacggcgtacaaaattcatattgtacattcttatatacagctctacaaacggcataaacatacatataagccaaccgcaagcgcttacgataacgcctgttacattgtctgttcttcctgttaaaatctgtgacagagtgccgataacacaaagcagtattgccgctaccgcaagcggaagcctcagcttgacgcaggttttctcatagcgtgagaaattcggatctgccgcttttccgtgcttttcaccttgtcttgctctgtatgtatcttcacccgttgccactactctcgctacagcagagccgttaagcactcttgtacctgcatatatacagcttttcttaagtccggtcgccttcgggtccgctccgtcatgcttttgcacaggggtattgtcgcctgtaaatctgctctcgtcaacggtaagtccgacatactcaagtatatgtgcgtccgcaggaactatttctcctccctgaacaattattatatcatccggaacaagacccgccgccggaataagctgtaatatctcgtcacgcaccactctgtatttcatctttgcggacagggtacggttacggatattttcgttatttttctgacatatcacacaaagcgtaactgtctgtgctatcgccattattatgcacattatgcctgtgacatactgcgacaatgtaaatatctgaagtaagcctgaaatcaacagcagaactgccgtggggtcaagcaggtagtgatatgacttgaagctcttgtcttcggtttctgtaaaaatattatttccgtacatattgagattatcagaggctttcttttcgctgagtccattataatctcccttgaaatttaaaaactgtgccatatttctcttttctttatctgtcgttttatttcccgttccgaaccgtctgcggcggtgcggataaactttcctattctatattatctcataattcaagcgaaaaatcaagagccttgaaacatatgcaaaaatgtcacagccgtaatttcgcattaaaatgacgatttcacaatactttcaccgttttgtaaagtttttgtaaaactctctaaggtttctttaaggcaaaagagttatcattacagcacagacaaagaacaacaccgaaaaaaccgaaaggaatgagataaatggataaaagcatttttaaacgtcacgagcttaaatatcttgtgagcgctgagcaaagggagtttatcgaaagcgaattcgcacggtatatgattcccgacgaacacggcgaaagcacgatatgcaacatctattatgatactcctgacttcaggcttataagaagatcgcttgaaaagcccgtttataaggagaagctaaggcttcgcagctacggtactgcgtcaaaggatgaaaaggttttccttgagctgaagaaaaaatacaagggcatcgtctacaagcgccgtatatcgctcaactgcgatgaagcgcaggagattctcgaaaacggcgaaagatttcccgaaaacagccagatagcaaaggagatcaactattttcttgacttttacggggacattttccctgctgtctatctttgctacgacagaacggcatatttcggagcggatgatccggatttaagaattacgtttgaccgcaacataagttggagaacggaagatatcaaccttaaagtcgagccgtacggtgagcagattcttgacataggatattcgctgatggaaataaaagcggcaggctcgatgcctttatggctggcagagcttcttgcacagggcggtataaagcagacatcgttttcaaaatacggaatggcatatatgacaatgctcagacgaagcatgggcataagaacgaaaaaggtaaaaagtgaggtaacggtaaatgtttgatacggtaatacaaggaattttcagcagtacggctgatataacactgggcggctttcttatcggcgtaggctcggcgctggtactcggaatagcgatggcttttatgtatatgtacaaaaacaaatacacaaagagctttgttatcactcttgccacacttcctgcgatagtcagcatagtgattatgatggtgagcggttcgataggcgcaggcgttgcggtagcgggaaccttttctcttgtaagattccgttctgtacctggtacggcaaaagaaataggctcaatatttcttgcaatggcggtaggacttgcgtgcggaatgggctatccgctgtacgctcttatctttgcggtgataatgggagttgcaaacatagtgcttaccgctacccctttcggagaatcaaagaaaaacgagcttgacagggtactgcatataactgttccggaggaccttgaatatgcgggaatatttgacgatatatttgtagaatacttatcacagtacaaaatgattcaggtaaaaacaacgaatctcggcagcctcaacaagctgacctataacatcacgctcggcaaggcaggctgtgaaaagcagatgatagacgagctgagatgcagaaacggcaatcttgaaattaacataacttctcaaagtacagacggcagagaacagctctgaaaaacgttatgatacgaaaggcggtaattttatgaaaaagaaaatcttagctgtaacaattgctgcagcgcttatagtttcatgctttacatcgtgcgataacaacacatcatcggattcacaggcatcaaaggctgaaagcagtacgaccgtcagctctgacagcgcttcttcagcaacagatataagttcggcatcggacagcaagacttctgacagcggttctgacagcgataaacagcttacagcggacgatatgttctctgaccgtgatctgtcgggcgattactcggaatgcacagatataactctcagcgacagtacggcaagctgttcggacagttctgtaacagttgcagacggctcggtcacaataaccaaagccggaacatataaattcagcggaacattcacgggtcagataatcgtaaatgccggcgacagcgacaaggtacagcttgtgcttgacaacgcaagcatcactaaagagggaagtgcggcgctttatattataaatgccgacaaggtatttataacaacggtaaagggaacagaaaacacgctttcaagcatgggcgaatttgcttcatcagatgatgcaacaaacgttgacggtgcgatattctcaaaatcggatataaccttcaacggcagcggcactctgaacgtaaagtgcgaaagcaagcacggcattgtaacaaaggacgacctcaagataacgggcggaacatataatatcacttccgcatcacagggtctttcgggcaaggacagcgtaagaatcgcaggcggtaatattaccgttacatccggaacggacggaatacacagcgaaaacacagatgagaccgaaaagggatatgtatatatttccggcggtacgctgaacatcacaagcggcaaggactgcattgatgcatcgggtacggttgaaataaaggacggaacattcacctttaaggcaggaggcggttcgtctgaaaagacaacaggcgacagcaccgagtcatataagggtataaaggctgacggcgtgctgacaatatcgggcggtacgtttgatattgatacgcttgacgacgcaatccacagcagcgcagacgttacggtatcgggcggtacgcttgacataagcacaggcgacgacggcattcactccggcaacaacacggttgtcagcggcggcgagataaacatcgcaaaatgctatgaaggtcttgaaggtcagacggtaacggtcagcggcggcaaggtaacacttacgtcatcggacgatggaatcaatgccgcaggcggcgacaatcagggcgtgggcggaggcttcggccccgactcattctcagccgacagcaaagctaaaatcaccataacaggcggcgaaatacacgtcaatgcaagcggcgacggacttgactcgaacggtgatattgaaatatcgggcggtacggtttatgtatacggtcctacaagcaatggtaacggctcgcttgattatgaaaataacgctgtgataacaggcggtacggtaattatggcaggctcaagcggtatggctatgaacttcggctcggagtcaacgcaaggctcaatacttgcaagcacaggtaacgcaagtgcaggaacagcagtaaagctcaccgattcaagcggaaacgtaattgcagagtttacacccactgtatcgttccagaccgtagtaataagcactccggatattacttctgacggaacatacacacttacagtaggcgacagcacgcaggatatcaccatgtccggctgcatctacggcagcggaatgggcggcggcttcggcggaggtcagcacggaggaaacggcggatttggcggaggtaaccgtcccggcggtaataatcatggcggctttgccggaggcaatcctcccgatatgaacggcggtcagacagccaccgcataagacagcaagttaaatcaatatataccttacagtgaaaatccctccggacttttgtgcccggagggatttgctattattttagtctggtataatgtggtatttgacttttcttgctttgaaccaacaatatttgttgctgagttctaagggactgataccgtcacaatcatagaagtagataaaaccgtcttcaatagccattgacgattcagaccggtaagggtcttcataatcgggattccgactttctgtgctgtatgatacatcattttcaagccacatctctatttcacagccccacgcccctttattcgcccgtttcttaagccttattcttcgtaaggttcaatcagccgttttcccgagtctgtcacctgataatacttatcgttttccgtatcaaccataagtatcggaataactctgctgtcgagaacagtgccgtctatgtaatagtgagattctccgtcgaaataaatgtcgtggaagaacttgtcgccggatatttcggcggtgccgacatgacctgcgactactttcatatcaagcccctcgattttgccggtttcagcgggatattttgaggtgaatacatcttctgatgtttcccattcccacatatcacccgcttcttcatcaataccggcgtgaacgaaaatcgtgtttccctccacataatacagcggaagggaagagagccagttgatatactcatcatcatcgctctcatcctcccactcttctatacgggcatatacagaattgttgcttatggttgacgatccgttgactacccattcatcgtggttgccgagcagagcaataattctgtccgaaccgaaacgttcccggagcttcattatcctgtccagaacaccacggttatccggaccgccgtgaatataatcgccgagaagaacgagcttcgccttgccctgttctatatcatcgagaacaagtgaaagtgcgtcctcaaattccgcaaggcaaccgtggatatcactcatacagtaaattatcattgtaaactcctttcacgagccgcattctttagcgtaagagtatatgcaacagcatacaaaacactgagattaatcattcatcattctctttgttctttttcaaatacaaaggagccggacaaagaaatgttgaaccaaggcataaccaaacaatgcccatcgatgtattgtttctgccaaaaataaggtctgcatttgaaccgataaaatagtgtggaaattgctcaacaaagtcaaacagtttattgaatacctgtgcattgattgtcataggaatatgctgtttattaaagacgatgcagtgttcattataatatccataaggataatactgcatgaaccaatcttgagatggaatttgtcaaggggtttttatgcaaaaaagcacgatttcataaaaatgattcaaatacatatcatccaaacagaattgagagaatagtagccttcaataatatgctaatgccgccgagcgtaaccagtatagttatgctcggcagtaaacttatttagggattgatgtactttccttcaacgatgaatacgccatcggttaagggcttttcattgtcgggtttacgcaggataccacggcgaatcagctcatctgtaatatatccaatgatctgatgcagataacagctaacccactgattgatctgatcgtgtaggtgtttcggaacgaaattttcaaaattattgcgcacagttacgatccactccgcaaggagatcattgagctttttatcagtcatctcaaacagtgaaacaaattttccaaactgctctgcggtaaagtgcgggaagtttaagctaaagcctgcctctgactttataagcagatttgtttcgataagatgtgcggcatcttcttcggaaagagcttctttggacacaacaccgtttacactgttctgtggtatgccatttgcacacatccagcgcatccctttgttatggtaaatgttgtaatcaaaatacttactgatccaatagtaatagatatgcgacggaactttgtactcgctgccgctgtcgtctcctgcaacattgcatccggaattatactctgcacagttttccgattcatcgaccgtttcttctacgataaaccaaccgtagcccccgtcttttctcggcggatacggaccgttttcaagcttcaagcggttgttttttacatcaccccagcggggtacgggtgtgggtaaggaaagagggagccacgagggagaaaacctaagggatagggttaggggcggcagtccctcaccctagtccctttggttgtctcccgcgtgaatagcagcaacgttattaaatggaatagcgaacccgataagtgctatccgacaaaaagaactatcggtagcttgccaaaggtgatcttctgttgctgagcaaagcccagccaactattgagggattgttacactacaccttgcccctcaccacccctattcaaaatcaccgccacaggcaaagcacggatgcttgtaacggtcgcacaaagtcgctatgcacggatgcatatagtcagccataccaagtcactgcacgatgcagtgacaaaaaatggctgacaatgcacggacgcagcgaccacaaacgaccgtaaaggctcacacattttcccttgtttatttttaatttacattatctctctccccttgacacttccaaaataatatggtattataatcttaattattcttttaagaaaaatcgcagtttttcgccgtttttttacacatattttaatgtatttgctgacattttatagaattattcggattttattgtggtttttttaaaacagaggtgtgatgatgagcttttataattccttcgaggaaatttttcaggagatgaaaaagagacttactcttactcctaccgccatgaaattgtggattgagccgttaaagccgctcaaactcaataacaatcacgttatgctctatgttgagagccagttctcaaaagacatgactatggctaatttcaaaaccgtaatggaagaagcgttcagcgatcttttaggctttgacgttgaagtcgagattctttgctctgaggaccttacagtagagcagaagctgaaatacggtattgaatcctatgccgattcatcaccgaaagagcttcagaaagagcttgacgatgacgatattgtaaagacccgccttaagaacagcgagcttgcaagcaattatcagcatacctttgacacttttatagtaggcgataacaataagcttgcgtatgcagcctgcaaggcggtagtacaggagcccagcactcgctataaccctctttatatctacagtgagccgggactcggaaaaacacaccttctttccgccgttaaaagcgaaatggaaaagctccaccccgatatgaatatcatatataccacagccgacaccttcacagatgactatgtaagcaatctgcgtacaaagagcaatcttgaagcgttcaagcagaagtaccgcagctgcgacctgcttttaatagacgatattcagtttatggcaaataaaagcgaaactcagcaggagctgttccacaccttcaacagcctctataatcagaacaagcagatcatattcacctcagatagaccgcccaaagagctgaacggtatcgaacagagattgataagccgttttgagcagggcttgcttgcggacatcgcaccgccggaatatgaaacaagaattgcaataatcaagcgtaaggctgagctttacggaatgaatcttcccgacagcattgtggattttcttgcggacaagcttaagacaaacataagacagcttgaaggagcaattaccaagataaacgcactgacacttgttacaggctctacgcccacgctcaatatggctcagcaggtagtccgtgatatacagtcaaaccacgagcctattccgcttacagtagaaaagataatcgccgaggtcggaaagatatacagcgttacccccgaggatatgcgttctcagaaacgttcttcgcagataagcaccgcaagacaggtagctatctatgtggtaaacagaatcaccggactttcctattcaaatataggagtagaattcggcaacagagatcattccacaattgtttatgctataaataaagtaaaatccaccattaaaaaggacccgacatttaaaggtatggtggacgatatgataaaaaatctcggtaacaatgcgtgaagtgatttttaatattgacagtaatatttaaatgtgacgaagcttaaaaaccgttgctttaatcaaaaatttcaccgctttcacccctgcggtgattttttacacaataaaaatcattcaacaagttgttagttttaaacggtgaaagcgagtttaaagtgttaaatgttgaaagcctgttaaaactgttgaaaacttataacaatctttcaaacattacctgtccgacattcaacaaacgtaaaaatgccctgaacataggttttatcggcactcaccgaacattcaacacattaaacgccccccaccgccaccaccaaaattaataatattatttaatttatttatcgcctgcggcgatagcttcgctgataatcttcagtgttaaaaatctgaaggtcggcgagataaacaaaacgttgattttgtttgaatttcctatacgaaagtaaagtgcgtatcacgctatgataagaaaggataccgtatgataaaattcagtgtacagaaaaatgacatcttagatgctctgaccacaacagccaaagcagcctcgacaaaatcagtcatatcggctcttgaaggaattcatctgagccttacgggaaatcagcttacagttaccggttacgatctggagctgggtattaaatccactattgatgtagaaggagaatctgacggagttcttgtacttaattcacgtcttatctgtgatatagtaagaaagatgcccagcggagttatccgttttgacgaatacgagccgcttaagctaaatcttatgtgcgaggatatcacctattccataatgggtatcaacagtgaagaatatcccgtacttcccgagctttcaagaggagagagctttgaaataagcgagcctcttttaaaaagcgtaataggacagactctttatgccgttgccactatagacacaaagcccgttcttatgggatcaaaattcgaaatcaagaataatgagcttaatgtaatatccgttgacggtataagaatagctataagaaaagaaagccttttacacgaagattttgactttgtagtaccggctaagaccttatccgaacttttacgactgctcagcgatgatgaaagcaagattgccaccgtttcggtagacagaaatcagggtatattcagcatagataaatataccgttttctcacgtctgcttgaaggcgatttcttcgattatacaaagattataggaatgccttcaaatatcgaggctgtagtaaatgtaagagagcttatggaatgtgttgacagaacacttctgcttcttaatgataagataaaatcacctgttgacttcacattcagtgacaatacgcttagagtattctgtgaaaccgctataggaaagctggatcagaagataaagtgtgattacagcggcgaggagttcagaatctcgttcaacagcagatatatacttgacgctctgaagaatacctattgcgataaggtaaaatttctgttcgtacagaatacggcgcttaaaatagttccgcttgagggcgacagcttcacatttattgtaagccctgtaagacgccgataatatgtctgtctttaaaaaacagcggaaatggatttatattgcctttgtgataattaccgttatcataatcgcaattattataattccgaagctgacaggcaattttcttataggctcgtgggaaacctccgacggtctgagaaaatatacgtttgacgaaaatacacttaccgtaagctctaaaatcaattcttacagtaagctatacggatattcatataaaaataatacattagcattacaagacagtggtaatactaaatattatactgttactataaaaggcagtgagatagtaatatcttcagccgacagcgacagctccgaaatacttcacagggtggaatgattatggataaaactgtaaataataataatatcgcaaacccgacaattgatgatttaaacgcagaaaaaccggctgaaaacaccgataaatctacaaaaaacatcaacatggagtctataagatgcgacaataattctgcggtttttcagcagaatgaacagaaaagcgactttgatattgtagattttgttataagccacagcgacagccgctcggttcgtcaaaaaagtaagctgccaaaaatattactctgtgtaatattaggagttatgattatcgtgatctgtgtgctgtctgccatttggtcatcctcagcaaagcagaaccgtctgtttggcacctggacttcttcagacggccttataatgacaattaacgataaaagcattacgataaacggcaataccagtgaatataagaccgaagaaaagaacgtcatagcaatcaagatgaacaacgagtattataagattatctataagctggacggcgacagtcttacgctcacaattcccgataaaagcggagtttcggagcttaaatataccagaaagagtgattaaaatgtgtataaatgtaaatgttaaacctccttttatcaagctggaacagtttcttaagttcagcggagcctgtgaaacaggcggagaagccaaaaacgccattcagggcggatacgttcatgtaaacggtgaaatatgcacaatgcgtggcaagaagatagcagacggcgatattgtagagcttgatgaacagcagtataagtgctgtatgagataacgacaaaatgagataaaatgcagataaaacgactttatgtaaagaatttcaggaatataagagagcaggaattttgctttcacgagaatgtaaacgtcctttgcggaaacaacgcacagggcaagactaatctctgtgaggctatttctctttgtatgggaccgtcgttccgtacctcaaggcaaagctcttatattcctttttctttggataattcaaaggaaaagtgcgttattaaaatgtggtttaccacttcttttaatacagatagtgaaaatctgatagaatttactatttgtaataataaaaaagaaataaaatacaacgggctttctataaaatctgctttagaattatacggcgtgttaaaatatgtggtttttataccggaacacttaaatctcatcaagggtgtacctgaatgcagacgtgaatatctcgacagtgtagctatgatgcagactcccgtgcatttaaaaaagctgtcacgatataacaaagcgttaaaaaataaaaataatttacttttcggaataaatttcagcgatgatttatctgtgataagaccgcagatagagagctggaacagcgttttagcggctgaggggcttaatgtcacctacggcagactcaagtatttctcactgcttgaaacgatagcttcacagctttacaatgagctttccggcggagaaaatctcacgcttaagtattattcaagcatatttgacagcactgaacttaaatgtgaggagataaacagtctttataacgaatatctggagcggctcaacaacagctttcagcgtgagctgaagatgcgttatacggtgcttggcgtacatcgtgacgatatgaatctttatattgacaataacgatgtaaaggagttcggaagtcaaggacagcagagaagtaccgcacttgcattaaaacttgccgaagcggaaataatcagacaaaaggacgaaaccccgataatgattcttgacgatgttttaagcgagcttgacgcaggcagacagcgttttgtactcaatcatatcattaattcacaggtttttattacttgttgtaatataaatgacgttaaagaattaaaaaacggaaaagtctggaaagtagaaaacggcattttcacggaggaatgatatctatgtatattcatatcggtggcgatataacattaccgtcagataaaataataggcatattcgacattgaaaagacctctgtaaacaaagacgtaaacgactatcttatgaaactgcagaagcagggcaggatctattatgtttcttacgatatgccaaagagctttattgtgacaaaggactatgtatatatctcaaacgtgtcggtttttacgctgaaaaggcggtttgcggataatgaaataaggtcggaaatataaaagggggcagattttgtatccgctcctttttagctttgttatcgtgttttcagcaatgcggaatcggtatttttaaacatatttacaatctgttacattattatctgttttaactgactgtatagattttcaatgtttagaaatagattaagcaccgctgttacagcagtaatacggcggcgaaaagtttaatatacgaacagcgttgaaatgccgtttttaaaagcgtttatgagtgattcaagttgactttgaagctgaaatgtgatataattatatatagtatcgtgagaaattgcggaaatgatgaaaggaaagagcatggcagaagaaattcttgataaaaacgtcaataccgtagaggttgacgagcatgaaatcgacggcgaaataaaggatatagaggataatacacaggttgaacacgcttacggtgcagacgatatccagatacttgaaggtcttgaagcggtaagaaaaagaccgggtatgtatatcggctctacaggtgaaagcggtctgcatcaccttgtatacgagatagtggacaatgccatagacgaagcccttgcaggctattgtaccgaaataaacgttaagatactgcccggagatgttattgaagtaaccgataacggacgtggtatacctacaggcattcatcctaaggaaaagataagtgcggctactgtcgtatatacgatacttcacgcaggcggtaagttcggcggaggcggatataaggtttccggcggtctgcacggcgtaggtgcgtctgttgtaaatgcactttcagaatggcttgagcttactgtatatgacggcaaggagatacatttccagcgttttgaaaacggcggtcattacaaggagcagatgaaggttatcggcacaaccgataagacaggtacacaagtacgcttcaagcccgactcgactatattccacagcacagagttcaaatatgatatactgcttgacagactcagagaacaggcttttctgaatgccggacttaaaatcgttttaagcgacctcagagatgaggacaagcctaagcaggaggtccttcagtatgagggcggtattatcagctatgtagaatggctgcagaagaaaagaggagcagaagcgcttcatcccgatgttgtatatattgagggacttcttgataatatatccgtagagattgcattccagtacaacacagacttcaacagtgaaacgttcagatcgtttgcaaacaatattcatacggttgacggcggtacgcacgagattgcattcaaaaatgcactgaacaaagtcataaacgactttgtaaagcagtataaggaacagcaggctaacaacaataagaagtccaagaagaagcaggacgaggtcaaggagtttgttccgctgagcggtgaagctataagagaggctataaatgcggtcatctccgtaaagctccccgaatgtgaatttgaaggacagacaaagggtaagctcggtaatcctgaggttcgtcccgttgtttataaaataactgtagagaagctgacatattactttgaggagcatcccgatacgatagccacgatagctcagaaatgtatcaatgctcaggctgcaagagatgcggctaagaaggctatggaggcaaagagaaagtctgttacggacggtgcaagtctgcccggaaagctggctgactgctcggataccgatccagaaaagacagaagtatatatcgtcgagggagattctgcgggcggttctgcaaagcagggacgtgacagacgtttccaggctatacttcctctctggggtaagatgctgaacgttgagaaggcaagagcggacaaggtttataacaatgataagctgcagcctgtcgtaaaggcactcggtacgggtataggagaagattttgatataaccaagctcagatacggcagagtagttgtaatggccgatgccgatgttgacggctcacatatcagaacgcttctgctgacattcttcttccgctttatgcgtcctctgatagaagaaggtcatgtttatcttgctcagcctccgctgttcaaggtgttcagaggtaaaaaggtaagatatgcgttcagcgacgaggagagagatgcctatattgctgagcttgcaggcgaaagcaacgcaaaggttgacgttcagcgttataaaggtcttggtgagatggatcccgaacagttatgggaaacgacaatggaccctgccgcaagaacaatgataaaggtaaatcttgaggatgccgcaaaggctgacgaaatattctcaatacttatgggcgacaaggttgaacccagacgtgaatttatagagcagaatgcaagatacgcaaaggatcttgatatataatcttttattcgggcgaggaaaaataaaatccgtgaatgcttaaaggtgttactatgaataatgaaattttaaataataacgaggagcagcccgatgaaaaggagctgttaagacagcgcagggaagaacagatagagcgtgtcaaggctcaatatgaaaccgatgtaaaggaaaaagctgaagctaaagtaagaatggaaaaggagcaggagcttgaaaatgagcttgcaccgtttatcaccgtcagaaaaggtcttatagccttatgcggtcttatgtgggtgtttgcggcattctgtctgcttaccggcacgcttgaaatgaagatattcctgcctatgtgtatgtttgcgcttgcggctcttgcgggcgttaatgtaccggtatttgtaaagaaaaagaaaatatttgacggcgttatagccggaatatgtaccgtgatctgttttgttacaggtgtgattatattgatgttcggataagacgaaaggaaaatatggaagaattactgttaaaaattaaatacagcatgacgcttgacgagataggcgagggattcaagctgtttcagaagaaatatcagtttaagaaatcgctggttttcacgcttgtttatcttatagcgctgggacttggcattgattttctgataagagatcataccggtatctacggctatattctggttggcctgtcgctcggtatgatattctatacctggtataagcctgtgcttataagaaaaaagctgattgcgactataagctcacttgccgaagaaacatatacggctgagttttaccgtgacaggatacaaataacgaccgtaatagaagaaccggttatagcggaaaatgaaaccaaaacggaggaagaaaccgattctcccgcaaaggacgaacctcacgaggaggaagagcaggaagaagtagttacaaatctttatttcggctctgattatttagacgctatggaaaatgagcagatgtttttactgtttgtaaacagacagaatatttatattttctcaaagaaatgtctttccgaagaagaacagaacaagctgagagaaatatttaccgaaaaatcaatactctgattgatataaaagaatcggaaaggaaatcggaatggaaaaagacgttaaagaattcagcacagccactgaaaagctgatacaggtagacatagaaaaggaaatgcgtgaaagctttcttcagtattctatggcggtgctggtatcaagagctttacctgatgtaagggacggcatgaagcctgtacacagaagaataatatacacgatgaacgaggctgacaatacatcaagcaagccgtacagaaaatgtgcttatacggtaggtgaggttctcggtaaataccaccctcacggtgacgcatcggtatatgacgcactggtaagacttgcacaggatttctcaatgagataccctcttatcgacggtcacggaaacttcggttcggtagacggcgacccgcctgccgcttatcgttatacagaagcgagaatggcaaagatagcatccgagcttctgaaggatataaagaaggatactatcgactggggaaagaactacgatgataagctggacgagcctactgttcttccggtaaaatttccgaatcttcttgtaaacggctctgtaggtatagctgtaggtatggctacaaatatacctcctcataaccttaacgaagtatgtgacgctatagttgcacgaatggataatcccgaatgcggcatagaagaaatacttcagtatataaagggacccgactttcctaccggcggtataatcatgggatacagcggaatacgctctgcatattatacaggtcgtggtaagatcaccttaagaggtaaagcagagatagtggaagaaggtaaccattcaagaatcatcgttaccgaaattccttatatggtaaacaaatcaaagctgcttgaaactaccggacagcttatgcgtgacaagcgtatcgaaggcatttcaaatcttcgtgatgagagtgacaaggacggtatgcgcattgtctatgagcttaagagagatgtaaatgcgcaggtggttcttaataagctgtactcattcacacagctgcaggatactgtcggcgttattatgattgcacttgtaaacggcgagcctaagcagctgacacttcttgagatactggataactatatagcgttccagaagcagataattacaagaagaacagcatttgatctcaagaaagcaagagaaagagcgcatattttacagggcttcctgcttgctattgataacattgacgaggtaatttccatcctgcgttcaagtaagtctgtacaggaaggtaaagagcgtctgatggagcgtttcaaggaagacgatcttgcaaagctgttacagagggcaatgggagagaactataaggatgttcattttgaacacgagataggactttccgaagaacaggcggacgctattgttcagatgagattaggacagctgacaggacttgaacgtgacaaggttatttctgagcttgccgaaattatggagaagataaatgacttccttgatatactttcaagcgatgagagagtaaaagaaataatcaaggaagaaattacagctatcaaggaaaaatacggcgatgagagaagaactgccattgagccgataagcggagaagtggatatagaggaccttattcctgaagaagaatgtgtacttacctatactaatatcggatatatcaagcgtcagcctgtagatgtatataatctgcagaagcgtggcggtaagggcgtatcgggtatgaagcagagagaagaggacttcgttgaggatatgttcataagctctacgcacgacaatatcttatttattacaaattatggtaatatgtataaattgaagtgctatgaagtacctgagggttccaagcagagcagaggcacaaacatagtaaatctgttacagctcgacgagggtgaacgtattgcggcaatgatgaaaacaagtgattttgccgagaataagtatttcatctgtgttaccaagtacggaaaaatcaagagaacgccgctttatgatttcagaaacgtgagaaagaacggtctgagagcgattacgcttgcagagggtgatgaaatagcagccgcacatcttactgagggtgacagctcgattataattgctacacatcttggtatggcaatacatttcagtgaagataaaataagaagtatgggaagacttgccgcaggtgtaagagcaataaaactgcgtgaggacgactatattgttggtgctgccaaggtatacagtgatgatatgagaatacttaccgtaaccgataagggatacggcagactcagtgcgctgagtgattaccgtatgcagaacagaggcggtaacggtcttaagaactacaagatacgagatgacagaggatatgtctgcggtatacgttctatacagacggacgatgatgttatacttatcagcaccgacggtgttattatccgtatccgtgcaaacgatctcagagtgatgagaagaacaggtttaggcgtaagagttatgaagctgtctgatgaggatagagttgtaacatttacaagaaccgagcatgatgaaactgcggatattgaagaagtagagcaggcaagtgatgaagagatagctgcggctgaagcagaggcagaagctgaagttattgaggacgagcctgaaacaaacgaagaagaataaaatatatcagcctgtcggcagaaattctgtgacaggctgattttctggaaaaatacctattgttccacatagaacatttttatgatcggggttatttatgtacgaacttgattattatgacgttatagttgtaggtgcaggtcatgcaggctgtgaggcggcactcgccgccgcaagacttggatgtaagactgccgtttttactttaagtcttgacgctattgcaaatatgccttgtaatccgtgtataggcggctcggcaaaaggtcagcttgtaagagagcttgattcgctcggcggtgaaatgggtagggccgcagacgctacttttattcagtcaagaatgctcaataaaggtaaaggtcctgccgttcattctctcagagtacaaagcgacagggtaaaatatcatacctttatgaagtcagtgcttgagcataccgaaaatcttgatataaaacaggctgaggttacagaagtatgtgccgaaaacggcaaaattaccggtataaaaacaaggcttggtgctttttatcctgccggctgtgttatcatcaccacaggaacttatctcggcggtaagattcatatcggtgagctgaattatcagagcggaccggataacgtatcggcggctttacagatgacagagagcctcagaaacctcggtctttctatgagaagattcaagaccggtactcctgccagagttcataaaagatctatagacttttctgtgatggaagaacaggatggcgatgaatatattacgccgttctgcttcgataatacattcaagctcgaaaataaagtcaagtgctacgttacttatactaatgccgaaacacatagaattattctcgataaccttgacaggtcgcctctttacgcaggaagaatacagggggtaggtccgagatattgtccaagcatcgaagataagatcgtaagattttcagataagccaagacatcagctttttgttgaaccgatgggtcttgataccgatgaatattatcttcagggtatgtccagctcgctgccggaagatgttcagataaagtttttaagaactatcaaaggtcttgagcacgttgagattatgcgaccggcttatgcaatagagtatgactgctgtgatcctcttgaattataccctactctcgaattcaaaaaaatctccggattattcggtgcaggtcagttcaactgtacaagcggatatgaggaagccgccgcacagggtgtaattgcaggtatgaatgcagcaatgaagataaaaggcagagaacagtatatttctgacaggacgacttcttttatcggtacgcttatagacgatcttgttacaaagggctgtgttgagccgtacagaatgatgaccagcagaagtgagtacaggcttttattgcggcaggataacgcaaatgacagacttgtgccgataggacacaaattcggtcttatatcggacgagcgttatcagagatttttggagcgaaagaatatacttgataatgaaacgagcagaataaagaaagctaccatctatccttgcgaggagcttaataaaatgcttgaaagtaaaggtacatcacctattacgcaaggagtcaagtttatagaacttttaaaacgtccccagatagattacagagatttggctcggtttgatgagaatgcacctgagcttgaacacgatataattgataagctggaaatcaacattaaatatgaaggttatatcaaaacccagaccgaaaaaatcgaacagatgaaacgtcttgaagaaaaacagcttcctacggatattgattataagactatatcgggcttaagacttgaggcacaggaaaagctgaataaacacagaccgctgaatataggtcaggcaggaagaatttccggtgttaaccctgccgatgtatctgtacttctgatatggctttcagggagaaaacatggagagaattgaatttataatcagtgaatttcaaaaatgcaatatcgaattatcacaggataaagccgataagttgttaaagctgtatgaatttcttgttgagtacaatcagaatgtaaatctgacagctataaccgattttgaagaagtagtggtgaagcatttcatagacagcgtgttgccgttcagtatgattgacattaaagaaaacagcagttttattgatgtcggtacaggagcgggatttccgtccattccgcttatgatagtaagaccggatcttaaaggcacactgcttgaggcactgaataagagatgtgtattccttgaaaaagcgtgcgagcttaccggagttgatgcgaaggtggttcacggcagagcagaggactacgcaaaagaaaagcgtgaagcgtttgattttgcaacggcaagggctgttgcggctatgccggtactttgtgagtattgcattccttatgtaaaaacgggcggcaggttcattgctcttaagtctgtaaatgaggatgaaaccctgtgcgaaaaggcagtcaacgtgcttggagggaagatagcgaaaataaaagactatacaataacaaatggcgacaacagacgactatttattatagataaagtaagtcagactccgacaaaatatccgagaaatccttcgatgattaagaagaaaccactgtaatacagtgaaaatataaaacattccgtcgtttttagcagataaacggcggattttttttattgcccgaggaataagtttgatataaaattaggttgggggtgaaataatggggttatttactaaggataagaaaattacgggacaagttattacagtgaatgtcagagaaatagacttaaacccaaatcagccgagaaagtattttgataaagcagaattagaaagccttgcgataagcataaaagagaacggtctgttacagccgcttacagtgagaaaaaaaactgatggcagatatgagcttatagcgggagaaaggcggctaagagcatgcatcttcgccggtatacacgaagtcagggtaattattgaggacagaaatgaagaagaatcttctgtgcttgcaataatagaaaacatacaaaggtgcgatcttaattgcattgaggaagctgttgcaatgcaaaggcttatggatcattacgggtatactcaggaaaaactggcaagaaagctcggaaaagcgcagagtacgatagcaaataagataaggcttctgaagttatccgacaagctgttaggaaaagcattggagcacggtttgtgtgagcggcagataagagcattgataagattacctgaggaacagcgggaaaaggcggaggagcatatatataagtatggactgaatgtaagtgaaacagaaaaatacatagacaaattacttgcaaagaaaaaagtagataagccaaaatggacatttactgctaagcgtctgtatataaacaacatcaacagaactcttgaaacaatgaaaaaatcggggattgattttatttcagagaagcacgaggaaaacggttatcttgagtatataatccgaattcctcacgattgatgttcataatgaagaatgttcataaaaatgttccatgtggaacaatttgtgaacgtttttttgtaaaaaggctttatttttctcccatagtgtgatataatgttataagtaacgtttgaaggaggtactatgggagtaattatttctatcgtaaaccagaaaggcggagtcggcaagacaacatcggctgtaaatatcagtgcagctctcggtgcaaaaggcaaaaaagtgcttttggtagactttgatccacagggaaatgcaacctccggctacggaatctcaaagaaaaatcttaaaataacctcttatgatgtcgtaatgtccaatgtgcgtccgcaggaagcggttatcgctacaaattgtaaaaatgtaagccttatacctgcaaacgctcagcttgctgaggccgaaatgcatctgttgcagattgaacagagaaatcatcagcttaaaaaagctctgatacagctcaaggatgattatgatattataatcgttgactgtctgccgtcactcggaatactggcaataaacgcccttattgcaagcgataaatttattgtgcctatgcagtgcgagcattacagccttgaaggtctggcacagctgctttcaactgtgaaaaaggttaaaaaaacctccaacaagaatctctcccttatgggaatcgtattcactatgctggataagcgtctgttgcaatcaaatgaaattatgagggatattaaaagaaattttcctccgtcatctatattcaatacggttataccgagaaatgtgcgtatctccgaagcaccaagccacggtatgcccgttatatattatgataaaagctcaaaaggcgcagaaagctatatgaagctcgccggtgagataataaaaaaactgaatgattaaggagggtgtatggcaaaacgtggtgttttaaatcaaaggtttaacagtattttcgatgataatagcttcgatgaagacgatgaaggcataagcactcttaaacttaccgatatcgagcctaataaatctcagccaagaaaaaattttgatataaccgctcttaatacactggctgactcgataagacagaacggcgtcattcagcctctgcttgtacgctcaatgcccgacggcacttatcagatagtcgcaggtgagcgaagatggcgtgccgcaaaaatggcaggccttacagaagtacccgttcttgtcaaggagcttaccgaccttcaggctcagcagattgccctcattgaaaatctgcaacgtgaaaatctgaatcctatcgaagaagcaaacggctacaaagagcttatggataagttcggtatgacgcaggaggaggttgccagagtagtaggaaaggcaagatcgtctatagcaaactctctgcgactgcttaatctgcctcctataatagccgagatggtttcaaataacgagctttcaacaggtcactgcaaggtccttctgggagtgagtgaaaccaaggatatggtcgagcttgctcataaagcggcaggtaaggacgtttcggtgcgtgaaatggaacgtatggtaaaggctcttgataaaaaagaaaagcccgaaaagaaaaaggatacattctatacggaggcagaaataagtcttgccaaggcacttgaaactaacgtaagtatagtacccggcaagaaaaaaagcacaattcagatagaattctatagcgatgaagatctgaccgatattataaatcggcttgcaaacagtaaataattttaaaagaaaggcatatcaaatgatagacattaaatttttaagagaaaatcccgaggctgtaaaggaaaatatcaaaaagaagtttcaggatgaaaaaatcgtactcgttaacgaggttatcgagcttgataaagaattaagagccgctcagctgaaggctgataatctgcgtggcgacagaaataagctgtcaaagcagatcggcggacttatggcacagggcaaaaaggacgaggctgagcagataaaggctcaggtaaagcagttctccgatgagcttgaagagcttgaaaagaaggaagaagagctgggtgaagaagttaagaaaagaatgatgataatccccaatatcatcgacccttcagttccgataggtaaggacgacagcgaaaacgttgagataaagagatacggagaacctgtagtacccgactttgaagttccttatcattccgagataatggaaagattcaacggtatcgatcttgacagcgcaagaagagtagcaggaaacggcttctattatcttatgggagatatagcacgccttcattccgcagttttagcttatgcccgtgactttatgattgacagaggatttacctactgcattcctccttatatgattcgcagtaacgttgttacaggcgttatgtcgtttgctgagatggatgcaatgatgtacaagatcgaaggcgaagatctctatcttatcggtacaagcgaacattctatgataggtaagttcatagatacaataaacgaggaggaaaagctcccctatactcttacaagctactcaccttgcttccgtaaggaaaagggcgctcacggcatagaagaaagaggcgtttacagaatacatcagtttgaaaagcaggaaatgatagttgtctgcaagcccgaagacagcgctatgtggtttgataagctgtggcagaatacagttgacctgttcagatcgatggatattcccgtaagaaccattgagtgctgctcaggcgaccttgctgaccttaaggtcaagtcttacgacgttgaagcgtggtcacccagacagaagaagtattttgaagtgggaagctgttcaaacttaggcgatgcacaggctcgccgtcttaagataagagtaaagagcaaggataagggaaactactttgcacatacactcaacaacaccgttgttgctccccccagaatgcttattgcgttccttgaaaataacctttgcgccgacggcagcgtaaagatacctgaggttctcagaaaatatatgggcggtatcgacagaatagttcccaacgataacaagtaagctacagagccacggatactcaggtatttgtggctcgttttgttaacagaaaggtcattatggatagcagaaagtataccgttgaatatattcccgaatttgccgactgtgataaaaagtacgacataaagccgcaagtgcttcttgcgtggtgcgccgagcttgccggaaatcatcttcgcagcagaaatataacacgggagcagatgtggaaggacggtcaggtttttcttctcacacgtgccgcagttaattttgaaaaagtaccacagtataacaataaattgtatatgacaacgtgggagggcggaaccaaaggctcacagtttacaagaaaatttgttgtcaaagaaatggacggaaatattctgtgcgatgtcgatactatgtgggcgcttgtaaatccccattcgcataaaatatgcagaccgtccgaatatatctacgagcagattccctgcgaagataaagttgaagcaaaagtaataaaattcaaggcggaagctcccaagaaaataaaggattatacattcgtttacagcgacattgatgccaacggccatgtaaataacggagtctatttaaggcttatgagcgatataataccgcaggagcttacagacaagcatttgaaaacgctgagaataaattttatacacgagtgcaggcagggagaaactgtcggactttatctcaaaataaacgataaaatctgcactgcggagggaagattccccgacggcaaggtcagctttgaggcacaggcagaatttgtttgacaaaatttagttaatgtgctataattaatatcaaagtaaatataatttaccttaaaaacagggaaagggcaaaaaaatgcttcacatcaaaaatttgcataagagttacggtgcttttgaagtgctgagaggccttgaaatgaatgtaaataccggtgatatttacggatttctcggtaaaaacggttgtggaaaaaccacaacaatgaacatagtttcaaatattatcccaaaagacagcggcgagattaatttcggaaaagaaaactgcaagataggctacctgcctgaaacaccgtcaatgtttacatatatgaacggctacgaatatcttgattatatcgcttcgtgctgctcctataaggatgacaagaaaaaacgtatagatgaagttatcaatatagtaggaatggctgagggcggaaaacgcagaattaaaggctattccagaggtatgaatcaaaggctcggcatagcggcggcaatatttgaccatcccgacctgcttattcttgacgagccgacctccgcacttgatccgcagggtagagcagaggtaatgagtataattaaaaatcttgctgatatgggtaccaccataattctttgcacacatatattgtccgatgttgaaagaacggcaaacagaataggaattgtccgtgacggcagaatggctgtcgaaggaactatttccgaaattaaggagcagtatgacaaagcgggcaagaaaatagtaatgggcatattcggcgacccctcagccgcaatacagcccgtaagtacccttaccggcggcaatttctattttgacagacaaagagccgtttttgagatacctattgcttccgatataaatgagcaggaaacagctcatcgtttatttgatttattgaattctgccgggcttaccgtttcacttttcgttattgaaaataagacgctcgaacagatttatatggaaactataggttaaggagggagcagaaaatgataaaatcgggtataaaaaaagagctgatgctttttacaagaggattcaagctgttaggcgttattattactattttagcaatatcacttctgtatccgtttacctataagtcaatggagcttatggcaaatcagatttcggatatgggtcagcagttcggcggtgaaacgcagggacaggttgagaattcagcagcttcaataaacaatatgctgggctcaatctccgaaatgtacggcggaagtatggcggcggtaggcttcaaaaccggagtaagctcgctcacgtcaacaggttctcttgtgataatgttactgcttatgtcagcagcaggaggagaacagaaaaaacgctctgtaataatgccgacctgtgccggactgtcaccatccggctatgtaatgcctaaatttatagtctatccgctggcaatagggcttatgtcttttattggcggaatgataactggcggtataagtaatcttatttataacaatgagttgattataagcgatatagtattctcctcggtgtgcagtgcgatatatatgttctttattactgcggtatacttcctcacaggactttccacaggaagaccaggtatatcggtcataatagtgtatgccggctctacgatagttccgctgattttgcaggcactaaatatagataagtataatccgtttaccctgcagacgctgcttatgagttcatatagtgaggcggatatgaacaatttcattctcagcacggttgtttccgttgttttatcggtaatatcctgcctgctgacgcttatgataaccacgctcagaaagatagataactctgtcggagaagcaaatctataaacaatcggtaaaaagaccgtacatataactatatgtaaaggagaagcgttgcttctcctttgttttatgtgcagaaataatgctgcccgataaccttctgtacaggcctgctcatcataaactggttgcttgtctttttcggattataatagtaaatacatccgccggtagggtcccaccccgataaagtgtcacgggcggcgtcatatgcagaatccgctataggttcattgaattgtccgtctacaagagcagtgaatgcaccgttctcgtaaattattcctgcaagtgtatcgggaaatgacggatgctcgatcctgttcataataacagccccgatcgctacctgaccgatataaggttcacctctgccctcagcagaaataatccttgccagaagatttatatttgcagtggtggcaggagggatagaacctatagatataccgagccgtttcagcgttgcattatcggcaactcccgtctgcgcaagcccctgctgtttctggaatctgagaattgcttcttctgtcttttctccgaagtatcccgtgacctcggcattaaacaatcctctgtccttgagcgtctgttgtaccgcctcgacctctgagccctgtgagcctttttgagaataagccgtgaccgattcattatttccgttttccgcaaaagccgaaaaaataccgcttataagaaagatgataacagtgaccgacatcattttataaaacggattcaattgtctgatgtattccatattaaacactaaacttcctttcagaatttacctttataaagagtatctgcaataagcaaaagaaaatacataaaatgtgtaaccgaaataagaaaactacatatagtaataaagagcctatcgttatcaagatgtacccctatttacaggaaataaatagcaaatagcagaaatgcaaaaaaattcgcaaaaaaaatcaaaaaatgcttgacaaacgttattttccgtgatataatagacaagcactcaaacgagaaggcacaaaaacagagggtacttgagaaagcctgaaaccgcttgaacagcgagaaagagggcggtcgagggtacggagatggaccgaaaaaaccggaaggaagaaacggcggaagcacggtgaccgactggtaaaaagttcaaaactctgaaaaaagaaatttaaaaaatttcaaacggcacattgccgtccgccgtttcgctattctgcgaatagctcagacaattccaaaggcggaattgtcagtggcgactcgccacttagctgtcgagggttttggggtcgtctattttttcgcctaagaacttgggaagctccatacctgcctggttgaacatttcacccataggcggaacagctttcattataccgctgataaagtcggctgtggcggtcttgccgttttcgccctttgagccgccgtcccaaacggttaccttgtctatcttgatgttcttgatagcttctacctgaatcttcatcagctcttccatgttgtttgcaagaatcagcttgatagcgctgtctgcgtttccgcctgcggcatttacaagctctctcataccgtcagcctgctttacgagtatctcctgagcgcctcgtgcctgtgcttccatctttgcaaacagagcgtcagcctcaccctttgcggtacggcgtgcaacctctgcctttgcctctgcctcaatctcagcctgctccttggcaatcttagccttaacgataacgtctgcctgctgagttgcggtttcgagggcggcacgggtctgttctgcctgctgctgtgctatgtaggcttcttcctttgccttagctgcctgaacagcttctgcggctgtagcaagacgcattgattccgcttccttttcacgtcttaaagcctcagactgagcgacctcaatcttggactcgttctcacccttgatagcaagagcgtttgcggcagcgacctgtatacgctggtcacgctgtgcgttagcctgaccaatctcaccgtcacgatccttttcggcaacggatttcttcgcatcattgatagcctttgcggcagcttccttaccgagcgcttcgatatatcctgactcatcgttaatatctgttacgttaacgttgataagacgtaagcctatcttcttaagctcaatctcaacgttgtttgatacggcaacaaggaacttgtcacggtcgttgtttatctcctcaatttccatagtagcaactacaagacgtaactgaccgaatatgatatccttagcaagctcctgtatctcgttcattctcagaccgagcagacgctcagcggcattctgcattatacccggctctgtcgaaatacctactgtgaatcttgagggtacatcaacacggatattctgctttgaaagtgcgttcttcaagtctacattgatagatatgggcgttaagtccataaactgatatgactggatgatgggcataatgaatgccgcaccgccgtgtacgcactttgcgcttcttgcctgaccgttcttgtcgcttccgactttaccgtagataacaagtatcttatccgagggacacttacggtatcttgataagatacccatcaataatgcgaatacgataactaccgcaacgcatattgcaattaaaatttcgggctgcatgaatatttcctcctgtaacttagaaattgctttattgcttatttatccttttcaaccgccacgacatcgccacgcacgtctattatccgcacctgcgttcccgtggggatttcttcctgttcatcggtgacagccgaaagctctatgaaacgctctcccgccgctattgtcacctttccctctccgctttcgtttgcgggaatcgggatatataccctgcccttttcaccgagcagcctgcgcacgtcaaggcttccgtcctgagtgagccttcttgtaagctgaagcacctttgcgactccgagcatcgcaagaaatcccagcacaagcgcaattattatagctatcgcaacgtgaagtccgagcgaggtacatataatacccgtccagccgaatacgcacaggaatgtcataattccctgcaatgtgaaaagctgcattgtgccgaagtccgccggattcgagccgtcgccggtcgtcatatggtcgcacccttctattgcgtgagctgtcatatccgtcggtatgtccgcaggaacatcggcaggcatatcgggaacatctccaagaccgtctattccgctcgtgtcgctgaactcaatgccttctcctccgtgacctatacctatcataagcaggatagtctgtatcactataataagcgttgcggggatggctatgcagtaaaagacctgcattgtaataccgagcgaattccaccattcaaacatatcttccaccctttcttttcatataatactgctgccagaacatttttcacgggccttccgtgaatgtcgggtctgtcacttgttgtaatagcccaacgtgagaagtataagaaaattcttgtcggtcagcgtccattgctcatttacatatttgaactcgatagtatactcgaattctttcgatttgaactccttgtcgcctataacgctgtctatataatccatctgtgcattgtagtcattcttgaattccgaatttatctttgaatcggtcttttcgttgaacttctccatatcaagagcggtaaaggtacctgtgacactgcctgttctggtttccttgtcagccttttcggtcagattatcataggtaacataattatcgaatatagacgctaaggcagcggaatatcgtgagagccattttgcgtcataatctgtgcctgtatcggtaaaataaagctccatactcattttagagaaggtacggcaatactccgcaagactgtcataatccttgctttttgcaagcgtgaatatcttttcaacggtttccttaggagaaagctgtactgcggaggtttctcccttatcagaacaggcggtcatcgcaaccgctgtcgaaaccgcacagaaaagagccgccgcccttaataacgttttctttaatctatatgaaaatttcaatttcaatatcctttctgcctatagcagatcttgctatgtaaatttaatttaccttaattatagcacatttgaacgaaatgtcaatatcaaactttgcaattgcaaaaaataagcagtttgcacaatataagcctatgttttttgtgcaatacacagaaaagcgacattatttgcaccgcagataaaaaattttcggcaaatgcacttgatttttttacggctatctgctaaactatcaatataaaaggtaaattaaatttacagagactgtttaaaggtaattatccgtaaccgtctgaacgatcaatactttatcaatgcggaaggagtgaaaatatgaattctgaagaactgggaaaaagaattaaagaagcacgacttgccaagaagatgactcaatccgagcttgtcggaacgttcattacaagaaatatgctcagccgtatcgaaagcggaaatgcctgcccgtccgtgaaaacgcttgaatatctggcagggcggcttgatctgcctgcaggaagtcttatatccgacgaggtgcagggcgaggaagatcccgacagaaacgcacaacagcttataacggtaaagcggctgtacaagaaaagcgattattctgcctgcataaaggcggcggaaaaactcaacggcagtgaattcgaggacgaggggcaagcgataacggcacgctgttgtatagcattatcggaaaaagctatgaacagcggagataaagcggcggcaataaaatatgcaaagcaggcgcttgagcttgccgacaagggcatttacaagagccgtgagataagcgttgacgctacgctgaagctgtcggaaatcgcaggaggaaagtaattcgaatctcattatagattgttatgtgatatacttatcgatacaggaacagttcacagactgacgaaaccgttaaggataatctgctgtgtgccggcattgcttgcttttaccgtgataattgcgataatggctatagttgcggtaaaatgtgtgcaggatatgcctgtagtaagcatactgctcggtgcacttgatataattatgatatttttgcttctgagcatattcaaaagagctttcggaacaggaaaagataaaaaatgattgacaaagctctttttttggtgtataatattatcgttgtgatgtcggaagatattacaggatatatgcagacgtatcgaagtggtcataacggggctgactcgaaaacgaatgccctttttggaagctcacctctgaaaaaccttgattttacagggcttttcggctatcattgaaaagtaaatatcccttagttctctccatcagttctctcctttttccaaggtgtttttgagggctgatgtgaagataaatacacggagagatgtccgagtggtcgaaggtgcgactctcgaaaagtcgtgttcctaacggaaccgtgggttcgaatcccactctctccgccagaatgctcagtctgcaagcggtttttaccgtttgcaggctttttctttttctccactctggaaagatttttccgtaagttctctccgtgatttgaacttaggatatgtagttggcgtatccttagtgaagcgatacgccgcagaagctatgaaatagcctctaatgcgccactcagaccgtttaccattgcgtcagccgatgacagcttggaattgtaatccaaatgggcatatacatttgccgtagttgaaaaatcgctgtgtccgagccattcctgtatctgcttcataggaacaccgttcgcaagaagcagcgaagcacaactatggcgcaggtcgtggaaacgaatgtggcgcaaattgttcttttcaagcagcttcggaaatgatgctgtgagatagtggggagaaatcaatgtccccatctcatctacacagatatactccaaatactttttgttgtagcatcgtccgcatactcgcttgtattcttcctgctgttccttgagctttagcagcttttctttgaacgcaggaacaaggggcagcgttctcatactcgacttggttttggtcgtatcctgtgctatctggatatgcttgccgtcaagattgcaggaagtaacggtgtgtctaatggtaatcgtattgttttgaaaatcaatagcgtcccactttaagccgagggcttcacttcgccttagtccataaaacgcaccgagaaaaatcggtatttcaatcagcgttcctttggcggcttcaaatagtgcctgtacctcgttgctgtcatagaagctgccgatgaacttatcagctttagggcgttccactttatcagcaggattgacagaaataaggtcaatctttacggcatatttcaaagccctatgaataacagcgtgatagtgaataaccgaattagcttttactcgtttcaactgcttcatatagaaagcctgaatgtctgttgccttcatttcggaaagtgtgatttctctttccttgaaatacggaatgataacgctctttgccatacctgagtatgatgcgtatgtggtaagtgcgatagtcggctttgcgatttccaaccattgaagcagaaaatccgaaaacagcatatcgtcctttatgggtttgcactcaggaacaaaggtctgccttgtttccatcaacatcttttccgctttctttttattgcccttgacaggcaatcctgtcggcaaccatttcgtttttctttttcccgcagcatcgggatagctcaaaaccatataaaaatagccttttttctcttgcagatgtcctgctaccataaatataacctcctttgcgtagcaccgacttctgctgttgaccatatacattgtagcaacttaagccaaagaagtcgaatgtgcaaattctttaattttccgcatttcgcagacctaacctcaaataagaaagaagatgggctttcggtactttgtacgctctgcccaccttcaagtgttctattttgttttcacgaagtaattgataacctgtttttgtgctgacaccaagagccttgctcatttcatcaacggttaaaatatctgggtattcttttaagactaacgcatatatatctccaaagttcataagctcctccttttttcaactccgatactgatgaggagaggaaattcaagtgatttcaaatactgctcatcaaggtgtgtgagatgttctttcaagcggcttttatcaatcgtgcgtaactgctcaaagagaatgattgaatttgcaggaagcccctcaatttgccccaaatacaagtgtgtaggtaatttcttctttttgcgtacgcggcttgttatggcggcaataatgaccgtaggactgtgcttgtttcctatatcattggagataacaagtacaggtcgtgtcccaccttgctccgagccgacaacagggtttaagtctgcgtagtatatgtcaccacgcttaattgttttatccattagtttgacctcctatctggatataagcaggtaagctctgcctatgtaatcagccaaacacaaggaagtttttaaggtcgggagagcataaacaattctctgtttccatagaccgccttgtatctggctttatgatagaagcatctctatttgtcctcgacaccccaagatgccaatgcgtttcacgcagggaagtcgccaaacggtcagcagcgaactgacgccacgggagttccaccccaactgacggtctgccagagccgccctcattgcctgcgacggttttatcacgctcggactgtgactggacgggagtatcattatcctctttgcggattacggcgaaatcgggagctgtccgatattttgagtaggtagttatcgctctcagccttgcggcaggtcgtggcgtacctctcgacacgcttatgctcatcacaatcacaaagagaaagtatttggcgaatgattattcgattgacaaggaacaatcctgttttcgccacacaaaggaaaacagggtgtgaggattttgtcctctcaccctgtagcccgtggggaactgcgtttttcccctctattcaaaaaatttttttaatttttctttgagcctgtccattcgcctgtaaacagctttctcggtgatgttgagagagtgggctatttcacgggtggaatagtcttgtatcttcagcaaggcgatttgtagagtctgcttgtccaccttaattaaaacctgatagagctgctgattttcgatactgtccagaaagtcctcaaccgtctttatttcgggctgctgcgtgtcatcggcaactccctcaaggtatgtacccgcttcctgcatacgctgatagtaccgcctgtctgaattgaaaatctcccaatcgtgagtacggagcatttcgatggtgctttcatcaacgccgagcttccttaactgtttttcttcggcttctttccaaagccgccatttcttttcttctttggctttattgtaagccataccgttttacctccaatctgaatttttgaaaaattcagattgaaaggcggcgaacggcaaccaacgccagatataggcttgtcttttgttgcgacaaataacgacaaaagaaaaaccgcaaaggtagtcagacctttgcggttataggcaatataaactctattatgtagatatatgacttctatattaggggcataatagtgccacgagcaactgagaatttttttaacagattatcctcagacacttgtagcactatgtaatatagttgctgcttctaataagcagcaaggctgtcacagcagaccagcacataaaaatccctccaaactcaaaacgggtttagagggcgttgataattctgtgcgggcgtgacagagcagcccaccaaagcaccgttttttttatttggtgggcttatgcagatataagagaaaaaagagccgatgactgtgattactcacaagttcatcggctctgcgtctttgcgtctggctctttgatgactgttatatgtaaatcttttgcgttgattagagtttcctttttacatttcggacaataaagaggataatttatcaagatggtatcctctctgcatttattacgggttttattgccgcatatcgggcataatatccattcctctgacattacaaatcaacctccctctatgagaaatcatttcacaattttttcaagaacagggaaaaggtgctgccgttttcatcggacgccaccttgatgtacccattctgcttatttacaatatcacgggtaagatatagaccaatgcctacgccgtcaactcctgttgactgctttccacgataaaatctgccgaagatttttgcctgttcttcttcaggaattccaattccgttatcggatatatccagccgcagataggatgggtattctgtgattttcaagtccacaattccgccgtttggtgtgtattttacggcattatcaagaacattcgtgattgcctccgccgtccagttaaaatcgagcagggcttcaaaggtctgttcgcagtcaaaggtaatggtgatgtttttccccctcgccttggaatacaccgtttttaccgcttgcagaacaatatcattcagactgtttttttcgggtttcagacggataataccgctttccagacgggacattttaatcaagctgtttgtcaaaaaggtcagcttttcaagggacatttgcagggtggaaatatattcgtttcgttcttcgtcagataaccctgtatcaccgagtagctgggcaaaggtatttgccgccgctacaggcgttttaatttggtgtgaaatatcggaaatcaaagtcttgatatgttccttttcctgcgccagcatttgattttgagctgtcaaaatattgcggagtttcaaaagttggtgttgcaagcgtgcagtcaaagtgtcctcggcttctgaaaagacagttctttcctgttgttccaccaaagcctcaatgagtagcgtaatatcttctaacagagtatcattatagcggttgtgcagaaagtccagcagaaacaacaatccgcataaaaacacaaaagcagcaacgataaaaagcatacggaaaaggatgtcctccataaaaaagaacacaccgatagataccgccgctgcggcagtacctacaatcaaaattagttttctgtaaattccaaaatgcttcatcgtcattctccaaaagtgtagcccataccaaaaacggtcacaatgtattcctgcttttcatcgttcatcttctgccgtaaccgctttatattcacacgcaccgtattatcgtcaacgaagttcccgtctatatcccatagttgttccaaaagcattgcctttgtaacaaccctgcccctgttctccattagataaaggagcagtttgtattccgttgaagtcaggtgcgtttcctgtcccttcatcagaacaaggcatttatcggtatcaacctctaaatccttgtatttgatacgatttttttcgccgagtgtccgttttaagattgccaataccttttttcgtaaaacctcaatgggaaaaggttttgaaatataatcatcacagcccgccgaaaatccccctaacatatcttcctcagtgtcgttggcagttaaaaataatacaggtgtttcagcggtttcacggatttttttgcaaaactccagaccactgccgtcgggcaggttaatatcgagcaggaacaaatcatacttttgcttttggtattgctgtaatgcttcgagatagccatagaccgctgtaatcgtatgctcgtccttttttaaggcgatagaaatgcccttgctcagaattttgtcatcttcaagaagaaaaatattcgccataatcttaaaacgcaccacctttctgctatattttagaattgcaggaacagacgcagcgttgctgcgtccgtcccgcaaatacaattagttatcaaaattgtgcagtcgttcaatgaccgtttcatcagaagtcgccttgtaaacaatagcgggaacgctcaaacaaatcacaaagattgctgcaatcaaaccaataacaagcgcaacagggtactcaaacaccgcatagtttgctatgtggggaacggcgtccgccaccagcagcagaaacgcattgccgaaagtcataatcagcaaagtggatatgagagcgtaaatgccaccttccaaggtcagtatcttcataatctgctttttcgttgtgccgatgctttccataatggcgaattcattttttctcgccaccacacctgtcaacataacattgacaaagttaatcaatccgataacaatcagcagaattgcagcaccgtttcctaacagattgacagaatagaacatctgattaaattgttctttttgattaatagcagatttcatctgccactccgattcggtcaaggtactgttgattgcctgtaattcgctgtcaattcgctctaagtcgttgaaatccttaatatccacgccgatagctgaaataatcggctcttttgtcaagcgttccatacccgcttcgctgacaaagatgatgttcggcacaatttgaatgtacgtgcgcctgccaatactatcggaaagattattcgagtaatcgtcatagtaaaaagctccatcgattttgaaatcggttgccttgccgtctgtactgtcggcagtcagcgtcagcgtttcacccactaaagcggtattaggagcattatattcggtatcttttcctgcaatcgctgtttcgccacgcttaaatgcttcaatgtcaatgggcgtatcagggtgctttgcgttgtattcttccaatgctttgtcatcgtcaagcgttgtgatatagcagccgtactcaccgtcatcggcatatccctttagtgcctctatcatctgttcataggactgccctttggatttatagcggctgtcctcatattggattttcataaagccttccaaagcattttcatcaaagtcaattcctgcccaaacggttttttgaacatctacattttcaatgccattgacttgctgaatttgttccacaaaatgttcgtcaaactgcggtacttctttattgggttgttcgggctgttcaaactgaatatcgttgtattcaaagtgatagtccatatattctttaataaagttttcggcattcatacttccgatgactccgttcacgcctaaaatcattgtgatgcccataaagagagacataaacacaaggatagcacgctttttgtcacgaaatacattgtggaacgccattatgtgcagcttaccgccgttggtggaatttctgcttttcgtttttttaggtgcgaagttttggaatttcagtgcttccacaggggaaattttcgccgccgcttttgccggtgcgttgcaggcaatccaaaccgttatcgccgaaaaaatgactgacagaatatagatggacgggtggaaaaacatttcggcgtccattatcgacttgccctgttcaaagccctcgttcaaaacaaatggaacaattccaaaagaaacagcagtggctaacacaatgccaatcgggataccgatacaggcaaattttaatgcttggttttttaccaatgatttaatttgcacctgtgttgtacccagcgttttcatcaagccgtaaaagcgggtgtcctttgaaatagagatatacaggacattgtaaataaggagatagccgctgccgatgataaagaataccaaaaggactaccattgcgataactgaaccgcttgatgatttcatcgaaaccgcaccgctgaaagactggttttcgtttaattccacatctttttgaatacggtgaaaatcatcgggcattttattcagcgacaaagagagaacgccgtcctgtgccattgtatagcctgcgtttttacaatacgcctcggaaacaaaccccattcccgtacctgtataggaatgaaaccagccgcttaatgtgaaagttttttcctgctgaccatttttatcatagtaggacagaggaatttccatattcagcttcgggtctgtaataccgagttgtgaaagggcgtcctccgacagcataatttcattttcgcttgcggggtatttgccctctaaatccttaattgcttcctgatagtgtttttcccattcggtggtgtcataatactggatcgcaatagaaagctcacgcccctcgtcgttcttctcggcaaccgagccgaccatatattgtgtaccgacggttttaacatattccaaatccttaatctgctgttcctgctccgccgttggcatagcaagggaaacatcggcggtcgtacccgcagtacgcacctgcattaacttcatattttccatatagttaatgcccaaactgaacacggtagtaatcataaaggtagtaaggacgattgcaaataccgcaaacaggttacgggtgcggtttgctttcatcattcctttttcgactcgcttaactgcgcttttatttcgattagcgtgcatatctaacacctcccgaaacaaccttgccgtcctcaatgcggattgtgcggtctgccatctgagcgatttcctcattgtgagtaatcataatggtggtctgatggaattgtctgctgatggactgcatcagcaggataacatccatactcgttttggagtccagattgccagtcggctcgtcggcaaggataatggcaggctttgttgcaagcgcacgggcaatcgcaaccctttgctgctgaccgccagagagattgttcggcatatttttaagttttctctccaagccgagagtttggataatctcttttacaaaacctgtatcggtctttccaccgtcaatctcaataggatacacgatgttctcatacacattgagtacggggagcagattgtagttctgaaatacaaagccgatatttctgcggcggaaaattgtcaattcctcgtccttcattttcaaaagttcttttcctcggatagtaacactaccagaagtagggcggtctaatccaccaatcatatttaagagagtggatttaccgctgcccgatgtaccgattacagcaacaaattcgccttcttctacggagatagataccccgtccaaagcacggacttcgttttctccgctaccatatatctttcgtaagtcctttgtttcaagtattgccatattgaaaacctccaaatttctgtttttattttgtaagctcagtatagcaaccacttcttacaatctcattacaatccacaggaaaattaaaacagtgtacgcttgcaagcaaatatgctgcaagcaggcggtattaccactttataaatatttctctatcctgtattgctcaatgacttcatttcctaaaagcgtaattgctttttgggggcaactgctgatacatcggtaacacattgtgcatttgctgtgcgggacagcctttccgcctttaacagagatatttttcatcgggcaaatagaagcacataaaccgcagccgttgcacgaggtactgactttaatctcagtagagtaatctgccgtttttccagaaaaccaaagcctttgaccgaaaagccctatgatatacgaaaaaactgttatgccgtttttcgggtattttccatttcgtatatgtaaagcagtttcttcaatttttctattagcggcggcaattatccgcctgttttcatcagaggatttctttagtagcttactgtcacatacagagtcgggcattttaatgtgaagccctccgaggatattcgccccatacttttttaataatcttgcggtgcagccagctccatcaccgctaaatgcgcccattgttgcgacgcataatatgtttttaccctgccagagagcagagttctttgaaataaattctctaaccatatatggtgcattagagaattgagtaggataccctaaaacaatagtatcattgcattggattgcatcaattacatcttcgcagcactctaaaggtatggctcttgcgctttggtcgattagagaagtcaataattcaatacaatactttgtgttgcctgttccgcttaaatatatacttaccataatattttctaaacctcaaaagatagggtagaaattaaatcctccaacttacttttccaatccataccatagtgaacatttttcattgtggctaatgaagctaatccgtgtatataggcaaagagagcgacaatgcaatcttgctttttatcatctggcatatcggagctttcaagaagttttaatatctgctctttgtatattacaaagggtttatagttctctgacgagctgctatcaatgtccaagttaatttcaatgttgccttcttgaaagaggaatgtaaaatactgcggcttttcgataaaaaaggagatgtacgcttttccaaattccattaaaaagtctgtgcttcctttatgatgttcaatggtttcaagcaatttatctgtaaactgctctgtaatgtgaagctgcattgccgcaaccaaatcctctttgtttgcaaaatggctgtatggggcggcgtggctgacattacaggattgagctactttccttaaagagagctgagataaaccataattacttacaagctcaattcctttttcaatcagttcattctttaagttattgtgatgatagctttttttatccatttttcatcctccaatcttgacagcgtaaacattatactacacaatctttacggtgtcaagatagagggttgtctttcaataccgtatcttctttaagttaatgctgtttgagttcctgttataagaagtgaaatatcttataacaggcattttcacatcgtttaataagaagccacatatccatacaatataagggaaagatatattgtagcaaggtggtgagcttatggacgagagaaacaacgattttgatttcgattttatgccgataggacaggcgattaagaaagcccgtgaagcaagaggaatgacgagagagcagctttctggaataatcggctacgctcccagacacattcaagccattgaaaatgaaggaaaatatccaagcatcgagctgtttatccaacttattcaaatgtttgatgtctcggttgatgagtatatatttcctaataaagaagtcaaaaagagttccgtccgcagacgcttagacgcacagctcgacaatttagatgataaagaactgtccgtgattgaagcaactgtaaacggactatgtaaagcaaaagagccagaggaataaaatcctctggttttcttttgcccatttttaataagcagggataccatagccgtagataacgctgctaccgatagaatagctgttctgtcggcaagcatcgcctgagttaccttcaacggtatagaccgttccgttttccacacgctctacaatacccacatggtctgtaagaccgtcaccttcccaatcgaagaagataatgtgtcctgcttctggcgtaaagctgccgtcctgccattgtcctctttccttaaaccactcagagccttgtatgcagcctgcaaacttcgggataatcccgttctcgatatagccgcattcgttcgcacaccacgaaacaaagcaagcgcaccattccacacgagagttgaagccataccacgaccaatagggttgaccgcctgtattgccgacctgcgacagagccacggtcacgatttcgccgtcgcctacggatatgccgtaaagcacttgcgaccatagcgaattgttttcatcggcaagtaattcggacaacatctgccgctgctcgtcatcaaaaccgtattggtctgccatttcctcggcggttttgtggctgactgtgatatacaggtaagtccgtgtttgggtggtttcggtctggacgatatttccgtgaccatcatctgtttcggttatcacggtttcggtcttgctttccgttctggagctgattttattcatttcccagaagatgtccgtcaggagctgctttttgttatcgtccattgtcgccacttcctgcgggttgtctgggtcggtggtagtcttgaccgagtaaaccgcaagcacctctttccagacggcacggcttcccgacatctccagaacatcataggcattctcgtttttgatttcatcaaggcggctgtcatattcggtattgatttcttgtaccacggtctgcatcgtcattccgttgcctgagtcctcacccgaaaagaaaatgccaaacaccgagcctacgagcataccaataaggcagataaccaaaatcacaacaaccgcaatccaaccacctgccgcaatcgccgcaatcaacgcttttgttcctgcgataatcgctttaactgccgcagcagttgctttgaccgcagcctttacagcagcaatcgcagccctcgccgtaactctggctgcctgtgcagctctctgagccgcttttacggaagcctttgccgccgcctgtgtcgctttagcggtatgctcggcggtttttattgccgcctttgaggtcgcctgtgcagtttttacggatttctgcgtagtctttaccgtacctctggctgctgtttttaccgtctttttcccgcttcgggcagtctgcgttatggtttttttcgcctgatttgcgcctttgaccgccttatctgtggaatggcttacggtactgcggtaggtctgcataccgtttccagacatacgctgttcggcggctttggcggctcgcttctgcttgaaatcggatagcttatcttttgccttaaccacattgtcctttgtggttttgaccgctttttgaccttgcttattgaactgatgaacaccctcgtccgtgatacgctccgaagctgctgaaaccttatcggcggcatattcggtggcggagttttcatcagcgtaacagccttgctccgccttgtcttttattttggaataagcggacttcatacgctcggaagccaccgcagccttgtcaatggtcttaatcgttcccttgactgcatctctggtctttatatcagccatagataacctcctttccaagaatacagagtattctttaagattttgcagtcaaaatcaagctgccttttttgcgaccaccacaagcctgccgttctgcgccgagtattcgcaggtagagagcgtaataagcctgtcgccgtattctgcgtttacgcctgtttcatacaatgcaagctccttgcatttttgaatataagcgttgtaatcgtcctcgttttccgcattgacaaaatcatagtagcggaagccctgagaactgtacgccacagtcttaaagacagcgataatttcatattcgccacgctccgtaagggtatcaaactgaatggtcttgtgttcttcataaaagctctgggatttataatcctccaaaaccccgaacatcttgccgcccttaatgtgatgaccgtaaatgacaaggttatcgctgcccgcaaggtcgcagttttcctgaatatacggtgtccccaagttgctgtattccttttcaaagttacgcttcagatagtagttcggctcattcggcgtctgcatcacgggataattgaggggcgtgctggcaatagaaagccagccgaccatatccgtgtttttcaaaaaaagctcgccgtactccgtaaggacattttcttcctccgtcaaggggacttctggggcatcattatcctctgtctgcgccagctccacgattgcggcaatattttcaaaggcttcggtctgttcggcttcgtgggcataatggtcgtaaatgtgatagccgcaaaaagccgccgcacctaacaggcatacggcggcagtaaggcagatgatttttttataatctttcataggctttctgtcctttcttattttgaaatttccgtctgattttggaatgataaaagctgtctgcataaaaataacgcccacatttctgtgagcgttatccttgtaatatgattgagtttagatacaaaatgcggcgtaaagaggaacaatctttttattatcctcaaagccaaagttctttgcagatagtttgatggcataggcaggcttgtaggtttccatatagacctttaagctctttgcccgtgtgttgtcggcggacttgacctcaatgggaataagctcaccgtcacgctgaatgacaaaatcaatctcagctccacgctcggactcccaatagtaggtcttatagccgttaatggcaagctgcacattcacataattttcagccataccgcccttaaagtcgttcagctcctcgaccatatagaggacatcgtttgccgctaagtctttctttgcacagagcagtcctaagtcggaaacataaatcttgaacgcatcaatgtcacggtagttctcaagaggcttttttatctgctcaaccttgtaaacctgcgacacgatacccgacaggcaaagccattcgatagcgttttcaaactcggaagctctgccgcctttttttatcagcttatattggaaacgggtgtttttcttggaaagctgcacggtgatgttgtcataagcaagccttgttttcttgatttcatttagattgttgtacttgctcatatcattgagatagcttgccagtatggtatcctgcgtatggcgcacaaggatatagtcctttgtttccacaaactgcattacgcattcgggcataccgccgacgataagatattgacggtaaagctgcattgccgcatcgtgcaaagcagagggcaaaggtgtatcctctgcaaagcatttcttaatttgctccacaagggcgctttcgccgcaggctaccataaattcctccatatccataggatagagagttttcatatccaccttgccgacaggaaaggaaaactttgccctgttcaccgcaacgcccaaaagacttcccgctacaataatatgataatcgggagcgtcctcgcaaaagtatttcagagaggtcaacgctctctcgcagagttgcacctcatcaaagacaatcagcgtcttttcccgcacaatagtctgccctgcgatatgggataaaatcggtatcagataatcggggctgatattttcctcaaaggtttcattcaactttggattggtttcaaaattaaaatacgccacattttcatagtgtgtgcgcccgaactccagaatggaataggttttgccgacctgccttgctccctgtaaaataagaggtttacggtgttcgctgtctttccacgcttctaaaaagctcataatttttcgatacataatcagacctccttcaaggtgctaaccatagtatatcacatattcatgtaaatatcaatgagtttcacttagaaaatcacattaaaatacacgaattatttttgagattgcattggatttcgacacgaacaccgtattttttctttaagtttctccgaatttggttgtcatcagcctgtaaagctcagtaccccgtgggaacttgttgacaaacggcacaagggagctgccgacttttaatagtccctgacctgcaccgacattcgtgatataactcatctgaaggtcggagatgttaagaagcctcccaagctcaatcctatcggttgaactttgatttaacataatgataaattcactattggcaagcatcgtcctcgccgtatggctctgcaaaaggtcgtccacattctgggtaatacctgtgcagtacgccccgtatttccgtacacgcttccagagcgtaaagaggaagtttgcggagtattcgtgctgaaagagcagataaatctcatcaatgaagatgaatgtgtttctgcctttcgccctgttctgggtgatacggtttaagatgctgtcaagaacgacaagcataccgatgggctgtaactgcttgcctaaatccaaaatgtcgtaacagataaggcggctgtgcgtatccacattggtatgctttgcaaaggtattcagagagccgtctgtaaacagctcgattgcaagggcgatttctttcgcttctggctcttcctgctttagcagttcctcacggaagtcctgcaaggtaggcggtacgccctgataattgccctgctgatagtgacggtacacgcttgccgtacaacggtcaataatcgacttttgttttgcgccaagacttgcaccgccgatgagctgctcgcacaaagacaaaataaactccgatttcaaaatgacggggtttgcgccgtcaccgtaatcggagttcatatccatagcattgatatggttttcgcttgttgccgagatgtgaatgacctcgccctgcatcgcctttacaagcggagaatattcccgttctgggtcgatgataatgacatcggcgtttgggtcggtgagaataatatttaccatttcttctttcgccgtaaaggattttcctgcgccagatacgcctaagataaacgagttgccgttgagcagatggcggcggtttgcgataatcatatttttgctgatggagttctgcccgtaatatacgccgttttcgtgatggatttcctgtactctgaaagggataaataccgcaaggctttctgttgtaagggtacgcatcgcatctatcctgcgaacaccaaacggcagggcggtattcagcccgtccatctgctgatatttcagcaccgcaaactgacacaggtgctttctggctgttgtaaggagcgcttccgtatcgttgtcaagctgctcctttgtttcagccgtatgcaccattgtcaaaaccgcaaacatcattctttggtcacgggttgttaaatcgtctaagaactccttgctttcctttcgctgctgttcaaggtcatagggaatgaccgctgaaaaattgttgttctgattttgcttgcgctgccaattcgtgatattggtttctacacccaaaagacgattttccacctcacgcacggcttcgtctgtgggtacggggataatgtcaacggacatcatcatattgcggttaagctcgcaaagctccgccaccatactatccttaatatatgccgcatactcacgcagaaaaatgacacgcccatatctgtcgcccatacgaaaataatctttttcaaactcaaaggtatcgggacagatatagtccttaaagtcgtgaccctttcgcatactcaaaagcatatcaaaggcaaagcccgtttcctcgcctgtgcggtagaaatcgtggaaaatgcggagtttttcttccgcttcaagctctacacattttgagccaagtctgccgaaatgggaaatcaggtctgcgcctacacgggcaaaataattcctcgcttcctcgatattctttttgcagacggaaaccgtcacatacttgtcctgtacgatagaattagctcccgtcgctttatcaagcagcattttgttgtattccttacggtacttatccagtccgtcctccgccataggaattaaaatggtctgctcaaaatcgaccttgttgagcctgcggttattgactgtgatttttgtggttgcgccgctatcaagagaattgagaagctccgagtattcgagaaacatcgcttctttatcctcacggcttgccaccgagtagtttatatcctcaaacttaaaggtctttgcgtatttgttgctgccgacaaggaaaatgccgtcctcccagatagtcttaatcgggataattgcctgcaccgatttgggaacgacaaacttttccttatcctgcttaaacagagttttaagagttttcagcattctttacctccttgctgcgtttcgcttttcttgattttttcgccacagggcaaacgcctttttcgtggttttggattgtggttttcagcgtttcataatagagattatcggggttaaacatcagctttttcggcatcaaaaactccgatttaatccacgcccatacaaattgctctgcggtcataccgttgtacctgacaaagcccattaccgcaaatggagcagcgccgagaatacacacccaactgagtgtttctattccgaaatacggacggagaataaagtacagccccaccgctacgccgcaggcaagcaaagaaaaaatgaactgtctgagcgacagtccaaagaacatactctccgtgtagttacggatttccttatttattttgacttccaatcttatgcacctccttatcgttccatagtgttctttcttttgggcggtttcttctgggacgggtatgggataaattcttcctcgcccgcaataatgctgaattccgctttcagaaacggatgcgtttccttttcctgatactgacggataagttcaacagcactttcctttgtagcggtgcttccttgctgtactccgtccttaaaaacataaaaccgtttcattgcttcctccttataagcccatcatttctcttacaacacggtctgccattttgaccgcaccgacgaggacgagcatattaaataccagctcgccgatatagctccaaaccatagatacaggcgcagcgttcgggtcaaccgcagggggagaagccgcaaaaagagagaagatgatacaggcaagtacaatgatgggtatcaacgaatctgttattgaggctgctgaaatcgacggtgcaagcagctcacagatattctggaagataactcttcctcttatcagacctatactcgtatacgttatgatcacttcgctgatcggcggtcttcagatgttcgatgtaccgcagatccttaccggcggtcagggaggcccgaataacactaccaagacgcttatcatgtatctgaacgaacagatcggtacatctaagaactatggtatggcaggtgcgctttcagtaattatattcattgtatgtgcggcactcagcctggttgtttactacttctttgctgctgacagaagcaacaagaagtctaaaaaaggaggtaagtaagtatcatggcaaaaaaggaaaaggtacttgaacatacctcagcacttcagcagaacagaacagatccggatatgaaggtaaagcctacgcttattattcacagaataatctgttatatcgttcttatcttcttctcaatcctgtgtttgttcttcttctacatcctgcttgttaacgcaagccgttcacattacgatattatgtccggcttctcgttcctgccgggaaatcaatttatcaataacttccagagtgcgatctcaaacacaacgatacctgttataaacggtgttatcaacagcttgattatcgcaacgtgtacagcagtattatcaatttatttctcggcaatgacagcgtattcaattcatgtatatgacttcaaaggtaagaaatttatctttaacttcatattacttatcatgacgattcctacacaggtttctgcgctcggtttcttcagtatgtgtaccgactggggactcagagatacatatattcctcttatagttcctgctattgcggctcctgcagtgttcttcttcatgattcagtacatgaagagctcgcttcctattgatattatcgaggcagcaagaattgacggttcgggcgaattcagaacattcaacacgattgttcttcctatgctgaagcctgctcttgcagtacaggcaatattcagcttcgttgcatcatggaacaactacttccttccttcgttgatcattgatacatcaacaaagaagacaatgcctatcatgatcgcacagcttcgttcagcagacttcttaaagtttgatatgggtcaggtttatatgttcattttcatagcaatcatacctgttatcatcgtttatttctgcttatcgaaattcatcatcgccggtgtttcactcggtggtgtaaaggaataagacaattttgggttaatatattttatacagaaacggcatcggaaattttccggtgccgttttgccgtatataatgccgtaacatcagtgcggtatttgccttgtggtatacaagctaagagtgtatgaagcataagaaaatcccctgttaatcgcttaacaggggatcggagtttattcggttatgggattagccaagtcttgcttcgagatcagcgagttcctgctttaaaccgtcggggagcttgtcaccgaactgcttgtagaattccttcatctcttctacttccttcttccagaggtctctgtcaactgcgagcagcttgtcttcaacttctgatgtaacctcatcctcgatacccttgaggttgatgtcacccttcttaggaaggtagccgataggagtcttttcagcgtcgattgtgccttcacatctcttgatgatccagtcgagaactctcatgttgtcgccgaaaccgggccacataaagttgccgttctcatcctgcttgaaccagttaacgttgaatatcttaggagccttgtcaccgagcttcttgcccatatcaagccagtgtgcccagtaatcagccatatggtagccgcagaagggcttcatagccataggatcgtgacggagtacgcctactgcacctgtagcagctgctgttgtttcagaagaaactgcagagcctacatatgtgccgtgctgccagctgaatgactggtaaaccagaggagttgtagctgcacgtctgccgccgaagatgatagctgagatcggaacaccctgggggttgttgaactcaggtgaaatgcaggggcagttctgagcgggagctgtgaaacgtgagttaggatgagcgagcttgttgcctgctgctgtgtattccttaccgttaaccttgttgcccttccagtctgttgcattctcgggaggattcttgtcaagaccttcccaccaagctgtcatatcatcattgttgatagcaacgtttgtgaagattgtattctttcttgtagatgcaagtgcgttgtagttgctctttgcgtttgtaccgggagcaacgccgaagaagccgttctcggggttgatagcgtaaagtctgccatcgggaccctgcttcatccaagcaatatcgtcacctactgtgaatacttcatagcctgccttcttgtatccctcgggaggaataagcatagcgaggtttgttttaccgcaagctgaggggaatgctgctgtgatatacttgatgtcgccatcgggcttcttaacgccgaggataagcatatgttcagccatccagccttccttccaaccctggtaagaagcgatacggagtgcgaagcacttcttgccgagcagtacgttaccgccgtaagctgagttgatagaccagatcgtgttgtcttcagggaactgaacgatgtatctcttttcgggatcaacgtcagcctttgagtgaaggcatcttacgaagtcgttggagtcatcgggcaggttcttgaatgcctgtgcacccattcttgtcataatgtccatgttgagtacaacatagatagagtctgtcagctcaacaccaaccttagcgataggtgagccgataggtcccattgagtaggggataacgtacattgtacgacccttcataacgccgtcatagagctttgtcagcttagcgtacatttccttaggatccatccagttgtttgtaggacctgcattctccttctctcttgagcagatgaatgttctgtcttctacacgggcaacgtcgttttcagctgttctgtgatataagcagccggggagcttttcctggttgagctcaatcatctcgcctgttgcgatagcctcgtcacgaagcgccttgagctgctcctcgctgccatcgatccatacaaccttgtcgggctgtgtgagggctttcatttcttcaacccactttaaaacattctgattctttgtcataaccgattgttctccttttctttattttatcagcttgtgctgatgaaagtcattcggtagggaattaccgatacggttcatcgtaccttgttccccttttactattataaactattttttgcaataggtcaatagcgaaattgcaaaaacagcaaaaaaattgcacaaagtaagcgttatataaccgtctttattttacagcatctaaaactcccgaatccggctgtataaaacaaagtaagtatagtcaacgcacactttgtgctttttattttactattttaatatctactgattttaaaggaattaaatgtcagctttaacttccttgcgaagcagtattatcgcaagaaggttcggtattgccataaggccgttgaaaagatcggatacgtcccatacgactgtcgcctgaatcactgctcccacgaaagcggtaacaatgaaaattgcaagatatacgcctacccacttctttgtgaaaaggtaaacgaaacagcttctgccgtatatccaccagcctgtaacggttgttatcgcaaagatgaatgttgcgatgctgaggaatgcaccggcaaagtcaccgagtccgtcctggaatgctatcagcgccatatcaaaaccaacgcttgatttctgatctgcaccgcttgaaagaatgcagagtgctgtcatagtgcagataatgatagtatcaatgaaaaccgaaagcattgcccacataccttgcgtatggtgcttgtcggcgcttgagtttgcattaatcattactgaggagccaagaccggcttcgtttgagaatacgccacgttttacgccccacttcatagcctcgagcattacaacaccgacagttcctccgcctacagccttgaatgaaaaagcttctgtgaaaatgcgtgcgaatacagaaggaacattttcaatgttcattataattacagcaaaacagccgagcagataaccgcctgcggctatcggaattacccatgatgtgactttactaaggcggtggatacctccgggtgctattgcggcaattactgcggcacaaaggattcccgatacccatagaggtactccaagacagttctgaagtgccattgaagccgaattcacctgagccatattacctatgccgaagctggcacctatacagcagacagcgaacattcccgcaaagaacgcaccgagctttttgccgccgaatgctttttttatgtaagcaaaaggtacgccgcccgtaagaccgtccgattgcacggttctgtattttgcaccgagatagttttcggcaaaactggtagccataccgagaagtgcggagatccacatccagaatattgcacctgcaccgccaaaagcaatagcgcttcctattgcgataatatttcctgttcctactgttgcaccgagtgcggcggtaagggttctgaaaggcgaaaccttctttccgtcagcctcaggctgttttgtaaggagtgtacgctttattatagtagggaagtgcagtacctgcaagcatctggttcttattgtgaagataatccctgagcctgcgaacagtataagcaccggtatgccccatactatattttcgtttatccactctaatatttccatactgacttgttccttttcatcaagcacagacgtgggtgcctgtacgttttatatattgattgtattcccgaatgtcgccgattatgacggggaaacttcacatcacgatatgatttcggcatttcaggggaatttccgattaaaaatagtatataaaaaaagtaaaatctgataaaattttgaatagttactgcttgttaataattaaaagcaaaagtatacaagtcgaaaaataacccctccggttttcccggaggggcgtaaaaacctattctattccgactattcaaaatttttgggcttttagattatttcgtgcggattattcgccgcagtattccttcttgtagtattcaacaaggcctacgagatcctcgtaacgcttcttggagttagcaacagccttatcgaacagtacgttagctctttcggggttagcacgcataagagagttgtaacgaacttctctcatcatgaattccttgtaatcgcctgtaggagccttgctgtcgagagtgaacggatttgttcctgcaggagcagcggggttgaatctgaacagatgccagtaacctgcctgtacagcttccttttctaccttctgagcgattgtaaggccgcccttgataccgtggttgatacaaggagcataagcgataaccagtgaaggaccgtcatatgcttcagcttctgcgattgcctttaagcactggttcatatctgcacccattgaaacctgagcaacatatacataaccgtacttcatagcgataccggagagatccttcttcttaacgtccttaccggctgctgcgaactgtgcaactgcaccgatgtttgtagcctttgaagcctgtccgcctgtgttggagtaaacttctgtatcgaatacgaatacatttacattcttgcctgatgcgagaacatggtcaacaccgccgtaaccgatgtcgtatgcccagccgtcgccgccgaatatccagttggacttcttagcgaggtagttcttagccttgagaactgcattcttttcagcgcagtcgcaatcaagagcttcaagagcagcaacgagatcctttgtagcagcagcgtttgccttaccgtcgttagctgtttcgaagtatgtgtcgatcttagccttaacgtcagcgttttcagtcttttcagcaattgcctttaactgaccctgtgctctgtgtcttaatgtatcctgagcgatgaacataccgagaccgtactcagcattatcctcgaacagtgagttgccccaagcgggacccttgccttccttatttactgtataaggagttgagggagcagagccaccccagattgatgaacagcctgtagcgttggcaatgtacattctgtcgccgaagagctgtgtgatgagcttagcgtaaggagtttcaccacagcctgcgcaagcgcctgagaattcgagcagaggctgcttgaactgtgaacccttaactgttgtttccttgaacttctcgtgaacctcgggcttgtcggctacttccttaacagcgtagtcgaacatgggctgttcgttcatctgagaatcaagtgacttcataacgagtgccttgttcttagaggggcaaacctgtgcgcaaacgccgcagcctgtgcagtcgagaacagaagttaccatagcgaacttcatgccgggaagacccatagcgtccttcatctttgcacctgcaggagccttcgcagcttcttcttcggaaagaattacgggacggataactgcgtgaggacaaacgaatgaacactggttacattcgatacagttctcgggaatccactcgggaacgtctactgcgataccacgcttctcataagctgcagagccctgggggaatgtaccgtcagccatgcctacgaatgtagatacggggagcttgtcgcctctctgagcgttaacggggataaggatattgttaacgaaatcaacgagatcctttctgtcacctgtagctgtgtgaacgggaagtgtaccctcagcgtcagcccaagatgcaggaacgtcaaccttgataacctcgcctgcacccttttcgattgcggcgtagttcattttaacaatgtcgtcacccttcttagcgaatgacttgtaagcagccttcttcatatattcgatagcatcttcagcagggatgatgttagcgattgagaagaatgcagactgtaatacagtatttgtcttgttgccaagaccgatatccttagctaccttgatagcgttgatgatgtagaagttgatgttgttcttagcgatgtatgccttaacgggagcggggagcttctcgtcaagctcgtcaactgtccactggcagttgagcaggaatgaaccgccgggtacaacgtcctcaaccatatcgtacttgtcgatgtatgaggggttgtggcaagctacgaagttagccttgtttacaaagtaagttgacttgataggcgacttaccgaaacgaaggtgagaaatcgtaacaccgcctgacttctttgagtcgtatgcgaagtatgcctgagcatacatatctgtgtggtcaccgatgatcttgatagagttcttgttagcaccgacagtaccgtctgaaccaagaccccagaacttacagcaggttgtgccttcgggagttgtgttggggttctcaccgatgggcagtgaaagacctgtaacgtcatcctcgatgccgattgtgaacctgggcttttctgtgttgttgtatactgcaatgatctgagcagggttagtatccttagaaccaagaccgtaacgacctgtgaatacgggcacatcctggaacttgcctgcctgcttgagagctgcaacaacgtcgaggtataagggttcgccgagtgcgccgggttcctttgttctgtcaagaactgtaatcttcttaacagtttcgggaatagcagatacgaaagcgtcaacgctgaagggtctgtaaagtctaaccttaacaagaccaaccttcttgccctgagctaacatatagtcgattgtttcttcgatagtatcgcaaacagagcccatagcaatgattacctgctcagcatcgggagcaccgtagtagttgaacagcttgtaatctgtaccgatctcagcgtttaccttgtccatgtacttctgtacgatagcgggtgtagcttcatagtacttgttgcttgcttctcttgcctggaagaagatgtcggggttctgagctgtgccgtgcagaacgggcttctcaggattgagagctctgtttctgaaagcgtctacagcttcgtggtcgagcatcttgtcgagcgtttcatagtcccatacttcaatcttctggatttcgtgtgatgttctgaaaccgtcgaagaagtgaaggaaaggaactcttgcctcgtatgttgaaaggtgagctacagcaccgagatccataacctcctgagggttagtggagcagagcatagcatagcctgtctgacggcaagcgtagatatcgctgtgatcaccgaaaatagaaagtgcgtgtgttgcaagagcacgagcggaaacatgaataacgctgggcagtaattcacctgcaattttatacatattggggatcatgagcagtaagccctgtgatgctgtgtaagttgtagtacatgcacctgctgcgagagagccgtgaactgcgcctgctgcgccggcttctgactgcatttctactacctttacttcctgtccgaaaatgttctttcttccggctgttgaccaggaatctgttacttcagccattactgaagatggtgtaatggggtaaatcgctgcaacgtcagtaaacgcataagacacgtgacctgcggcgttgttaccgtccatagtaagtttttgtcttcccatgggaatcgtcctcctttgtttttgcatacggtcataccaagacgtatgctttcaacttagtattatatcataatcgttccggaatgtaaacctctaaaagtgaaaattttcagaattttttagtttcctgtacaattttttgagtcagcttaagctaacccgatataactgcctttgaaaaaatgttttccgccggcaacgaaaaatatgctatgtataagatgtggcaggcgtatttccgctatctgtgcggagaaggcggctgtgccgctgtgagcggatatctgctgtttcgataatctttgtgaaaagtaagaaaaaatttcccgctcctccttgaaataatcgccgtttaatgatacaatattatatataaacttactatgaaattcgctgcaacagcagttataggaacggagcagaaaaattgatccagtatttaaaggatatctgggagaatatacagagtgtttttgcaacaatgggacttgttgattatcttgatattctccttcttgcctatctcatatataaaggcattaaaatcatcaaggaaacacgggcggagcagcttatcaaaggtataattctgcttgctatacttttctttgtcgtaaaccagtttcagctgaaggcgatgaaggttataatagaaaccttcctcaatgtcggaattatcgctatacttattgtattccagcctgagcttcgccgtgtgcttgaaaaaatgggacgaaccacaaaggtgaaaaagctggctcttaattttgaaagtaagacggatgcggcgaccgccgacatacataactgtatagaggctgtctgtacggcttgcgaacagctttcgcagaccgctacgggcgcacttatcgtattcgagcgtgaaacaaagctcggtgagcagatagacaccggtacgataatcaacgcaacgccgagccctgagcttttcggtaatatatttttcccgaacacgccgctgcacgacggtgcggtgataatccgtgacagcaaggtatatgccgcaggatgctttctgcctaagcctcagaaggaagaactgatttcaaaggctctcggttcacgtcacagagcggctatcggtatgagcgaggtttcggatgcggtgatagttgttgtttcggaagaaaccggtactatatctatagccgaaaacggaagtcttacacgcttttacaataaggatacactgcgaaagctgcttacggcaaagctgattcccgaaaagcccgaagcaaagaagatgaagggtaaggctttaaaaaagcataagaaaaacgcacccgatgcgaaaaaagaacagggggcggataaataatgaatgaatggataaagagctttttacagaattttgtaaagaatcttaagaatattatatttgcgctgattattgcaatcattgtatggtttgcaatctcaatgcagatattccccgatgtcactactcacgtcagcaatattccggttgaagtcaaggctacggaatatatgacgaaaaatgcgctatccgtaacgaacagttatgttgataagataaccgtacaggtaacaggcaaaagatatgaggtaggaaaccttactgcaagcgattttacagccagtgcggatctgtcggctatcacggcgccgggtgaatataaggtaaaggttaacgtaacaccggtaaaggaaaacagctgtacggttgacgatgagggccttagcgttaaactcaaggtcgaaaagacggtatcaaaaacgttcagtatttccgacggcagtatgaaggctgtagctgaaggcattaccgctacggcgggtatgaagatagacagcgttaccgctgagccttcgactataacgcttacgggcgacagcaccgcaatagacgcagtgaaatcggtcgagatacgttctgtatttgcaggcgaaacctcagagtcggtttcttcaaaaggtcagattgttctgcttggcagtaacggagatataatcgaaaatcccgatataaaatatgacaacgagagctacaccgtgaatataacgctgtataaacagaaaactctgcctcttacggtacagtttacgaatgttccgtcaaactttgatttaagcagtcttaagtacagcatctatccggaatcgctcactgtttcttcacccgacgattcacttgattcacaggagaagttcgagataggaacgatagatctcagtcagcttacgaccaagtatttgcagaagctgacgcttccgatagctttacccgaaggatataagaatatcagcggaaacacatccgctatggtttcgtttgaggatgcggagaattacacgttcctcagctatactgtccagaaggataatatccgtattataaacgcaccggacaattttgatgttgatgttcttacaaacgaactcagcgttaatgttacgggtccggcagatgaaatagcggcgcttgcgtcaaaggatatttatgcgacggttgatcttatgggaactacgcttaccgcagggcttaaagatgtgactgcagaattcacgttgcgtggaaccaaggtcagaagctgggttacaggagaatacaaggtatctatacaggtaaccgagagggcagaggatactgcggattaaaatcggaacggagatgttttcttgaatatttcattgctttcacaggcggtcggtacgtctaccaatccgcttgagaatgcgcaggagcagataaaagaagctgaaacgtttttcaatcaaatgataaacgcttttgtaggatatctgcctacgctgattgcggcggcaataatactgatagtaggaatagttatttccaagctcgtgctgaaaatgatgagcaggggtatgaaacacgatgttatcgacaagactgtttcacgctttatttattcattggtcagaatactgctttatgcgctgctcgctactattgttcttgccgttctcggcgttccgatgacttctataatagctgtgataggaacggcaggcgttgccatcggacttgcgcttcaggacagcctttcaaatatagcgggcggattcagcataatgctcacaaagccgttcaaaataggagattatatcaaggtcgatgacgtcgagggtacggttgaagcgatcaatatgtggtataccgagcttcattcatatgacaataaagccatcttctatcccaacgggcagataacatcaaagaaggtcaccaactatacggcgcttggaataaggcgtgtggatatggtctatacgatttcttacaatgccgatttcagaaaggcgatggaggttctcaaaagcatcacagacgctcacgagcttatacttaaagagcctgagccgaaaataaggataaccgagcttgccgagagtgctgtaagaataacctgttatccgtgggtaaaggctgaggactactggacggtatactttgaccttaacgaagcggtcaaggagcagtttgacttgaacggtatcgagataccctataatcagcttgatgtgcatctgaaaaaagacaatcaggatgccgctgctaaaaaataaagcaggcaataacgctttcgcagagctgtcgcaggctctgcgaattgttatatcggacgatatacggtaaggaaaattgatttgcgaatgagaaaaggagttttttgtggataagatacatctgaaatcaccttcaaactggataaacgatcccaacggatttatatattataaaggtaagtaccatttgttctatcagcattttccctatgcgccggtatggggcagaatgcactggggacacgctgtaagtgacgatcttgttacatgggagcataaggggatagctctttatcctactaagaaaaatgacaggagcggatgcttctctggcagtgcggtcgagcatgacgggaaaatgtacattttttataccggcataaattatcgtgaggaagatcccgaaaatatcaactgcgcactgaattacggctttatagcgtcacagatgaagattgtttcgcaagacggatatacctttgataatttcaatgcgaaaactacgataattcaacctttgcgtgacagcacttcaggctcggaatccgacaccagagatcctaaggtatggcgtggcagtgatgcgtggtatatgatagtaggaagcacctttgacaataacggaagattcctgtttttcaaaagcgaaaatctcgaaaactgggaatatgtgaattattgcgaaaaaagaggattcggctgtatctgggaatgcccggattattttgaagtcaacggtaaaggcgtagtaatcttttcacccatcggaatacttgatgataatatgatgtatgattcagcggcgatatgctgttttgcggattttgacgaaaaaagctgcaaaatgactatgagcgatgaatacagtatgtttgattacggcatagacctgtatgcaccgcagagcaatacggatgaaaacggcagacgtgtagttgttgcgtgggcgagaatgcccgaagcggtaggcgataatgagaataaacgcataggtatgatgtgtatacctcgtgtggttgacataagaaataatcacatatatttttcacctcacccaaacataagaaaagccttttcaaaaaagagcggcaagccttcgcataaatcgggatatatgctgaaaacagcaataaacaacggggagagcataaatatcggcggttatatcatccgccgtgaagatgatattattataacggatcgtacagcggtttttataaatgataaaaattacaggcttattgcaaaaacacctgttgtgaaagaggggaacaggctcgaaatctatatcgacagcaatctgatagaaatatatatcaatgacggggaatatgtgctgagcagtgtggtttacggattgtcggatataattgaaggcggagaatacgagattttcgtaacggaataaatatctgaaagggaatatatcatggaagaaaagaacacaaatgtttcgcaaacggaagaaaatccggagcagaacagccctgaaatatcggctgagaatgaaagcacgaccgaagcggcaaaagacggcgttaagacggcagtgcctaaatggcttatcataattatagcggctatggcggcggtgataatagggctttcggtaacgctcgctgtgattctcgcgggagggaaaaccgtcgatgaatcgtcatcatcacagagcggcacatccgcagataacagcgaaaactcatcattatcccaaagcacgcagagcgatacttcgacagacagctcgcagggtgctgtagcggaagacggcatcatcctgcaatattccgtagataattcgtggggcgacgacggaaatctgaattacggagttcagtttggtatcaccaacaatacaaacagcggaatttcgggctgggagctggtctttgaaatagacggtcttaaaggctgtgagggctggaacggcacatacagtcaaaacggaaatacggtaactgtgacaaatgccgaatataacggggatattcagccaggctccactgtggttatcggctgtaatctgaatacggacaaagaactgaaaataaacagggcagagcttaacaaaacgcagtgcgttgttaaagcgggaaatgtaaatcagaataatcagaataatcagaataatcagaataatcagaatgcaaacggtaatggcacttccgaagcagatgttgatgcactgcttgaaaggagcaaggacggcgaacagggtgacgactggcttcatacggacggaaacaaaattcttgataaagacggtaagcaggtgtggcttacaggtgtgaactggtttggatataataccggcacgaatacatttgacggcttgtggaacagtgagcttaagtcgtccgtaaaggctattgccgatcacggattcaaccttatccgtgtgccgatgtcggctgagcttataaattcgtgggcggcgggagaatatcccaaggcaaactacaacaatgcctacaacacagagcttaacagtatgaacagccttcagatattcgattattttctgaagctggcggaagcaaacggcattaaggttatgccggacatccattccgcagaaacaaatgcttcagggcatacggtgaatctctggtataccgacaaggtaagcgcagaggattattataatgcgcttgagtggatggcggaacgttataaggataatgatacgataatagcgtacgatctcaagaatgagccgcacggcaagccctatgaagcggataaagcggcgatatggaacgattccgattcggctaacaactggaaatatgttgccgaaactgccgcatcaagaatacttgccaagaatccgaatgtgcttataatggtagagggtactgagatatatccgacagatattaagagcaacaaggatttcagctcgacaaatgacgatgattactattttaactggtggggcggtaacctcaggggcgtaaaggattttcctgtcaatctcggaaaatatcagaacaagctggtgtattctccgcacgactacggtcctacggtttatcagcagccgtggtttgagggcgactatgattttgacagccttatgcgtgactgctggcaggacaactggttcttcatctacaagaacaataccgcaccgcttcttataggagaatggggcggatttatgaaggagcctaatcttaaatggatgacctgtatgcgccgtctgataagcgagaaccatcttaaccacacattctggtgctacaatgccaattcgggcgatacgggcggacttgtgcttgatgatttttcaacgtgggacgaagaaaagtacgcatttgtaaaggaggtcctgtggcaggaaaacggcaagttcgtaggtcttgaccataagatcgcacttggtgaaaacggtatcacgctgaaggatgccaaggggctttagagcttgataagcgatgaaatttaaatgccgataacgtcatattcatccttgctaaaagggcagggatggatatgatgtgaggcaaataataaaatatgtatctgctttacgggacgtttattgtcacgaaatggcgacaattttaagctgtaaaagaaaatcgaaaaattttcaaaaaagtcttgacatttcatttttattgtgttataatatacaagcgtcaatgagatgcgtgcttttaaagcagttaatgaatatgcgggtgtagttcaatggctagaatcccagccttccaagctggttgtgtgggttcgattcccatcacccgctccatagttttcacgaaagtgaaaacttatttattttgataaatatgaaaatgcagaccatgcgccactagctcagctggatagagcaaccgccttctaagcggtaggtcacaggttcgaatcctgtgtggcgtgccatttatggtgggtgtagcgtagctggttaacgcgtcggattgtggtcccgaagatcgtgggttcgagtcccatctcccaccccatatttattaagaacgaatgccgcctgcgctggcttatagtgccggcggcattcgtttatactgggatatagccaagcggtaaggcaacggactttgactccgtcactcgtgggttcaaatcccgctatcccagccatgcgtaaatcctctctgtcactgcgattgagggggttttcttttttgaaatttttgtgttgtaatcgccgattacgccacaattacgccattgtgtatttgttaactgcttcagaaagtatcttataatcatccatgtgtgtgtaaccgccggttacttctaaagactgatgaccgagaattttcgatacaatggcagtaggcattcctcgtgcctgcatcagcgtgctatatgtgtgtcgtgttgaatgcggcggtaaaacttctataggctgctttccgtcagccgcaagttgcttattaagacgatcgaagaaccacatatatctgcttcgcaggcttgattctgtgacaatgtaatcagcaataacatatttctgagctctgttgattttttcttcaataaaagtcattacattcttattgataggtactattcgttccttgccgttctttggtgggcctatcgttccatcacgcttaacagcactgtcgataagtacacagctacgtttaaaatcaaactttcccggtgatagagctctcagctcgccggagcgtattcctgttgacaaaagaatgattatcggaagcccgaaagtatcgtcgtttttggcaaaatttaagatttcgattgcatcttcctctgtgtaactttgcttctgtcctgctttcttcttggctatctgcgctcttgtaacgggattctttgtgcaataatcgttgtctactgcgtcctcaaataaggcatttaacaaaaagcgtaaccgcttccgaatactttggctgtaatcaaggttcgcaaaaaaatcggtaatatggatgggcttgatgtcactcaaactcattttgcctatcttatgatcactcactttttgtaagagatacttatattcttcaaacgtgcttcgctgtatgttgtttttcttgtatgtgtccagccacacaggaatccattctgacagcgaatagtcgtcggttgctcgctttgattctccgccgctcttgataaactctttgtacttcttacggcattctgattccgtagagccgtagaatcggtaacgtaatctttttccgaaaatatcatagccatcacttatggtcaattctatttggcctgttttaagttttctgaaacttccgtcgccctttttgcgtgctctcataataaacacctcctaaattttttccccgcttgttacggcggggaagggtttatttgatatatctgttaagcgctgctttcaattcatctatgtatttttctgcttcgtatacactttgcaatgagtgtttgatttcctttttgttttcatccggaataatgatggttttcttgttatctgtaagtataaatctacagatccattttgtggtttttccttgataaagtatgctgaaatagctttcagtatctttatacactatgttttccattgcacagtattctttcagaagatttttaataacaaaatacgcttccagttcttcattagttgtaactattctcgatattttctctttcggttcttcggttgtttcttcctgtacattttcaggttgtttatcagctatatttacatccagagcacttttgattttatcgctcatcaattcattgatataatcgttaagtgcctttttaagtataggacggaacttttcaattaccgattgcattagttttccttcgtatattccggtaaggaacaatttcacaaaatcatccgacggctgttgcaactgtttagccagtattgttttaaattcattcgaatatttaagctccgaagcaacatcaaatatctttgaaatgtcaaactgcgatttgtggaatttctttaattccgcaacctgattttcttttatatcaagtatattgatttcaaggaaaggagtttcatccattttgttggtttcatcaagatcagtataaaaacgataaaactgaccgttggtaagaattgcgaattttgctttagaagtgccaaagtacctgaacaactgactgtcatgcttttcaagattttcacctatccatttacattcaatcaatatgacaggatcgccgttattcattatagcgtagtcaactttttcgccttttttaatacctacatcggcagtgtactcaggcacaaattcgtcagggttaaatacgtcatagccaagcaaggaaaagaaaggcattatcagagctgttttggttgcttcctctgtttgaaggttaggctttaaagtttcaactctttttgcaaattgcttaatctgatcgatgaaatccataataaaattcctcctcaatcttttcgacataatgtgacaaaatataaatctatatgacaaaatctataaaacgtatttactttatgtcgaaagtatgatattatattatttggaaacagtttgagaaatcttactgttagctcctgccgatattcgcagtatcggtgggagcgtttttttatatgtcttttatgatttttctaacaataccaagtattctaagtctatcacgctcagcacctttaaaaactcttggtgcgtattctggattgaatgacagcaacgtaatgctgtttttgtcatactctatcttttttacgaccgaatcctcgtcatcaataaggactacagccacctgtcctgacttgcaccaatcttgttttagcacctgaataaaatcgccatcttcaattttaggatacatactgttaccttgtacttttatacacagtgtattacgagcctcttcgtcattggatataaacaacggtatgtaatccagaatataattgtcagggaacgcaccgaagccggctgatacgctctcatatacgggaatcattcgtattttttcttgtggtaggatcattgcgtttgactcgatggattgtgatgttgtatcgggattatctgttttaagcgcaagatacgctgcactcacattcagttcgcacgctattgactcaagtatcggcaatttaatttttgccacttgtcctgtttcatatctttgaattgttgatttgtttaatcctaagcgttctccaagttccccttgtgtcagtttattattttcacggcataacttaatccttttaccaatctcttttacgtctgccatgttgtccacctcatttcactataagcattataacacattaaattgcataatgcaatagcatttcttgattttgttaaaaaaagttgcaaaacgctattgacaaacgctaaaatgtgtgttaatatatggctatgcaaggttgcgaaacgcaacgtgaaaggaggggatgagatggtgaatacaaacaagatcaaaggcagaatgcgtgagcttgaaataacacaggcagacgtcgctaagtgtctgaatattgctcaaccaaccgcaaatcaaaagattaacaatatcagaccgtttgatttagacgaagctgaaaagttttccgctcttttaggtataaatgccggagagtttggtacttatttttttgctcactgagttgcaaaacgcaacagccagaggaggtgagaacatggaagccaacattgaaagagaatgggaagaaaagtacaagcctgctattctccggcataagaaagtgccaaaggagatagtagccgatttgcttgacgtatcaacacagacggttgatgatatgcttcgctcgggtgattatcattttggtattgcacggcattgtgcaggcggtaaatacaagtatgagattcatccattgcgatttatagcgtggtacgaaggaaggttactttaataaggaggtaaaaatgaaaatatctaagataatcgcccgtatactgtccctgctcctcagagcctggataacagcctctgccgccgtgatgatgtacataccggtgtcggcactggcatatgccgaacgtggctatcgtgcgataggcggcgagatgttacccgttgcaatagtcgctgttgcggtctggtacgggcttgggtggctgatgcgtgtgtggtatagggatatgataggaggcggacacgatgacagatcttgagcgaatcgccaaagaagccaccgatcacggcatgagctacggcgagtatgttgcctggaaggcgagagccacaattgagcaacagcaaaactaccgccgggcaaggcaggtggcggagctgaacagaaagagaggacaaagaaaatgagtgaaataggagttgttaaagggttcaaggtgttcaatcctgattggacgtgtaaaaacaagcagtacggttgtcccggaaggtttgaagaagatgttacaccgtctgtttgtaatgaagggatgcacttctgcaagagggcaagcgactgcttcaattattattcattcgacccgaataacaaggttgcagaagtcatagcttacggcgaagtatcagaagaaggcgataagtgcgctacgaataaacttgaagtagttcgtgaaatcccgtggtctgaattgcttggccttgtaaacaccgggaaaggttgcaccggacgttgcaacagcggcaatcgcaacagcggcaatcgcaacagcggcgattgcaacagcggcaattgcaacagcggcgattgcaacagcggcaattgcaacagcggcaattggaacagcggcaattggaacagcggcgattgcaacagcggcaattggaacagcggcgattgcaacagcggcaattgcaacagcggcgattgcaacagcggcaattgcaacagcggcgattgcaacagcggcaattgcaacagcggcaattggaacagcggcaattggaacaagtgcagcttttctaatggttgttttaacaccacaagcccgaaaatttacctgttcaataagccgtcaagctggacatatcgtgattggttgaatagtgaagcttgttgcctgattgagcggatatcgaacaatgtagtacagtgggttcagtattccaatatgacagatgaagaaaaggcagaacacccgaaagctgaaactacggacggttatctgaaaaaactggataattccgaatctaccgttctttggtggtgtgagctttctgattgtcaaaaggcaattatcacagcaatcccgaacttcgacaaggctattttcaaagagatcaccgggattgatgtagatacggattaagagagagggaagaaatgaagtttaaagttagcacaacggttgctacctacgaagaagtaatggcaattgttcaggcacttgccggcgttgtaaacaatatcaatgtaacagactgtgaaggcgaggaggacgaagacgatgtataaatgcgaacgttgcgattggacaggctcggcatcagagctcggacactacaccgagtatcgtggcgagtgtcacggtgcgcgggtttgggaaacattaccgtgttgtccggagtgcggatatgatgttgagaacatcgaagaagagtaaaaaaagagctccccgaagggagcaaaacaaatatttatgcaagaccagtataacactggcaaaggaaaaagtcaatggatataagagaaaaacttacagctgagctgacagacgcaaagctcggcaaatacgaaaacgttgttaagccctatgtgcttgacgagatctgcatttttgcaaagcagaacagcgaatttgcacaggctatagagcagtcggacaagtcttttgccgactgcctaaaggcaagcgttgcaggagctaaggaacacatatccgatctcgattgttacaagcgtgctgtagcgttttactttcccggtgctgacatcaaatgcactatgacgcttgatctcggtgataacggcttcagcaacgaaacgtccacagacgcagacagcggcaagctacagcttgaccttgacagcctgctcgacttctgaggtgtggtatgacaagaaaagaagccgaaagctatacagacaattttccgccgggcacgttccgaacggaatagatcctgcaagctatgaaccgaaggtggtgaataattcagatgtcggaatttgattttgatcttaacgaagcacttaaatatataagcccgtcagacctttcctatcaggagtgggtgaatgtcggtatggcactcaaagaagagggctattccgttaccgtatgggataactggtcggcaaatgacaacagataccataaaggcgaatgtgaaaagaaatgggagagcttcaacggctcttcctcgcctgtcacgggcgctaccatagttcagatggctaaggacagaggaatgatgttcggcacgggagaagaacgtgagcttgactgggacgatgaaatatcatacgaacatcacgatgaacacgttgttgtaaacaaaaactggatagagggcaaagaaataaacgctccgacagactggcagcctcacagagaaataatcagataccttgaagcattattcgagcagagcgaaaatgtcggatatgttgtgcaaagctacgaaaaagacggtaaattcatccctgccaacaagggctattatgaccgcacggcaggtcagcttatcgaatcattgtcgcagtgtgacggcgatataggctctgttctcggtgattacaacactcaggcgggggcgtggatacgtttcaaccctcttgacggcaaaggcgttaagaatgaaaacgtaaccgaatacagatatgcgcttgtcgaaagcgacaatgtagatatagaaaaacagcacgccataatctgtgagcttgaactgcccgtagctgtgcttgtgtacagcggaaagaagtcactgcacgctattgtaaaggtagatgccgcaaattacgatgaataccgtaaacgtgtagattttctgtatcagatatgtcagaaaaacggactgtcacccgatacgcagaatcgtaatccgtcaagattatcacgtcttcccggtgttcagcgtggtgaaaacaggcagtacatagttgatacagacatcggtaaaaacggttgggatgagtggcgggaatggatagaaagtgtaaatgacgacctgcccgataccgagagcatggctgatgcgtggagcaatcttccggaacttgcaccgccacttattgatggtatactcagacagggacataaaatgcttatcgcaggaccatcaaaggcgggtaagtcgtatgctcttatagaaatgtgctgtgcaatagcggaaggcaaagaatggcttggctggaactgtaccaaaggtagggtgttgtatgtaaatcttgaacttgacagggcttcctgtctgcaccgtttcaaagatgtatatacaacacttgtctgggaacctcaaaatctcagtaatattgatatatggaacctaagaggtaagtctgtcccgatggacaagctcgcacctaaacttatccgccgtgcgagcaagaagaactatatcgccattatcatagacccgatttataaggttattaccggtgacgagaacagtgccgatcagatggcgcatttctgcaatcagtttgataaggtatgcacggagcttggctgtgcagttatatactgtcatcaccattcaaaaggtgcacagggcggtaagcgttcaatggacagagcctcgggttcgggtgtattcgcaagagatcccgatgcactgcttgaccttacggagctggagcttaccgacagcataataaagcacgaaaaagacaagatgacctgcaagatatgctatgaccggctgaagaaatgcggacacgaagacgatgtttcacaggatgatatatgcagtgcaaagcagatgcgtgaagcactcagaaacgctgtgccggacgcagattataagcatgtgtgtgatttcattaccaagtgtgaaaaacgcacagagagccgtacagcgtggcgtatagaaggcacgctccgagagttcccgaagttcccgccggtgaacgtttggtttgattatcccgttcatcgtatagacaagaccgacgtattaaaagacatacagcccgatgacggcagagcagtaggctggcaaaagaatttcagcaagaaaaagaccgaaaaggaacgtaaggacgagcgtaaagaatcgctcgaaacggcatttgatgcttgcatgattgacggcaaggttactttatccggtatggccgagtatatgggcgtgaccgaaaagacggtccgaaaccgtataaaagagcacggcggtttctggattgacgataacgaggtagggaaaaagtcgaagtgaaaactttcactgcgagggaaaatctcggtgattttcattttccctgacagggaaaatgtcgagaaaatttctttcactgtcagggaaaaagtcgagaattttcactttccctacagagtgaaaaagtcggtgaattatcgagattttcactgtcagggaaaatgctatatactacgtatataggttttttctttccctgacggtcacagggtgaagtagtcgtgcgacagctgcgcacgacgacttcttcccctgactgtgacaaaagcactgattaaaaatccaaaaggagatgttaatatatgggtaatagcttgagcttttttatgccgatgataccgcctacggtaacggcacaggaacacaaagtaacggtttctcacggcaagccgatattctatgatccgcccgaagtcagatcggcgaaggctaaactgacagcgtacctttctcagcataaacccgacaaaccgtataaaaagggggtaaggctgacgacaaagtggctgttcccgaaagaacagcacaaagacggagagtatcgtataacgaagccagataccgacaatcttcagaaaatgctgaaggactgcatgactgtttgcggtttctggactgacgatgcgcttgtcgcaagcgagatatgcgaaaagttctgggcggcaaatcccggaatatatatcaaggtcgaggtgctgaaatgacgatagacgaagttcagcaggctatgataagtggtcagaccgtaaggcatacacacggaggaataaccgccgaatacacaataagcggtgttatatcccgttacagcaagataaggggctggtattatgtgcttgagcttaaagacagaaaagcggacagcttgtctgtcgtgaatatggaggaggttgaaaatgaaagaatatattaagcgtgaagtattgtcaaaaattatgaacgatatagcaggagatgaaacttgccctatgaacattgcggcagatatttattatgctgtagattgcatacctgcggctgatgtcgagccagtaaggcacggaagttgggaagtagggtattttcacgaccgagtgtgtagctgttgcacgcaccccgacaatgaccttgatgattatccacatctgtactgccctaactgcggagcaaagatggataaaaaagacggacaaaggagataaataatgactaaacgcaaacccgcaaccgaaacctgcctgttctgtgggcgtaaaattcctgacagaagcaacgcagatacaatcagagagtttgtctgccgttttcagcagacggcaagtgaatcgacaacgacattacttggcaatcgcattgtaacttacagaatatcgccagaggagcttgaggaacttatggataatatgatagcggaggtaattggagaagatagcatgatgaaagcttggcttgcaaaagaaactgttaattttagggcaacagtcgtctttgctgaaacacgaggcaaagcaaaatcagccgcattaattaccgattgctgtgaaggtgcaaatttctgcgatattgaagtaagacgagtaccgcaaatggacaagtattacgtcgaaggtaaaacaaaaatggactggtcagatccgaaagacagagttgctttagtaaaagagtgcagtttttgttgtagacatccgatagcagaagattgcaaaggctgttctgcaaaagagttttgcgatgaggcagtgcagaaagaggagcacctcaatgaccgctaaagaatacctatcacgctatcaccttatcaacatacgcataaatcaaaagatagaacagcaacgacagttcagagagcttgcaacgaacatatcgccgtcatcgggcggaggacacagcagcggggtatcggacaaggttggtatggctgttgcaaaaatcgcaacgctggagcaagagataaacgcagaaatagacgaacttatccgtgtcaaggctgagatagagcatactatatcggcagtggctgacgagcggttaaggctgatactgatagcacggtacataaactgtaagacatttgagtatattgcctgtgagatgcattactcgtataagcagatatgccgacttcacggtaaagcacttctgagagtgcaaaatgtccttgaatgtcctattgcatctgtggtatgattacgatagaaaagaagcgaaagcgtagtgaccgaggagcggctaataagccgccaggtcaccttttctatcaattatgcgtacaagagttatccattggacctcctttttcttagtcgagccgtccgctcttctgattctttcgtgcggacggtgacgaatacttcaagcactctgcaaagggtgcttttcttatatcttaaatttatgttaaaagcttgttcgagatgtggcaagatccacaagcccggagaatgcacagccgggataaagtatacacagaagatacgagacagcgaagccgacaggtttcgtaaccgcaagatatggcgcagaaaagccgatgaaatacttgagcgtgacggtcactgctgcagggtgtgcctgtcggcaggcgttatcaacagcacggacctgtctgtgcatcatatcgtgccgctaaaggtcgattatgaccgcaggcttgataacgataaccttataacgctgtgccgctatcatcacgaggcggcggaacgtgggcgtatcagcaggcaggaactggcaactatgacttgtaccgtcgatttttcacgccacaacatatagtggtacgataccatacaccacaatatatggtgtgcccccctacccttgcgatttttgaggggtcccggtctgacatctgaccgccacctctttacacgatatattcccgatatgactttgagaggagtgagtatatgcccagaggagcaaaaacgatagacaactgtgcaggacacaggacaaagaaagaaaaagaagcccgtgagaaagctgaagcggctatgctcacagggcagaggtgcttcgagcgtgactgtgtaaaggctgatccggtagcgcacaaggagtacctgcgactgacaaagttgctaagcacgatacagaaaaacgatgcactgtacggagcaagcattaatcgatactgcgagctgtacagcgaagtaaacgctgtcaaagcggatgcagtaacgcaaagagcggtgctgtcgaagattgagatagcttttaataatttatcggacgaggaaataacaagcgatgagctgatgaagtttacaaagctgatgaccggagctcttgcaaagatagccgaccttgacaagataataatgcagaaacgaaaaatgatgagcgacattgaaaaggaaaacggttggacagtgctttccgctatcagagcaataccgaagcaggcggaaaattccgaagatgacgctttaatgaagatattacagggaggcaagaataatggggctgtttgataagatattcaggcgtgacactgaaggcacggatattgaagtggctttcgggctaaagcagataagcaatataacgagagaacaggcgcttgaaatccctgcggtttcagcggctgttaattttatagccggcacaatagcaagcctgccgataaggctgtacaacagcaatgacgaagttcagacagcggcggaaatcactgaggataaccgcctgtatctgctgaacgaagaatcgggcgatactctgaacccgacagaaataaagcgtgcggttatccgtgatatgctccttgacggaacgggatatatacacatagagcggagcggaaacgaggttttggctctcagatatgtccgtgacagtgctgtaagtgtggagaaaaattctgacgctatttataagacgctccgtatgcttgttgatggcagagtgtacaatccgtgggattttgtcattctcagccgtaacagcgttgacggaggaaagggagtaagcatacttgccgaaaatcccacgcttttgacatcaagctatatgctgttacagcttgaaaagtcgatgagccgcagaggcggtaacaagaagggctttctgcgcacagagcacagagtagacgagccagcgttgcaggctatacgggaagcatggagaaagctttatagcaacaacggtgacggtatgatgatactgcagaacgggctcgacttcaaggaaagcagctccaccgccgttgagatgcagttaaatcagaacaaggtgacaaatgcagagcagatagcaatgctatttggcttatctcccgatgtgctgtcgggcagagccgatgacagaacgtatatcaacagcataaggacagccgtactgcctgttgtttctgcgcttgaaatggcgcttaacagggcgttattgcttgagaaagaaaagcatagtaagtattttgtcatagatacttctgaactgctcaaggctgatattctgacacgctatcaggcgtatcagataggtcttgcagcaaacttcttacagccggacgaaatacgcttcaaggaaaaccttgcgccgctcggacttgactttatcaagctcggccttaacgatgtgctttatgatccgaaaacaaagcagatatacacgccgaataccgacagccacgctaaaattgatgatgcgggcttgcaaagcggcgatgagggtgatataatagcagaaaagagagaaaacccttatcacgccaaagacggtaagtttacgaatgcgccgggcgggaaaattaaatccgttacggtcagcgatgacggcatagtgactacggtttatgaagcacaggctaaaacaaagtatgcaccatcgccacagaaaaatcacagcggtatacaggtaaagccaaagacttatacaaagctgcgcggagagtttaataccatttatccgggtagcaaaaaaggagaaagtggatatataagtaaaggcaagtatcgttataaagtagaatcagacggagagggcggcataattatacgaaagaaatggaggcagaattagttatgaaaaaagaagaactgtacggaaaatatcaatcagaatatcaaaaacgtattatagaacgttttgcggatacaattcctgaatatatatacccgccaaacgatgacgtttcacgtaaaaattatgatgtatatatgagttttatctgccttcttgaagccccagagcaatatcagacggcagataaagtcatagattatttagaaaaaaatccgaaagcaacagtcgaagatacgtgcaagtattttgacgagataacaccggacggtttaccgccctgcgcttctgaatgggaagatgacgaggacgaagaatgaaattgaatatgacggccgctcttaacaagggcggttttcttatgccctcgtgcaatcgattgcacttgacttgaacacaaactttgcaaaaacagccgttttttgtgaagttcggcgcagatcagaaccaaacttaataattttaccgctcttaaaaagggcggtatttttatacccacaacacagaaaggagtgataaaaatgaaaatcgaaatccgctccgctgatcttatgcacatcagcggatatgtaaacgctgtcgagcgtgacagcaagcagctgcctgcgtcaatggcacctggtatgacaacgccgtttgtcgaacgtatcgtaagcggtacgtttgcaaaaagccttaaagatcatccaaaggtcgagctgaggttcaatcacagcaaggtgcttgacactacagacggaacgcttaaactgcgtgaggacagcataggacttcacgcagaagccgacatcaccgacagagaagtgattgcagaggcgagagcaggacatctgacagggtggagcttcggtttttcgggagcgcaggcgcaccttgagccgtgtgacgagggtgtacagcgcagaatgattacggggctgacactgcacgaggtgtcaattctcaaccgcaatcccgcttatatcgccacgtcaatagaaacaagaggcgaggaaacgaccgtgacggaacagcgcagtgccggaaacgatacggtcgaggtaacaggtgaaatccgggagtttatccccgattacaacaaggaaatagaaattttacagcttatgtcggattacttcgacggaaaggaaacagtatgaatttaaaagcactcatcgaaaagagaaatgctcttatcgccgatatgaagtcactctgcgataaggctacagcagaaacaagagcgatgacaacagaggagcagacagactatgacgctaagaagtcggaagtcgaggcactgaacaagacaatccgctcaatcgaggagcagaacgctcttaatctgaactctgcaaagtcagacggcacagcaaccgacaaggaacaggcagaaacaagagccttcgaaaactatctgcgtacaggccagatagtcgaaacaagagaagatgtcaatctgacaaagggcgataacggcgcagttatccctgcgactatcgcaaacaagataatccgtaagattatcgacatctgccctatttatcagatggcaacaagatacacgctcgctggtacgctctcgattccctactacgacgaaggaacgcaggctatctcaatggcgtatgccacagagtttacggaccttgcaagcacatcgggtaagttcctcagcattgagctcaagggctatcttgcaggtgcgctctcaaaggtttcgagaagccttatcaacaactcgcagtttgacatcgtttcatacgttataaacgaggtttcgattgcggcagcaaagtggatcgaaaaccagcttatcaacggcacagcaagcaagatagacggtcttgccgcaggtgttacacaggtggtaacgaccgcatcggcgacatctatcacagcagatgagcttatcgacctgcaggaaacaatccccgacgtatatcaggataatgcctgctggataatgaacaaggctacaagaaccgctataagaaagctcaaggacaacgagggcagatatatccttaatcccgacgcaacggcaaagtggggctatacgctgttcggcaagcccgtatacacaaccgacagcgtatcggctattgcttccgaaaagacagctatctactacggcgatatgagtggtcttgcagttaagacctccgaggacgtatcaatccagatccttaacgaaaagtacgcaacacagcacgctgtcggcgttatcgcatgggtggagattgacgcaaaggtcgagaacgctcagaagatagccgctcttaagatgaagaaggcaggaggctaataatgatagtaaaggcaacgaccaacttttcgggcaccgtcagtatggcaaagggcgaggagcgtgagctccctgccggtcctgtgctgaacgacctgctctcctgcgggtacatagtgcctgtagacaaggaggagaaaagtgaaactaagcgaggtaacaagcgcaaagattaaagcattctgcggtgtcagcgatgacgaggacggaatgcttgaaatctgtgccggagcggcgaaatcctatatcaagggctatacggggcttgatgatgcgaaaatagacgaatatgaagacatcacggtggcttacttagtgcttataaacgatatgtattcctctcgtgacttctcgtccgacagagcgtcgcagaaccccgtgaccgctcagatactcgccctgcacagcgtaaatttgctgaacggagtgaatgagaatgacatttaacagaaaaatcacgctcatatcctccgagcagaaaaacggctcgcagggcaaaacagacagagcggtaaagaccgtatacgcaaaggtttccgagcctggcgtaacggcaaaatatgccgccgaaacagcagggtacaagtcggaacttacggtgtatatgtggagacgtgaatacagcggtcagtctgtcgtacagattgacggcaggcggtatcacgtcgaaacaaccggagcggctgacagcgacctgcatataaagctgatactggcgagaggaggctgacaatgataacagaaaagattgattcggcactctcggcggtatttgagcatttttacagctatatgcccgaatttgaggacggcgaagagccggagaagtatgcggtgtacaatttatcgtacagggatacgttcttcagctccggcagggcaaatatacggcagtattccttgtctgtgagcgtattttcaccgcaggcagacattgagctgtatgacaaagcgcagacggcgatagagaatgtaggcggtatatttaccggcactaccgatctgtcgcagtttgatgtttatcccaacagaaaaattttagtcatggagtttacgctctatgaggaaaggacataactatggcaaaagtaatacagggtacagatcgtaagtctgctgtatgcactaagcgttttgcgtatgcgccgctgacaacggataacgccgatacgctggcatacggtgatgtgaccgagatcaaggacatactcatcacaacaaagtacactcctaaaatgaacagcgcatcgcagtatgcaagcggcgttgaggttgacagctatgtagctaaggcaggcggtacgcttgacgtaacaattgtgaacacaaactccgctgacgaggtagcacttttcggtgcaaaggtgaacacggcaacgggagtacttgaaagcggtaaggacgatgttgtacccgatgtaatgtgcatctacagcactatgacatcggacggcaagataaacctgtacaagttctccaagtgcaagtttacttcacagggcgagaacgtacagacgaccgatgagaacggcgtaacattcaacagccttgcactgcaggcaaattacaaggcgcttatcaacacgggtgttgatatgtactgcgtaaagggtcttgatcccgttacagacaaggcgagcattgacgcatggtttgcgaccgcttcgggcattatcgtggctgaagtgtaaaaaagtacagatatgacggggcgggaaactgccccgaaaattatctacaggtgaaaaatggagctaatattaagatacatagaactgcttgaattgtgtcgcagtgaactttacgatccgttccttgcggatatagaggaaagatgccttgaagcgataggaatactgctaaggcataataaaaaccacgaccctgtaacaggtcgttttacattcggaaagcagtatattgatgttacagaggaatataaaaacagagccactccgggagagggctcattaacgtatgatgatagttacaattctaaggcacataaggaagaaatcgcttttgcacagtggttacataataaaatgggcggagatatacatttgttgaacgagcaaaatcaaaaccatgtgaaaacacccgattatatatggaattctaaactttgggatttgaaaagtctttcgtccgaaaaagccgctaacagcgctttgcgaaaaggcataaatcaaatatcgggaaatcccggaggagtaatgcttgactgcagaaagtttaacgttgaagaaaaaacgttgctcggcattattgaaaagcgaatgaaatggcacagagatatagaggtagatataatgattgtaaaatctgagagcgatataagagtaatcaggtataagcagatataaaaaagagatgcccccccgccaaaatagcagaggttcatctctccttcatagacattacatctactatcaatattatatctcaatacagcaaaaatgtcaatagtcatttataagattataggagaaaatgcaatgttcacagaacttttaaacaagaaaatttacatcacagatactttatatctgcgatatgacataaaagcgtttatagaagcggaagaaaatggcatcagcccgtttgaactgacatttcctctgccgcttgactacatcagagctgggctcagatgttgctttgatgaactgggagccgactctgtaaagcgttccgagatagtggcatatatgataaaggaactgtcgcaggaatacctgcaggacagggtgcttgccgctacgactgccgcacttcctgcgccgatagtgggaagtaagccgacagaagaaaagcccgacttcaagaagctccgcagtctgtttatagatattatgggacggacggaggaagaattcacatattccacgctgtacgaaataacggacagatggaacgactacgcaacatttatggggtacaaagccccaacagagaggtttgtacagtatgacgattaaagacagccgtgcatacaaatacgccgtgtgggcattgcaggacagctccggtaaggtcggaagatacgtcagaaaacagtgcgccgaatggcttaaagctgtcgatgacggttatgtagatgttcaggaatggaacaagataaccgcattgctcaaagccatacagcacccggacttaggccgtgatatgtactcatcgcttgaagattacagcctgctttttatatatgcggtgctttgcacgaaaacagacgggaagctgtattacagcacgggactgctcgaaatcgcccgaaagaactacaagacgttcacagcggcggtaatattcatcatcggtatgctgacactgccacgcttttcccgtctgttctctgtagctcccgacttaaagctgtcgagcgagctgaaagtagctatcaagaaaattataaaatcctctccgctgcttgaaaagcatttcaaggttatgcggtccgagatcagatgcttgatgtgtgatacggagtatacgccgcttgcgtacagtaaggataagctggacggtaagctggctcacttgtttcttgccgatgaggtcggagcaatggacggctatccggttgaagcaatgcgttcctcgcagattacgcttaagagcaagctcggaatacttatttccacacagtacccgaatgatgataacggcttaaaggacgaaatcgacatagccaagaaacagcttgacggggtgtacagctctggcaagaaatattttgcgttgctttatgagcctgatattgagcttgtacccgactggaagacgaacgacagtgtgctgtatcagtcgaaccctgtagctgtcgataatgcggatctgttctcggaactgaaagacaaccgccagcttgctgtgctgtatgaaaacaagcgtgagaacttcctatgcaagcactgtaatattcaatacaagggcgtaggcagtgagggctatgttgaccttatatccgtgcaaaactgctctgaggacgtgcctgacgagttctggcggggaaagatagtctatctcggacttgacctctcacagacagaggataacacggcgctcgctatgatatgctatcacgagggcaagatatatgttaaatcggtagcatttattcctgccgaaaaggtagaggaaaaatcagtaaaggagcacgttaattacaagacgcatatcgcaaacggtgattgctttgcgtgcggcgattatatcatagactacggctttgtcgagaattacatactgacgctgaaagaaaagtacggcgttataatagctcagctcggcttcgaccgttggaatgcgctgtcaacggtgcagaagctcgaaagcgccgatgatccgatagagtgcgtagagatacgacagcattcaagcgtgcttcatgctccgacaaagtggctcaaggagcagatactcacgggaaatatagtgtttgcaaagaatgaactgcttgaaattaacttcagcaacgctcgctgtacagaggacacaaatctgaacaagtacgtcaataaaaagcgctctgccggcaaggtcgatatggtggtgtcgctgataaatgcggtgtatctgcttcagcaggagatactcaacggcgattgcggcgtgtttgtgcagtattaggagaatattatggaaagaataaagaaatttttgcttgatcacgcagaatttatgatagcaggggctatagttataggaaagctgataaaatgacactgatacaaggatatttcggcataatcgaattatgccacagtgacaggtacgacctgttcctcgctgatacggagctgaggtgtcttgatgagatagggatactgctcagatataaccataaccacgacccgcatacaggcagatttacaagcggtaatggggttgacaacggcaaaaaagatgttgacaaattgacagagagtagtataataaattatgcaaaagctaccgatgttttcgaggtgtccaataattctgaaaattctaattttgaattgcagaatgtagtagatttaatggaaaaatcaagtgtcggtagagatgctttgactaaattatcagaaaaaggtgttaaaccgattttcgattattctgaagtgcgtcatactaacagaggaatgcaacaaggaaattccatcagattatatgctcgtaatattgcaaatgaaagagtggctgcacagacggtgatacacgaaactacgcatttatattatggcataggtcaaaaccaatgggctgaagctgtttgttttgcaaaagaaaaaatgtttataacaggtagacctttaacagttgcagaaaaacgatatatagtaaaacttgccaaagacaactatcccgagtttaagtggaagaaaggcggatatataaatggaaaacggttatgaactcatagaacgattaagaaaaggcgaaaaaatcaagtgcacagattgccagaaaggatattataccactaatacagaagatgtttcgactgctcgtgaatttcgatgcaataaatgcaatagtgtgttaagaatatcaccaaacattacagttgagtgattgcacttgattttaacgtgcatggtcaaaatatcacattaaacaaatggcttaacaaagccaaatgcaacttgcccaaaactgaataaatcatccactccgaaaggggtggattttttatacccaaatttctgaaaggagcgataaaatgtccgatgatttatttactcttgatttatccggaatggaccttaaagatctcattcaagtggtaaacgaaatggatagcaagctgaacagcaagatcatccccgaaattcttgaagaagtcggcgatgaactgatagacgaagaacggcgaatgctgcagggcaggtcgaataaagacggatctccgacaaagctcagcggattgctgacgaagcagataacaaaaacaggcaagctgtacaaggtaaaagccgggtatgacacagctacaattaaagcacatcctgaaagcgtgattatagagtttggcagaccgggtaaaaagagccgcaagaaaggcgacaaggataagcttggcagaaagataggcgctgtgcaggcatactcgcacatcagagcggcgcttatatcaaagaagaaagcaatcacggagcttgcggaaaaccgcttccgtgatgaaatagaagaactgtgggaaaagggaggtaaaaaataatggcacaggaacttactgcgaatttcggggcaaacagtacaaaattttctaagggcgtacaggaaataaaagcccagctcaccgagcttaacaaagcccttgaactcaataagcaagccgttgcagacacaaacaaaaaagctaaggagtatgaaaaagaactcaatcagctgaaaacagccgagaaagaaaacggcacagctacaaaagaacagaaagcccggatggcagagcttgaaaaggagattgacaaggcacgcaccagagccgcacaacttaaaaccgagcagatcgatttaaaaaacgggcttaaagaaaccacaagcgagttgaaaaagcagaagtcaggcgtttccggtgtttccgatgagatgaaaaagatgaaaacgctgataaccggctttattgcggcttacggcggtaaaaagctttatgaactgctgataggctcgaatgacgaaatggagcagtatacaacctcgcttgaagttatgctcggttctgcatcaaaagcaacagcaatgatagagaaaatgcgggactttgccgcaaaaacgccgcttacgcttgaaaacgtaatctccggcggttcgcttctgatgagctatggcgtggacgaaagcaatcttatcgatactatgacaaagctcggagatctcgcacgtggtaatgctgaaaaaatggacagaataacacttgcctacggtcagatgcttgcaaagggcaaggttacaggcgaagaacttatgcagatggcggaggcaggtgtaccgcttcagacagcacttgccgaaagcataggcgtgacaggtgaagaattttccaagatggtttccgcaggcaaggtcggcatagacgatctgaacaaggctataactgggcttacaacaggcaacggaaagtttgcgggaatgatggaaaagcagtcacagactatgcatggtatgctcagtaccttgctggataacatatccgagttcttccgcaaaatgggcgagggtgctttcggagaagtaaagtcggtattgcaagatgtcagcgaccagctggcagaatgggagcaggacggaacgcttgacgagtgggcgcagaatttaggtgtatcgcttaaaaatcttgttgcttttatgaagcaggctatctctgtaggtctcgacttcaaggaagcaataatagcgggggctgtggctctcggtacgtttaaggttgctataggaataggtaatgtcataagtgcgacggtagcgtcaatacagcactttacgaaagctacaaaggcggcaagagcggcacaggcaacatttaacgctgtcggtgcggctaatccgtatgtgtttatggcttcgttgttagctacattagtggttgacacaattgcgttcacttccgcatcggatgatgcaaaaaagtcaatagatgaattgaaagattcggcaaacggagcgaaagacaaggcagatgaactatccgatgtacttgaacgttataaggccattagtaataacacaggcacagcggcagagaaaacagaggaactccagtcattacaaaaacagttgaatgatacgtacagcactacagctgaaaagcttgatctcgtaaacggaaaatatgaggataatatcgaaaaactgcaagaagcaacaaggcaggaaaaagagttagcattagcaaaagcacaatcgtattatgatgaattaacgtcctctgatgcaaatcgaaactatgatgatgttcatagtgtagattctgacgaggatatgagcgccgtgagcaaaataacaattgccgcacacaaagatcacgaaggtacgggcagaggagcatataaaacttatccgctttttggcgatgctaatttgtacgatcaagtaactggaactgctcgtcagcgagccgattattataaagatgttgtaacaaggcttaaagaagtaaatctcgaagcaacggaagcctataaaaattacaacgatttatggattaagtatgaagatgaagcacagaaaatagaaaaagccaaagtttctgttgacgaattaactgattcaatcgaaaaatcatcaaagaaaaccgaagaaaacaccgagaccaaaaacaacaacataaaaaccaccgaagaacttgccgacagcacatcaacactcattaagaatcttaacgagctggcttccgcctacgcagagcaggggaagaacggcaatatatcctatgacactatgctgaagctaatagacgcagggtatacgcagtgtgtcagccttgacaacgaaacaggcaaaataaagctgaacacagaagcgtacaaagagcttgcaaaggcaaagcttgcttcacagatagcagagtacgatgcaacaatcggcacgtccgacacaccaaatattaactcatactacgatcagcaggaatgggaagcaaaaaaggatctaaggctcaagcgtgatgcactgaaggcaatgtatgataacttcgataactatatggaagcaggcagtttcagcggttcgggcagttcttcatcatcaagcagttccgataatgaattcaagaaggcctctgaggcatataagaccgaagcagataaaaaaatcgccctcataaagcgtgaacttgaagcaaagaaagagcttcgtgatgctacgataaaagcgattgacgatgaaatcgaagcccgcaagcgtctgaatgaggacaacgatcttgaaaagcagataaacgaagttaaagcacagcttaaatacagccagcttgacgaattctcccgtgagcagatggagaaaaagttacagggattgtacgatgataaggcggaaaaggaatggcagagaaatgcacaggagcgcaaaaatgccgcaaacgcaaagtatgaaagcgagcagaaaagctacaacaatcagatcagcgcaatcaatgagagcctgaaaaccgtacagcagataatgtcggctatggccgatggctcaaaaaccgttgaaagcatagtcaataacgacaacacacggaataacacagcgaatgtcaatcttatcggtacggctctgacaatggctcagataacaaaggcggtcaaggacgcactgatggacgatattgtaatcagataggagaaaagtatggagaaaatcacattttcaaccgttctcggcacggcggtgactatcgatgatgttaatacatcatccgacgcagacggatacataccgctccacctgcttagctttgagggaaatgctctcggatataagcacgacagctccgagcgtgtaggctttgacggtgcgggattttacggcgcaaaagcaaatgtccgtactatcaccgcagaaattgctctgcttcctcgcaacggaaagccggctacaatgtacgaacttcgcagaaagctcatgcggtactttcccgccggtgttgaaggtacgctgaaatacacgaacagcgccggcaagacatatcagattgagggcgttgtcagtgagcttcctgcggtagaacggcaggcaggtgtgctgtgcacagcgaaaatatcgatcctgtcatacgttccgttctggcgtgtaaaagcggcagatgtggaattgtcggcagctgcgggaaaaacgcagtcggtaaatttcacagcgcagacggaggataaagtgccggctatgctcagcataacggcaacagctgccatgacgggtaccgatacgcattcggcaataattgcgctttcggggcgtgaaatgcctgtgtcgtacaacagcatgagcgtctacggcaaagagccacaggggacatacaaaagcgccacaggagagcttcagctgacaaaatacctgagcacaagtgatgtgataaacatcgactggggactgcttggcaaggtgtatataccgtattcgcaacgttccggtatcgacctgataaagtcaacatcgcagtatatctatcctggcaataacaatttatcggtaaagaacattgcaacagcaggcacgataaaagcaaagctggtgcgttttgattatgtaaggagcatctgatgatagttagagtatacgattttttatcggtaaagaagccaaaattctcgcagaatctcgtcggtatcgtatctgatgttgaaagtttcaagtatacacgcagagcatacgacattggcagtttcgagatgacaatacctacacacgctgatgaagccggatgtatacagccggaccgtatgctgatagtcggggaaaagctcggtcagacatatatagcaagcgatccgacaaagcgtatagtaagaggaacgtttctttatgttacggatattgaaaagaaggatgataagataaccgtcaccggatatgatctgaagtatctgtttgcacttcgtgtcacgctttttccgaaagaagaacaggacaagggaacatacggctattacgtcacaagtggcacgacattttcgtgtatctcggacatcgtcaactacaatatcgttaatgctacagatagcgacagacagatatacggtatgttcggcataacgatgcctgtaaatcagatcaacgcagacccgccgcttacaggcatacaggatgaccgttacatgacacgtcttgagcctgtcagcacggcaatttttaatctgctaaaaaactgcaagacgcatttttacgatatgcggctaatcatagatgataatgcggaggacggcgataactataatccacatatggaatcgagcgaggacaagccgactatcataatagacgagagcagatacaacatcaagagctacacacgcaaggacggaacatcagcatacaagaatgctatatatgccgtagtcggtagtggcgatgatgtcacgataaaatgcgtgaagcgccccgatgataccgcaagcggagtaaagcgtaaagaagttgtgcttgatgtcgataccgacagcgtatccgagatagacagatacgcacttaaagcggcggaagaatatgtggtatctgacgactttgagatagaaccactgtttatggatgacgaagccgaacctgagttagcacagaaggtatct

SEQ ID NO: 46 - DNA, 2925777 bp, Eubacterium siraeum (residues 1,462,890-2,925,777 of 2,925,777)
  modified_base (770732)..(770830): a, c, t, g, unknown or other
  modified_base (834100)..(834199): a, c, t, g, unknown or other
  modified_base (1189005)..(1189104): a, c, t, g, unknown or other
  modified_base (1741844)..(1741941): a, c, t, g, unknown or other
  modified_base (2117469)..(2117568): a, c, t, g, unknown or other
  modified_base (2292231)..(2292329): a, c, t, g, unknown or other
  modified_base (2598473)..(2598572): a, c, t, g, unknown or other
atccgcattgacagtgtagagtacgaaacggtcataaccgagattacagacgagtacgcaaacggcaagcatacgcaaagctatgcctgcggtgacaaaaagctgaaggtgcttaatgtgctgaacaaggcaacggcaggaaatacgcagaaaatcataaacaacaaaatcactaccggcaatgccagcagtgtcggcaagttcaccgctaccggcatcggctgtgagatattcaacgactatgaaaataatatcgcaagcagcacatacgctcacgccgaaggaagcggcacgaaggcaacagcgccaagcacgcatgcagaaggaagcggtacagctgcaagcaacacatacgcacacgctgaagggaacagcaccacagcaagcggaataagctcgcacgctgagggagaaaacaccacagcaagcggttattgcagccacgcagaagggtataataccgttgcagacggcggatacagccatgcggaaggatacaatgctcttgcaagcggttggtacagccacgcaggcggcattaacagcgaagcgaaagcggaagcatccttcgctcacggcgagtatgcggtatccaattatcgaggcggtgcggctttcggcataatgaacaagactaaggacgcactttttgttgtcggaaacggttcaccgagaggaagttacgaaagcgatgcgctggtgcttgacgatggcggaaatctgtgggtggcaggtagtataaagtgcggcggtgacagcggaggttataccttgtcgcctgcgacagccgacacgctcggcggcgtgatgataggcgataatatatcggtaacggctgacggtacaatatcggtggatctgtcgggttacttgaaagcggacgaaatatcggaatgggcgaaggctgaaaataagcctgcttatacggcaagcgagatagggcttggcaatgtggataacacagcagatgccgacaagccgatatctacagcgacacagacagcacttgacggtaaggcagatacaggacacacgcacacggtatccgacatcacagatatgcctgcatacttgacacaagaaaccgatccgacagtgcctgcgtgggcaaagtcaaaaaataagcctacatacacagccgatgaagtcggggcggcgaaaaagaaacacacacataacgtgtcggatatcacagatatgccagcatgggcgaaagccgagaataagccggtatatacggcgagcgaggtcggagcggcgacaggggcagatattactgcggcggtgaatgctgtcgagatcggcggcagaaatctgctgtatgacagcaccggaaatcttaaaaaaggctggagtttcgcttttgcttcagttcttaattacggttttatactttttaaaatagattatcccttacggcatacaaccgatttttatttaaatttactttatttacggctaaatagccgtgtaacaatgttacaataggtaaatatgttgaaaatgttgtgtgcagtttgtgcaaaactaacaaaaaattgaatttactttgttaacattgcctattgattataaaatcgttttcatttataattgagatagcaaataaagatatttgcgaaatcgcaaaacgaaattaacggaggacattaaaatgaagttaagaaaaattatggcaggtattgttgctacatcagtagcaggtacaatggctgttgcagcatcagcacagtatgatgcattcgttatgtacgcatcaggcaactggtatcccgcacttattgccgatgccagcggtcattttgaggaccctaattcaggcgcagtcacagagtggacatcaggcactgcagaagttactaaggacggtacatacacagtatctctctctaacatcaagggtaccggtgttgatgaagaaacaggcgaagaaacactgcttcctgcagcgtgcgaaggcgctgcagtattcaacgttgatatccctgacctcgctacaactttaggcatcggcggaaacagcgaaggctttgatgcgaatatgacacctgctgaaaagatggcatttgctaagtctaagggcgttaacgtaaccgacgttaagatctcagtggttacggacggcgaaacaacagaagttgctgttgattcaagcaagatcctcttcggtgatatcgaaaataacggcaagctccgtatcgagctttacaaccagttcggtgacacatcgaaggatgctcctttaaatacttcggacatcttcttcaatgatagcctgaatgttacattcacaatcacaggtatcgacgctatcacgggtggaaacattaagcccgctcctacacctgctcccgctgacacaacagctcccgctgatacaacagctcccacaacaggcgattctacaaagcccaacacaaacacaggtgttgaaggcgttgcagcagttgcaggcgttgcacttctcgcagccggcgctgtagtagttgctaagaagagaaagtaatttctgttcacggtaaattacattaatatgtagcaaaagcccacgcatttcggtgcgtgggctttttgtgcgtaaaagcaccgtaaagccggatttcgcaggcagaaaaaacagagcatatcggttatccgttccgatatgctctgtactgcttaaaatgtccgatataattgcttacggcaacatattcctgtgcttagttctgtggcattatgactttaaccgcagagattacggcaacagcttactgtgcgctgataaccatcttgtatcttgcgaattttttgccttcgagtatctgtatacccttcttttccttgaaaattccgctgtcatcatcataatcgtcactgccgcaccacggctcaatgcagatgaatcctgcacgttttcccgcaggtgtccacagcccgagcgtttcgaagccctcaaatgctatgcaggcaagcgtctttttgccctgaacgagctttacggctcttgactttatgttatcaaaatataccacatcgttatcaaacatatcgtagctcagcggcagctttgacgagccgtcaagacgctgtatgcgttccttgcttctgaacagccttgtatcaagatccataaccggagttgacgctttctcacgcttttcaaataccagcgtgcagttgtcaagatcatcgcaggctatggcaggatgcgctccgatgcagaacggtatgctgtgaaacccggggttgaaaacgctgtagcagatttctatcctgtcgtcaaacagattgtactgtaagctaagctcaacgctataaggatagccgttttttacgggtgcgtacttgtactgcagaatgagcgagttgctgttttttcttactgttgtaaatgtattgtcacgggcgaatccatgctttgtaagagagatttccttcccgtcaattatggtcttgttgttttttacatttcctatcgcaggaaaaagcacgggtgaagtctttccccagaaagcagggtcgccgcaccacattatctctctgccgcctattacaagcgacttaagctctgcgccctccgaggctattacggctttggcgttttttgttgtcagctcagttgtcatttaagtacctcgtcttttactgctcgtaagctgtcagcttatcattttcgatcgtcagtttcggattgttgaacttccagcttttgataaattcgggtattttctttgtcgtacccttaaaatcgggtaattcgctcagtgtgataaccttttcgcttgaatatacgctcttgaggaattcctcagacatacgttccgtatttaccgacggagtgccgccaagctgtgttataacagctcccgagccgtttgaggcgcatacgaattccttgcaccacggagcgtaataaagccattttactttgctgtcagccttgaacacttcttcggggtcaggtatgtatcctacctcagacagagcggacatttttcctatgtcatcggtgtacttggaaagcgtgttgtatgaagcaatctgcgccgagtgatcttctgaggacgggtatacgtccataccgcctatatcatatgtgttagcgttgaccgttgcttttttcgactgaccgttccatacccagataagatttgtcagcttgtggtaattctcaaggcggtcatataatatgtaccatagcttctgataaagctgtttatcataggtatccctgtccttaacaccccaccagaaccaagcgccgcttgcctcgtgcagaggtcgccatataacaggaacgccggctgtttcaaggcgctgtaaataaagtgcaatagtatcaatatccttgattattaccttatattcatcggtgccgggagttacggctttttcaaggctgaagtcccgtatctcatcgctgtagaatgctgtgcctttgacgcttttgtcgctcatatcaacgggaaccttccagtgccagcagaaagcaactatgccgttctgctcgttgtgccactttatcgcttcttcaatctgtgtgtaatcgggcgtgtccgtaccctgagcgtaaaggaagtcaaagcccatgatagcaggcatatcgcctgttgtattgtagtacattatattctcgaactggcttgcgtcggaatactgctgacctgcgataatctgctttccgtagacgctcttaaggtagttgaaaagctccagtgtttcctcgtttgtgttctcggatacaggcttagagccgtccggtgtctttgcttcgagcttcttgataagtgcgtcaacatcggtttcgtactttaacgcaacatccatatctatgttgccgtcagcgtcgacagcaatgggatttgagcggagcttctgctctgtatttccgtcgtcggttgcagacgaggtagtattgccggaattatccccgtttcctgatgcggtgctgtcattgcaggctgtcactgacagtatcattgacacggctaaaattgccgcaagcgttcttttcattgaaaaaatcctttcattttagctaaatttaatcttgattatggcggaatttaatccgcataagctaattataacaaatccacaagtaaaattcaatagaaaaaggaaaatgtgttgaaattttgtctgcataaagccggaatatttgtaaatcatgtcaaggaagcttaccgttcttgtattccttcggggtaacgccgaccgcctcgctgaacgcacggcagaaatggctctgtgacgagaaacccagtaatgatgcgatgtcagctatggtgtgagtgccatccttaagcataccttttgcggcatttatacgggaggcattgatgtactcgtggatgcccataccgatctcagctttgaaaaggcggtgcagatgggagcggtcatagcctgcttcatcggctatctgctgtacggtaaggcgctttcctgtgttctcggaaatcatctttatagcggtgcgaaccggcactgagagccgtttcgcacgtcttagccgttgcatacggacggcataatccattaccatttcgttattaagatctataacctgttcaatcgatgtgcatatatccgctcgccttatgtatatgtcgctgagagtatatgcggtttcctcagacatacctgcggctatacaggtacgggcgactacggcggcgcagactacaaggtgataaatctgattgcggagtggatcgtccgaaagctgaccttttccactttcaatatcagcgtcatattttaacttagcttctaataactggttaatatcacctgatgcaataagagcgaataccgagttttcattttcgataggctcgtggtaaaattcctgagcctgctgtacatagagcagtttttcgggttcggtattttcatttttttcatcttcatcagtgatgcgacaggttgtagttttatgctgattgtaaacgttattttcggtgtttgcagtggttttcggagcattttttgccataatattcctccttaatctttaaatcggtctttttatcattatacaacaaaagtgcaaaaatagcaacatttttgataagggtaattttgggtgttgtaaaatatattagagagatttattaaagcaaatgtgtttaaaatacgatgtataataatgattattaaacagatagctaaatgagaaaatgttaaaatatggtgtggtagtgtaacgtgatagttagaatgcaattgaatgcgtaaagttgttatgtaacattcgaggtatactaattgtttgtagataagcattttgatatatatttaagcatttatatataattacaagctaccgatagtgctatttgtcggaaaacagctcgcctttgacaagggatgaaagaatgtggtgcggagcaagggatggttgtacttttgagatgattgagggaatggcagtattcggtgcaacgggaggcaatccctccggtagtcgcccgaattttttcgggcgacagcacctcacctttgacaagggaggcaagaatgtggtgcagagcgagggatagtgcggttttggaagggttggtgtgggtcgaagggaattgaaattgataggagtgctaacataaaagcttctgaggcattaacaatccccaccgtcacggctcggaatagtttcagaattgtaaaggtaggactatctgaatactgtacagcaagccaaaaaattatatcagccgtgccacctcccctttttcgaggggaggcaaggacgtggtgctgagcgagggattattgttcttttgcaatggttgtgggagatggcagtattaggtgcaacgggaggagcgagctcctcacctacggaaagcgagagggatagtgcgggtttgggagggctggggtggggcgaggggtgtggcaatccctcagtcttgcgacagataaggttgagaggatattaaatatacttgaatcgctgagcaaggcaatttatgataagaagtagccttgtcgcaatccagctccctttactcaagggagccaagaatgtggtgaggggcgagggtatgttgtccttttacaatgattgcgggaattgcagtataataattcggatttgttgcgtatgcggttaagggcttactcggagcgttttcgggtaaggcggtagacgggtttttcctcgcagaacattttccagcggagaatatcatctgtaaaaatgccgacggcggagaggaaaaaccacagcaccgtgaaaagcaggcatatctgaccgagaaggttgaaaggcagctgttcgtagttccataccttccaatcgagccagaggttgactatacagccgcagagaaattcaagggcggtgattataagcgatgatacagccatctggacggggagcgagaggtcgaatttttcgttaatgccgccgaccagcagaaagcagatccctcctaaaataaacattgtccagtggctgtttcctctgaacagaagttctgttatcgtataagcacagccgccgaagcagaacagcataaacagcttcatcggcagacagatcttgtaattcatattgttaccttgcctttcgtttttgtatccttattttaagctgttaggttaaaattatgcagatatggcagaatataagcatataattatcttaaaggaaattttgcaaaacggaggttattatatggtgcttataaaaagaatcacggcaggtgtgacggcttttgctctggcggcggtgatgcagggtgcatcattgaccgcattttcggaaggtgatgtgagcgcagtagacagcataacgaaggcggcaatcgttaccgaggtttcaacagggcaggtgctgtacgagcataactcgcacgaaaggctgcctatggcatcggtaaccaagctgatgtgcctgctgatatgggcggaggaaatggaaaagggtacattcggtatggatactgtgataacggctaccgcaagagcgaacgctatggacggctcggtgatatggcttaatgtcggggaggaaatgtcggcatacgatatgatacgctcggtcgttattgcctctgcaaacgatgcttgtgtggcggtatgcgaatatataacgggaacggaagaaatgttcgtggagcgaatgaacaaaagggcgcaggagcttggaatgagcgatactcactatgataactgcgtaggatttgacagcgacacgcattacacctccgcttatgatacggctcttctaagtgcggctgtgtcagagtatgactgctacaacgaattttttgccaccagacttgattatgtgcgtgagggggagcggcagacacagcttcttaacacgaacaagatgatgcaacgctatgacggcatcatcggcggaaagaccggaactacggacaaagcggggtgttgtcttgcagtgtgggcgaaacgaggaaatatgaagctgtgtgctgtggcgcttggctgtaaggaaagcgaacagcgttttactgcgtgtaccgacctgctgaattacggcttttcgggctttgaactgtacaggacggcggtagactctgatgtgctgacacctgtaactgtcaccgaagggcttgaaaagcaggctgaggtaagggtcaaaagactaaatactatcgtgattcctaaaggaagctcaaaaaggatagaatacactcatacggtggtcgatagtttgtctgcgcctgttcagtacggcgaaaaggtcggcgaggtcagggcgagccttgacggagaggaaatcttctacagcgatattgtgactacgggcgaggtcggagagcttaactttttcagcagtctgctgataattataaggcggtttttctcaatgtagaatgagaaacatccccgtgcggtctgcacggggatgaggagttatgaatatggaaatcaggcgggtatattttctttgtcgaagattatctcgccgtcggacagctctattatcctgttgcacttttcggcaacagagcggtcatgggtgacaattactacggtcttgccgtttttgttaaggttaatgagaacgttcattatatcgtttgcggtgtttttgtcaagcgccgctgtaggttcatcggcaagtattatattcgggcggttgacaatggctcttgcaagcgcaacacgctgtttctgacctccggaaagctcttttacgggctttttcagaagatcggatacaagcatatcttccgccgccttggttatcagctttttcatcattttgtattttacggcagggttgaagataagcggatacgatatattttcatataccgatttatcgctcagaagtccgaaattctgcaggacaaagcctatttcctcgtttcttatctccgctattgtgttggaggaatacttgcagacctcatattcgcccaaaaaatatttacctttagtctgcgagtcaaggcaaccgaggatatggagcatagtggattttcccgagcctgaaacgcccattatagctaccatttcgccgtcattgatagtcaggtttacgtttttcagtgcgtgaacctcggtatccatatgataattataatatttgtccacattttcgagttttatcattggttttcgtacctccgtattacatcaagcattttgcttttaagcagggtgatatttccgataatgcttatcaggacggtgagtatcagaagatataacgctgtgaacagtatgctgtcggcgttgatgatgttgagtccgaatataagctttatgataagcagaattataaatgaaacgatcgtggaaaacagcattacaaccagttcgcacacggtgtttataatagctatcttacttgtgtttgcaccgcaggagcggaaaacagcggcggcttttatgcggctttcggcattcagaaaaccgtttgcgactatacctatagagccgacaaccgcaatagcgataaaggcagggaagagctgcaggaggctgatataatcacggctgaatgtgtctttatctacgccgaaaagcggattgccgaatataatatcgcctttctgtttatcgttcgcagaccatgtgttacgaattcttgactctaactccgcataaaacatatcatcggttttgagcagtatgacatcgcaaaaatgctggtgaaaataattatcatcattttcgtactgcttttccgtaaagtcccgattatcaggggtgtaacaaccacttttttcaagtatgcgataatcggtaaaataagaactgttatatagcagatcgccgggagatagcagcaagtcccatacttcattgcttttatactttccgactaccagcagctcaaacttgccctgtgcggctctgcctttcacggtgtcaccgatttctttgtctgaaacggattgaacaattacgggaattttcccgccgtaatccttatttatatcgggtttttcgccttcaagctctacatcaagatattcgctgagctcggttgtataaccgctgacattgaaggaatctttttcgtatctgttatatagggataaattatccggatggaagttataggtcagcagctttatatattcatcgcttattctgctttgctcgctgtacattaaggaattattgatgttaagtatttccatacgacattttatgccttgtcttttcagttcatcggaaatgcgctgtgccgacaatggctttaatgaagtggtatgtgttacaattgccgtcctgtcatagcggttttttgatatataattgacgccttttatgtaatcactgcttattgcaatcataagattaaacaacagcgttgtgaaaataaagcagagcgatatcataatacagttgcgttttcttgacaacagtacagattggataagagatagtattttcatatcagccgcctctctttctgagcgggtttctgactgtacgctttagtcccggaagcgtagagatcagcattatagccgagaatataatgaaagaaataagataatcgtccaaccggggaatatattcaagtcttagctgctttgtaaaatatacaagaagcggaagcagaacaatactcgctataaatgccgctaaaacgtaggtcaggtttacacacataagaagtgctacggcatacttatctttacagcctgttgttttgattacgcttagctgttcggaacagttttctgcgaggtgaagcataagagtcagaagctgaatggcagtgaaaaccgaggctatggctacaaaagcacctgaaaacatattatataacaagttaccgccatcggctgtagacggtggggtgatttcaaggtttccgtttacggcattgtataatttctccgtttcctcttgtgaaagatcacgcttaaaagctacatttatatttacagatgtgtctgttttacaaatataattaaacatactatcttttgatgtgttgtaaactgtaatatctttgtctgaagaaaagaacgaaaaggggagcacgaaattgtcagatgttcctatgatttcaagctcaacatttccgttgtcggacggaagcgtgagtgtatctcccacagaaaatccgctttcggaatcgacaattattttccccatatctttttccagttcttcctttgtaaaatccctgccggattttatggggtaagcgggatttatgttgtgatgaagctgttcaaaatatgcgggaaaacgttgaatacagccataaaatttgcagatcattccgtattttgtcaaatatgaaatttttgttttgccacacgttataaaagtgatttcgggaaaattatcagtaatgaatctgatgtcattagttgtgtaatctgtaatttcaaatccgtattttgaacggtcatacatactgctgtaggcatattcggaacttttataaccgacattaaaaagcaggaatgaaaacacggagcacagagaaataagaaaaataaaaatattcagtttgacgtcacttttcaggtaggtttttaacaggctgaaatagagggttttatatttcaacggttttcctccttgttttcttgttttcgcctgtgaccttttccggcttttctcttactttgtcgaaggctgagggaaggtagaaagtgggtttcatagtaacgatgtttctcctattcgttaaattttatcggtatcttagcgaatacctatagctaacttattgcaaaattattgcaaactttatttttattatacaaaaacaattttgccgaatcaagcattaaaagcaataatattgtaagtctgctgtgattttggaggttgttaacaaaaattctcagtaaatatatgcaatataaacaaagataatacagatttaactattggcaggaaagcaggatgaaaaaattcaattcaaaagtttgcggtttgatgaaattcgattatatatgatagcgagggttaaaaatgcacaaaaaaattgaattcattttgtgaaattagacgaaagtgtcagttcttagcaaaacatcttgcaaatcacagccgatttcgctataatagaactatataaagaacggcatcggcagacagaaaaagttatgagtaccgtagctttataatttgtgtgtggaaagagtataaaaggagagaatagtatggcagttacacttaacgacaagtaccttaagggcgttgtaaacgccgatgagcttaagggcatggagcctatggtaaaggtcgctcacgagatgatcgaaaacaagaacggcttaggaaacgactttttaggctgggtagatcttcccgtaaactatgacaaggaagagtttgagagaatcaagaaggctgcggctaagataaaggctgacagcgaggtgcttattgttatcggtatcggcggttcttacctcggagcaagagcggctatcgagctattaagaagcacgctttacaactcgctcgctaaggatacgcccaagatattcttcgcaggaaacagcataagccctacatatcttaatgaggttatagagcttgttaaggacaaggacttctctgtaaacattatatcaaagtccggtacgacaaccgagcctgcactcgcattcagagtattcagagaaatgctcgaagaaaagtacggcaaggacggcgcaaagggcagaatctacgcaactacggacaaggcaaagggaacgctcaaggagcttgcagacgctgagggttatgaaaccttcgttatccccgatgatgtcggcggacgtttctcggtacttacagcggtaggtcttcttcccatcgcttgtgcaggctgtgacatcgacgctcttatggcaggtgccgcaaaggcaagagaggacttctccgtatgcgatattgaaaagaacgattgctacaagtacgccgcactgcgtaacgtacttcgcaacaagggctacaaggtagaaatgctggtagcttacgaaaactcatttgctatgatgaacgaatggttcaagcagctgttcggtgagagcgagggcaaggacggaaagggtctgttcccggcatccgctacattctcgacagaccttcactcactcggtcagttcattcaggacggctctaacattctgtttgaaacggtagttcatatcgcaaaggctcagaaggatttcttcttaaagaatgacgcaacaaacggcgacggactgaacttcctgtcgaatcagaatatgtcggtcgttaaccagaaggcttatgagggtactataattgctcataccgagggcggcacacccaatatggtgcttgaaatgcccgaagtaaacgagagcgagcttggctatctcatctacttctttgagaaggcttgcgcagtatcaggctatctgctcggtgtaaatccgttcaaccagcccggtgttgagagctacaagaagaatatgttcgcacttctcggtaagcccggctatgaggacgctaaggcggcactcgaagccaagataggctaaggataataaatcgtgatgtatggctgtaatcggccgaagcgaaagcagtcagacagacggtttttattatattaaacggcgactctgccgtaaaaatacggaggactttacaatgattaaacttatcgcaggtaaaaagggaacaggtaagactaagttacttataaacgctatccacgaagctgagcaggcaagcaacggcaacgttgttgctatccagatcggttcttccctcaacatagacatctatcacaaggtacgtcttgtaaatatcgaggactacaacattgataactacgatgcaatgtacggcttcatcgcaggtatgctcgcatccgactatgactgcacagacatctttgttgacggtattctcaagatctgcggcagagatatggaaaaggttggtgctatgttcgataaggtagcggctgtaagcggcgagaacacacacgttacattcactatatctgcagaggtagctgacctcacagaaaatattaaaaaatatctcaaataagtgttgacaaattttgatttttgtagtataatatcactcgtgttagcttagacgatgataaatcggcttaattttgagataatgaacatcagaggggggtgctaaaatggcagttccaaagagaaaagtatctaaggcaagacgtgacaagagacgttcacaggtatggaagctatctgcacctgcattctcacgttgccctcagtgcggtgagttaaagctccctcacagagtatgcggcaattgtggttattacaagggcaaggaagttatcgctagtaaagaggcgtaatgcttgttcgcgcaaacattgtggcagtatgtcagaaatgacctactgcctttttgtttatccgatacggaggaaatatgtctgaaaggttgaaaaggttcttttcccacggtggcacaatagcttttattacaggattttttctgtatattgcggttgtgctgccgattcttataaatgataaagggattttcactatcgtgggggattacagctctcagtcgataccgtttgcgtatcatataagggattgtttgctgtcgggaaacgtatgctgggattggtcaagcggacttggctcgcagtttctcggagattatgcttactataatctgttcagcccgttttcgctgatttatcttatagtgccgagagatgctattatatacgcaatgccgtttgttaccgctgttaaatacggcacgggaagctgtcttgcgtatttttacgcttcgagatttctgaaaaacaagcattatgcagttatcgcaggcgtgatatatatgttctcgtcattcagcggatataatgtgatattccatttttctgatgtgattgcgctttttcctttattgctcatcgccgttgaggagctgtgcgtcaataaaagaaggtgcgtgtttgcactgaccgtctgctttatggctctgctgaattactatttctttgcaggtcaggctgtgttctgcgtgatctacttctttgtcagattctttgacaggaagtttgtcaatacgctcaagaagctgttatcggttgcattcgaggcggttaccggatttgcaatgtcggcggtgtttatgctgcccgtgcttttttacctgtcggcaagctcgaaggctaccggaatgatctcgctgtctgatatgctgatatacagcgacggatttaattatctgaagctgatacagagcgcttttatggttcccgatcattttttctttacatcactgttcccttcggtcgataatgtttatcctttcggaaatctgagtgcgtctgtagcgttctatattccgctgttttcaatggcaggcgttatttcttttgcgtgggcaagaaaaaagtcgtggctgacgattattatgataatctgcggagttatggcgtttgtgcctgtattaaaccagcttttttcggctctgaacagtgcgtattatgtacggtggctgtatatgccgatgcttatcgcttgtgtgatgtcgttatccgctcttgaggaaagggtcagcttcaagccgggcatcataacctgtacggctgttgttgcggctatgatgatatatcaggcggtagttgacacggacgggcttattgtaagggcgtcgcacaggacgaatttcagcgtatatcagactatgcttcattttgcagttaccgtgctgtcgcttgtgcttctgatcgttattgtgaaatcaaagcgtgacaaggattttataccgaagctgtatatattttctctgatctgtgcttatatgtgctatggggttatggtgcagtatctttattcaagcataccgagtgtagaggcgacaacggcggcatttgccttcggagagaaattgccggaggaatgcagggagggcagtcccagaatagcgctgtctgcgacaaatgctaatcttatatggggtgcggattcgccgtcgcatctgaacagtctgcacgatgaagggtttacacagttccttgacgacagctcgctcggctttgaaagcggagtatacgagaggataacttttgattacaaggagatttgcgaccttatttcagtaaagtattttgcaggacttggcgaaacaggcgacaaatatgacggctgcagaaaagtcggaacaatgggagaatatgcgatatatgaaaatccggattatataccgatgggttttgtttatgacagcatgatttcccgtgacgcttttttgagtatagaagacaagaagctgaagcatctcacttatctaaaggctcttatagtaagcgatacgaccgtcttttccgatattcttacagatataagcaatacggcaggagaagaaattacggatgacgaatataaaaggctgattgaggacagaaggcggagtgcggcttcctcctgtgaaaagacgagcaacggacttacagcgcaaatcgagcttgaaaaagagaatgttgtgtttttcagcgtttcgtacaacgaaggctggagtgcttatgtggacggcgaaaaaacggatgtgtacaatgtgaataacggctgtgtcggggtacgggtacacgagggcaggcacgaaataaggctgtgctatactgtgaaaggattcaacgagggcattgcgataaccgccgtgtcttcgggaatacttatattatacgccgcagtatgcggtatcaggcgtaaaaacggtaaggctgaggtttaaatgccgcaggcgaaaaagataatgaaaaacgggtgccgtattgcagtgtacggtatccgtttttatgcggaaggcagaacattttaatgttgacgattgcgttataaaagtgtataatatatatgtatgcttaattgagagaaaggactgataacgtgtctgtaaggataacctccgtagataaaggttctcctgccgataaggcaaggataaaggcgggcgaaagccttgtttcaataaacggaaacgctatacacgacatactcgactatcagttttatgcttctgataaaaagctcgtgatagagcttgaggacaagacggtaaaggtaagaaagggcgagtatgacgacctcggacttaattttgagacctatcttatggactgcaagcagcactgtaagaataactgcgtgttctgctttataaatcagcttccgaagggtatgcgtgaaacgctgtacttcaaggatgatgactcacgtctgagttttttgcagggcaactatattaccatgacaaatctcagcgacgaggatgttgacagaattataaagatgaagctgccgatgaatatttcggtgcatacgactaatcctgagcttcgtgtaaagctgacgaaaaatccgaatgcaggaaagtgccttgattatctttataaaatggcggcggcagggatcgagataaatacacagatagtgctttgtcccggacttaatgacggtaaggagcttgagaaaacgctgaccgacctttgtatgctttaccctgcggtaaagagcgtggcctgcgtgcctgtaggtgtaacgagattcagggacaagctgccgaagctggagcttttcaacgaagaaaccgcaggcaaggcgatagacacgctggagtttttcggcgatatgatgtttgaaaagtatcacgacagggtagtgtatgcgtcggacgaattctatcttacggctaagaggaaaatgcccgattatgagttctacggtgattttgaccagtttgaaaacggcgtgggaatgtgtgcgagtctgcaaaaggagtttatagacgcacttgcggataagcgtgaattcggtgaaacggacgataaggagcggcacgtttcggtggcgaccggggtacttgccgcaccgctgatagaaacactcggaaaaatgctgaaaacggattttccgaataccgtggttgacgtttatactataagaaacgactttttcggggaaactattaccgttgccggacttataacggcaggagatataatcgcacaacttacaccatataaagataatctgggggaaagactgcttataacagagaatatgctgaaaacaaacagcgatatttttcttgacgataagacggtgagcgatgttgagcaggcactcggaattgagataatgccggttgcaacggacggatatgagcttcttgacgctattttaggggaaggggcggatatatgaaactgaaaaaaaggatattttcgtttctggcggtgcttgccgtatcgggtcttgcgatactgatgtgtacggcttgtatgtcggctgaggaaaaagaaaaggcgaaagaggatataagggaggcaaagcccattgccgagaaatatcttgaagataatttcggagggggtcaggtagtcagcattgaatttatgcaggctaagaaaaaccccgggcctgtgccggacttcaataaatatgcaagcggtttctgcaaggctgacgtgcgtcttgagaacgggacggaatttcagctgatagttgataccgataacaagatatgctatgataatctgaatgccgataaggtaataaacgaggctgttcaaacgattgtttcgctgacggacggcacaaagcccgatgatattgaggtcaatgttgcggtaagaggcttactcggtgctgtaggaagcggctatgaggactttttgtcgagagataccgacacggcggaaaagctgctgaacggcgattattacttcaatgttgtactgaaatacggcagttcggtaaacggtgttgatgtatcaagactagagaaaacaccgtacaaggcaagtattactgtaaggctgatacagctttcacaatttgccgaaagcggcactaagacggatcttctcggtagttccgactgtaatcttacgcttggtgacagcctgacatatctgtatctgagagagaatttatttcttgataatttcagaatgagcgatgatgagaacttcacacgctttcagaagggcaatatggttacatatctgcaaaataaggtcgatgatctgattcttgcgtgggatagcagtgttgccgatttaagcgtaagctctgttcctgcggaaaagcaaatcagcaccgaatattacagcggtcagaaatttacggcgttgtgtgacactgcggcgaagattgattatgtaataaagacagaatcaagatattccaaagtgtacgcatttacaacagatgatttcggtggcacaccgtatcttgcaggcaatggcggcggagaaggaaaagatgttgccgactgtatgatgctgataagcggcactgattatcacagcgcagactttaatataaaaggcgccggcagtataactgtcggattatataagagataaaaggaaggaatgagtgaatgaacggaatagtagcggtagtaggacgtccaaacgttggtaaatcaacactctttaaccgtattgtcggcaagagaatgtctatagtagacgatacaccgggcgttacccgtgacagaatatatgcaaaggcggagtggctcggcaaggagtttatgcttgttgatacgggaggtatcgagcctgacagcaaggatgtgatactctcacagatgagaatgcaggcacagcttgccatagacaaggcagatgtgataatattcgtgaccgatgttacatcgggagttacggcgaatgacgcagatgtagcggctatgctccagaaaagcggcaagcctgttgtgctgtgcgtaaacaagtgtgacggaataggagaagttcctcctgagttctatgaattctataatctcgggctgggtgatcctattgcggtatcgtccgtacacggtcacggtacgggagatctgcttgacgctgtgtttgagaatatgcctgaggaaaatcctcagcgtgagtattcagaggatgctatcaaggttgcggtcatcggcaagccgaatgcgggtaaatcttcactcgtaaacaaaattgcgggcgagcagagaatgatagtgtcgaatatcgcaggtactacccgtgacgctgtcgatacggtcattgagcgtgacggtcaggaatatgtgcttattgatacggcaggaatccgccgcaagtccaaggtaaacgagcagatagaaaagtacagcgtgcttcgtgcgtatatggctgtagacagagccgatgtatgcgttattatgatagacgctacggagggctttacagaacaggacagcaaggttgcaggatacgctcacgagcagggcaaggcaagcgttattgctataaacaagtgggacgctgttgaaaaagacggaaagacaatgcaggaattcacaaagaagctcgaggtcgatttttcgtttatgtcatatgctccgtttgtgtttatttctgcgcttacaggacaaagggtggataagctgtttgaacagataaagtacacctattcgcagaatataagacgtatctcgacaggtactctcaacgatatgctgggatatgctaccgcaagagtacagccgccgtcagacaagggcaagcggcttaagctgtattatatgacgcaggcatcggcaaagccgccgacgtttgtaattttctgcaacgataaggagcttttccattactcctatcagagatatatagagaatcagataagagaaagtttcggtcttgacggaacacctataaaaataatagcaagagaacgaggagaataacggataatgatatatctgtgttatgcaataatgataatagtgccgtatctgctgtgcggaatcaacactgctatcatcgtcacaaaaattaaaacgggagaagatataagaacgctcggaagcggaaacgcaggtcttacgaatactctcagaacgcagggaaagattgcggcgctttttgtactgctcggagatgtgcttaaaggcacgctgtcgatacttatagtcagattttcgttcttgtggcttacgggaacagatacggcaaatcccgacaatatgatgacctatgtaggctttgcggcggcggttgcggctataatcggacacgttttcccgatatatttcggcttcaagggcggaaaaggcatactggtttctgtggctgtgcttatgacggtcgagtggatacctgcttgcatactgctcggaatattcatcatagttgttgcgctgacacgatatgtttcacttggttcgtgcatagcggcggtatgttatcctgtgacgatacttgtatacagcctgataacaggagatccttgcgtatggataaatgtgatattatcggcgcttatcgctgtgctcatcctgtttatgcacaggggaaaccttgtaagacttaaaaatcacactgaaaagaagctcgggcagaaggcctgacagaaagaaggtttacagatggctaagatcacaatattaggttgcggtttcggtacggctcttgctattatgtgggacaagtacggacataatgtgactgcatggtcaaaatatcaagaagaaatagacgcaataatgaacgacggcgagcataagcgactcctgcccggagtgattgtaccgccgacaattaggctgacaacggatataaactgtgtgagcgactgtgatatacttgtgttcgccataccgtcaaagtttgtccgtgaggttgcacagaaggtcaagagctatgtaaaaaaggataccatagttgtaaatgtcggcaagggatttgaagaaaataccgacaagcgtctgtcgcaggtgcttaaggaggagcttcccgacaaccgcatagcagtgcttacgggcccttcacacgcagaagaaataggcagaaacgtgcctacgactatagttgtttcttcggaagatgaggattgtatgatgtatctgcaggaaaccttgcagaatgatcgtttcagaatatacaggaacagtgatcttgtcggctgtgagcttggcggagcgttaaaaaaccccatcgccctctgctgtggaatagtagaaggtatggggcttggcgacaacactattgccgcacttatgacaagaggacttgccgaaatcacacgtcttggcgtggctatgggcggcaaaagggaaacgtttgacggattgtcgggcgtaggcgaccttatcgttacctgcacatcctctcattcgagaaatcaccgtgcagggcttctgataggtcagggcatacctgccgcacaggcggtaaagcaggtcggcacggtagagggctatcagtgtgcaaagatagcttatgcgatagcccgtgagcataatgtgcaggtgccgataatcgaacagctttgcgaggtatgctataacggtcagagtccgcttgaggctgtttcaaagctgatgggcagaccgagcaaggctgaggaggaaatattctgattcagaccgctttgcgtgttttgttgtcggtgaaggtgattttttcaacggaacaggaatgtttggaaacggctttcgctcttttggcgagagctgttttagcttgtacaaaagtctttaattgatatacttctgttatatattttagtatttatctatgataacaagctaccgatagtgctatttgtcggacagcacttctcgggttcgctattcgaagcgatgcacttgtcaatattaacgagggaaagaaccaaagagactagggcaagggacttgacagcccctctccctatctcttaggttctctccctcgtggctccctctttccttactcacacccccaccccgtcggggtattagtggaactcgaataaccacctaaacattgtatatcctgtcaatgcagggacgcttaacgctacacgtccgcatattagtacatatatctttgtaatgatgcactcacgaaattattaatgccctgtcgatatggaaactgttttaagcagtgttggcgatatgttttacggtacagctttaataatcagtctgtcgaaaaacctatatattttttgaaaatgagtgtttagcgttgcttaccaaaagttttgcaggacgcaaagcccacaaagcgttcttatagggatagagaatttgctctgtttttcatataaacaggcttgttttataagcaaagccgtactgtttttaagcagtacggctgtaatttttaagaccaccttgccgtggtatgacgatgaaacccgcacataaagtacggtgggtaactttcccccgattgtttcacgctcccttcttccgcaatggcgggaggtctgcaatccgcaaacggagagaaatccctattaaagagtgtcggatcatatgaaatcatactgaagcgaacaaggcagtgtattaacttttattcttcctcttcgtcaagctcctcaaacacgttgaagaattccttggctacacggtcatattccttatcgtcatctattgttgacaggtaaacatcatcgttcttgtttacttccttcaggataacgtaaacgtcactgtcggcgttctcgtcttcttcttcgggaataacggcacagtatgtgcaaccgtcaacctcgatgcgcccgataagctcaaatgtaacggtatcgccgttttcgtcctcgaggtctatatactcggcagtgtctaagtcgttgtctgtgatgttttcgatttctgacattgtttattccttccttttccgaggaccgtttcaagacctctgttctgtatataattttacacgaaaccaaaggtgttgtcaagaggtattttatgattttctcacaatactattcctgtggaggtcaaattcccttaaaatagcaaatcgatgtatttttaagttataaatatagcttaaacacgtcgatattgtgtaaactgtgtaactatatgactaatatacaaaactacgatgtgcaatttgtatagttttcattcagaaaagtgttgacttataccttctgatgtgttatcatatagacaaggaaaaggaaagttccccagacagaataaaacatcttcatgctgactatttaacacgataaagagggttttattcaacatatatacgattcggaaaccgtatataaataaagtcggataggaggcgagtccaatgggtcaggaaaaaagtgagtcacagcagtctgttgaggctcgcaacataaagtaagaagtgaatagtacgatgacaatactcatacggtactcatcgacacacataataaaaaggttttgacctttaattgcgagtaaaacggctaccggacaaagaaaacaagaaaccttatagcgatttgaaaaatcgcagatttccgcaaaagcgtttattatatacagctttcaaggtaaatacaggtaaggtgattgagatgtacagttcaagacattcaaagaggcagttctactgataacagcttaatatcctgcatcggcagaagtcgacacagaggataaaaagagcagctgataaagctgaaagaagctgatttgagctcttaaggatgtgtttcaaatggtaatatacgctgactgcataataaagcgtctaagaaaggtgcttaacgaagaaagacagtgaggtatagtccaatgtactgacaacgtacaggtagtgtgaactacgaaataatgtaaaagtcggttaagtttaacgacagacaggaagttggtaggatgataccacgatgatggctgcagaatatgcgaagaacgcataaagcgaggcagtaagccgataaccgattcgacaattgaatataacaataactgacgggctttggagtatgtgttgcttcaaagcccgttttcattgcgcacataacttgcatttaccgacaaaaagtggtataatcagaaaaactctgattaaggagattactatgataaaattaccgaagatgtatacagcaaattcaattaaagcgatgcacgagaagcttaaccttgatgcagaaacagtaatgctgttatatgattattttgatgcgttttcaaatttttatgagatgttacctttgaaagacgcatataagataatcaaaaaacaaaatgataaattaaagctgacagacgaagattttattgctttttctgagatagcaaggcacgaggagcatttctattttatactcggcagtgaagatctggacaagaacagaaaaaagagtaagccaatggaaagaacaatcgtaaacgaatcgttggtgattattgacgaaatattttataaaatgatggtcgcttctcagaaaggcaagccactatttgttccggcgaaaaataagctgctcagatatgttgatgattcttttatagaagaaaatgagtatacaacggctctgtatgatttctttgtgaataatatgaaattaggcgagtcagatgcatgggatactgtcggcgattgtattctggaaataaaaaacggtgaaaatcctcttgaagaagtgctcagctatcttgattatcgcaaacttttgccggaggagaaaaatctaagtgagttgataagcattatatcacgtttgaataactttactagaacaccggtaaatcgtggatttacacctgttgagcttaatcaactcggcagaggtctgtctgccgacagtgtagtttttgaggaagatgatttgataccgcaagccgtttttaattcaaacagcgaatcgtcaaaacagtaaacaggataattataaagcaagccgttggcgctgtgttgtgcgtcaacggcttgcttttgttatcagtatatttcctgttcaagatttctgaacatatcgtcatcgaaaaaatccgtaatggttatctggagtccgtcgcagagttttttcagagttactataccgatattctttgatttcatattgattatatcgtttacggtcgattgggtaacagcagaaagagttgccagcttgtttacggttatgtttttatccctgcatagctgtaatatgcgccttgaaactgcttcggaaacagatttgcataccattatcatcattcctttcagtaatgatgataccacaaattttcgataattattaacggtaaaccgttgacaaacaagtgatgatgtgatataattcaattaacggtaaaccgttaatgtacttatatgaaaggaagttatagttatgtcaagatgtccgtatctggattacgagtcgggaggagcacttttttctcagggagattatgtctgtaagctttgcaataaaaacatttccgagaacgaagtgaagaataagtgcaaaactgattatggcgatgcatacgaaaagtgtcctgtatataagaatcgttgaagcttatggagtaggagaaatgtatgtcatataatactaatgatataatgggctatgcacaagatccgattgtattttctaacgagcagggtggtaacgaactttatgaaaaagttaaagaagttatggtgtatggcataaacgaaaatggtttgccagctacaatgtttgaagataccataaaaagcgggggaatgtttggcacaaaatgccctttattgatgataagacattccgattcatcgtgcagattttttatgattggaatatttgtttacggtaatcaagttatgtttgcgttgtttggtgaatcagcagaaaatactaaatataaccgtaagcagtattatcaagaaaacggaaacttcattaaagccgctttaatcaagccagatgaatttaaattgcaatcagagcttcaatggagagaagacatattaaatgtatttaataatgctacacattgatgtgtcaaatgaaattgataattaggagcttcaaatgtatctttttgtatgtgctttatgtatgtttattaacggtgtgttagcggcaggagctaaattgaaatctatcagatataatactcaatatactgtatttgaaaataaattattcatagttattttttgcatcggagtatttttcggaattggtgcttatggtgtagataaaatggaacttgtcgcaataattataactgcaattgtggcttttgtcgttgggtttgtggttttatattatattggcaagcatcgagcagaataatctgatagtatggttatattaatatttataaagatgaataaaacggtgagcctcacaagctcaccgtttttgtgtttaatattttaatttattgctatcgtttattcccgaccgttttgctatcttgcatatattcggaactataaaaagcgggtattgaagcggcacattgctattagtaaaaataaatcttcgctatcgtttattcccgaccgtttcactatcctacatatatccgcaacctataaaaaggtcggaatttgaagcggcacattgccgccgcttagtagccgtattcgtcggagatgaggattacttttattctgtccttgtcacgctgatgagccattatgacataatcgttgcaaatcctgtcggggcttaagcagtgcgcacatctgcctgtctttgcacagggggtgtttctgccgagccttacacagtttgcgggagatgcaatcgtttcaagacggtcaacggctgagtggaggtctgttacaatcttgtttaagcccgctacaatgattacctgcttcggtccgaatatcatggcggctacacggttgccggtgccgtctacgttgtataattcgccgtattcggttatcgcattggtgcttgcaaagtatgtgtcggcagaaaaagcctttctgtaaaggtcgtttacctcatcgggagagagcttttcacggtcaatgtagataccgctgtagttttcgttcagaaaatcctgaatgccggtttctttgagcgtcattgttccgccggaaactatcagcttgtcgtcctttataagctcctttattatctgcttagcctcgtcgggagtatcgacaagataacccttcatattgttgttttcaagggcggatattaccttttccgctctttttttgagtgcggcttttacattttcgttcatattatcagttcctttcgtcattttgtgcggtatgaccgctgtataagataaatataacatatttcgcaaaaaagtcaagaatagtgatagacatttaaagctgaatgtgctataattgactacaagcagagttgtgaactgcggtttatgaagatacgatataaaacggtaatattccgataaatagaaaggaacataatatggagatattaaagctcaatgcgccctgcaaggattatatctggggcggcaacagattaagagaggaatacggcaaggtatcagacgcagataagatagctgagagctgggagctgtcctgccataaggacggtcagagcgttattgcaaacggcaaggacaaaggcaagatgctttccgaatatgtagcggaaaataagaatgcactcggtacagcctgcgacagattcgagtatttccccatacttataaagctgatagacgcaaaggataacctgtctgtacaggtacaccctgacaacgattatgctatgcgtgtagagggcgagtacggcaagacggaaatgtggtatatcgttgactgtgaggaaggctcacagctgatctacggctttgataaagaaatttcaagagaagagtttgccgacagaataaagaacaataccttgcttgaggtcactaacaatgttcccgttcataagggagatgtgttcttcatcgagtcgggtacgctccacgctatcggcaagggtatacttattgccgagattcagcagaacagcaatacgacatacagagtatatgactacggcagagttggcaaggacggaaagcccagagagcttcatattgaaaaggctatagacgttaccgagctttgccctccgaaatatgatacaaagcctcagggcaagcctgtaaagatagacggcggcgaggaaacattgctccgcagctgtgaatatttcgatgttcataaaatcaaggtttcaggaacagtaacgcttgacgcagacgaaaagtcgtttatgtcggtgctggtgcttgacggcagcggtaaaatcggtgagcttgacgcaaagaagggcgacagcttctttgttcctgcaggctacggcagatttactcttacgggtaatcttgaggtaattctttctgatatagtttaagacttgtgttatgaaaggttaaaggggatatatgaagtattatatcggcgttgacattggcggtacgaatatcaaggcaggagtggttgacgagaacgcacagctcgtttcgaaaatatcgctcaagacaaatgcggcagacggttataagagcgtccttgcggtaatcattgacgctgtcgaacaggctgtacagctttcgggcgaggacattgaccggataaagactatcggcgtcggctgtccgggaactatggataacgaaaacggcacggtgctttattcaaacaatctgcactgggagaatgttccgcttgcaaaggatcttgcagaacatttcggcaagcgtatcatccttgaaaatgacgctaatgttgcggcatacggcgagtatcttgcaggtgcggcaaagggtgcgaaaaacgctgtagtgctgacgctcggaacgggtgtgggcgcaggtataattattaacggcgagatatacagcggttcaaacaacgcaggcggcgagataggtcatactgttatcgaggttgacggtgcgccgtgtacctgcggaagaaacggctgttttgaggcttattcttcggctacgggacttgtccgtatgacgagggaaatgattgaaaaatatccgagcggatggcttcacgaaatggttgaccgtgacgggaaaatttcagcaagaactgcgttcaatgccgctaagctgggcgaccctgagggaagggaagttgttgataaatatatcaagtatcttgcctgtggcattacgaatgtgataaacgtattccagcccgatattctctgtatcggaggaggagtatgcaacgagggcgataatctgcttataccgcttaaagcactgattgcaaagcagatctactcaaaaaacaatgctaaaaataccgagatagtaatctgcacgcttgcaaatgaagcaggtatgatcggcagtgccatgctcggcagaaaataaaaacacttttttacaaaggaaaggacagtaaaaatgagaagcgatcttatcaagagcggcgtagacagaacaccgcacaaagctttactgaaggcactgggtgtaacagacagcgagatgcacaagccgtttattgccgttgtatgtgcggcaagcgactatgttcccggtcatgcgcatctgcacgaaatatcaagacaggtaaaggacggtatcagaaacgcaggcggcgttccttttgagttcttcaccatcggcgtgtgcgacggccttgcaatgaaccacagaggtatgagatattctcttgcatcccgtgagcttatctgtgacagcatcgaggtaatgctgacggcacatcctcttgacggtatcgtatttatcccgaactgcgacaagatagttcccggtatgataatggctgccgcaagaatgaacctcccttcgatttttgtaagcggcggtcctatgaaccccggcagagtacagggcaagagagtaggatataacgagatatatgaagctatcggtcagtattccaacggcactataggcgatgatgttcttcttgactacgagaataacgcttgtcctacctgcggctcatgctcgggtatgtacacggcaaactcaatgaactgccttacagaagcaatcggtctttcgatgccgaagtcgggtacagagcctgctgtaaatgccgctcgccgcagacttgcaaaggaaacgggcgaaagaatagttgagcttgtaaagcagaacatctgcgctaaggatattatcacaaagaaaaatatgatgaacgcactcgctaccgatatggcaatcggtgcttcctcaaatacggtacttcatcttcttgctatcgcacacgaggcaggagtagacatttctcttgacgacattgacaacaagagcaaggcaacacctcagctttcaaagctcaatcccgcaagtgatatattcataacagaccttaacgatgtcggcggtatccagtcggttatcaaggagcttgcaaagggcggtcacgttgatacaagcgttcttactgtttcgggtacacaggccgacagaatcgccaaggctccgaatgcagacggaacaataatccacacctgcgagaatcctatcagaaaagacggcggtcttgcaatactcagcggtaaccttgcagaaaacggctctgttgtaaagcagggtgcagttaagcccgaaatgatggacttcacaggtactgcgaaggtatttgacggcgaacaggctgcttgtgacgctatcctcaataacgttatcatccccggtgacgttgttgttatccgctatgaaggtcccaagggtggtcccggtatgcctgagatgcttgctcctactgcggctattgtcggcaagggtcttgacggaagcgttgctcttatcacagacggacgtttcagcggtgccagcagaggtgcggcggtaggtcacgtttctcccgaagcggctgacggcggacttatagcttacgttgaaaacggagataagatacatatcaatatacctgcaagaagcattgaacttcttgttgacgatgaaacgatagcacagcgtaaggctaagggcgtaaatgctcccgtaagacagcttgacggttatctcaagcgttacgcaaagctggttacaagctcgaatacaggcgctgtatttgaagactgatatgctaatttaatactgttcagcaaaggctgtgtatttaggtacacagccttgcggtgatattgatgacagaagggggcggtagctatcgctcacaatgataatatgcacgcaggacacagggagcgtatgataagccgccttaaagagttcggcagtgaggggtttcagtcgcacgaactgcttgaaatgatgctgtacagctcttttaagcagtgcgatacaaacccgatagcgcacaggcttattgacagattcggaacgctcagcggtgtgttctccgcaagcgaaaacgagctgtgcgaggtcgagggtgtaggcaggtctaccgctcagatgataatcgttcttcgtgcgaacatagagcgtatgctgtcggagagcgttcagaagggtgagatgctcggcgcatccggagcggtaaaggactattgtatggggcttttccgctttgtagataccgaacagctgagaatgatatttctcgacagcgagtattgttttatgtcgcaggaaataataagcacgggtgcgcttgaacaggtgcggccggatataatgagattgcttgaaaaggcagtgcagaaaagatgtcctatcgtcgttatgacgcataaccatccgagaggcagtgaaatgccgtctacggaggataagataatgacgagaaatcttttcaaccttcttgaaaaggcaggaatttatcttgccgaccacgttatagtcggtatgcacggcagtctgtctatgcgtgagaacggtattcttcctgatatatggaacgatttttaaggagctaaaatggataagttcgtattaaaatcaaattataagccgatgggcgatcagccgcaggctatagacagccttgcaaacggcgtgcttgacggcgataaggaacaggtcctgctcggagttaccggttcgggaaaaacctttactatggcaaatattatcgaaaaggtcaaccgtcccacgcttatccttgcgcataacaagacgcttgcggcgcagctgtgcagtgagttcaaggagtttttcccggataatgctgtcgaatattttgtaagctactacgactactatcagcctgaggcgtatattccgtcaaccgatgcctatatcgaaaaggacagtgcgataaacgatgagatagaccgtctgcgacactcggcaacagcggctcttgctgagcgcagggatgtaattatcgttgccagtgtaagctgtatctacagcttgggcagtccggaggattaccgtgagaatatgctttctatccgtgagggtcaggaacgaagccgtgacgatataataaaaaggcttgtcgaaatacagtatgaacgcaacgatatgaattttatccgtaacaagttcagagtaagaggcgatgtgcttgaggttttccctgcgggaagtacgtcagacaaggcgataaggatagaatttttcggtgatgagatagacagaatatccgagatagatatagtgacgggcgaggtgaaacgccgcttttcgcacgttgcaattttccctgcgtcacattacatcgtaagcaaggcaaggcttgaaaattcgcttaccgagatagaaaacgaaatggaagaacgtgtaaaattcttcaccgataaccataagctgatagaggcgcagaggatagagcagagaacacgctatgatatggaaatgctccgtgagataggaacgtgcaagggagtagagaactattcacgggtgcttgcaggaagagcgccgggcagctcgccgataactcttatgcaccattttccgaaagattttcttatgttcattgacgagagccacgttacattgccgcaggtaagaggtatgtacggcggcgattttgcacgaaagaaaaaccttgtggattacggcttccgtctgccgtctgcgtatgataaccgaccgatgaattttgacgagtttacctcgatgataaatcaggtcatttatgtttcggctacaccgggagaatacgaaaagagccacgctgtgaacacagccgagcaggtcatacgtcctaccggtttgcttgatccgataatcgagatcaagcctgttgcgggacagatagaggatctttattccgaaataaacgagcgtaccaaaaagggcgagtgtgtgcttatcactacgcttacaaagaaaatggctgaggatctgacagcttattacgaaaaactcggcgtgaagatacgctatatgcaccacgatattgattctatcgaacgtatggagataattagagatctgcgtatgcacgtctttgatgtgcttgtcggaataaatcttctgcgtgagggtcttgacttgccggaggtatcgcttgttgcgatacttgacgcagataaagagggttttttacgaagcgaaacctcgcttatacagactataggcagggcggcaagaaacgccgaaggcaaggtcataatgtatgccgatacggttactgacagtatggaaaaggcagtgaccgaaaccaaccgccgccgtgagattcagatgaaatataacgaggaacacggcatcactccaaagactatagtaaaggatgtaagggcggtgctggaaatatcgtccggcaaggataagggcaaaaagagaaaatacaccaaggcagagcgtgaggcgcttatcaagcagtataccgcagagatgaagaatgcggcaaagctgcttgactttgaacacgccgcatatctgcgtgataagataaaggagcttcaggaaagcaagtaagctgttgacggagatgacaaaagaaaatgggaatagataaaataatcatcaagggtgcaagagagcataatctgaagaatattgatatagaactgccccgtgacaagttgatagttatgacgggactttcgggatcgggaaagtcatcgcttgcattcgatactatttatgcggacggtcagagaagatatatcgagagcctgtcatcatatgcaagaatgttcctcggacagatggaaaagcccgatgttgacagcatagagggattatctcccgctatatcaatagaccagaaaacgacctcgaaaaaccctcgttccactgtcggaacggtaacggagatatacgactatctcagactgctgtatgcaagggtgggcattccgcactgtcctgtctgcggtaaagagataagacagcagacggtggatcagatagttgacaaggtaatggaactgcccgagaggacaaagtttcagattttatcaccgatagtaagaggcagaaagggcgaataccgcaaggagcttgaggaccttgtaaagcagggctacgcaagagtgcgtattgacgggataatctacgatctttccgagcagataaagcttgacaagaacaagaagcataatatagaagtcgttgtggaccgtcttgttatgaaagaggatataaagtcacgtttatccgacagccttgaggttgcgggaaatctttcgggcggacttattcttatagatgtaatcgacggcgaggaactgagtttttcgcagaactatgcctgtcccgaacacggagtaagcatagaggagcttgtaccgagaatgttctcgttcaacaatcccttcggcgcttgtccgacctgtaccggtctcggaattttcagaaggatagatgtagacctgattttacctaaccgtgatcttactatccgtgaaaatgcgataaaggcgagcggctggaagtatgcggacggaactatagcgcagatgtattttgacgctgttgcaaacgaatacggcttcagcgtggatcagcctgtaaaggaactgacaaaggaacagttagatgcggtgctttacggtacgggcgaaaagaagataaaggtcgtccgcagtaaagagcagggcggcggtgtctatatgacggcgttcgagggtgtagtaaacaaccttgaaagacgttataaggaaacaacgagcgtatattcaagagaggatatagctcagtatatgggcgatacggtgtgtcccgactgtcacggtcagcgactgaaaaaggaagctctttgcgttactgtatgcggtaagaatatcaacgaattctgcgatatgagcatcagcgaagcacttgaatttgtcaaaagcataaagctgtcggaacgtgatatgatgatagcaagtcagatactgaaagaaatcaaggaacgtctgggatttctgagcagcgtcggacttgaatatctgaccttatcaagaacggcaggtacgctttcgggcggtgaaagtcagcgtataaggcttgcaacgcagataggcagcagtcttatgggggtactgtatatccttgacgagccgagcattggacttcatcagagggataacgacaagctgattgcaacactgaaaagattgcgtgatctcggaaatacgcttatagtcgttgagcatgatgaggatacgatgagggcggcggattttatcgttgacataggtcccggcgcaggcgttcacggcggtgaggttatctgtgcaggcacgcttgacgatataatgaagtgcgagcgttcgataacagggcagtatcttacgggaaaattaaagatagaagtacccgaaaaacgcagaaagcccactaagaaatggcttaaaataaccggctgccgtgaaaataatctgaagaacattacggtaaaagtaccgctcggaatattcacctgcattacgggcgtatcgggcagcggcaaaagttcgcttgtaaatgagataatctacaagtaccttgttgcaaagctgaaccgtgcaagaataaagccgggtgcgttcgatactttcgagggtacggagtatcttgataaggtaatagctatcgaccagtcgccgataggcagaacgccgaggagcaaccctgcaacctatacgggtgtattcaacgatataagagagctgttcgcatcaaccaatgacgcaaagatgaggggctatacaagcggaagattttcattcaatgtaaaaggcggacgctgcgaagcctgcgagggcgacggtatcaacaagatagaaatgcacttcctgcccgatatatatgtaccgtgtgaggtctgcaagggcaaacgctataaccgtgaaacgctcgaagttcactacagaggcaagaacatttacgatgtgcttgaaatgacggtagaagagggtatagctttctttgaaaatcacgaaaagataaagagaaagctgcagacgctttatgatgtagggctcggatatgtaaagataggtcagcctgcgacaacgctttcaggcggtgaggcacagagagtaaagctggcttcggagctttcaaagcgtgcgacaggcaagacggtgtacattcttgacgagcctacaacaggacttcataccgccgatgtacacaagctgatagatgtgcttcagaagctgaccgacggcggaaataccgtgcttgtaatagagcataaccttgatgttataaaaacagccgactatatcattgatatggggcctgagggcggaagcggcggcggtacggtgattgctaccggcactccggaggaagtagcggcaaatcccgtaagctatacgggcaggtatctggcacagatgctcggtatcgataggacggagcagacaacgcttgaataaattctatacggacagataagttataattcttatctgcccgtattttgataatataggcaggcttaaaaaggaaaaaattcaggtacgcccgatagataacagcagagttaccgattgctaaccgaaaaaattaagaaaatcccttgaaaatggcgagagaatagtatataatatatttgtatgttccgggtatttcccggcaaagaactaccggtgaccgtgacaagctacggctgcggtcacgaaaatttgaaaggagtctacaactgttatgacgtattcacatgaagttgaaactatgtgtcccgtgaagcagggcgtagcgcacggcgcagctcccattccggaagaagcaaagtgggtaaaggcgaaggaaatcaaggatatttccggttttacacacggtatcggctggtgtgcaccccagcagggtacatgtaagctgtctttaaatgttaaggatggtgtaattcaggaggcactcgttgaaactatcggttgctcaggtatgacacattctgcagctatggcggctgaaattcttcccggcagaacaattctcgaggcacttaatactgacctcgtttgtgacgctataaacacagcaatgagagaactcttcctccagatcgtttacggcagaagccagagtgctttctcagaggacggtcttgcaatcggtgcaggtcttgaggatctcggtaagggccttcgttcacaggtaggtacaatgtacggcactctcaagaagggtcctcgttacctcgaaatgacagacggttatgttacaggtcttgcactcaatgaagatgatgagatcatcggctacaagttcgttaacttcggcaagatgatggaattcatcaagaacggtgacgatgctaacacagcattcgaaaaggcacagggtcagtacggccgtgttaacgatgctgtaaagatcatcgaccccagaaagcagtaaggaggaaataacaatggctttatttgaatcatatgacagacgtgaaccccagattctcgctgttttaaagaactatggtataggctctattgaagagtgcgcagaaatctgcaaggctaagggtcttgacatctacaagctcgttgaaggcattcagcctatctgcttcgaaaacgctaagtgggcttacacagtaggatgtgctatcgctatcaagaagggctgcaagagagcagctgacgctgccgctgctataggcgaaggcttacaggcattctgcatccccggttcagttgccgatcagcgtaaggttggtcttggccacggtaacttaggcaagatgcttcttgaagaagatacaaagtgcttctgcttcctcgcaggtcacgaatcattcgcagctgcagaaggcgctatcggtatcgctgaaaaggcaaacaaggttcgtaaggaacccctgcgtgttatccttaacggtttaggtaaggatgccgctcagatcatcgctcgtatcaacggcttcacatacgttgaaacagagatggattactacacaggtgaggttaaggaaggattccgcaagtcttactctgacggtcttcgtgctaaggttaactgctacggcgctaacgacgtaacagaaggcgttgcaatcatgtggaaggaaggcgttgacgtttctatcacaggtaactcaactaaccccacacgtttccagcaccccgttgcaggcacatacaagaaggaatgtgttgaaaagggcaagaagtacttctcagttgcatcaggcggcggtacaggtcgtacactccaccccgataacatggctgcaggccctgcttcatacggtatgacagatacaatgggtcgtatgcactctgacgctcagttcgcaggttcttcttcagttcccgcacacgttgagatgatgggtcttatcggtatgggtaacaaccccatggttggtgctacagttgcttgcgcagttgctgttgaggaagcgctgaaggcttaatcaataacatcggtacaagataatatgctatataaggcggtcgctgtttggtgaccgcctttttgcataaaaaccgctcaaaaatgccgatgaaacgttaaaaactatataaaccccactacacattaataataaatcagaaaaatccaaaggcggatatgatatgcttgttgcgtcttatttaccgttatgctataatttaatcagaatcaattgggagcgtgagaaaatgctcagtgccatatatcctgttccggcaagcgaagtcaggctgccgttttatctgttgggaatagggagaacatcgcccgaatttcacgttaagcgtgataaggggcttacttcgcatcaatttctgtatactgcaaaaggctgcggtattttagaagtcggtaacagaaaatataagctcgaaaagaactcctttatgtatcttccgcccgaattgcctcacgagtattatcctgaaaatgatgagtggaatacctgctggatgattttcagaggcgactttcttaagggcattatgaatacaatgggcttcatcggcgaaatggtcgcaacggacgccgaccttaccgcattcaaaaaaatattcgacagaatatacagtcttgcggcggataatcttcataacggcgaaaaatgctcgttgctgatatataacgctgtgctggcggcaaaagagatactcggcggtaagcaggaagaaaacaacacgggaaatctcatagctgataatgctgtcagatatataaacgagcattacggcgatgatattacactaaatgagcttgcctgcctttccggcgtttcaccgcagtatttcgaccgtgttttcagagaacgacttaatatgcggcctatggagtatatcgctcgtgtaaaaatctcaaaagccaagtctatgcttcttgattgtgatatgtccgtgacacagctttcaaaaagtctgggatacaccagccccacatacttcggaatcgtattcaaaaagtatgaggggatttcgccttccgagttcagaaaaaacagcggtagtgtaatttagtttcaaaaagttagagttatcattaatttaagattgacggcggacgtttttcgatatatatttatattgtgattttatatcgggagggggtgcttttgtagacatttaaaataaataaccgcacttgccatcggtgcggcgattatgtgcaccgcagttaatactgtatttgcggaaaataataacagaggtgatacggtgaatattaaaattgacggcagtaaagcaaacacaagtgaaaacttcctctacagaggacagggtatgatcagctgtaacggctcgtcaaggcttttgcttgactataaggagaaaaattcagaaagctataacaagatacttgaacatctttacggcaaaaacggacttaaatttactcatttcaaggtggaaatgggcgccgatgtaaatacatcgtccggcacagagcctgcgaccatgagatatgaggatgaaaaagccgatgtgacccgtggggcaggttttcagcttgccgccgatattaaaaagataaatcctgatgtaacgcttgatatgctgtggtggagcgagcctaaatgggtatcggattcaagcgatgtttatgccgcaagatataagtggtataagcaaacgcttgacgccgcttatgaaacctacggccttgtgtttgattatgtaagtgcgaaccaaaatgagcgtgccgttgatacggattggataaaatacctttcaagagccctcaaaagcgaaaaggactgtccgtatgattactctgagatcaagatagttgcggcggacgaatgcggcacttggggcatatcaaggctgatgatgaagaataaggagctgtgtgatgcggtcgatgtgatcggttctcactacacaagcttcgctgatgatactacaaaaaagcttgcggaggaatacggcaaggaattatggttttccgagggaagctcacctatgaactatgcacagtcggcttaccgctttgacgagggtaattccggacttacaggtcttaacggtgtgcttgatattgcaaaccgcatgattacaatggtgagcggcggatatatgacgctgtatgaatatcagcctgccgttgcaggatattatgacggcgttacatattgccacaaacagcttataaacgcctgcaccccgtggaacggctattacacccttgacagcggatattatatgaatctgcatttctcacagtttatggataagggctggagctttatatatgacgcttgttacggcgatgcaaaggtcggcggtgacggtcacgcactggttgatgcaaagtacagctatattaccgcttgcagtgcggaaggcgattacagcacgattattacaaatacgacatcggagcctatcacatatagctttgaggtgtcgaatcttgctaaggcgggaaacgaggtatatgtctgggaaacaagaggccctgacagcaatcaggaatatgacgctaactacttcaagaaaatcgctacggtaactcccgaaaataataagtattctgtcacgataaagccgtattcgatgataacagtttctactgtaaatatcacctatcccgcatctgacgcacctgcggaaagtgagaacacattgctgtcgcttccgtattccgatgatttcggttattcggacgaattcctttcatcaagaggaaacgcaccgctttatacgaccgatgagggcggcgcttttgaggttgccgaaaagaacggcgaaaaggtgctgatgcagaagattacaaaggatattaaggctaacgaatggggcggtacacctgatccgacaactaatttcggcgatgaccgctggtataattacagcgtcagtgcggatatacttacagacgggaaagacagctatgcaggcgtaggtctgagatatatcctcgcagacagcggtaggagcggttacagcgttacgctttatgaaaacggaaactggaatttcttcggcggaaagaagaaggttcttgacggaaatatagcagactttgattcgtcaaagtggcataatgtaaaaatttccgcactgaacaatgatataacagtttcagtcgatggcgaaaaaataattgattataaggctgaggagtgcggctacagtgcaggaagagcggcactctacagttcatataacaactgctgttttgataatgtcaaggttgaggcaaccgacagcgttcagccgtatgtgaataagtttgataatttcgacaacatatttacttacagcgaaaacggctgggaacacagcactatggacagcttcaaaaactacaagcgtacaatttcgcacggtgctgaaggagcttatttcaccgttgactttgagggaacgggcattatccttacaggcgtacagaaaggcgacacggttgtaagcattgaggttgacggcaaaaccgttaataaggaatatgccgtatcaaaaatcagcaacagacagtcgttcttgctgataaacggcttggaacagggtaagcatactcttaaattgactgtcgtaagcggaagctgttctgtcgatgcggcacaggtgctgtacgattatgaggctgtgaataaagccgtaaccaacgaaacgtcatcggtagccgaaagcacagattcatccgacagcgttcccgaagctaacgacaaatcagcaaaaagcaacggcggcgacagcggtaaaggctcattcccgtttgttcccgttgccgtaggagcggctgctgtggctgccgcaatcggcgcaggcgttgcgatagcaaaaaagaaaaagaagaaagattgatagtcaggagggcatattatgtcaagatttgagataagagataagttttatttggagatccgttttgttttttcttcctgttttgcccataaaaatatgcacctccaaatgtgtctaacttttggggtgcatatcaattcttgggtttcggttcgactttacttgacaaaagccgataaatatagtattatactgatatatgtaaaaggggagtggtgcgcttgtatttcggtagtgtcagattttttaagcatcttattctgactgtaacggcattactgataatagtgcctacggtgctttgtatattgcttgcagttgacaacggcaaaaagtcggatgagatagataggctgaattctcagctttctgcacagtcgcaggtgtcacagacatcggacgatcagagcagaacgtcttcggcgacagaaagctccgacaatgttaaagcggagccttctgtgaccgaaagcgcaaagccggaaacatcggcggctcccgaaacatcggcggctgtcccggaaaccacaaaggcgcctgaaacaacgtctgcttcatcatcggcggttgaaagcaccgacagttccgtgtcctccggtgcggacagctatacttcacttttcccaacgctgtatgcagataaatatgacggcgaatatgaaaatagcaaaaacaccgtttatcttacatttgacgacggtccttcggtacttacggaaaatctgctttattatctgagacaggaaaacgtcaaggctactttctttgtagttcccgaaagaacagagtattgctattcattactgagagaaataagcaatgcgggacacacgataggaatacattccgcatctcacgattacgaaaagatatacgcatctgttgacgcatttctcgaagatttcaacgaagcgtatgagatagtccttgaggctacgggcaaagcacccgacatttacagatttcccggcggcagtgtgaacgattataacgaaaagacccgtgatgatattatcgcagagatggatcgcagaggttttacatatttcgattggaatgtggacagcaacgactggcagggttacggctggacaacactgtacacaaacgttttaaaagacgctgaggaattttcctcgcccgtgatacttttccataatacaggcgaccgtgataatacggtgcttgtgatagaggatataatcaaggcgcttaaaaacaaaggctataaattcggcagtctttctcagaagataaagccggttcaattttaaattctgatttcaagaaagggataacaatgggaatcaaggataatttcacacaggctatgaaggagctgacgaatcccagaccgtctgacgctcgtaaagaggtcagggacgttgcctcatacatgaatgatactgccgacgcacagccgacagaacctgtacaggccgtacagaatactcagccgtccgagaacgaacagcccgaacagcaggcacagcagagcgtgaaccccgaaacagcgggcaacggctttgcacagcaggagcaggcacaggatttttctcagagaatagcccgtgatatgaatgaacaatacactcagagcaactcgtttgatcagaatgtacgcagcgacgcttttacgcagacacctcagaacaacggattcacaggcggccggaacggatttgcacagagcggttcagacaatggcggcaacaatccttttatgagtggtatgagggctgataattcgcaggaaatgaccgttatatccaaaaacactatgatagacggtaatgtgcgctcgtttgcagatatgaagattgacggcaatattaagggcaacgttgaaacgaccaagaatataactataaacggcaaggtcgtaggcgaccttacctgcgacaatatcagtatgaaaaattcggctgtacagggtaatgtacgtcttaaaggacaggctgtaatggctaacgattcgatgctgataggcgacctttcatcacaggtggcacagctcaacggtaagataaagggtaatatcgagatttcaggcaagataatgcttgacagggattctgtcataatcggtgatataaaggcaggctcaatcgcaatttccgacggtgcggttatcaacggctttgttaccacgacttatctttcaaaggatgaaagcgccaacatcttccctgaaaatatcgcactcggagattaagcataaaaatattgaagccctgcattgcggggcttttatttgactttaactgaaaaggaggttttgcaatgacgcagaacaacgaaacaaaggtactcacacccgagcagattgaaaataacaaacagcagataatagatatttacagaaattgcgttaaaagagaaggctcggataaactgctcgactatcttataaacaagagcgatttctttacagcccccgcaagcacacgttttcacggtgcgtatgacggaggacttgcacatcattctctgaacgtttataaatgcttcaaggcttatcttgaaagagatcgtgtccgtgagctgtataatctcaatgcaagtgatgaaacgatagcggtatgcgctttacttcacgatatatgcaaggtcaatgtctacacaagaggcacaagaaacgtgaagaacgaagaaacgggtcagtgggaaaaggtgccgacattcttcttcgatgacggattgccttacggtcacggcgaaaagtccgtttatatgataacgggctttatgcgtcttacccgtgaggaagccttcgctatacgctatcatatgggattttcgggcgaagaaaatgcaaacaacgtgggaaaggcattcggaatgtttcctcttgcgtttgctctcagcacagccgatatggaagctacatatttccttgattgataatacgcaataatataaaagagcagtcgctgtcacacgattgctcattttgttatgtgatgctcgcttagaaattaataacccctaaatgttccagcaggattttagtaccgataagtatcagtatgatgccccctgcaagctccgccttcgacttgtactttgtgccgaatacatttccgaccttcagacctatcgctgacaggataaaagttgttgctccgatgaacaggacagccgcagctatatttacatcgggaagaagcgcaaaggttatgccgaccgcaagcgcatctatgcttgtcgctatcgcaagcagcagcattgtcttgaagctgaatgatgcatcgagtttttcctcgtcctttgaaagcgcttctcttatcatatttcctccgataaagcacagcagcacgaatgctatccagtggtcaacggctgtgatatattgctcaaaggttgagccgagaagataacccacagcaggcatcaatgcctgaaaaccgccgaaccaagcgcctattatcagataatgcttagctttaagctgtcgctcggacagccccttacagacactcaccgcaaatgcatccatagaaagtcccacagcgataagaaataattccaacagtcccataatttgtcctccggtgttttatcttaggcaataccgcataattattgtcgtgcgattgcgcagtcagatttttcgtcagattgtataaattgagtgcaggcaggcttgcgcctgtcaagcgaaatttgtgcaagatgacgggaaatatacaagtaagcgtgcggcaaaggcgatagccgctaattgtgcggtattgcccttaatcttatgcgggagcctgatgcgaaatgtgcaataaaaaagacctgagtacagttatcctgtactcaagtctcaacatttaagacaaaccagacgtgattaaagagcattatcaccgtcagtatgttgacttgtcacggtattccgctgtctactcccttaagttatcggtattatagcacaagcgtcagcaaaagtcaagcgttttatacttctccgacaatgcccgatattcccttacagcacagctttccgtccttgttgacaaacatatctgttctgccataagctctgcataatcttctttcctgcggttacaatatctgtaacttaagaaaaggagatgtttttatgcaattatccgaatcaaagacccttgagaacctgaaaaccgcttttgcaaacgagtctgcggcgatggtgcgttatgagatatttgccgaaaaggcaaaacagaacggcgatgaggaaatatcgcaggttttccgcaccacagcaagaaacgaaaaggctcacgcacaaatatggctcggacttatctacggaggaatacccgaagcctctgatgctcttgaaaaggcgatgcacggcgaaaactacgagtggacgcagatgtataaggagtatgccgaaaccgcaagacaggaaggacttgacaatatagccgatctgtttgaaaaggtgggcgatattgaaaaggagcatgaaagcagattcaagctgttcgtgaataagctgaccgacggaagcctgtttacctcctgcggcgaaacggtgtggctgtgcaggaactgcggacatatacattgcggaagtacccctcccgaatactgccctgtctgcagaaaaccgcagggatattttcagcgaaaggacgacagcattctgtcttagcctgcaaaaaagcaaaggagcggcagtatacgctatgtagctgtcgctctttgctttatccggatttacggaatttacacatattgacggttatacgcaattctctcttgcattactcacggcgatgtagtataattattatgatagggcagatatgtccgcagtacagctataagcagaaagaggaacagtatggcacaggaatttaccgtatcgttacaggcgataatcgacgagtgcaagctcgaggttatccacacaccgcaggaccctgcaaagatattcatttcaaatattgatgtaaaccgacccggacttcagcttgcgggattttacgaatatttcgacaagggcagaattcagataataggcaaggcggaaaccgcatatcttgaacagtgcggagcagagataagagcgcagagaataaagaaattcttcagcgaacagccggcggctgtggtagtgtcgagaggtatggatattatgcccgagatgcgtgagctttcaaaggaactgagcgttccgcttttacgcagtgaggaaagcacctcgacgttcacgtcaaagcttgttgcttatttaagccttcagcttgcgcccagaatcacacgtcacggtgttcttatcgaggtatacggcgaaggtatgcttattctcggcgagagcggagtaggtaagagcgaaaccgccatagagcttgtaaagcgtggtcaccgtctggtagctgacgatgccgttgaaataagaaaagcgtcaaatattactcttgtaggcagttcgcccgataatatccgtcactttatggagctgagaggcatcggcattatcaatgcaagacagcttttcggtatgggtgctgtaaaggtaagcgaaaagatagatatggtagttgaacttgagctgtggaatcccgaaaaggtatacgacagaatgggtgttgacaaccactatgtttccatactcggcgtaaaggttccctcgctgactatccccgtaaagcccggacgtaaccttgcggttatacttgaagttgcggcaatgaacaacagacagaagaaaatgggctacaacgccgcacaggagctgcttgacaatctcggacttgatatggagagcagtgatacagtcaagagcatgggctgataaacagaaaaatataaagataaataacagtctgtcgaaaaactatataatttaaaaatggggtttggggcatagccccaagcggggtgagggcggcagccccacacttagccccggcacggatgccgggcgtgtatgcacaagggctttgcacgatgcaaagccaaccaagcatacacagcctttcaccgggggaaaggggtttggggatagggattgtaaactagcaccttatttttaaaaaagactttttctacaatctgagataaataaatgtgtaagaatagataaaagaaaggatatgaccctaaaatgaaattcgttgctgatatgcacactcatacgttggcatcggatcacgcatactcaactataagcgagaatgccgcttcagccgcaaaggcgggactgagctatctcggcatgaccgaccactgcataaatatggaggattcgccgcatatatggcatttctgcaatatgggcgttatacctcatttcctgtcgggagtgcgtattataaaaggcgttgaagcagaccttacaggatataacggcgagcttgatataaacgatgatatttattacaacgttgagtggataaatgcgtcgatgcacaacccctgcataataccgggtacggctgagcagcacacaaacgcatatataaaggttatggataacccgaaggtgtgcgtcctcggacataccgaatcggcggattatccgtatgattatgatgcggtgacaaaagcgtgcaaagaaaagaacgttgcaatggagttcaacgtcagccgtttcagaagtcagacctctatacagcgtctgcacgatattatattgccgacctgtgcaaaaaacggctgttatgttatcgttgactcggatgcgcatttctgcgacaagataggtgcgttcaaaaaagctgaggctcttcttaaggatattgattttcccgaagaactgatagtaaatgccgatcttgaacgctttgaaagctttctcaggctgagaggaataaagacaaattccgaaatagagccggatgaagactgacggcgaataagcataaaaagcaaggaatatattaaatatcggaaggaaatataacataatgtacaacataggaattgatcttggcggaacaaacataaaagtaggagtggtaaatgacgatttcaaaatcgtaggaaaatcaaacataaagacagacctgccccgtcctgccgaagaaatcgcagacagcatagcaaagggtgttgagcttgcctgcaaggaagcagggatcgatgtaaaggacattaacagcatcggtataggaacaccaggagtagccgacagaaacacgggtgtagtgctttattcctgcaatctgggatttaacaataccgatctcggcggacttttaaagcaccgtcttggcactgacatatatgttgaaaacgatgctaacgttgccgcatacggagaggttctcggcggagcggcaaagggatataaagacgttgtcgtaatcacactcggtacgggtgtaggcggcggaattataatcggcggcaaaatatacacgggcttcaatttctgcggtgcggagcttggccacgttgttatcgaatataacggcagacagtgcaactgcggaagaaagggctgttttgaagcatacagctcggctaccgcacttatcacagccacaaagaaggctatggaagaagataaggacagcgcaatgtggaatatagcaggcagtattgacaaggttgacggcaagactgcatttgacgctatgagagcgggcgacaagagcggtaaggctgttgttgacgagtacctgaattatctcggatgcggacttacaaacgtagtaaacacattccagcccgaaatgctgcttatcggcggaggaatctgcaaggagggcgactatctcacaaagccgctcgaggaatatataaagcgtgagagctactgcataaaccccgaacgttcaaccgttctcggcatatgcaagcttggaaatgacgcaggtatcgtcggagcggcaaatctctacagactcaaggactaaaggctcataaggggaagtttatttggcgtaaaacgcaaaaaaataaatttacaaggagtatgctttgaacgattacagcatattggagcagaccgccgggaaatacggcgcagttgtgcttaaaaatgaacctatgaaaaatcacacctcgttccgtatcggcggaccgtgtgatgttatgataaagataaattgcgaggcgttgctgtgcgagcttataaagcagtgccgtgagaacgatattaaatactatgttgtcggcaggggaagcaatatccttgtctgtgacgaggggcttcagggagttgtactgcttataggaagcgacttcggctcggtgagagtagacggtgaatatatagagtgcaacgcaggcgcatcgcttgcggctgtctgtgctgtggctcttgaaaacgagcttacggggcttgagtttgcatacggcatacccggttctgtcggcggtgctatttttatgaatgcgggagcttacggcggcgagatgaaggacgtggtcgtatcctgccgatatatcaccgagaaaggcgatataaaggaaattccgcttgaaaaaatggagctttcctacagacacagctttttttcggagcgtaacctttgcataacatccgtaaaaatgaagctggcaaaaggcgagcgtgaaaagataaaagaccgtatggatacgctgatggagcgcaggaaggataaacagccgctcgaatatccaagcgcaggcagtacattcaagcggcctgagggcgactttgccgcaaggcttatagaggtctgcggacttaaaggtacagcctgcggaggcgcagaggtcagcacaaagcacagcggatttataataaataaagacaacgcaacgtttgatgatgtaatgggcgttgtggaaatagtaaagcaaagggtgaaagagcagacaggcgtaacgcttgaatgcgaagtgcttataatgaagtgaaattttcggataagtgccttagatatgtgaccggacgagataagacaaggctttatcggaagctgactggtatataaataaaacggcacaccaaaatcattcattattcattaaaaaagataaagggcgcagggaaaggaacacaaatgaaaaccgaatttgttatagtaacgggaatttcgggtgcaggcaaatcctgtgcggtaaatgttatggaggatataggctatttctgcatagacaatatgccgcctcagctcataccgaaatttgccgagatatgcgaagaaaacgatgatatttcaaaggtcgctattgttaccgacattcgtggcggaactatgtttctgaacctcaacgccaccatagaggaactgaaaaagcgtggtcttgacgtaaaactgctgtttgtggatgcaaaccatcatgtagtaaaacagcgatataaggaaacacgccgcaagcatccgctttttgatgcgacaaacggcgacatagacaaggcgatagacgcagaaagggagataatcgagcctctgcgtgaaattgccgattattacattgacacaagcctgatgtcaacctctacgctgaaggaaaacgtgcttaatattttccttgacacgccgtctgacagtatgactataagctgtatatccttcggcttcaagtacggtgtgccgaatgaggcagaccttgttttcgatgtgcgttgcctgccgaatccgtattacatacccgagcttaaggaaaagtcgggacttgacaaagaggtaagggattatgtaatgagctttgaaagctcgcagactttacagacaaagctgttcgaccttatcgactttctgatacctcagtatcttcacgagggaaaaagccagcttgtaatagctttcggctgtacgggcggcaagcaccgcagtgcgacatttgcggaaaatatgtgcgagcatctcagtaaaaatcaccttaaagcaagggtgcttcacagagatgtgaataaggataagaagtaacgataatcaaccgacagcggataaatgtgaactgatttcactttaaaaggagcgattctgatgtcatttgccgccgatgtgaaaaatgagctgtgcaaggcggaacacagcagaaaacagcttgagcttttgtcaaagggagcggcgtatgccatgacggaagacggcgaaggctgtttttttaatacggaaaacaaaagggtagccgatagcattgccgatgcctttgattcggtcggcaaggaatattcgaccggtgaaagcaccttcagaggaagaacgctttacacggttactcttgcggataaaagctacgcttaccctatgcccgactgttcgggagatgacgctttcggcgtgtatctcagagggattttccttgtctgcggactggtcgcaaatcccgaaaaaggctatcagcttgagctgttcctgcacgatgagagcaaatgcagaacattgctttccatgatagaagaacacggcatgggggcaaagctgtcaagccgcagaggcagcagctttctttatatcaaagagagcgaaaagatctccgatatgctgacctatatgggcgctatgatgcaggcaatggagataatgaacgtaaaaatctataaggaagtacgcaacaacgtcaaccgaagcgtcaactgcgaggcggctaaccttgacaagactatcgccgccgcacagaagcaggcggacgatattaattacatattcgaaaaaagaggagaagggtatctgcccgacgagcttttgcaggtagcgaaaatccgccttaccgcacttgagctgtcgctgagcgatataggcaaaatgcttgagccgcctataagcaggagcggagtaaaccacaggctcaggaagataagccttatagcagatacactcagaggagaagataatcggggagagtaaaagtgagcggttttgtacatctgcacgttcatagtgaatacagccttcttgacggcgcctgccgtataagagggcttgttcgtcgtgcaaaggaaatgggacagacagccgtagcactgaccgatcacggcgtaatgtacggcagtatcgacttctataacgaatgcgttgaaaacggcataaaggcaataattggctgcgaggtgtatgttgcaccccgtacaagattcgacaaaagcacaaagtccgatatgaagcctcaccaccttgtgcttctttgcaaggataacgagggctataaaaacctttcaaagctggtgacgctgggctatacagagggcttttataataagccgagagtggacagggagcttttaagacgttattcaaaggggcttatctgcctttccgcctgcatttcgggagagcttgcaagaacgcttcttgacggaagacttgcggacgctgtgacgcttgtaaaagagtacagggagatattcggagaggactattatatagagcttcaaagtcacggcataagcgagcaggaacgcattctgccgtatcttctgcgtgtggcgaaggatacaggcacacagcttgtcgcaacaaatgacgctcattatgtcgaaaaagaggacagctatgtacagcgtgtgctgacctgcattgccaccaacacgacccttgacgataagaattcaatgcagtttgccaccgatgaattttacctcaaaagcgaggacgagatgaaagcactcggctttccgcagtcagcctatgacaataccgtaaaaattgcggaaaagtgcaatgtcagcttcacattcggacatactatcctgccgtttttcaaggcggaaggttatgacaacaacgaaatatactttaacgctcaggtaagaaaagggcttgtaaaacgctacggagatcccgtaccgaaagaggttcttgatcgtgccgaatacgaaatgtcggtaataaagaaaatgggctttatcgactatttcctgatagtagccgactttataggctacgctaaaagaaacggcatcgcagtaggtcccggcagaggttcgggagcaggaagcgtatgtgcatactgtcttgggataaccgatattgacccgatacgcttcaatctgctgtttgaacgttttttaaaccccgagcgtgtgactatgcccgactttgacgttgacttctgctatataagacggcaggaggtcatagactatgtcgtaagaaagtacggcagggatcatgtggcacagataataacattcggtacaatggcggcaagaggcgctatccgtgacgcaggcagggctatgggtctgccttacggcaaggtggataccgtagcaaagctgataccgatgtcgatgcactccacgattgacggcgctttgaaaagcgagaaggagcttgtgaagctggcatcatccgacaatgaagtcagcctgcttatagaaaccgcaaaaaagatagagggtatggcgagaaacacgtctatccacgccgcaggcatagtaattacccgtgaccctgtagcagactatgtaccgctgtatcagaacagcgagggcgaagttatgacgcagtacactatgaccgctatagagcggctcggactgctgaaaatggactttctcggacttcgttatcttaccgtgatacaggattgctgcaagctcgtagcgaaaacctgtcccgattttgacatagaaaagatacccgaaaacgatgctgaaacatacgatatgatgtcatcgggcggcactctcggagtattccagtttgaaagtgccggaatgacctcgcttttatcccgtatgaagccacgctctgttgaagatcttactgcggcattgtcactataccgtcccggacctatggattcgattccgacctatcttgcaaaccgccgcagccccgaaaaaatacgctacaagcaccctcttttaaagggcatccttgacgtaacctacggttgtatcgtatatcaggagcaggtaatgatgatatgcagggtgcttgccggctattcatacggcagagccgatattgtccgcagagctatggcaaagaaaaagcctgaggtaatggtaaaggaacgtgcgacattcgttgagggcgctgtcgcaaataacgttgacagacaggtagccgaagaaatattcgacgatatgatgagctttgcaagctatgccttcaacaaatcacacgccgccgcatattcactgctcgcttaccgcacagcatatctcagatgtcattattataaggaatatatggtcgccctgcttacaagcgtgataggctggggcggaaagaccgccgaatatatcggcgaccttgcacagcacgggctgaaactgctcccaccccatgtgaattacagcgaaaccggcttttcctgcgaaaaagacggaatacgtttcggccttcttgcaataaaaaatgtcggtgctaatatgatagctgatattatcgaagaaagaaccaagcacccgtttaagtcgctgtttgacttctgtgaaagaatgtcggacaagaatataaataaacgtgcgcttgaatcgcttatcaagtgcggagcgtttgacggactgggtaataaccgccgtgaaatgatgatttcccttgagctgatgcttgatacgctttcacagcgccacgatcttgaaggacagatgagccttatgggcgaagatgatgcggcggacgaaggcacgtttcagataaagcctgccgatgaatattcacacgcacagcttctgtcatacgaaaaggaaatgctcggaatatatatttccggacaccctgcagatccgttttacaggattgcccgtgaatccggatatgaaaatatcggcagtatacttgaaaacaacaaggataaacaaaatgtcagggtaacggcactgcttacatctgtccgcagccatatcacgaaatcgggaaagacaatgggcttcatcgtaatagaagacgcaagcggagaaatcgagtgccttgtattcccgaagctgtacgatcagtattcgtcaatgctaaggaccggtaatgtttacgctttcgagggtacggtatctgcggaggacgagggagaccccaagctgctgataaatgcgataacacagcctgatttggctaagctgcggaaaatgcacgaaagccgaaaaacagggcagaataaggcggctgtgctgtatataaggttttcctcccgtgacgatgccaatattcccgctgtaaaggcgcttcttaaagtaaacaaaggcaacactcttacgaagatatgttttgagaatacaagggaaactataaccttgccgcccgctctttccgttgatttgaacagtgattttatacaaaaattgaacgggatttgcggcaaaaacaatataatcataaaataagtcgaaaaaatgaaattaccccttgactaaattgcattttaggagtaaactaaggtgtgtgtaaaataatctcggagggtgacctctaaggaaggatgtacgatattatgaaaaagattggcgttttaacaagcggcggcgacgcaccgggcatgaatgccgttatccgtgcggtaacaagagctgctattgcaaagggtatggaagtcgtaggtgtccgcagaggatataacggacttatcaacggcgacattgttcctcttgatgcaagaagcgtatctgatataattcagagaggcggcacaatgctttacacagcaagatgtgcagagttcagatatgaagaaggtcttcagaaggctaagaagacttgcgaagaacagggtatcgagggtcttgtagttgtcggcggcgacggctcgttcagaggtgcggctgacctttctgcaagaggcatcctgagtatcggtgttcccggcactatagataacgatatttctatgaccgaatataccatcggttatgatacagctatgaacacagttgttgaaatggttgacaaactgcgtgatacagcacagtcacacgacagatgctccgtagttgaggttatgggcagaaatgcaggctacatagctctcaatgcaggtatcgcctgcggtgcgacatacattattactaaggaagaacccttcacagtaaacgatgttatcgctaagataatcgaaggacagaagagcggcaagcaccacttcatcgttattgttgcagaaggtatcggcggaagcgaacagctcgccaaggaaatcgaacaggcaacaggcgttgagagccgtgctacaattctcggtcacgttcagagaggcggcagccccacagttcaggacagagttgcagcaagccagctcggttattatgccgttgatcttctttcaaagggcatcggcaaccgtgttgtaggtcttcagcataacgaagttgtagactatgacattcaggaagctctcaagatgaagaaggaattccctcacgatctgtacaagatcgctaatgagatcagcttctgatttaaagaatgcttataacggttttccgttatataaaaagactgcaccgaaattttaaaggtgcggccgacagagtaggttaacgtgcgtaaagtgcctgagggacggggagttgtcctcaggacgaacactgaaaggtggcggtacgttttccgcatctcgctgttgcatataagagataatcgccgtatttatcccgcattatgcgattgcgtcagcttgcgtcattgaggaggtaaatatggcgttttttcgtaatttcaaaaagtcgtttgaggaactgaaatctattcgttgccttacagtaacggcgcttcttatcggtgtttcggtagctctgaaattcgtaatgattatgccgagcgaaacgctcaagataagctttgcgtttgtcggtcttgcggctatcggtatgctgtatggtcctgttgtggcaggacttgcaggcgttgtcactgatgtaataggctttcttgtaaagcctaccggtgcgttttcaccgatattcacactggtcgaagtcgcaggtgctgtgatttacggtatattcctgtacggacttaatcccgtgaagctcgatttttcaagcagatccgcatttttcggcggactcaagacaaacggctttcaggtgttcagaatatttatggcgaagttctgcgtcaatcttttctgcaatgtgttcctgaatacaattgcaatggtgataatgggctactttgcgccggaggtattctgggtaaagataacaacacgaatagtaaaaaatctcacgatgctgcctatagaggtattcatacttctgctggtgctttatcctgttatggtggcataccgtgcggcattcagagaaaaacgctcggcttgatacaagaaaagaggacttagtatgactgaacttggatttttaggcgcaggtaatatgggcagtgcgataatgcgtggcatctgctcatcggatatgcagataagcgtttcggcgtatgacaaggatacggcaaagctcgaagcactttcggcattcggagtaaagccctgcaagagcgaatgtgagcttgttaaaaagtgcgattacatattgcttgcggtaaagccgcaggtgcttggcggagtgcttgacactgtcgcaggggaagtaacgcacgacaaggtgataatctctatctgtgcgggaatatccgaggattttatccgcagtcatacaatactgagcgcaaaggtagtgcttgttatgccgaacacccctatgatgctcggtcttggcgcaagcgcaatatcaagagcggacggagtgaccgatgaagagtttgcttttgcaaagtcggttatcgaaagttgcggtatcgcagaggaagtgccgataaacaagatgaaagaaataatcgccgtaaacggcagctctcccgctttcatctatctttttgcaaaaggcttcgtagattacgcaaagagcgtggacatcgatcccgatgcggcacttaagctgtttgcacagtcgcttgtcggctcggcaaagatgctcacagattcgggtatgacggtagacgaacttataaaacaggtttcttctccgggaggaacgactatagcaggtcttgacaagctgtatgagggtaagctcacagatacggtcgatgaatgctgtaaggcttgtaccgcaagagcgtacgagcttgcaaaaaagtaaatattgttacggctgccgtatcttgcggcagccgtattattttggctgacattgttatctatacatatggtctccataactgagcctgttcggaaacgcagatacttttccgcaggcatactgtatttaacggcataagtcacttatcttgcaatgttaaatgccgggtgattatatccgttaatataaaaaccttcaatccgttcccggataaaccgctttcaaaattacaacataatcggttcatcacagaatataaaatttttgcaccgaaaaccgtaatgtttgcacgggttaagcccgtaattccgcataacaaagccacttagttagctgtttctaaccatttttttcttgactacaccgttttaccgtgatatacttaaatcgggctgattagctatatctaacagccgcagtatttttaacattttgttctttcacagtaaaacgcagatgataaaacctgtcggttttgttctgacaggttatatttaagcctgcgaaagtgctgaattacgcctgagatatacagattgcagaattaatcggaacagagcacaatgtttacggaggtcttgtcaaaatgacaatggatgaattaaaaccgggagaaagcgcatatatcgaaacggtcggcggaagcggagccttacgtcaccacctgcttgatatgggacttacacccgatgctgaaataaccttgcagaaggtcgcacctatgggcgacccggtgcagtttgaggtgcgtggatacgagcttaccctgaggcttgaggaggctcgcaaggtcactgtaaaaaacgtacataagaaagacagcccccttaaagccacaggatcaagacgaaatgatacacctcaccccggtgtcggagaatttgccaaatacgagaagctgcatctgaaacacggaatagtgcttgaaaaaggcgcaccgcttacatttgctcttgcaggaaatcagaactgcggaaaaacaacgctgttcaatcagcttacaggctcaaaccagcacgtcggaaacttccctggcgttacggttgaccgcaaggacggagctatcagaaatcacccggaagcgaccgttacggatctaccgggcatctattcgctttcgccttattcgaacgaagaaatagtgacccgtgattttctgctgaacaataatctcagcggtatcataaatatagttgatgcttcgaacatcgagcgtaacctttatcttacaatgcagcttatggagcttggcatacctatggtgcttgcgctcaatatgatggacgaggtaaaggcaaacggaggttctatccgtgtaaacgatcttgaacggatactgggaatacccgtagtgccgatttccgccgtaaaaaacgaaggtatagacgagcttatcgaccatgcgatacatattgcgagatacggcgaaaagcctgcccgtatggatttctgcaccgacagcgacgatccgcacgacccggttgccgctgttcaccgctgtatacattcagccgcaacactgcttgagccggatataagggcggcagggcttcctgtgagatttgccacaacgaagctggttgaggacgatgaacagataaagaaaaaaatcaccattcctgaggaaaagcacgatgctttcgatcaccttgtttccataatgcagcaggaaacaggcatggacagagaagcggcgcttgccaatatgcgcttcaccttccttgaaaaactgtgccgtgaaaccgtagtacgtccgcacgaaagcaaggagcataaacgcagtatggcaatcgaccgtctgttgacaggaaaatacacggctatcccttgctttttaggcataatcgcacttgtgttcttccttacgttctctgtaataggtgcggcactttccgacattatgcaaatgggcatagattttctcaccgaccttatcgacaaagggcttaccgcatttgaaataaaccctgtagtgcattcgctggtaatagacggagtatgcgccggcgtgggcagtgtgctgagctttctgcctactatagtaacgctgtttttcttcctgtctattcttgaagatacgggctatatggcacgagttgcgtttgtaatggacaggccgctcagaaaactgggtctttcgggcaggagctttgttcctatgctgatgggattcggctgttccgtacctgcgataatggcgacaagaacgctctcaagtgagcgtgaccgtaaaatgactatactgctcactccctttatgagctgttctgcaaagatacttatatatacaaccatcgcaggcgcattctttgagccgcagtaccgctggcttgtgcttgtaggcttgtatctgttcggcataatttgcggtattctctattcgcttatacttaaagtgacggtatttcacggtgaacccgtaccgtttgtaatggagcttccgaactatcgtctgcccggagtaaagagcgtctgtcagcttatatgggaaaaagcaaaggactttatccagaaagcgtttaccgtaatctttgcggcatctatcgttatatggttcctgcagacattcgacatacggctcaatgtggctgacagcgccgaaaacagcttgcttgcgatgctcggcagtctgtttgcgccgatatttgcaccgctgggctttggtgactggagagcgtctactgcactcatcacaggtcttaccgcaaaggaaagcgttgtttccacccttactcttctgctcggcggagatgtttcgcagatacagacgcttttcacaccgttcacggctattgtgttccttgtatttacgctgctgtacaccccgtgcgttgccgctatagcaacagtaaagcgtgagctcggaagtgtacgttctgccgcagtaacagtgtttatgcagtgtgctattgcgtggataatggcgcttcttgtacgctgtgtcggaatgattttcggcattgcataaggtgaaattatggatgagatgaatataccgagcattattctgcttgcgctgatagtaatcgctctcgtgcttgtaatcatacatattataagaaacggcggttgctccggcgactgttcggcgtgcaagggctgtaataattgcagcaattgcaaaaaaggcagaaaaagcaaaaagtaaaacatataccgaaaggcagagccgcggctctgcctttcagactgtcgatacacctatgtattttctgaaatgattgtgatgaggttccacctgttcccattccgaacacagtagttaagctcatttacgtcgaaaatacttggcgggtgactgcctgggaagatagatagatgccgacataaagaagaaagcacagttcctgtgctttctttatatattcctccttagctcagtcggtagagcgcgtgactgttaatcacgatgccgttggttcaagtccaacagggggagccattcaagcactgctcaggcagtgcttttttgttgtccgaaacgcttaacactgagctgcgaagtcggtggcaaaggctgagaagcgccgccggtggcggaagaagcgaacagggtttggcgcagcggtcggctttttgcgagaatacgagcagaaaaagacgggaaccgcaagtggaagcgtgacacggtccacgatgccgttggttcaagcggggcagtgggagccattcaagcactgctcaggcagtgcttttttgttgttcgaaatgcttaacactgaactgcgaagtcggtggcaaaggctgagaagcgccgccggtggcggaaaaagcaaacagggtttggcacagcggtcggcttttttgcaggaatacgagcagaaaaaggcggaaaccgcaagaggatgtgtgacacggttcacgatgccgttggttcaagcggggcagggggagccattcaagcactgcttatgcagtgcttttttgttgttcgaaacgcttaacactgaactgcgaagtcggtggcaaatgctgagaagcgcgccggtggataaattaagcaagtaaaaagttattttattcaaattccgattgacactagcaaattataatgctataatactgtatgtagattaagtaatgtcctgtcggttaaactatccgcagaacacatgaatttaaaggagaaaaaaatatgaaaacatgtccaaattgtcatgcacagcttgacgacagttcaattttctgcacatcatgcggaacacagttcggtgcagtaccccctcagcagaacgcagtaccgcctcagcagaacgcagtaccgcctcagcagaacgcagtaccgcctcagcagaacgcagtaccccctcagcagaatgcagtaccccctcagcaggcatttgttcctgcttatgatccttatgatcataccgctgaatttgatcctaaggatatttcagataacaaggtttttgctatgctttgttaccttatggattttatcggcatcattgttgccctcctcgcaactcactcatcaaagtacacaatgttccatataagacaggctcttaagataaccgttgtttctatcctgtctgtattcgttcttataattcctttcctcggttggattgcattcccgattttacagggaattatatgggtaataaagataatttctttcttccagatctgctccggcaaggctaaggaacccgcaattataagaagcttcggctttttaagataaccgtacatattctatgtataacacagctccgtgcattgaaaaatacacggagcttttttgcaaaccacagatcaatattcttgaaatccgcacggattaagtatataataaagtcagttcatctgaaccgaaatgctcatgccggatatttcacgggcagaagcaaggctaaagcatcaagaacaacaggaggtttattatgtttgctccaaatgaaaaccgttacgacaaaatggtctacaatcgactgggcaacagcggacttaaggtttccgcagtttcgctcggattatggcagaatttcggcttcggctcggattttgcgactgccgaggagatggtgcataccgcattcgatctcggcattactcattttgatatagccaacaattacggacatccctataacggaagtgcggaagaaaacttcggcaagattctcgaccgtggtatgagggaataccgtgacgagctttgcatttccacaaaggcgggctatgaaatgtgggacggaccttacggcgacaagaacggctcaagaaaataccttacagcctctctcgaccaaagcctcagacgcttgaagctcgattatgttgacatctactatcatcacattttcgatcccgacacaccgcttgaagaaactgcgcttgcgcttgacaatacggtaagacagggcaaggctctctacgtcggaatttcaaattacaacagacagcagaccgcagaaattcagaaaatattcaaagagctgagaacaccgttcatagtaaatcagccgtcatattcaatgctcaatcgctgggtggaacgtgacaatctcgataaatactgcctcgacaacaacctcagccttgccgtattctcaccgctttatcagggctttcttacagataagtatctccacggcgttcccgaagattcacgtcttgctaaaggcggcgcaccgtggcttgagggacagcttgatgatataatgctgaagcgtcttaatgctctgaatgaaattgcgctgagcagaggacagaagctgtcgcagatggcgctttcgtgggtacttcataataaggcggtagcaaccgtccttatcggcgcaagccgcccgtcacagatagtcgaaaatgctgagtgcatcaataagctcgattttaccgatgaggaaatatccgcaatcgaagccgttcttaaataaaggagaaaattatgccgttaaagatagtccgtgcagatattacaaaatttccttgcgatgcggtagtcaatgccgccaatgaatcattgcttggcggaggaggagtggacggcgcaatacaccgtgccgcaggtccggagctttataaagagtgcctcgcactcggcggatgcaggacgggcgaagccaaaatcacaagcggctgtaaaatgccttgcagatatataatccacacggtaggccctatatggcggggcggcgatttcggcgaaaagcgactgcttgaaagctgttacagaaattccttgtcgctcgctttggaatatggttgtgaatcggtcgcatttccgatgatttcggcaggagtttacggctatccgaaagaacaggcgttccgtgttgcgtccgatacgattctcgattttctcgccactcacgaacaggctgacgatatgacggtctatattgtcatttttgatagcgacagctttctaagggcaaacaagctgttttctgatatagaaagctatattgacgataattacgctcagagccataccgatgagccggctgaaaaaagccgcagattatttaggggaaagctgccggacacagcaaccacacattgttttcctacggtagcaaccgcacataaaaaagcgtttgacgatatgtgcgttcttgaagcagaagcggaaacgcaagacggtactcttgaggatgcactgggcagtatagacgagagcttctcacagatgctcctgcgcaagatagatgaaagcggtatgaaggattcggagtgctataaaaaggctaacattgaccgcaagctgttttcgaagattcgcagcaacattgattataagccgtcaaagcctacagcagttgcttttgcgatagcgctcggtctgtcgctcccagaaaccgccgagctgttgatgaaagcaggctatgccctgtcgcacagcaacaagtttgacattataatagagtattttatcaaaaacaacatttacgacataatcacaattaacgaaacgctgttctcttacgatcagatgttgctcggcgcataaaccagatcctgcgatccacatacgaatcgcaggatttttcatttgtcgcttttcatgcgaccatttttatttccccatatgctaaaatacagacagaagataagaaaacccaaatctgtattaataagcggaggaaaaaaccatgaaaaagataaacgttaaaacagcaagagcaaacaagataaatcattcgaccgagatggtattcatactcgacaggagcggctcgatggcaggtcttgaatccgacactatcggaggcttcaacgcaatgatagaaaagcagaaaaaacagcctggcaaagcatacgtttccaccgttctgttcgacacatcaacaactgtacttcacgacagagcggagctcaacaccgttaagccgattacggctgacgattactccgcaggcggatgcaccgcactgcttgatgcaataggcggagcaataaaccatataggaaatatccacaagtacgcacgtccggaggatatacccgctcacacaatattcgtgataacaaccgacggtctggaaaacgcaagccgtcgttacagcaagagcgatataaaacgtatgatagagcgtcagagatcgaaatacggctgggaatttctctttatcggagcaaatatagacgcaatagtaacagccgaatctttcggtatcggacaatcaagagccgtaaattatcacgcagataagaaaggcacaaaggtaatctatgacgctatttccgctccgctcaccgcaatgcgcagtaagggcaggatagacgataactggagcgaggaaatagaggaagatttcaacaaccgtaaataaagtaaataaaatcatcggcagactgttcgcaaggtctgccgatgttcttatttcgaaaacataatgtcaactttgtcaaggtcaagcatataatatgcgtgtctttcccttgtgtttttgatgagcaaatcagcaggtatactgctcagcttgtttcgcaccgaggagtaagacacattaaaaaagctttcaagctctttttgagatataccgttttctgaaaacagtgccgcttgtatcaacacataatacagcctttctatatctttatgatctgcattgggcagttttggacataagtcgccgtaaaaattgaatttatcaagcttatttttgatttcatcgtataattgtttcatagaaatatcgacaaggctaaggaacatctccgcaaaaggtgtaaggtcgcctttgttcaaaggatgattgcaggtatcaaaagcgttatagtacttatttatattttcttttatcgtataagaaatgtgataaccgataagactgttaagctcttttgacagaagataactgctgatgaaacggtctgttctgccgttgccgtcataaaacggatgaatatatccgaacagatagtgaaaaacagctatccttattaaaatatcacagtcggcatttgcaagaaaattcaacgatttatccattatcgatattatttccgattccggatgaacaccggtatggataaccttttgtgtaggcgaatatacatttacattgttttttctgaaaactgtgccgtcaggaagatttgaagggtctgttgcacttatctcatcgtaaaaaatatcgtcatatatttttcttatgtcccgtccggtacgcagaggtatttcctcattctgcgacaacgttgcatattttttgacaagtccgacaaaacgtttttttctgtctttcgttgaaagatcggacagtatttcatttatttcttttcgtgtgctctgtacaccttctatgttgttcgtaagcacgatttcgtctgtaagacaacgtgtacggtattgtataagagctctctcgggtaataccgagcacatattgacaattttggtattggtacgctcaattgaaataatactgccgaacatttctttcgtctgacataagaaagcggcattgcccgaaatttctatatcaagatgaacagtatcatcgtcattaaagcgtttttcatattccgatttataagcttccctatcaatatgaaagagttttttaagcggcatttttttcataaagcaacctcctttgttattatagtacgattgtaacacatttattcacaaaaatcaacgatttttgcaaattacacacctaaaaacgttaaaacttcacaaaaaagccctgtttttataaagttcgtgtgaatagcagcattaaagttttaaaagtgagcagattttataaatcagaaagctattaacattatttgagcttaatttactgattctgacccgttatgacctaaagcacatcaaaaccgttcaattttattcaaattgcacaaaaactcttgctatatgttgtctaatacaacaaaaatcacgcttttttgaataaatctgaacgaaagtgcttgattttgaacttttaacgtgttattataagctcaaggacagagagtaaagtccaaaagagcttaaaacagctcaccggattaatatcatgatatttttaaagaggtcttaatatgctgacagaagaacgacattcaatgataatcaaagcagttaacgagcgtgcaagcgtaactatcgcagagctttcggagattcttaacgtttctgcgtctaccgtaaaacgtgatttgattattcttgcaaatgagggcaaaataatcaaggtgcgaggcggcgcaatgtcaaagaacgacagcttctcgtcggtagagaaaaacgtcgaggaaaaatccgcaatctgcaccgaagaaaaaaattcaatcgcaggatatgccgcaaagctgattgaaaaaggtgactttgtttttcttgacgcaggcacgacaacggagaagatgatagatcatcttaccgtcagagatgttacattcgtcacaaacggctttattcacgcaaagaagctggcggtaaagggctacaaggtctttatcacaggcggcgagataaaagccagcacagaggcgattgtgggagccgagtgcgtactcacgctgaaaaactacaatttcacaaagtgctttatgggcacaaacggcatatcgctgacagccggctttacgacccccgacgtgaacgaggcaaaggtaaaagccgccgctatcgagagcagccgtgaggttttcgttttagccgaccattcaaagtttgatgaggtaagctcagcgacattcgcaggactcggaaaggctgtcataatcacagatatgatccccaacagaaagtataaagaagcggcagacattacggaggtaggacaatgatatatacggtaacatttaacccggcggttgattatatcgtgcgtacaaaagcgcttacggcaggagcggtaaaccgctcggaaagcgaggagatatacttcggcggaaagggcataaacgtttcgctggtattatccgagcttggcgtaaagtcaaaggcactcggtttcgttgcaggcttcacaggtgaggcaattgaaaagggtatcactgaaaagggcatagatgccgactttgttcatcttgaaaaaggcttttcgagaataaacgtcaagataaagtcggacgaggaaaccgagcttaacggacaaggccccgagataacagctaaagccatagacctgcttttcacaaagctggattccttgaaggcgggcgacacgctggtgcttgcaggcagtatcccctcatcacttccctcagacatttacgagcgtattatggcacgtctttgcgacagagggataagatttgtggtagatgccacaaaggagctgttgctgaacgttctcaagtacaagccgttcctcataaagcccaacaatttcgagcttggcgaaatgttcggagtagagcttaagacaaacgaggatataataaagtacgcaggaaagctcagagaaaagggcgctgtaaatgtccttatttctatggcaggcgacggagcgatacttcttgacgaacacggcaagacccatatctgcggagtatgcaagggcaaggtaagaaattccgtaggtgcaggcgattcaatggtggcaggctttatcgcaggctgtgaaaacggcgactatgaatatgcgcttaaacttggtacagcttccggcggagcaacggcattttccgacggacttgcagaaaagaaaacaatagacgagcttatggagcagttagcttaaaccgaaaaaggaggaaaagagaatgagaatagttgacttattaaataaggacagcattcttttaaacggtgcgccgaaaagcaagacagaggctatagatatgctggtcgatcttcagatgaagagcggcaacatatccgacagagagatatataagcagggcattttagcccgtgaggaaaaaggctcgacagcggtaggagagggcatagcgatcccccacgcaaagagcagtgcggtaaaagccccctcgcttgcggctatgaccgtgccgggcggcgttgattacgaagcgcttgacgatgagccgtcagacgtgctgtttatgatagccgcacccgatactgaggcagacgttcatcttgaggtgctttcacgtcttatgactctgcttatggacgaggatttcagagcaaagctcctttcggcaaaggatacagacgagttcttatcggttatcgacaccgccgaaaaggcaaagtatcccgatgaaccttcagctaaggaagtgcctgaaaatactgacagaataaaggtgcttgcagttaccgcctgtcctacaggtatagcacatacctatatggcggcagaggcactcgaaaaggcaggcaagaagctcggaatctctatcaaggtcgaaacaaacggctcaggcggagcaaagaacgttcttaccgataaggaaatagcagagtgcgacggtatcatcgtagcggctgacaagtcggtcgagatggctcgctttaacggtaaaaaggtgctttcgacaaaggtttccgacggtataaagattcccgaggagcttatcggaagaatagaaaagggcgacgctcccgtttatcatcacgagggcggagcggcaagctcatctttatcttcggcaaacgagagcttcggcagaaagatatacaagcatctgatgaacggtgtatcaaatatgctcccgttcaccgttgcaggcggtatcttcatagcgcttgcattccttatagatacgctgatgggcgtacagcctggcgataatttcggtactgtaactcccgtagcggcattcttcaagacaataggcggttacgctttcaactttatgatacccgtacttgcaggctatatcggtaagagtatagcagacagacccggcttccttgtaggacttgtcggcggctatcttgcaactacaggctcgaccttcgtcaagataggcggcgatgttccctcaggcttcctcggcgcactctttgcaggctttgtcggcggatttattatgctcggacttgaaaagctctgcgacaagatgcccagagcccttaacggcatcaagcccgttctcatttaccccctcgcaggtcttggcatcatagctgtagtaatgtgtgcgataaatccctttatgggcatcatcaacactgcgatagccgatttcctgaaccatatgggcgcagagagcaagatattcctcggtgttatactcggcgctatgatgtctatagatatgggcggaccgttcaataaggcggcttatgtattcggtactgcggcaatagcaacaggcggctacgatataatggcggcagttatgataggcggtatggttcctcctattgcgatagcactttcaacaaccttcttcaagagcagatggacagaagaagaacgcaagaacggccctgtaaactatattatgggacttagcttcatcacagagggcgcaattccttatgcggcggcagacccgctcagagttattccggcttgtatggtaggcgcaggcgttgcaggcggtctttcaatggcattcaactgcacgcttatggcaccgcacggcggcatcttcgtattcgccgttgtaggcaactggcctatgtaccttgtatcccttgcagtaggcgctgtagtatcaatgttactgctggcactgcttaaaaagaagaaaacggtaaaagaacccgaaacaaaaaacgttaagtaaataaaaaggagcgtatcacaatggtaacaaagacagtaacagtagtaaacgagcagggacttcatatgagacccgcaggacagcttgccgcagaaatgaagaaattccccggttgcacgataactatcgcaagcggcgataagacagcaaaggcaacagccgtaatgcagataatggcggcaggcctcaagaaaggctcaatcgttgagatcaccgcagacggcgataacgagcaggcggcacttgacaaggctgtagagcttttcgaaagcggcttcggcgaataagaaagactatcggcttttaccgcactgtcaggcggtgcggtaaaaccgttatccgataaaaaagggggagcaataatgaagaaatatcttggcaaaggcgtatacggcgcagtggcaataggaaaaatatccgtgttcaaaaagtgcgatgcggcagtaacacgcatacacgttgaagataccgaaaaggaaaagcagagagtaaaagcggcaaaggagcttgccgcaaaacagcttaccgagattcacgaaaaagcactcagagaggtcggagaaactcacgcacagatattcgagattcatctgatgatgcttgatgatgacgattacaacgagtctatcgaaaacataatagatacccagtcggtaaatgccgaatatgcggtagcgcttacatcggataactttgcaggaatgttctcgtctatggacgatgcctatatgcaggcaagagccgcagatgtaagggatatttccaaccgcattattgcaaacctgacaggtgcaaataccgacagcaccacggccgatgaaaagtctatcgtctgtgcggacgatcttgcgccgagcgaaaccgtttcgcttgataaggacaaggtgcttgcattcgttaccgctcacggctcgtcaaattcgcatacggcaattctcgcaagaaatatgaatatccctgccgttatcggcgtgggcgacagctttttaagcgagataaacgagggcgatacagccatagtagacggcttcacgggcgagattatagtttctcccgatgagcagaccttaaaagcctataccgaaaagcaaaagcgtgacgaggagcagaaaaagctcctgcaggagcttaagggcaaggagaatataacccttgacggcactaagataaacgtgttcgcaaatatcagcggcattgacaatataggcgctgtactgctgaacgatgccggcggaataggacttttcagaagcgaatttctgtaccttgaaaattccgatttcccgacagaagaacagcagttccacgcttataagcgtgtgcttgaaagtatggcaggaaagaaagtaataataagaacgcttgacataggcgcagataagcaggtggactatttcggactgaaaaaggaagaaaaccccgcactcggacttcgtgccatccgcatatgccttacccgcccggagatattcagaacacagctcagagccttgttcagagcgtccgtttacggcaatctcggcataatgttccctatgataacatcggtgcgtgaggtcgagcgtatcaaaacaatctgcgaggaagtaaaagcggagcttaagtctgagggcatcgagtattccgacaagaccgagataggtataatgatagaaactcctgcggcggcgataatcagcgaccgcttagcccctatggtagacttcttcagcgtaggcacaaacgatctcacacagtacacccttgcctgcgaccgacagaatcccgatgcggaggaatttgtcgatactcaccacgaggctattctccgccttatcgaaatgagcgcaaaaaacgcccataagaacggtgcgtggataggaatctgcggcgagcttgcggcagataccaccctcacagaaacattcttacgcatgggcattgacgagctttcggtttctccgacattcgtccttaaggtccgtgacgcagtaagaaaaacagatctgtcaaaataatatttgcttacatcgaaattccaatataaagattacagcagctgcgctttctcccttgcgtgagctgctgtaatttttattccccgtttcacaggcacagcaataacccgccgtctttttatcaataagcataatattacgggaaataccttaaaatttcggttgacattgcataaaaaatatggtaaaattagtttgaaatatagtctacagctttatggggaggttagactgatgcgaagattgatgcaacttaaaaataaaaaaggcttcacgctggtcgagcttatcgttgttcttgcaatgataggagtgcttacagctatcatattacctctgtcgatgaatgcgggaaagccgcaggcggcagttgccaaggcaaagagcttctacttcggctcacagaggatacttatacagtacagggcagattcacccgaattgcagacaggctacctgtcctataaaaaaggcgcaatgacatataccataaataccggcgactatatgtacatctgcgcaaaagccgagaagaacaacggcttcaccgagcttaagctggcaaagctgtcagcaccggcagacggcactgcggcaaaccccgccacaggctatacacagtttcagtttgcggctgagataactgcctcaagcaccgaccactctttgcttgataagctgaacacattctcgacggatgatgacgagggatattactatgcgttggttgacgatcagtgcaaggtcataatgacctactggtgcgaaactttcatagatgacatcagtaaatcaaccgacaccgcctcaacatattcaaagactactatcttccccaccgacaattattatgtggacggttatcttttcggcgcttaccccgaaagatactctatgcttggatatactatgttcagcgaagtcgatcttccggcagatccgtctgcatcgactacagcttccgcaacacccgctcccgcaggtccgtgattttaaaaatcgtcaattttgcacccactgttccggtgggtgcttttgttataattatgcaatcgccgattccccctatgcatccgtaattatgcacaatttcctgctgtaaatcgtcgaaaataatcgttaaaaacagtagcggttagcaagttacaacttattgacaaatttaaagtatggtgctatactaaataaaaacaaaagtaaagtctgtgtaagaagatttgaaggcagattaaagtgcctgcggaatagcattgcggaacatatccgctgtgattccgtttttattatgtaaaggcagttagccaagactcaccgattagtgctttagcttaaccgcccgaacaaatcacacagacggtctctgtaaagagcgatgatataaggaggtccaattatgaactgggtaaaattaggtatttttgcaggcggcgtggcattcggctcggtcggtcttaagctactcggcagtaaagacgcaaagaaggtatacgcacaggttacagcggctactcttcgtgccaaggaatcggttatgaagaccgtcaccaatgttaaggaaaacgcaggcgacattctcgccgacgctaaggatattaacgaaaagcgtgacgctaagaatgctgttatcgaagacgaatgtgattgtgactgcggttgcgaagccgtttcggaagaagcgtaagaattgatagaaagccgacggtacgcttagtttgccgtcggttttttatatggagatgaccgaaaatgaaatgtaaaatacttcacgagtccaaaggcagactgcgtgtgcatcttttctgcggaaaaatgtcgctcgacaatgccgacgtgcttgaatattacctccgtgccgtaaacggcgttaccgatgtttcggtatatgaccgtacctgcgatgcggttatagtattcaccgacagaaaagcggtgcttaaagcgcttgccgcctttgcttttgaaaaggctcagaaaatgtgcttggttcccgaccatacatcgagaaagctcaaccgtgagtttgaggataagcttgtaatgacggtaattgcccgtttcatttcaaaaacatttatccctgctccgataagagcgttcatcgctgtaataaggtcatggaaatatataaagcacggacttaaagcgcttctcagcggcaaactgtccgtagccgtacttgacgccactgcggtgaccgtatcgctcttaagaggcgacttcaagaccgcagcatctgtaatgttcatgcttaatatcggtgagatacttgaggactggacgcataagaaatcggtggctgatcttgcaggcgcaatgtcgctgaacgttgaaaatgtatgggtaaaaacaggcgacaccgaaacgctcatatctataaataatgtgcgtgagggtgatttgatagtagtccgcacaggtaatatgataccgcttgacggtaaggttgcaggcggagaagctacggtaaatcaggcgtctatcacaggcgaatccctccctgtcagaaagagcgagggaagctatgtctatgcgggtactgtagtagaagagggcgaatgtgtcgtatgcgttgataaagctctcggcggcggaagatatgaccgcatagtaaagatgatagagcagtccgaaaaactcaaatcctcttctgaggataaagcgtcaaggcttgcagacagacttgttccatatacgctcggcggaacgatacttacttatcttctgacccgtaacgtaaccaagatgctggctgtgcttatggttgacttctcgtgtgcactgaagctctcaatgcctatagccgtactttcagcaatgcgtgagtgcagtaattataagataagcgtaaagggcggtaagttccttgaagctgtatccgaggcggatactatcgtgttcgataagacaggaacgcttacctatgccgcacctacagttgaaaaggtaattcctttcggcaacagagatgctgacgagatgttgcgtcttgcggcttgtcttgaagagcattatcctcactcaatggcaaatgccgtagtagccgccgcaaaggaaaaagggctcagtcacgaagaatatcattcaagcgtggagtatgtcgtagcacacggcatatccagtacggtggaaaatgagaaggttatcataggcagcgctcactttgtatttgaagatgagggctgtgtagtacccgagggtgacgaagagcttttcaattcgctgtcgggcgaatattctcacctgtatcttgccgtatccggtgtgcttgccgcagtaatctgtatatcagacccgctgagagctgaagcggcagacgccataaaggcgctccacgactgcggtataagcaagatagttatgatgacgggcgataacgagcagaccgcaaaggcggtagcggcaaaggtcggcgttgacgaattccacgcaggtgttctccccgaggataaggctaatttcataaagcgtgaacacgaaaagggcagaaaggtaataatgataggcgacggagtaaacgattctcctgcactgtccgaagccgacgcaggtatcgctataaatacgggagccgcaatagcaaaggagattgccgacatcacggtatcgtccgaagacctttatatgctggtaaccctcagaaaaataagttccgcacttatgaaaaggattcaccacaattaccgctttatcgtatcgttcaatcttatgctgatacttctcggcgtaggcggaataatccaaccgacgacctcggcgctgttccacaatgcctcaacccttgcaatcagccttaagagtatgaccaatctgcttgatgaagaagaaaagtaattatcaggattataggctcttgttataaccggtctgcctccgctgttctatctgaacggcggaggcagacttttaataaccccacacatcttaaaaatccggctcataccacaatcaacgcaaaaagaaccattgtctgagcaaccgatccgcaatgtaacgtattacagattataaaaaattacccatttgtgtattgcacgacctcaggttatatgatatactgaatacatcagtatgatatttaccaaaaacgaaaggaaaatacattatatgggagctatacttgaatacaaatgcccgtgctgcagcggaccgttacagttcgataccgatgcacagaagatgaaatgcccctactgcgacaacgagtttgacgcagaaaccctcaaaagtaacgatgacatccttaaggaagaaaagcccgatatgatggactggtcaagccagcccggcaacgagtggatgcagggagagcttgaagggcagaaggtctacctttgtaattcctgcggcggtcagattgtctgtgacgataccacaggagccaccgactgcccctattgcggaagccccgtagtaatggtaggacagttcgcaggcgacaagcgacccgatataataatcccgttcaagctggataaggaagcggcaaagaacggatttaaacagcacctttgcaagaaacgcctcttgccaaaggcattcagaacggacagctacatagatgatataaagggcgtttacgttcctttctggctctatgatgcccacgccgatgcgcaggcatatttccacggaaccaaggtcaaaagctggagcgatgacaagtataactacaccaagacatcgcactacaggctttaccgcaacggctcaatggactatgagagagtgccggttgacggctcaagcaagatggcggatgaccttatggagtcgctcgaaccgtttacggcagacggcgaggtggctttccagaccgcatatctttcgggctatatagctgacaaatatgacgttgattccaacgaaagcaacgccagagccaacgagcgtatcaaaaagagcacgcttgaccgccttacaagcaccaccaccgactttacatcggtaaccaccgaaagctcctccgtacagcttgataacggcactgtgaagtatgccttatatcccgtatggctgcttacagccaagtggaacggcgatatatacaacttcgcaatgaacggacagacaggaaaattcgtaggaaatctgccgctcgataagggtgcatactggcgctggacgggacttatcgccctgatagcaactgttgcagcacttgccgtttccgcatttgtattactgaattaagggggcttatatatgatgaagaaaagaattacagccatacttgcggcggcaataatagcagtcggagcatcggttcctgcctttgccgacagcgatttttacactgccggaaacgatgcacaggtgcttctgacagcacaggaagcgcaagccgataccgctctcgatactcttgatacaataagcgacgactctgcggcagtagtgctcagcgataactatgacaccgccgcaataaacgaaaccggcgaaacagagggcgatgacagcgacaaagctcccgtagcgacccgtgatattattattgcggtctgcatcagcgtagttgtcggaattatcatcggcttcatcggctcgggcattatgaagtcaaagctgacgagcgtcagataccagttcggagcggctgattatatggtacccgacagcttcaagctgaatgattcccgtgacgtttacctttactctaccgtaacaaaaaccgaacggcagaccgacaaggaccgataatgtaacaaggcaacagatactaaaaaacacaatatgccgtgcagccgcctcccgaaaatcgagcgtcaggctgtacggcatttttttatcggaaatgccgaataattgcctgtacggttggcttaattttgcgttacaggctcttgacaagaggcgaggataaaggtataattaaattaataataagcgtctgttgtagacaatttaaacctgtcgatgatacacagtagacttaatttttatcgcatatacggaatactctgaggcaagcagtcttttaagcaacaagcggttaaagttcgcttgcctcaaagctattccggagtgcgtagcactgaagtgcaaggaaaggaaaggtaaaattatggcttttatttactctgagccctcacacacattcggcgagtatctgctcgtaccgggctattcttcttctaagtgtatccccgcaaatgtttctctgcgtacacccgttgtaaagttcagaaagggcgaggaaagctctatctatatgaacattcctctggtatccgctatcatgcagtctgtatcagacgataaaatggcggttgcacttgctaaagagggcggtatatctttcatctacggctcacagtcgatagaggacgaggcggcaatggtagcaagagtaaagagctacaaggcaggctatgtaaagagcgactccaaccttgctcccgatatgacccttgccgatgtgcttgagcttaaggctaagacaggtcactcgacaatgcccgtcacaagcgacggcacagaacacggaaagctgttaggtattgtaacaagccgtgactacagagtatcaagaatggctaccgacacaaaggtatctacatttatgactccttttgaaaagctcattaccgctcccgcaagcacaacgcttaaggaagcaaacgatataatctgggagcataagctcaattcactccccatagttgacgataacggcgttcttatgtacttcgtattcagaaaggactacgaacagcataaggaaaacaagaacgagcttctcgacagcaagaagcgttacatagtaggtgcaggtatcaacacaagagattacgcagagcgtgttcctgctctcgttaacgcaggtgctgatgttctgtgtatcgacagttccgagggctactccgagtggcagaagctgactatcgactggatccgtgcaaagtacggcgacagcgtaaaggtcggcgcaggtaacgttgttgataaggaaggcttccgcttcctcgcagattgcggcgcagactttatcaaggtcggcatcggcggcggctctatctgcattacccgtgaacagaagggtataggcagaggacaggctacagcacttatcgaggtatgcgaggagcgtgacagatatttcgaagaaacaggcatttatgttcctgtttgctctgacggcggtatcgttcacgattatcatatgacgcttgctcttgctatgggcgctgactttatgatgctcggcagatacttctcacgtttcgatgaatcccccacaaacaagctgttcgttaacggtagctatgttaaggaatactggggcgaaggctctaaccgtgcaagaaactggcagagatacgatatgggcggcgacaagaagctctcgtttgaagaaggcgttgatagctatgttccttatgcaggcagcttaaaggacaacgttacacgctcactgtcaaaggtacgttcaacaatgtgcaactgcggttgccttaatatccccgacttccagaagaacgctaagctcactctcgtttcttctacaagtatcgttgagggcggctcacacgacgttatcctcaaggaaaaccgtggcgctcgcagcgaataagcaccgaagcggtgcgtcaaattcgccgttctgactgttgccgacaggcgacagttacgttaccggcggtgataatatgccactgcgtactcagatataattaaaaggatactgcaaaccgttcaggttgcggtatcctttttgcttatgagggaataaatctcattgcaacatatttcagataaagcagtattttagatgtatcgctaacactgccgaaaacatcttctgtaccgacaaggcatatataatttcgtgaccttatcagtgcaactgcactgacattgacctttcaaaaaaacgctactaacctgagatatatgtactaatctgcggacgggtagcgttaagcgtccctgaattgacagaatgtacaatgttcaggtagttttacgagttccgccaacaccccagcggggtaagggtatgggtaaggaaagagggatgccaagctgagcattgctttagcaatgctcccgctcctcacgtcgctcaagaggaataactgatttgggagaaaacctaagggctgccgccctcaccccgcttggggctacgccccaaaccccattttcaaaaattatataggtttatcgacagtctgagacagcgccgtccggcactgcctttaatgtttacaaatttattgcaattacgcctgttcgcttggggcaaagcctgttcttttcagagcctttgaaattgcgagagcggcaaagtatgcgagaactacgcttgctatatcctttataagatagggagcggatacgagcaggaagctggataacagatccttgcctgcaacgagagcgtactgtacaaatccgcagatatggcaagcggcaacgcctaagatgcccattgctattctaagcggtatacggaacttttcgggcatatttctgaatgcgattccgctgatggccgccatagcgataaagccgattataaatccgcccgtaggacctactattgaagcgattccgcccttgaagccgctgaatacgggaacgcctaccgcaccgagcagaacataaacgaccgttgaaacggttgctcttgccgtgcagagataaaagccgcagagggctatcgcaaaggtctgtaatgtaaccggtacgccggagggcatcggtattgctatctgcgaaagtaccgccgtaattgccgcaaagagcgcacaaagtacgattgttgtgattttctgtctgttcatattttttgtttcctttccattttgtcaaacgactttaacagaataccaccgacagcgcctcgtgtcaaccaaaccgcacaaatgggtgacaatcgagaatggtctgcgttataacttaataacataattgtacaaaataactaaaagttatgtggtaaatgtgtgaaaaatgcaaattgattttttggcgggaagaggttataataaatttattgagaatgttgtaaacttttaacaacactcataagaatgaaacatatacaatttgtttggaggtaattaaaatgaagatgagaagattcatcggtgcagcagctgcaatggcagtagcaggcacacttacagtaggcgcagcagcagaaacttataatgcttatatcggtttccagacagcaccctactcatttagaaactcttttgatgacgcttcatatggtaaggacgttgcagacggcaagtacttcaacagcgtaatcgtatggggcggtaacgaccctgaaacattccctcagtatgaagacaaattcgatgatgatatgccggatggtagtggcggctatgttattcctgctacatacacagatgtacagatcgacaaggacggcacatacaaggttggtattactgactttgactgggcacttgacagtgcatctgcattcaaccttctgttcgtttcaacagatattcctttcaacaaggatgcaggcgaagacggtgaatctatcgctaagttctctgactgcaagattatcgttgacggtacagtaacatcagaagttgctgatcctatcattgatacagaagacggtaagaagtcaggtcatacaaaggttctgttcgctaacatctggaacgatgctcttaagaaagatggttataacggtgcataccccacaaagtctttagagattgaatttacagtttcaggtcttgacgctcagcagcctgctgatacaacagctcccgctgacacaacagctcctgctgatacaacagctcccacagcaggcgattctacaaagcccaacacaaacacaggtgttgaaggcgttgcagcagttgcaggtgttgcactcctcgcaacaggtgcagtagtagttgctaagaagagaaagtaatcttaaaaagattaacgaataacgacagccctcattcgtgagggctgttttaatatcacgaccgaaagaggaaatatgaaaaaatctataatcagacgtgcgatagccgtgtttattgcggcgactatgcttgcaggctgtgcggcgcaggacagcggtgtattatcgtctgtcggaaacagctcggcgaccgaaagcaatatatcgtatgttgaggatacgagcagtgtcgatgaaaattccgaggttacttccgttgacagttcagtaacagagagcgacacatcttccgatacctccgaacaggaagaaagtaatacttcaaagcaggaaaatgcatcaaaggcagagaacaccgagaagcctgccgatacaacaaaggcaccgtcaactgccgacacgaaaaacaacagccagagcaagcctgcggcttcttcaagcaatttcactgttcagtggaagaagtcgagcagctgggaagaaggcggtaagaagtgcggaggttatgagattgttataaccaataacggcgatacggtgaacagctggacggcaaaggtgactgtccccggcaatacaaagctgatgtcgcagtggaacggaatattcagcatttctggaaacacaatgacggtcaagaacgagagctacaacggaactatagaaaagggaaagagcatttcgttcggattcaattattcggctgacgcttatatcaatgagggtaaagtgactgtgaacggaagtaccgcaggaacgagtgccggaaataacagcaacaataataacaatagcaataacaacaataataataatacgtcaacaatcaaaaagccggcggcaacagttcctcaggcgccgagcgaccctaaaggcactacgccggtatcacagcacggtcagctttcggtaaagaacggacagcttgtcgataagagcggcaagggttatcagctcagaggaatgagtacgcacgggcttacatggttccccgaattcgtaaacgagagcgcattcagaacgctccgtgacgactggaatacgaatgttgtccgtcttgcaatgtatgttgacgagtggggcaacggtcagtgctatatgggcaacaagagcggaagccttgaactgcttgaaaagggtgttgacatctgcatcaagctggatatgtatgttatcatcgactggcacgttcttaatcccggcgacccgtccaagtatacaaacgaggcgaaatccttctttgaaacggtgtcaaagagatatgcaaaatatccgaatgtaatttacgagatatgcaacgagccgaacggcggtgcatcgtggagcggtaatatcaagccgtatgctgaaaagataatacccgttatccgcaagaatgcgccgaactcggtaattatagtaggcacgccaacatggagtcaggaaatcgacaagccgctttcagatccgctgaactacaagaatgtaatgtatgcgttccacttctatgcggcaactcacgcaggacttcgttcaaacgtagaaaactgcgtggcacagggattgcctgtatttgtgtcggaattcggtacttgtgacgcatcgggcggcggtgcaaatgacttcaacgaaacgcagaagtggcttagctattttgacaagcaaggcataagctactgtaactggagtatctgcaacaaggatgaaacctgctcggtactgcggccgggaacatcggcaaacggtaactggagcgagagcgatctcaccgaaaacggcaagtggatgcgtaactggttgaagaagcactaagcggcgggtcgccgctgacaattccgaccttttgaaaggtttgcggttggctgggctttgtgggacggtcggggttaaacgatggctgaaactcaataaaacaaagcacccgtggggcacggcaaattccgacctttggaaatgtcggtagttggcgtgactttgcgggacggtcggggtttgacggtagctgaaaacaagctatcgaaatacttgtttgtttactcccgccgtcgaacaaatgtgaatatacagcaaccgtatttaaaggcggaaatgcgagccgaggcactcggcttccgaccttttgaaatgtcggcggtttgcgtgactttgcgggacggtcggggtttgacggtaactgaaaacaagctgtcgaaatacttgtttgtttactcccgccgtcgaacaatcgtgaatatacagcaaccgtatttaaaggcgaaaatgcgagccgaggcactcggcttccgaccttttgagaggcttgcggttggctgggctttgcggtaaggtcgggagtggacgatagcccgcaataatcggtaataaaaaatccgtgtcaggcgacacggattttttctgttatagctgtttttatatgtgcaagaccgtttgcaataaggcattgaccggggtaatagagggcaaggcagaaattcgagaacgggaaatctatttttgagaagtacgccatcaggagcattatatcggatataaggaacagcacactgccgagcgcaagtataaggttgaatctgttctttatgcggataaagttcattattgctttgcctgtcataatgcagattataacagcgtatgaaatgccgatgattttcatcataaccgagccaaagtcaagaagcggtgagaacatcataaacagcactatggggataaatattataattgcggggataaagtcggtcggacggggcttttgaatcagcgaatatgctatgaaataacagatgtgacctaatgcgaaaatcgccgctcctgcgatgaaatttaagtttatcgctatatctgcgctcattgcgaagaatacgccgacggtcagtattactgacggcagtttcttatcggggaagtatttcagagcgtatatcaggtttactacggcagcaagcataaagaaaacgcttgcggttatttttatcgggtagagatgagtaattatcagagctgtatcgcaagcaagcgataagccgagaaaaataatgttgagcggtaaaacgagttttttcatatatttgtttcctcagtctgatcattcagttcgatattgatttttcttgtgtatcgggatagcggatattctccgtcgtgggattctccgaaaaagtaagcggacatatttcccgcctgcgtaactcttgtaactcctgcacatagcaacaggtcggtaagttctgctctgtcagccttgtcgcagataagccctgcggtctgcaaaaatccttttgcgtttctcagtgtacgcattatgtcctttctcgggagcctttttacaagcacattgcacatcataggcgacagttcaagttcaaagtcgtcttttatgataaggctgcaattcttaccgtaaaatacgtcgggagaaatttgccgtatcccgattgcctgttcaagacgggcagagtagcttatgagcgtatctctcgcccgtgtgcctatagaggtgttcctgtgttttccgactgccgcttcaagatacggaaggaacatttcgcaaaatagggtaagctcggttttatcatcggtgtcgataaacacggtctggcaggaactgcagagcagttgctttgtagaggctatatgctcggcaaaagccgaaaattcatctgtatgatttgcataatcggcaatgtagcagaagccgagcttgtgtccccattcaatcagcttaactcccggcggagcaagtgaacgcactgcttttacggcttcagtaccgccccataccactatgccatcggcaaagcctgcaagcgtttggatggtacgcacatcgcttgacggggtatcaaagacatatatgtagcgtgacagcaaaggctcatatttgcaaagccgctttattatgcggattgacaagcccttatcggcggacggaagcttcagtatattgatattgcctgcaagaagtccttctgcaacgctcatcacgggtaagccgtcggcatttcctgcggctatgtggaacagaacgccgagaggttttgcctgaatttttattttcggagtgatgccgttcggagaaccgataaagccgtctgaatctccgagttcggttttcagcctgtattcaagattttcacggctgaggcaggcgagtataagctgtttatagtaactcacattttcaacgtcaagcgctgagagcatatcgtcaaaagcaccgttttctatatcagtgctgattttttcggcggcaagcatgacctgtttagcagaaagccgacagtttccgagagtgtcgcatattctgtcttcaaaacgggctaacagcttgtcgcacatatcgttttcgtatatttcgccatcaaagaaaatcatacgttcacaccctttattatctcttctgcgcctgccgcacaggtctttatatcctccggcgcaactctgccgacaatttcaagaaacggcgttttcagcccgcaggaacattcgcttccgttatgaagtatgccgaggtcatctgtcattacggaaagcaccggggtcgctttaaccataggagttatcaggtttacaagtcctgtcttgccgttttcaagcggttttaacgtatcgacatctctgattataactctgctgtaagcgggaacgtggaagtgatgttccttgcaatcgcagtataaaataggatgctctaccgctccgaaaaattcgataatatcgttttcctttatgccgagtaccttttcggcaaggctgtaaaaggaatttttatcggtctgctcggcatagaactgtttccagccgccgccgagcattatgcgtgagcctttcggcattttaagataaattttacgctcgtccattattctcagcagaaaataagtataagcgggaaaccccatgaatcttgtcgggaaacgtgaacgtgaatgcctgacaataagatctataatcctgtcaaagtcgggggaatagccgccttttttatatgtcaggatataattgcggctcaatgcaggagtgaagaatgtcgcaccgaaagccgtctttgttacggcggtcttgtttcctctgtggtgcttgtaacccataatgatatagtggcacggaacgggagatagcagatttctcagctttgatacacgcatgaccattttaagtccgcagagaaggcctcctgtgtcaaaggctaccacgcttttcctgccgcttgtgccggaggaagtcgcttttataagcggaatacagcctttattgaaaatctgttttttcttgaacagcaatgtgggtatcacgggaagtccggacgcatccgagggagaggatataccgagattttcgcatattatgcggtaatcatcgcaatgggaaacgcagtaggagaaattttcttttacggctttggtgaacaattcgtcggaactatcggaatacgggtcttttaccccaaagagcaatcgtctgtatttcatcggtcttcctccgctgtttaaatatttgatacagtaaaatgataacataaatagcacggtgtgtcaataaacggtaaaacaaatgcgttttacttaattaccgtgtaacctgttacatcgccttgctgataattttgtgtgaaaacggcgtaaaattatcggaaatctgtagacaatgacgattatttgtgatacaataataataacacctgtcgcagaggttttttgttttatgactacaagtaaacgattactcaaaacgtaatcggtacataacaaaaaaatgcggcggtattatgacagatttataaagcagagaataaactgcacagaaaggaatttttgctatgaagaacatacccgatgtaaagctcggaattgcggctgtaagccgtgactgtttccccatgagcctttcagcttcaagatgtgaggctgttgtaaaggcatgtaaggagatcggtgttgacgtatttaaatgtcccaccactatcgaaagcgaaacacacatgatgcaggctcttgaggagcttaagggcgcaggctgcaacgcactggttgtatacctcggaaacttcggtcccgagtcggctgaaacactgcttgcaaagtattttgacggtcctgtaatgttcgttgctgcggcagaggaaacacaggataacttagtaggcggcagaggcgacgcttactgcggcgtgctgaatgcaagctacaacttagcactcagaaacatcaaggcatacatacccgagtaccctgtaggaacagctacagaggttgcagatatgataaaggaatttatccctgttgcaagagctgttatcggtcttaacaacttaaaggttatctcattcggtcctcgtcctcaggacttccttgcttgtaacgctcctataaagcagctttacaatctcggtattgagatcgaagagaactcggagcttgacctttatgccgcattcaacgagcataagaatgacgcaagaatccccgaagttgttgcagatatggaaaaggagcttggcgacggcaacaagatgcccggtatcctgcccagacttgcacagcttgagattacgcttcttgactggatggaagcgcacaagggaagcagaaagtacgttgtattcgccaacaagtgctggccttcattccagacacagttcggctgtgttccctgctatgtaaactcaagacttacagcaagaggaatccccgtagcgtgcgaggttgatatttacggtgcaatcagcgaatatatcggtgcctgcatttcagaagacgcagttacactgctcgacatcaacaactctgttcctgcagatatgtatgttgaatccatcaaggacaagtacaactacacactcaaggatacattcatgggcttccactgcggtaacacagcttcgtgcaagctgacaagcaagactatgaagtatcagctcatcatgcacagaggtcttgagcctgacaaggagcctgatattacaagaggtacgctcgagggcgacatcgttcccggcgacatcacattcttccgtttacagagcacagctgacgctaagctgagagcttatgttgccgagggtgaagttctccctgttgctacacgttcattcggtgctatcggcgtattcgctatccccgaaatgggtagattctaccgcaacgttcttatcaagaagaactatcctcaccacggtgcagttgcattcggtcactacggcaaggctatcttcgatacactgaagtacctcggtgttgaggatcttgaattcaaccgtcctgctggtatgctgtatgacggtgagaatccttacgctaagtattgatttatcggacggcaatacgaaagtagataaagttgatatagtatagtaaaatccctgagagctgagcctctcggggatttttatgttgataattattgcggtaaagttaatgaattatcaaaaaaataatccgcctaattccagtaggcggattactgttgtataaacactttaattaccgagggaaaccgtctatgagggcttcctatatgttgattatagcaaatgatcgggttaaagtcaaggtaaatctcaaattcgtgtcatttttatcgcaatatctgaggactgttttaaggcagtccttaatttttgcgataaatcagttaaattaaattattaaacaattaagcgcaatcattaatatccgccgtcaatgcaactcgcacatattatcaacattgggaaaggcgaatttgaagcggctcacagccgccgcacttgcaaaaacgtgggatttgtggtacaataaaattaattattgactaaagtttcgctgtacaggggagtacggcggttgaaaggataaagctgatggcaaagaaaaattatgacgacaacagtcttaaacagctgaaaggacccgatcaggtacgactgcgtcccggtgttatattcggctctgacgggcttgacggttgttgtcactccgtgtttgagatactttcaaactcgatagacgaggcgagagagggcttcggaaagaagataatcgttacacgcttccttgataaaagcattgaagtgcaggactacggcagaggtataccgatagacttcaataaaaacgaggagaagtacaactgggagcttgccttctgcacactgtacgcaggcggtaagtacgataacaacagcggagataactactcatactcgctcggccttaacggtcttggcctttgttcgacgcagtttgcggctgagtatatggaggtcgagagcaataacggaacgtggatatacgacctgagattcgaaaagggctataacgttgaaaaggaagaaagaggcttccgtcgtcaccagtcggacggaacaacgggtactaaaatcaagtggaagcccgaccttgatgtatttacagatattgacgtgccgtttgaatattttgacgatgttctgcgcagacaggcagtggtaaatgacgggctgacctttgtgctgagaaacgaagtgcgtgacgaggaaacaggggaaactcactttgaagaacatatctactgttatgaaaacggcatcagcgattatctgaaagaaatcgtaggcgataccgcactcacgaccgagcaggtatggagcgcacagcgtacaggtaaggacagagaggacaagccggaatacaaggtaaagatgaaggtcgcttttgtattctcaaacaaagtacagcttatacagcactatcacaattcaagctggcttgagcacggcggaagtcccgacaaggctatgcaggcggcattcacaaatcagatagacggctggctgaaagctaacagcaagtacaacaagaccgagggcaagataaaatttaccgatattgccgactgccttgtgttcatatcttcaaacttctcaacgcagacaagctatgagaaccagacgaaaaagagcataaccaataaatttatacaggaggctatgaccgactggctgaagcatcagcttgaagtgtacttccttgaaaatccggatgaagcggtcaagatatgcgagcaggtgctgataaacaagcgtgcccgtgaaaatgccgcaaaggcaagagatacaataaagaaacagctttcgggcaagatagaccttgcgaacaggatacctaagttcgttgattgcaggagtaaggatacggcaagacgtgagctttatatagtggagggtgactcggctttgggcgctgtaaagcaggcgagggacgcagactatcaggcggtaatgcctgtaagaggtaagacgctcaactgccttaaggcaagctatgataagatattcaagagcgagattatcacgaaccttatgaagatactcggctgcggtgttgaggtaaaggctaaggcgaataaagacctttcaacatttgatttaaataatctcaggtgggaaaagataataatctgtaccgatgcggactatgacggataccagataagaacgcttattcttactatgctgtacagacttgttccgaccgtaatagaaaagggctttgtgtatatcgcagagtcgccgctttatgagataaacagtaaggatatgacctattttgcctatacggaagcggaaaagcagaggatacttgccgatataggcgagcagaagtataagatacagcgttcaaagggtcttggtgagaacgaaccggaaatgatgtcgctgacgactatgaaccccgaaacaagacggcttataagagtaatgccggaggacgcacagaaaacgcaggagatatttgagctgctgctcggtgataaccttgacggaagaaaggactatatccgtgactacggctataagtaccttgacgatatagacgtatcttaagcggaggatatatggaaattaacaggatagaggtaatatctgccgtagtgtcggagatgatagcgacactgcccgaggaaagacggcagaaggcatacatacatcttttcggcacggcacagacggcagggcttatcgcactgcgcagaggtgttaacgcagagcttgcgcagataagcggactgctccacgactaccgtaaatatctgacgggcgttgacgaaaagcacgcagaagaaggtgctgacgctgtaatgccgatactggcaaagacggggcttttcagcgtgtgcgagataggcaatatcacaagagcgatagcgaaccacagcgacaaggaaaatgtcgggcttccgcttgacgaggtgctgaaagacgcagatattctgcaacacgttttacagaatacaacgctacccataagagataaatacgagaaacgctttgaaaagctgaaaaaagagttttcgctctgagcaaggtataaagctaaaaagaggtatagattttgagaaaaggaaagaacgaaaagagcgagaagaaggtcgctccgaataaaaacgcttatatagagggcgcaggtattgtcgagaatcagccgataaccgatacgctgaccgaaaactatatgccgtatgcaatgagcgttatagtttcccgtgcgctccccgaaattgacggtttcaagccgtcacacagaaaactgctgtatacgatgtacaagatgggtctgcttacgggagcaagaacgaagtcggcgaacattgtcggacagacgatgaaattaaatccgcacggcgatatggcgatatacgaaacgatggtaagacttgcaaggggcaacgaggcgcttctgcacccgtatgttgacagcaagggtaacttcggcaaggcatattcaagagatatgtcgtttgcggcatcacgatatacagaggcaaagctcgatcctatctgcgcagaaatatttgcggatattgaccgtgatatagttgactttgtgccgaactacgataactcaatgacagagcctgtactgctccccacaagattccctgcggtactggtaaacaataacgtcggtatcgccgtatctatggcgagcaatatctgctccttcaatctgtcggaggtatgtgagacagccgccgcgcttatgaaaaatcccgaacacgatattgtatccacgcttaaaggaccggatttccccggcggaggcttcatattgcaggacgagaacgagcttcgccgtatatatgccaccggacgtggaagcgtaaaggtgcgcagtaagtatatctatgacaaaacggcaaactgtatcgaagtgaccgagattccgcctacgacgactattgaagcgataatcgacaagatagttgagcaggtaaagctgggcaagctgaaggaaatctccgatgtgcgtgacgagtcggacttatcgggccttaagataactattgatttaaagcgtgggcaggacagcgaggcggtaatgaaaaagctgttcaggataactcctttacaggacgttttctcctgcaatttcaacattcttgtaggcggtatgccgaaggttatgggcgttgccgagatacttgagcagtggacggatttcagaattacctgcgtaaagagaaagacaaagttcgagcttgcaagaaagaaagagaaactccatctgctgacaggtcttaagaagatactgcttgatatagacaaggctataaagataatccgtgaaacagaggatgacgcagaggtcgtaccgaaccttatgataggcttcggcatagacgaaacacaggcggaatatgttgcggatataaagctgagaaatatcaacaagggctatatcttgaagcgcatcgaggaaatagacagccttaaggaagaaatagccgatatggaggatattctttcatctgaacgcagagtgaagcagataatcatatcggagcttggcgatatagcgaagaaatacggcaagcccagaaagacaatgttcatctacggcactgaggacgaggagaacgaggcggaggaggaaatacccgattatcccgtaaatctgttcttcacccgtgagggatatttcaagaagattactcctcagtctctgagaatgagcggcgaacagaagctcaaggaaaacgatgagataatcgaaacctatgacggcagtaaccgtgcggagctgttgttcttcacagataaattccaggtatataaggcgagagcctgcgactttgaggacggaaaggcaagcgtgatgggcgactatctgcctgtaaagctggagcttgacccggacgagaagataataaagatgatagccgcagaggactacagcggaacgcttgtaatgttctttgaaaacggtaaatgtgcaaaagtgcctatggcatcgtttgaaacaaagacaagacgtaaaaagctggcgaacgcatataatgacggctcgccgcttgtgtctatgacgcttattgacggcgactgcgagtttatgctaagctcggacgcaggcaaggtcatgatattcaacaccgtgcttatcctgcccaaagcggcaagggatacgcagggcgtgcaggtaatgaggcttaccagagcaaagctcagatctgcggttaaatacaaggacggtatgataaaggacgcagacagctacaggacaaagaccgtgcctgttgcgggaacgctgtacgatgaggataccgaccagctcaagtttatgtaacgcatcgtaacagccgacaaaaaaatatcagaatttagaaaaatatttttataagtaaaaaaggggtcgcatattgcttgctttgatgattttgcatcgtgcaaaatttttttgcaagcactcaaagcgtccttgctttggggcgaagcccccggcagggactaggggcggcagccccagcaatatagccccttcccacggggaaggggtttggggttggggataaatgactggcgatatttgtataagagcaagttcttttatacttttatataagttgaatatcctttaaaccttgaaattcacactgtactgtgctatacttaaattgcgtctttataatgacgtgagaggttataattcaggcggtcagccacagtaaaaagaggtagaaaaaatgctcagcgatattgaaattgcccagaacgcaaaaatgctaaaaataaaggatatagcaaaggagctcggaattgacgaggaggagcttataccctacggtcactacaaggcgaagatctcacaggaatgtatagaccgtcttgaaagcgaagaggacggcaagctgatacttgttacggctataaaccccactcctgcgggagagggcaagacgactacttccgtaggtcttgcggagggtatgtacaagataggcaaaaaggctgtacttgcactgcgtgagccttcactgggtcccgtctttggtataaagggcggtgcggcaggcggaggatatgcgcaggtagtgcctatggaggatataaatcttcacttcacgggggatatgcacgcaatcacttccgcaaacaatctgctttgcgcacttatagataaccacattcagcagggaaacgtgctcggaatagaccccagacgcatacagataaagcgttgccttgatatgaacgacagagcactgagaaactgcataatcggtcttggcggcaaggtgaacggcgttccgagagaggatcacttccagataaccgttgcaagcgagataatggcgatactgtgtcttgcggacgatcttgttgatcttaaggcaaggctcggcagaatccttgttgcgtatacttatgacggaaagcccgtattcgcttctgatgttgaggcggtaggcgcaatgacagcactcttaaaggatgctatcaaccccaacctcgtgcagacgctcgaaaatactcccgctatcattcacggcggtccgtttgcaaacattgctcacggctgtaacagcgtaagagcgaccaagcttgcgttaaagctcggcgactatgccataaccgaggcaggcttcggcagtgatctcggtgcggagaagttctttgacataaagtgccgttacgcaggacttaagccctcgtgtacggtcatagtagctactatccgtgcgctgaaatacaacggcggtgttccgaaaaccgagcttaccgcagagaacacagaggctctcagaaagggcatcgtaaacctcggtgcacatattgagaatatgcgtaaatacggcgtgcctgcagttgttgcgataaaccacttctataccgatacagaggctgaaatagctattgtctgtgaatactgcgagaagatgggcgcaaaggtcgcattctccgatgtattcttaaagggcggagaaggcggtatcgagcttgcaaacgctgttatagatacaataaacgaaaacgagggcaagactaattttgctcctatatatgacgagaagctgtccataaaggaaaagctgaatataatcgtaagggaaatctaccgtgcggacggcgtaagctatacaactggtgcggaaaaggcaataaaggaaattgaagctatcggctttgacaagttgcctgtatgcgttgcaaagacgcagtattccttatcggacgacccgacaaagctcggttgcccgaagaatttcacgataacagtccgtgatgtaaagctgtcggcaggtgcaggctttgttgtcgcactcacgggtgatattatgacaatgcccggactgcctaaggttcctgccgcaaacaagatagatgtaagcgcagacggtgagataagcggtctgttctgatggaaaggtttatttcagattcgcctgaagaaacggttgaaatcggcaaaaagatagcctcttatctgaaagccggcgattgtgtgctttataccggtgaaatgggcgcaggaaaaacgcatttaacaaagggcatagcggaatatttcggcagtacggacgatgttacaagtccgaccttcgctcttgtgaacgaatatgagggcgatgtgccgatcttccactttgaccttttcagaataaacacgctcgacgatctgtacgctatcggatttttcgactacctcgaccgaggcggaataatgtgtatagagtggagcgagaacatacctgagcttgcctcgtatcttgacggcaggtgcggtgtgaatatcacaaaaacaggggataattcaagagtaattgaatatattccgcaggaggaactatgctgatactcggtatcgacactgccgccgctccttgctgtgccgccgtgtatgatacggaaaaggggcagatactcggcagtacggtgataaacaacaagctgacgcacagcgtgacgcttatgcctgttgtaagggaccttgtcagaaatgcggagctttctatggagaatatagggcttttcgcagtggcaaacggtccaggttctttcacgggacttcgtataggcatatcggcggtaaaagggctcgcttttgcattgtcgaagccttgtgcggcagtttcaacgcttgaggctatggcgtataatgttacagcttatgactgcgttgtctgcgccgcaatggacgcaaggtgcaatcaggtgtatgttgcactgtttcgtgtaaatggcggcaaggtcgaaagactgaccgaagaagaatgtctgaaaaccgacgaagcggcaagaatgctgtcggaatatgacgatgatataatgcttgtcggtgacggcgcatttataatgaaaaaagcaacggataacgagggattggaaaacgtgaagattgcccccgatccgttaagataccagacgggctacggcgtatgccttgcggctgtaaacgcaccgcagttaacgcccgaacagcttatgccgatgtatcttaagctgccgcaggctcagcgtgagcttatggcaaagaatgctgaggcatataaagaaaggaaagaataaaaatgctggcaataggtagcgatcacgcaggatatgagctgaagtgcgaggttaagaagttccttgacgggctgggagtcgaatatatcgactgcggctgtaacggagagagagcggattaccccgacatcgcagaaaagacctgtgagaaaatcaaaagcggagagtgcgacaagggcattctgatatgcggtacgggtataggcatcagcatatccgcaaacaagataaagggcatccgtgcggctttgtgccaggattattatacggcaaagtacacacgtcttcacaatgatgcaaacgttctgtgtatgggcggcagagttataggacctggtacggctgaagaaatagtaagagtattcctgtcaaccgagttcgagggcggaagacacgcagcccgtgttgacaagatgatggcgctcgaaaataagtaagtaattaaagtctgcggatttttccctatgaaaatcacggcagggctataaaaaactaatccaacaatacatagggagaaaagagaatgttatggcaaacgagaaacttcacatctgtgaccacccccttgtacagcacaaggtatctcttttaagagataagaacacgggcgcaaaggaattcagagagcttgtaagcgaaatttcaatgcttatgtgctatgaggcaacgagagatcttcctcttaagaaggtacagatccagactcccgtagctatcgcagagtcaaatgttatctcaggcagaaagctcgcatttgtacctatcctccgtgcaggtcttggtatgaccgagggcgttatggcacttgttcctgccgcaaagataggtcatatcggtatattcagaggaaagggcggatcggataaaacggtcgcaaacgagtattactgcaagctcccgtttgatataaacgagcgtgacgtaatagttaccgatattatgctcgctacaggcacatcggctgtacacgctatacgcaagattaaggaagccggcgcacattctataaagtttatgtgcattatcgccgctcctgagggcatagccgctatacacaaggaattccccgatgtagagatttactgcggtgcgcttgacgacggtcttaatgaggatctgtatatcactcccggcgtaggtgacgcaggcgacagactcttcggaacaaagtaagtcggataaaatcaagctgaagacgttgagaaacacacgcagacaaggaaacagccccgacaggcgtacaaaggtacgttgaggggctgttgacgcagtaagcaaaaatgctttcgcacagccgttttttacggctgtgcgaaattcttttacttatcctattttaatcttgtgtcagatgatttatctgcatttttgcggtgcgtgggtttatcgacagtcaggagcctgccgcaattgcggcaggctcctttaaacccgtgcggttaatttttgcgtggctgaagccctgtcataaagccgtcaagtgcggcggagcatatatcgccgccgacaattctgccgctgacgatgataaggttcattctgatgttatcaagcgtgtttccgctgtcatcggtgtaatcggttataatatatgtatattgtactgcgtcctcacccttatacagcgataaatcaaagccgcactgcttttgcaaagcgttgtagttttcatatacgctgccgaatacggcagggataacgatattctgtacggtttcgctgtcggcggatatgctgtagccgagtgtttttgcgtaatttgctctgtcgctgtacgtttcaccgcatattgcactgcggcggcacataacaagaacggtaagcagtataacgaaaagagcggcagggataacaagcaagcggataatttttctgtgtttcatttttcctccgttatgtcaatttattgtcaggtcggtcggttgcggggacagtcacttgaaatttactaaaatctatgctgaaatattcagcaaaatgctgaaattttaacgcaatctttaacacgtttaagtattaattgcaaaatttcactaaaattatccgctttcatttgtgatttgtaacaaattcgaatggaatttactttattcaaggctgagattcggctaaaatttgtataaattgtacacaaaaaggacaaaatttaaatgcgttttatatgtgttttatgcctctattttatcataaatatgtaaactatgtccttgcacattctgtaaactatgttatcacactatacagcttgcccctcacgttgcatcaaaccttaccggcttcacaaaccttgcaaaagtagcacaaccttagcttagcactaccactcttgcaaaattaactatacatttttaatatcatttttgaaaaagaaattccttatcgggaggggcaagcccctcccctacaaaaaattttcgatgatattaatttttcttatagctttgcaatgaaaccaaagtcgtaatttacatcaacaacggaaccccgccgtttcgctatccgtcgctaaattgcaacattttcaaaggcggaatttgctgcggctcacagccgcaacgtcacattgccgccccgccggtaacgaaagttacgccgctgtcaaacctttaaaacggcggaatttgctatgccccacgggcattagcgcttgaggtttactatttcttcgagcatcgtgtccgaagtggtgatgattcttgagtttgcctggaagcctctctgcgtgatgatcatatcggagaattcctgcgacaaatcaacgttagacatttcgagcgcacccgatactacagaagcagaaccgttttcgcctgcaatgtttacctgaggctgacccgatgaaagagtttctctccagtaggagcttcccacctgctcaagaccgttggggttatcgaatgtaacaatatcaattctgccgagcattatgataccgtgtacgctgtgtataccgtatatagtgccgtcctcattgatatatacgctgtcaagatcctttaccgtctgcgtagccgcaacacgtccgtctgtcatcttgatattgcccagaagctcgaccatatcagagtagaagttgttcgagccgcctgcaagacctaccttgccgtctgtggcaagaagcgtttcaagtgagccgtttgcagcgtcccagtccgtacttgtaaccttaagctgatacttttcgttactgcctgccgccttgtctacagccgtctgtatgtcggctaccgtagcaccggggcaaacgcttatcgtaagaccgttgtccgaccactttgccgttgtgtctgcggcattcttggaatatcttaagtttatcgtgtagttgtttgcgtattctcctgcgtttactgtcgtaaatgtaagagaagcctttgttgttccgtcgtccagcttcattgtgttggtagctgtcgttgcgggaatgtctgccgcagggggcaccgtatcaagctcaaagtggagcggaagtacgccatcaatgcttacaccgccgttttcacaagcacgggtaacagcgtcctcaagatcgttgaggtttgtataatcattcttttcgttcagctgtacaacgagcttgtttccgctcatataagcgtaatcgctgttgcctaccgtaaagcctaccgatatgttgccgtccggagtcgctgtatctgctgatactgtaagcggatatgtactgcccttgtatgtaattgtctttgagtagctggcttcgttgtcaagcacttcgggaactacaaatgtaattctgttggacgatgcgtcaacgcctgttgcgtcaccgcttacgccgagtaccatattaccgtttgagtcaacaaggttacctgcgttatcaacgttgaaaacgcctgctcttgaatagaagatgttgccggcttcgtccattacctggaaaaatccgtcgcccgataaagcacagtcataaacgctgtcagaatatgtgaagcccgactgtcccattacctgtccgatagcgcccagcttagtaccgtaacctacctgagagggatttacaccaccctggaggttagagcctgccgagccgttcttcttggtctggtaatatacctcctggaaggtagttacgcttgtcttgaagcctgtagtgttgacgttcgcaatattgttgcctataacgtccatcttctgctgatgtgtctttaatcctgacacgcccgagaataaagatctaaccatgatctgttcctttctccatcgtgccgaccgttcttacccgtctgtcattcggggtaaggaatacttcctttcggtccggtattacataattacggtcgagtcgatgttcgtaaaaatattaccttttaaatcttcctgtgacatagttgtgattaccgtgcggtttttcacactcaccacaaaagcagtcctgtctacgagtaccagtgtttcgttactgcccttttctgcggctatctcaatgccgtcattaagtctttgcagcatatccgagtcaagtatctcgatatttctgctttctatacgcttcattgcgtgtttcgaaaagcctaccgccgagtttcttgcatcaagctcgctttgcagagcttctgcaaatgttcctcccgactgttgtgcggccttttcagcattccctgcttttgcggtgttaacgttgcctgtcgaaatctgcagattccgcagcttgagttcatttatcaacataacactgccgcctttttatttacttgttgccctcggcacttcctgccggagctcccgtgttcttgtcagccgtacttcccgtaccctcgctgacgtgtactatctcgtcaatagagtagagataattgtctatcacgatcttagcgtcgccgtcctgcatttctgccgactcgaccttgccctttgcgtagtagaatttgccgtcgtcgccgagtacctttaccgttacttccttgcccacatatcccagtgcctcggtcatcgtatgtaacgtacccttgcttaccgtatcgcttatcgcctttaccgccgataaatcatactgcttgccgtcaactactaccttcacatcgcttccgctgatgtttactccggtgcatacgcccgataaaagcgttccgtcatcgctctgcgcattcattgtaagcgtcttgcctacaagacctgccgcatagtttgacatactgtacttcagattgtcctgctgtgcctgtaatgccgtgaactgtgccatctgcgacacgaactcggtatttgacgtaggctcaagcggatcctggttgctcatttccgccataagcagactgaagaacgtatctgtgcttatcgtatcgttcttgcccgaattcttgaaaaggtccttatacttttcgtgatttgactgtacactctgaagacttgaaatgtctgccatctgttatcctttcatgtcagtccgaccgataaaaatcagtccatcgtctgaatctcccccaacagattttcaaagtcgtccgtgtcattcttctgctgactgtgcgactgctgtctgtaagggttcttactgctgccgtcaaaatctctctggaaaagttccgcctgtgaggtttccaccttgtacgaggtaagttccacatcgtcattcttcagtgcatacgcaagctgctgtgactttgcctgtaaaagctccttcgccgcctgagtttccgtcagtatctcaaccgtgagctttccgccctcatttgccatacgaaccgtgattttgcccagtgtttcgggtgtaagcacaactgtaagcgtgcttttgccgtttgccttaggtgtgtgttcgctcacaaactcagccatatcgcttatcggtactctgagagtgcggatttcctgcccgttttcgtcataacggttttctgttcttgcaaatacatcactgccctttgcaagcatatcgcttaccgcattcttgtcggtaaccttctgctcggtttcaaggtcgctgtcagatcttgtgacctcgtttcctttggctatcgccctcagctcatcgctcttgctttcgatgttcctcttggcaaatgccattctcggagcattgtcatcctgcgtctgtatatcttgctttacgctgttgtcaccgtatttttcgtatgacgttaccttaaattcagccttaacaacctcaggactatctgcttttacaccggatgtttcctgcctgcctgtttttccgataaagcccatcttatcgacaaaatcagtcttttcggtaaaagtcgtatctgcctttgaacgtatattatccgcatctgaagacttttcggcatttccgacagccacgcttgcaaaagcgtctggcttgtcagccgctgcagccacagcattttcaccggcaatgctgtctgaagcggtttccgctttgacgttcgtctgttttacagtatccgcagagtcatcgttattcatctgaatttcacttgcaaaatcatttacggcggaaatctctccgttttgtaaaccgagtgccgtattaacgtcattcccgtctgaaattccgctgaaagcaccttcttcagatagcacatcgcctatcggactgctgacctcaagaccgctcatgatctgcataagctcgctgttgtccgtctgcattacatcagcgtaaaactgcatcgtaccgccttgcagatatcctgcaagctcggctgttttaagcagttccttcagttcctgtgcattctgctcaagctcgttcaacccgcttaatatctcgccgttcataacagccttattatcggcattcattcgcacagctgagttcatattgcactgctgaccgcttgttaccatagcaccgagcgtatcggagaaacctccggcagtaccgattgctgagccgttttgtacgctacctgccgagattgtggcggcattgcctgcaaacgttgtaacaacggcaggcaatactgctgtcccattcatcatatctcaccccctttcagcactattcattgtcaaaaacaatatatgctttttaacaacttttatatatttaacgtgtttaaaccgttaaaatttatgaaaattgcacagctttccaccttgtattgtaacacatttcgaactatatgtcaacaatttacggtgtattacctccgtttgaagggccgtttgtcacaaattcctctatgatctgctcctgctccttctgcgaggcatatctgtactcctcaagctgtttttcctccagcttttcaagcttcgaaacctcttttgtagcgtctatgaccttctgaagctgagtttcaatttcctcacgcttatgcgccataagcccctttatgcgatatatgtcctgttgcaaagaggaaacatatttcttgtgcagcgataatctcatagcggtagtgccgcctcgtacaagttcgttcagcttgtctatgctctgttcgtactcagccacctttgcgtcaagctcgctttgcatttccgcaagctccgcccttagtctgccgagtattgatttctcgctgtcaagcacctgatcgttgtactttttcagcgactgcaatgtaaaattaaacttcttcatatcgcattgttatcaggaaaccgccgcctttaacagctttatggtatcctccatcgagaacgattcatacattccctgcatcagaaaatcgtttatcttgtctatcttctttatcgcctcgtcaagagccgggtttgtacccttcttgtacgctcctatcgagataaggtctgcgttgttgttgtaaagcgcaagcagatttctcagctttcctgccgctttattatgctccgggtctgcaattgccgacataagacgtgagatgctcggcagtatgtcaatcgcaggataatggttctgcgctgctatcttacggctcagcactatatgtccgtcaattatacctcttacggtatccgatataggctcgtttgtatcgtcaccctcaacaagcacagcataaattcccgttatactgcccttttcgaagtttcccgccctttcgagcagcttcggcattgcggcgtatattgacggggtatagcctcttgcaacgggaggttcgcctgtcgaaagacctatctcacgctgtgccatagcaaaacgtgtaagattatccatcatcagcagtacgtccttgccctgagagcagaaatattctgcaatagccgtagccgtcataggacatttatttctcatcatcgcaggctgatccgatgttgcgacaacaacgaccgaccttgccataccttcttctccgaggtcgttttctataaattctcttacctctctgccacgctcgcctacaagcgctataacgttgagatcggcctttacctttcgtgcgatcatacccataagcgttgacttgcctacgcctgagcctgcaaagatacccattctctgccccttgcccattgtgagaagtccgtcgatcgcctttacgccaagctctataggctcgtgtattttcggtctggtgagcggatttacaggaatgcccgctataggcactgtgtctgtatattcaatcggctctccgtcgtcaagcggatttcccagtgcgtcgattattcttcctatcagcttgtcgccgactcttacattcagcttgtcgcctgtgttgtcaactatactgccgggacctatgccctcaaggtcggtatacggcataagcagtaccttatgctcgttgaatcccaccacttcggcagggatatgcgacttcatatcctttgtgtagatacggcacacatcgcctatactgcacagcggtccgctcgcctcgatcgtcattccgactatcttttcaattttacccagatacttatatgtatcggtagttctgagttctgtcagaaatccgccgagatccatgttaaagtcctttcaaataagggagttattcgctttgttcttcgccgccgtcattgtcggtttctgcctgtgccgcaggttcctcctgcttctcggcctttttccttgacggcgctctgcggtactttcctctgcccagctcctctatcatcttgagctgtgtctgtattccggcatcggtaatttcactgccgttgtcaattataacagtaccgctcggtgcgtccttaagcacctcgacctccacgttctttacatttgtgaacagctttttgaaatagtcggtatccgccgccatctcttcgctgacatcggtctttgataaggtcagctttacatattcactgccacggaagctctttcccgcttcctttatcgttttcttgacgaccgccttgtccttctgaccgagagaattcagcgttatgcggtttactatctccattaccgtgtcgaatatctcgacctcgtagctgtcaaaaagttccgccttgtcgcttaccatctgctcgctgagccttttgatctccgagagcatatcacggcatttgtcaagccctgcggcatatccgtcctcgtgacccttcgcaaagccgtccgacctgcttttttcaaagattgcctcagcctgtgcctttgcttgtgcggcataatcctgcgcctgctgttcggtttcgctgagtattttctgtgctttttcacgggcatcggcaagtgccttttcaccctgctcacgataatagcttgttatcttctctttttcctgctcaagttcctgcctgtgctttgccgatgcttcatcggcgaccgccgtattttctgcggtgtcggccgtcactgtttcctgcaagggagcttgcggtgcgacaggctttacttttattgagttgtcgataacaactgtatctgttgtaggctgtacgggataataaccgccccgacccgccttgaatacgcctgccaaaatatattcctcgctttcgtattatgcgatgatttcgtcttccttgccgccctttgagataacgagagtaccctcgtcctcaagtctgcgtatgatggatacgatcctctgctgagcctcctcaacatcacgcatacggacattgtgaagatactcaacgtctgtctgtacgctttcacgcatacgggtagacatatttgcatagatgcactctgcgacctcgggagtagagcccttgatagcaaccgcaagatcctttgaatcgacctccggtataaacgcctgtatagccatattgtcgagagttactatatcctcgaatacgaacatctttgagcgtatatcgtctgccagcttcggatctctcagcgtcagttcgtcgaatatgtatttttctgttgcacggtctacgttgttcatgacctccgcaacatagtctatacctccgacctctgtggtgtcggcggtaacaagattatcaaacttcttttcaagcgtgcgctctatagattttacgacatcgggtgatgccctgtccatcttagccatacgctcgactacatctatccttgttttcttgggcagttcgcttaaaatcgccgatgcctgatcgctccttgcgtaagaaagtatcagtgctattgtctgcggatgctcgttttgtaccattgcaagcaggtttttatagtctgccttgcggacaaatgcaaacgcttttgtctggaactgcttcgttatcttttcaaacagcgcctgtgccgtctgcggaccgaatgccttttcaagtatgtcacgggcatactccacaccaccctcggatattaccttctgggtaaggcaaagctcatagaactcgttaagaacgctgtccaccacttccatagggtagtagttcattcttgctatttcaagcgtgatctgctctacctcctcgtcggagaagtgcttgaatacctcggacgcattttccgtaccgatagagcttatgattatcgccgccttttgtgcgcttgtgagtgcctccatatatatccttcctttatgctgtcaatatcattcgccgtttttcatcatagaacgtatgagctgggcaacgacatcgggatttgtgcgtgagaaatccttgatttccttcttgagaaccgcactctttgactcgtcgtcatagtcgtcaaggtgctgtatgttgaattcttcgtccggctgaggctgaggctcaaagctgagagcggcagattcctgcgccgcctgtgccgccgctgcctgtgcggcagccgccttggctcttgcttttgcacgtttcttcttctttgcgttgcttgtaagtatagctacgataagcagtgcaagcacaagaagtccgagcaggagtatgatataaaccgtccagtcaacgcttccgcctctgtttatcgtattgccgttgccgttagtgccgttgttgccgtttataacaaacgggtagtttgcaaccgtaacatttgcaacgtctgcgccgatagcaaacgcaattacttcacggagctgttccttgtccgcttcaagcatattgatctgatctacagttacagccgccgttattttatctaccgaatagccgttcttttcgagctgtcttatctcggtgtttacaagacgctttacggtaatactgttctgatagtaatattggttatcgccgtcgcccgtgatagtcggatagttcggtgaaatgtcgctgttgcttgttgtgccaacaacgcccgacagcgagcctataccgccccagccctcgttctttgttgagctttctatcataccgcccgatgtaccgtcctctgctacagacggcgtgtagatggtatattccgactttgagttatcgtaattgagctttacgtttacgtttatcgtgtagtccttgtacagctttttcagcgtatcgttgagctggctcttgagcaggctctgcatctgctcctggaagttcagccttgactggtacagcacgtcctcctcaacggtcgtgttctcaccgctgagcagcttgccgtccgagtcgagtattgatatgttttcacgctcaagacccggcaaagagttcagcaccagtgcatagataccctcgacctgatcgctcgtaagctgtgcgccgtttttcagatcaagctttacgctgactctcggttcttcgctgtccgtggagataacatagttgctgttctccggcatagtgattataacataagagttcttgaccgcacttatggtgttgatggctttcataagatgcgtctgtaactgctgtatctgaagtaccttcttttcggtgtcggtcgaccatatacctatgccgctgttccatacgtcaaagttgaacgttgacttggggtatccctgtatgctgagctgcattcttacattgtccgcctggtcgctcggtacagagatactgccgtccgtacccatttttacgtccgttattccaagctcgtttattgccgaaacgacctgcgagctttcctcgctgtcaagtccggtataaatagccgtatatcccttctgattaagcactatcgcaagcactattgcggcaactattactaccgataccgcagttattatgaatatccgcagatttttcgcaagcgagctccatttatctttgaatccgctccagaaagcggagagcttatccttcatctatatatgtatccttcccttgaagtgtagatcagtattgatcagacggtcatacgcattatctcgttgtatgcgtcaacagccttgttcttgacagtaacaagcagatccacagcggtagccgccttttcgagatttacctgtatctgtgcaagatcgtccacatcgccgagcataagatcgacagaatccttctgtacctgtgcgtcggtttccttgacgttctttacaagcgactcaaaaacatcaaagaacgttgcttcgccgtcatctgtgctttcggtctgctttttctgactcatcgtttccataggtgtgatactgcttgtaagcggtactataaacatttatatcagttcctttcgggtatcgttagttgtttcctatgctgagtgccgtctgcgccattgatttcacggcgttcagcacagcgaggttagcttcatacgagcgggtagccgccatagcgtccatttcctcttccgccacgtcaacgttcggcagatagtaatagccgttctcgtctgcgtcgggatgtgtcgggtcatagaccggtgtgagcggtgtttcgtcctcgactatctcggtaacaagaacgcccttgtttttagtcgcagaaacagtattcgcaggcactccccctgctattttttcttttctctttgctatagtttcctcaagcacagagttgaaacccttgttttcgctgaacagtacgacctgccttctgtacggcgtaccgtcctccgttctggtggtttttgcgttcgcaacgttctgcgaaattacatcaagacgcagtctttccgctgccatgcctgatgcggctatattaagcgaacttaaaaatgccatgcaaaaaactcctttctgtatgtcaaaaaagcgttgaaatccgtttcactgtatataatccattattttaaagcgtctgccttaaggcaataccgcataattattgctgtgcgattgcgcagtcagatttttcgtcagattgtataaattgaacgcaggcaggctggcgcctgtcaagcgaaatttgtgcaagatggcggaaaatatgtaagcttagcgtgcggcaaaggcgatagccgttaattgtgcggtattgccttaaattacgttttcattgccgaacgcagccttgtgaactctccgttcatctggttcttgagagcctgatagtgaagctgtaccttcgcaagctcgtttgactgcgaatcaacgtctacgttgttgccgtccggctgagtgttggtcgcagtgtcctcatacactcttgtagcaagctcgacctgctttgagccttccttcgccttacctccgacaacgcttgtgctttccattctgtccttgagtacagcgtaaaaatcaagatacttgcagttatatccgggagtatcctggtttgctatattctgtgcgataatctgctgcttctgccacagaacagacagaccctgttcggtaatgcgaaaagcgtttgtgttgaaaagtgccatatatcctccttttcaagccggtccttttcagaaaatgttccccgagtcataaacagttaatacgatgaacgatttccgtattttgtatttcggtgtaacaaagttacaatatgtagaaaaccaccttaagttatattaacattacatggtttttggtgcgattttaacaaatttcgagctacagttctagcaactcaattgtatattatacaacattttttaccgttttgcaaggctggtaggagaaatctgttgatttttgtacgattctctaaaagcggtgactgacaatatgcaacggctgtattttttagtcagactgcacaatagtataagctaccacttcctgtcgaatgtgggaagctcggtaaacgttcttttccttgcctgcctgtagaccattcttgttttcggtcttaaaacgggctttgtttcggcggctttctttttctcgcaccttagctgataccgcttctgagcgagcgagcagtgtctgaaaatcgttttctgcttcgggaagcactgcggaagcgtcagcgaggatatttccctgaagccgttttcgttaagccaccagctgtcaaattcaggcttgccctgccttatgtggtaccccagacggtcagagtcgccctcatagcatctgattttccccgtaaagacaagcctgccctttttcacagacagcttcatctcgtcatacggtattatataaagcctgcgttgtatcccgcccgtgtccgccgatattttaccgccgtacctgctgagaatggcggcggatttctgtatctcgaagtaggtgcatcgttttatacgtcttgaccgtgtttcgcatataaagaacaaaaggaaggtgaacgcaagccacacggcaacacatatcgcaggaacagcaagtcctgcggcgagaaacccctccgtccgccactttcttgtttgtattatcagcgacataaggctcagaagcgccgggagcgcaagcacagctccgacagctacgcttgctttctcgcagacagtgcgagctttcgatgtgtcggcgtgaaaaaaattctgcattgaccctgcggaacaatattccgctaccgcacctcccttacgacaaacttctgcttatactaattatattatagccggctcacaaaagtcaacgagcttttcttaattaaattgtataaaaacaagctgtactttttaaacaattcgcagaatttttaaaaaccgactaaaaaactgctgattctgcttgatttattgttcaatttattgtatacttaatgataaatgataatataggcgtgttgggtgcggctgtaatgccttttccccgtgtcttaggaaaggggagttgtgctttttgagctataagaaagaagactttacttcttttgagataacctcgcttgacggtgagcggctgatgtacaccgagagcaacttcgactttccgataatgtacgaccttaacgataatattattgacaatatgctgatgataaagggacggaaaatgcccgagatcgacacatctcagtatgtttacgtcatcgccagtatgcgtgacggcgaccgttacagatacaagacgaacgtatccgtatcgaccgaccgccagcttaatgtgatattaagacccgacaaggcggagcttcttgaagaacgcagaagatatttcaagataaaaacgaatgaaagagcgtttataacgctaagaatgcaggagggcgacgacaagcccaccccgcttgatccgcctgccgaaatatacatcaaggatataaacgtcggcggagtatttttcgtctgcaccgacgcacgcaggcattttgccaagggcgacaaattgctgatgataatcaatctgtccggctcacgccttgagcttaacgcagaggtgctcagagaacagacgatagattcgcaggaaaccgatacaggctacggatgccgtttcatcggtgtttctcattcgcaggaagaaactatttcaagatatatctacaagctgcagtttgaaatgctgcagaaggaacgtgaaaaacgtgatatgttttgacagaatttaacataaaatgtgaagcggttgattgatattgaatttaagggtttcggaggttttataaaatgcagtcattaaagattaaaacgactttacgcatactcactacggctttcgccgtaataccgatgctgatagtcggcatagtgggatatttcagtatgacgggctttgccgcaaattcggtaagccagttcgcaagagcggcaggtgcggctcagcaggagataatcaatcagtacataaacgagtgtatatccgatgttgcttatctttcattaagcaggcctgcaggaacgcttgcaaagagcggtcagggcgatgatgccaagtcaatgctttcgctcattgccgagaatatcgccgacagaaacagcggtttcaagaaccttgtgataaccgactcctccggcaatatcgtttacgaatacgaggatatacagggcatgaaggagagcttcttcggcttcgaggagcttgagggctattccgaaggctcgacaaagatttcaaagatctatatgaacaacgaggactacgaaacaagcgtgttctacgttgcaaagagcatagatgctgacggccttaacaatatcgacggattcgccatagagattatcgacctttcgaagataagcgaaatactgtctaagacgtcatacggcgaaggcaagggctatctttccgtaaccgacggcacaggatgcgtgctgaattacgagggtaacgccgtacagaagatagacgatatcactgacagcggaataagagatgttatgaagtctacagttaagcccacatcggctgaaaataacattgactataacgtaggcggtaagctcggttgctacaattatttcacaggtgcgtcctcattaaactggaagtgggtaagcgtttaccctgcaaatatagcaatgtcgcagattgcagttcctcttgcaatatcgctcggtactatggtggttcttgccgttatatgcgcacttctcggtattctcatcacaaagtctatcgtaaacccgatgaacgagatggtaaaggttgcccgtgagatacaggagggcgaccgtgacaagcgtcttgatataaaggcacacaatgagttcaaggatatttccgagctgttcaacaatatgctcgatgacgtaagtatgtctgaggagcttcacagaacgatctccgacatttcggacaatatgctgttcgagtgggatttccacaaggaaacaatgtacgtttcggataacttcaaggagaagttcgacatagacccgtcagaagctcagcttgcaaacggtaagttccttgataagataatgacggaggattatgccgaaatctataagcgtgatataagcgcactgctcaagaacagaacaggtcacagcggcgagtatcagatgaccacaaaaaacggaagcctgttatggttctctatccgtgcgctctgcgtaaccgaccgtcttggcgaaccgctccgtgttatcggtgtcgtaaccgacatagacagcgaaaagaagcttgagcttcagctttccgagcgtgcaagctatgacttcttatcacagctttataacagaagcacatttgagcgtgagcttaagagcgagattgagcgtagcgcacacgcaaaggttgcggtactctttatagacgttgacgatttcaagttcataaacgaccgtttcggacattccgtaggtgacgaggttatcaagtatgttgccggctgtatcaaacagcgtgtaaagggaagcggatttgccggacgtttcggcggcgatgagtttgttctttgtatcaccgatcctaagcagattgaggagatagagagcctgtcgcttgaccttatagatgagctttacgagggctaccactccgagcttgcaaacgtttcgataaacgtaaaggcaagtatcggtatagcgttctaccccgaacacggcgatgacagcaacaaggtagttgccgccgctgacgaggctatgtacttcgtaaagaagaacggtaaggcaaactaccacatctatcagcccgaagattccgagatggaagatcttcagcacacattgtaataaaagtgatcagaaatattcatacccgctttttcggcgggtatgattgcttttatctgtaaataatttgaaaacctaaaatttaacccgttaaggcaaagagaggaaacactgtatggcagttgttatagcgataacaaatcagaagggcggcgtcggcaaaaccacgacctgcgccgcattctgcggaggactaaccgaaagcggtaagagcgttcttgcaatagacctcgatccgcagggaaatctcagcttcagccttggcgctgacgcagaagaaagctatactatgtacgatgtattcaagggaaactgcaccgtaaaagaggcaatacaatgcacggataactgcgatgttatccccgcaaacatactgctgtcgggctgtgagcttgagcttaccggtgttggcagagagtaccttctaagagaggcgctgtcggacgttatggacgattatgattacataatgatagacacccctcctgcgctttccatcctcacgataaacgcatatacggcggcggacaagctgattattccgatgatagccgagatactcagcctgcagggaatagcacagcttaaagaaacgattttcgccgtaaagaaatattacaacaaggatctggagattacaggcatattgcttaataaatataatccccgacttgtgcttacaaaagaagttgaggagcttgccggaatgatagccgaacagcttggcacaaagatactcagctcaaggataagtacaaatgtttcccttgcggaagcccctgcacacggcatttccataatggaatatgccccacgctccaaggcaaccgcagaataccgcagtcttatcaacgaagtgaccggtgtgccgatgaaaaaatcacagaaaaaggacagcaaacgtcccgtccgcagaccctcaaagaaacagtaattcacgaaaggagcgcctcctgtggcagaagaatataaatcaagcaagacaagacaggtaatgaatcttataaatgcaaagccctcaggtgtcaatccgttcttaccgcctgccgagcaggaaagagagaaaagatcgcttgccgaaagcaccgtagaggacaaactgcgtaactatacgcagtcaaagcgaggcacattcgctcctaaatctcacacaaagcataacccgatgctccatatccacgaggacgatgagccacagcagacggttaaaagcgtaacacgtcacacaggacagataacgatagacataaaccgcataatcattgacgagatacttgacgatgcgttaagacgcttcaacacctgccactgcgaaaaatgcaagcggataatatccgaaaaggtgcttgaccttgttcccgtaaaaatagtaacggtaacacaggatgaggagcgttcggtagtagacggctattgcagctatgcccgaaaggatatatactctgcaatcgttaaggtcgttcttgaaaacaaacgcagacccttccacaacgaacggctgtgacccgcatcaaattccgacctttttaaaggttggtgcgttattggggttagcaaaacggtcgggaataaacgatgcaatgattaccggataagctgtcgggcggcaatgtgccgcatcaaattcgccgttctatttgattgagctttgcctgactttcgtcacctgcggtaataaacgttaaaaagagaaaccaaaagtttcgcttagtccttttcaaaataaccgccgctctcatttcaccgttgcggtgcttgagttgagcgacaatatgaaagccacagcttttgctgtggcttcagactgtcgataaacctatataatttttgaaaatggggtcgcaggggcgtagcccccgacagggtctaggggcggtagccccagtaaaatccccctttcccggggaaagggggcagggggataggggtagtgagttagaagtttgtttcaaaaacatactttttctacaaactgaaagccacagcttttgctgtggctttcaggtatataccccgaaattcaaatccgataatgcagaataaaacaaaagcccctccgccataagcggaggggctgtatgctctttaattaaagcatctcatcacttaaaagtgattacttgcttctcttcttaagaacgatacctgttgtagcaactgctgctgctgcgagaactgcagggataactgctactgcagcacctgtaggagggttaacgggctcgcctgagcaatcgccgggcttaacaggatctgattcgccgggctttactgtgatttcttcattgattctaacctgatcgatagcgattgtggggatagcatcgccgtcagcagccttgaggtctgtgcaaactgcgatgaatgccacaccatcgataaccttgtcaaggtcgattgttacaacataagtaccattacctgttacttcaacgggagtgcacttagcgtttgcattgaccgtgtcaccttcgccctggaactggcattcccacttggagtcagccatagcgatccaagccttgaagggagttgtgaagtttgtaactgtaaacttaacagaaatcttgttagcacctgcaaaagcagccttatcagcgattacgtctgcgttgtcgccggtccattcattgatgatgtttgtacgaacaagacctttatcaataacggtcctacctgagttagcaattttaacgtcagcgggagctacaggctcagcgggatcttctgtcttaccgggatcaacaggaggatcaacaggatcaacaggatcaacaggatcaacaggatcaacgggctttactgcagcttcttcatcgttgattgttaatgtgtactgaacgcctttatatgaatcccagcttaagcagtagaaatcaactacagcacccttaacaacggggatagaaagctgaccaccgtagatcggaagagcgtcgtgtagggaaagagtgtgtcagtacgtgtagatctcgggaaaggggctatattactggggctaccgcccctagaccctgtcgggggctacgcccctgcgaccccatttttatataatcaagaggtttatcgacagactgaacctcgcagatctctctgcgaggttttgtggtggaaatgtccagaaacgcttccgcagtgacaataactccgtcaaagccgctcggatcaaaaaaatcgtatatgacattttcaaaattgagaaattagtcccttatccggtgattataaatgtttgaaaacaccaccacgtccgtatccgcggcaaatgccgcctcggctattccgcatatgatatccttctgggtgcggtcgtcggctcttgcggttattacggcaatttttttgacatttcgttcgtcctttcacgcattcataaaaagcccgttcccgtagccgctcaacccctgttctgcggtaaattctgccgctgacggggaaggatttttgacgcgttcggcgacagagtatgccggaaacaagctttcgtatatattataacttattcacgttcacgcgggtatgtcaaccgaaaaggtgcatattatgattaaaaggtggacaaaacagatatcagctgttgactttgtgttgtttattggtataataaacttaaaggtgtctttggacacgagaaataaaacggaggttttaacgatgaagatcacaagtaaattcgcggctattttgtgcgcggcggccctgtttatgacggtgggttgctcgaacggcggcgaaacaagcagcgggagctccgagcccaacgcttccggcaactccggaaccgcagacgtttccagcgcttcgaattccgaaacgaatgaaagcggcacggtatcagaggagaaaattatggacagtctgaacaacggcataattatcgacagcgtaagcggtaacgtttataagaacgagatgaacgcaaatcccatctcgccgaacatattctgcgccgatcccaccgcggtggaatataacggaaggctttacgtttacggcacgaacgaccaacagcaggcggaagagggaacaaagaacgactacgcctatatcaaatcgcttgtggtattttccaccgacgatatggtaaactggatatatcacggcaggatagaggtcggagagatcgcaccgtggatatataactcgtgggcaccgtcgatagtttcccgcgttgaagacgacggacttacgcatttttacctttacttctcaaacggcggctctggcgtgggcgtgataacctccaccgaccctgtgggaccgtggaccgatccgctcggcgagcctctggtttatcagaatatgcctgggctggagaattgccccgcaccctttgatccgggcgtgtgcattgacgaaaatggcgtaggctggctcgccttcggcggaggcacaccggcggacggcaacactatgcacagcaagatcccgaagatagctaagctgggaaaggatatgctgtcctttgacagcgaatttgtttccattgacgctccctacttttttgaggcgagcgagctgaactatatcgacggggtatattactatacatactgcaccgactggcaggatcacaagaccggctggaaggagtacgagggggtcaaagttccgcccgcgtgcagcatggcgtatatgactaccaagacccctctcgacgcggatagttgggaatgcagaggaccctatttctataatgcgggagagaacgccgacggggcctcaggacttcgctgggctaacaaccacactcatttcattgaatataagggcgtaaactacatcattcaccatacgcttcttctggaggagcttatgggaggaaaagcgggcttccgcagtatgatggcagactatctgcccatggacaaggcaacgggcgatattcccataactgcggcaagcaagaagggcgtagcgcagataaagctggtcgacccctataccaataacagcggtgcgctgatgttcaccagtgcggatatcggatacgacaaggtaaatgatcctgccgcaaaaagcactgccaacggcgcgtggatatatgtaagaggagcagacttcggctatggggcatcagagtttatcgctgaggtcaagggcaagggaagaatagaggttcgtcttgacgatatctcctccaaagccgctgcgttcgtcgagttcgactgcgcggattataccaaaatacgctcggacagctttgcgcagtttgacggaagaaatcatgacatttatttcgtattttccggctccgatatagagcttaagtcgtggaggttttcgaagggagacgagcagcttcgtcctgaagagagcatagcctccaccgaaataccctacaagacgctggtaatatcgggacagaccgagcccggaccgagcccctctgcgatgctcgacattccgaaggacggggactattccataaaatcctcttcttttgaaaaggacagcgccatagtcaacctcgggtttattaataccgataccaatgcgaagtataaggtgcttgtgagatcgctgacgctggcaaccgaaaacggagatgttgaagtacccgtaaataaggaactcgatcccacaagctcgtcggaaaacgggcttgaaaacggctggggcggctccgaggtcggatcgctgatttacggcacggaggaatgtggaatattcgcagcgaaaacagacataacatggacaaactatcgtctggcgcttaaagtaaacggcgaagagacgccgttcacatccatcacctacaatgtcaccgtaagcggtcttgagcttgacagctgacggaggcaacggaaaataaggagggaaaaatgaaaaaacttgttaggttcgcagcggcgctgatggcggtattgacgctgacggcatgcacggcggaagttggcacgagctccgtgacgtcgacgccgatgtcgacgacgacgtcgacatcaacgtcgaatccgctaccgagcgtcaccaccgagcccggaaaagaggaggaccccaaagtgcttgataaggatatcataaaatccacgataacttcaaccgacgacggcaagggaaactacacaaatcccgttattttcgccgacgtgcccgatattgatataatccgcgttgacgacgcgttttatatggtttcgacgaccatgcacctgtctccgggttgtcccgtaatgaaatcctacgaccttgtaaactgggaaatagtaaattacgtttttgatacactggaggacagtgataaacttgccttaagaaacggggaaaacaattacggcaagggtcagtgggcgactaccctcagatataacaacggtgtgtattacgccggcttcacttccttctccaccggaaaaacttatatctatcataccgacgatatagaaaacggaaaatgggacaggttcgtgtatgacgaatgcttccatgatatgagtcttttgttcgacgacgacggcaaggtgtatcttatctacggcggcggagagatatggtgcgttgaactggaaaaggatctgagtgcggtcaagcccggaaccaagaaaaaactcatcaacaacgcgggacttgtcaagggctgccttgccgagggttctcacgtctataagctgaacggatattactatatttttatcataacatggccacctaatagcaaaagaacgcagctttgttacagaagcgaagcgctcgacggcgagtgggaaaggaaagtgataatcagagataatatgggcttcagaaatgatggtgccgcacagggcggtatcgtcgacgataaggacggcaactggtattgctttgtatttcaggatcacggggcggtgggcagaactcccgttttgtcgaccatgacatgggaggacggctggccggtagtcggagttaagggaaaggtgccaacgaccgacaagattcctatcgcgggtcacgagaaaaagggcatcgtcacaagcgacgaatttatcaactcacatatagtgagatcctatcatagctttgccgacacgcccgaggaagctggcgagagcgattataacggctctaacctcgggttggaatggcaatggaaccacaatcccgacaaccgcctctggtcgctcaccgagagggaaggctatctgaggctgagaacggtcgatgtctgcagcacagttgccaatgcgagaaacaccatttcgcagcgaaccttcggaccagaatgcggcgcatatatcaagctcgacgtttcagaaatgaaagagggcgatgttgcggggtttgccgccttcgcagagaaatacggttatgtcgccgtaaaaatcgaggacgggaaaaaatatatcgtaacggtttggtatgacgataacgacgacgttgaaaaggaatttgaaacggaaagggtcgaaataacggaaaacgaagtgtatctgcgggtcgactgcgatttcaaaaacgcaacggacaaggcgtatttctattacagcctcgacggcgagaactggacaaaaataggagacacgctgcaaatgaattattacggtctgcattttatgggataccgttatgcgatattcaacttcccgacaaagcagacgggaggttatgtcgacgtggactatttcagggtggaaaacaaactgctcaaataaactgatacattcaatgcgtttcagccgcacagggggtaagaccttgtgcggctttttctttttcgggctgctgttttttcttctttcgggaggaaagagttttttccattgaaaaatagcggctttgtgttataatttaagtacggtactgcggcagtaactgcaatactgctaagaaggagcaaaagtaaagccaaaatttgagccgcattaaacaaagaaaacggctgcaaaaaccacccaccttgatgttgtataataaaacttgacatcccacgctcaaaagaatatgctaaaatcaggagggtgaaggacatgtcagaagcgaagaaatacgacaggagctacaaggagcagtcagtaaagccggcgctggaaataggggtaaagcgagccggcgaggaactgaaggtaccgtacggaacgctgtacgggtgggtgcaggcggcaaagaaaggtatctataccgacacaacgaaaaaaagaagtcccagataacgcagaagtacccgcagtacgttattgatatgctgtgggagctgagaaaggaacaggacgaacagtgcgccggaattggcgacaagtggcaggactgcgaccgtctgttcatcaagtgggacggaagccctatgaacaacaatactccctacttttggttcaaggagttttgcaaaaagaacagcataaggttctgcgacattcactcgttaaggcacttacacgcaagcatgctcatcaatgcgggcgttgatgtggttgcagtatcggcggatttgggcactcgcaggcttcaacgacaacgaacatctactgtcatatgttccaagaagcacaggcaagggcgagccgggcaatcgccgacgcacttatctttgacaaaaaagaaaagcagggcggcgaaaaagccgaatttcctgcttaaaaaccataaattcaaaataagaacctctgctgttaccgaaatcaaagattttgaacagcaacgagaaccttgttgctttgcaataaagaccaaataaagaccaagaccaaaatccgtacaaaaagaaacactcccaaacagctctgtaaagccatttaggagtatcgtagtgtggtgacccgtacgggaatcgaacccatgattccgccgtgaaagggcgatgtcttaaccgcttgaccaacgggccgtagaaatggtagcggcagtcggatttgaaccaacgacaccctgggtatgaaccaagtgctctagccaactgagctataccgccatatctttctgtttttgtcactctgtatcagcgacttttatattatatcacagcgttttgcgtttgtcaacactttttttaaatttttttcgatttttttcgtttttgaaaaacgccgtgatattttatataaaaatcagctaatcagacctctgcgtactgctttctgcctgtttcaaaaatgttgccgccgacagcgtcgattgcaacgataagagggaatttgtcaaaagtcagctttttcacactttcacagcccagatcctcaaaggctattacctcacactcggttatgcactgacaggcaagtgcgcctgcaccgcctatggcacagaagtataccgcaccgttgcgttttatggcgtctactacggcaggtttgcggtctccctttcctatcattgcggataaccccatatcgagcagcaggggagcgtaggggtccattctgcccgatgtcgtagggccgcatgagccgatagccatgccttctttagtgccggtaggacctgcgtagtaaatagccgcaccgtctatttcaaagggcagttctccgccttcgtcgataagctgttttatacgcttgtgtgcggcgtcacgagcggtgtatactgtaccgctcagttctatcttgtcgccggctctgagcgtttttgccttttctttaagttcgcttgtgttaagttccaagtttgtactcctgttcgcattgaatttattatgccggaaagcatacactttccggcatacgatatttacttttgattaaaggtcgaagaatcccacattatccgagctcatctcgtcgtcgtcatcatcattgtctttaagaccttccatcatcttgagatcccacgaaggatcatactgggctgtgttggtggtcatattgtcgtttattccgccgagcatggacgaataatcggacatatcaatcttttcttccttagcggaagctgcgggagcggctggatcgtcaaacgaagatgtcattccgtcatcgtctgcctgcttatgtgcagggggaggagtaatagacataccgttcatctgtgcttcgagatccttccagggatcgttcaccttttcttccttgccggcgacacccattgaacgactttcattcagcttttccttaggtttatcggcgctgcggtcggcagtccgttcggtcttagctgcgggcgcaggctcatcagcaagaaggtcgctgaaatcatcgtcaacaggagcaggctctgccttagcttcgggagcgggagcaggctcatctgcaagaagatcgctgaaatcatcggctgcaggagcaggttctgccttagcttcgggagcgggagcaggttcttctgcaagaaggtcactgaaatcatcggctgcaggagcaggttctgccttagcttcgggagcaggagcgggttcatctgcaagaaggtcgctgaaatcgtcggcaacaggagcggcgtcggctttgggagcagatgccgcagcaggctcatctacaagcaggtcagccatatcgtctgccgcaggagtttcctcaacgagcagatcacccgtatctacgttatccgcagaaatatcatcgtcacccgatactatctcaaatgaactgagcagaccgttgttgtctgtcagcatatcgtcatcatcgtcatcgtttgtctgagccggcatatccagcttaagctcgaagttatacggctcgatttccataggagcgtagtcgtcaagctcgctctcgtcaagtccgccgatattttcaagctcgctctttgcgttgataagctcctcatcatcggacagcttttcttcgggaacgtcagccgtgttatcagtggctgtttctgcctgtgcggcttcttcaacagccttagcgagtacatcgtttacagcctttgtatcttcaacagcctttgcaaccgcatcgtttacggcattagctccggcaagtgctttttcaacggcttcatttactgaggcggttatgttggcaagaacagcctgaatatctattgcgggagccgccgcacctgatgtaacgacgtttgcgaatgtgtctgccttttcaagcacagactgcttgtaatcgtatgttttctttactgtatcggcaaaatatgcctttgcggccgtgataatctcgtttgccttgctctgagcgtcatcgattacagcgtttgcatcggcgtttgcttttgcggaaatctctgcaagctgagcggggtcaattgttccgccgctgtgctttgctttatctatttttgcagctgcctgctttttgaattctgtgaattcttctgtcaaggcagagtatttgtcctgcataacgtgcagttctttttcggtctgcgccagcttgcgtctttcgtcaagaacctgctttctgctctcaagaatctgtgcgtcaagctcagcctttttcttttcaagctcggctgtaagttcgttgttctgaccttcgttcgtctgctgtttttcttcgagcgctcttttcagctcgtcattttcttccttaagggctttacgctctttattgtgctgtactatgtatgccattacttcggctttgtcgaagccgagcggcgaggttttgaattcgccgtttgtagatggcgcttttttctgttctgccattattgtaccccctgaaaaatctggttattgttattataccaaaaattattcaataattcaatagtgaattgtaaagttttatcaattacccaaaaatgcgaacagctattggtgattttaacgaaaattcgctatcggctattgtattttattgaacggtagtgtataataatataacaaccttaaaataatttcggttttttaaagatattaacgaaaggactgatattgatgatcgacaaaactatgccgttttcgctcaaggatgaaagagaaaacgagatgaaggaaatactgacaacggtttacggtgcgctcaaggagaagggctataatcctataaatcagcttgtcggctatattctgtccgaagatcctacctatataactacatataacaacgcccgcagcctgatccgccatattgatcgtgacgagcttttacaggcaatggtcaagacttatctcggcagctgacgaaagccgccatttatttcaatgaattacaaccgctcctttacggatactatatctgtaaaggagtgatttttttgcacggaaaaatgtcagccgcagtatttacggtattgacggcaatgttcatgtgcggatgtacgtccgataagaatactgtcggacaaagcacagaatataacggcaggggaggcagaacgcctgctgaaacagcttttctgacggacggaaaagagaaggtctgctacggtcagggctatgaaaccgatagcgataatcgtcctgtaggagcagtacaggcgcaggaaaaatacgggtcatacggcggaagattcatattcggcaaagacgacaggacgatctgcctgacgtttgacgagggctatgaaaacggctgtaccggaaaaatactggatattctgaaggaaaagaaggttacggcaacgttctatgtgacgcttgattatgtaaaaagcagtccggagcttgtacagcgtatgataaacgagggtcacgaggtcggaaatcacagctgtacccacccgtcactgccggatacaagcgatgatatggtatttgaagaaatacaaggacttgaaacttatatttccgataatttcggcggatacaaaaccgttacgatgcgtccccctagaggagaattttcggtcagaacattacgcattgccaaaaatatgggttatgatactgtgctgtggtcctttgcgtacaacgactggaatacggacgctcagcccgacagggacacggcgtacaggcgaataacctccgcaacgcacaatggggctgtatatctgctccatgcggtatccgaaacaaatacggcgatactgcccgatgtcatcgactactggcttgataacggatatacggtaaaaagcatttcaggataaaaaaagagcatcggcacataataatgcaagccgatgcttttgtatcaccgcaattaacacaaaaaagaaaacgctcccgcaggagcgttacgttaaatcgttattctcaggaaacagcgtttaacttcttagcaagctgagatttctttctagctgcagcgttcttgtggataataccctttgctgctgccttgtcaactgctttaactgcaaccttaacgttgtcagcgttagtatcagcgtcaaccttcttcagaatagtcttaagagcggtcttgtcagccttattgcgagcctgctttgtagcagatactaaaactctcttcttggcagatttaatgttaggcacttacggcacctcctttatacagatctacatataatcatagttatatttcacaatacgctttattatagcacgtccaaaacgaaaatgcaatacttttttacgatttttttgaaaaaattcttcgggaggaaattttatgcagcttacgggaagaacagatatggcgaccgagtttgtaaagggcaaaaacggaataagatgtgaaagctatgagctttacggagagaagataaccgaaataatcgtttccgaaaaggaaaccgctctttttaaccgcccctgcggaagatattttaccgttgacagtacggacgttccttatgcggacggtcagatccatgcactgtgtgcggtgcttaacaagctccttccggaagggaaatgtcttgttactgggcttggaaacccgtctgtagcgtctgacagtcttggttggagaacggcaggcagggtgcttgcgacctcacatttcatcgaaaaaatgcacaatgcggacggaatagggaatgtgtcggtaataaggacggatgtttcggcaaattccggtatagacagcgtctgtcacgcaatattctgtgcggagaagataaaagcggactatattgtagcgatagacagccttgcgtgcagtgagccggagcacctttgcagaagcatacaggtcacggataccggcataacgcccggcagtaccgctggcaacaggaaccgtcttgacagtgcggcggcaggcataccggtaatcgctgtaggcgttcctaccactatggagtatgaaagcgataacgacagattttttgtgacaagatatgatatagatgttgagataagcaggtacgcgcatataatatcctgtgcgctgaaccgcagtctgtgtccgtcactgtcatacagcgacatatcaatgctgatgaattattcctgaatatttgcggaaaatgaatcataagctgtaacaagaaaaatccaactgtgaaaacacttggcgaaaggaagggcttatgagaggcaataaaaacaaaggtattgtaaaggttcttggcatagggcttactgcggcggtattatcgtttaccctgacgggcgtagctgaaaacgccgttacgggagcggtaagcggcaaaagcgtttcggacggactaagacagcttaccgcactgagcgttatgcttgctgttcctgtaaacgaatttgacggcagggatgaagatacggtttcatccgagccttgcacagagaaaccggacaatgaaacaaagactgaaaagcaggagcagcaggagcagaaagtgcctgcaaccgataatccgtcaagcagtacggaggatacttccggtgaaacgctggtgccggtcgacgctcccgccgatgtaaaaacacggctgatttccgtcaacataagaaaggacaaggacgatcttacacagtatacggcaaaggacggtacggtaaaggaaaagcactacggaaagataggcggcgacaatgtaatagacctcgaaaacggtcagataagaaactgcaccaagctgccgtcggagcttataggcgctgaggctgagaaaaagccttctgtcacgctgtcggacagcaacgaacctcaggtgcttataatacatacgcatacgaccgaaagctacgaacgtgacagtgacggatattacgatacagattatgacggaagatcgctttgccctgcaaacagtgttgtgggagtaggggcggtgcttgcgcagacgcttgctgataacggaataagcacgctgcacgacggaacggtctttgatgatcccgtttacaactactcatattcaagaagcagagagcgaacagagcagctgctgaaagagtatccgtcaataaaaatagtgctggatattcaccgtgacggaatagcggacggagatgtgagaatagctcccgttgcagaaatcaacggcagaaaagcggcacagataatgataatatgcggatgtgacgacggcacggatatattgccggattatatggataacctccgctttgcgtcatatttgcaaaatgcgatagaaaaagataacaaaggcataacacggcctatgcttttcgattatcggttttataatcaggatctggctgaggcttcactggttatagaattcggagcgttggcaaacgatattgagcaggtgcgatactcagccgagcttgccggcaggagcattgcaaatttgctgaaaaatgcagattaatagaagcatattgccgttaaaaagcgtgtcagaaagattatgataagaatcggaacacaatcgttataaacagataaaccgcctgggcattaaatccgggcggttacttttatggagcttgtgacgggactcgaacctgcgacctgctcattacgaatgagctgcactaccaactgtgctacacaagcgtatttattccgatattctgatatatttacacacattttccgttttccgaaagcggacgcttcacaagtcaaaacattgcataatgcacaataaacacttgaaaagagcgaggcaatgtggtaaaataaatatggtcatatttcggaatgcagttccaaaatgactatattattatatcgtatttttgatttgttgtcaatagctttttgacggaaacgaggaaaatttgataaaaaaaacatctgtggcaaggtgtatcggtgtagttatcggcgtactgctaattgtttttgcagtatttctcgtagttacatcaatgctgttttcattcggcggctctgctgcgccggatattttcggatataatgtttacatagtgcgtgacaacgatttctatcagcttaaggcaggcacagccgctatagcgcagaaggtgtggcccgacgaggtaaacaacggagagcttataatatataatcggtatgaaaacggcggagcacagcttgcaaaggtaaattcctccacgcttaaggaaggcgttatgagctttgatgttgaaactcaaggcggagaaaatatcacaatatcacaaagccagcttgttgcaagagttaactattgcagtgatttctggggtgctgttatcggatttgcaatgtcgccgtttggcgttatggctatcgctatactgccgtgtatcgcaatagtagcatttgagatagtgaagttcattatgtcaaagcgtccggtaccgcaggtggaaacggtcaagttgcaggaagaagctccggtgtatgttccccctgaaagcgaggagcataagctgtcaaaagcaagcaatgccgaagcgaaaaaggccgctgttccgtctttatccgataacggaaaagtgccgcataatcgtgtcctggacagctctcacggtaaaacggatgatttcacagagcgtctgcggagcaaaaagaatatagcggcaagtgccgataatataaaagatcgagcggatttttccgccggagcaagaaaaagaatggaatcggacagagcagagcagcaaaaggaaaagaaagctaaaacagaaaatataaaaaatgaaaatgctttgcccgaaatgacagaaaaaacggttgcggctgaagtaacgcacagcggctccgagcccgatatatcgctggtgttcagagatgacgaggacaagagatatgatatagacgatattcttgccgatatagaaaaaaggcatcattgacgggcagaaaagcagaaagaaaagtaagaacgaaagagagaacacttgaaatgaataaaaaatcagatactgtgaattcagagcttcgtgacaagctgttcatagtattggcattaaccggttgtgtatcgaatatagcgggatttactgcaaatgcggtgatattcggatttaccccgcagaccttattctgtgcggcttgcgcacttgtaattatagtatcgtcattggtcggttttctgacaggaagaacctatgtcgctacgtttataatactcattgtgcttggatttgtcgagttcccgatgttgtatatttcatacggtgcaagcacggcagtgtatatgcttgttgcggaaatcgggattattacttttatgaagccggtgcacagagttataatgggagcggcggtgttcgttgcagatatagccgcatttgttgtcagaagcaaattcccccagctgaatatggctaatgacaatatggagcttgatacgctgttttcgttcattatagcgtttttaggcataatggttgcggtcgcaatagtgatagtgcaatttgagcgtcaggcaaaacagctcagtgaaatgggcgaggagcttacgcttgctgtgaataccgatccgctgaccgagataagaaaccgccgttatcttataaaatatcttgaaaatcagctttcgcaggacgagaaaaagaaacactgtgcggtgcttatcgacctcgatttgttcaagtcggtaaacgatacatacggacacgttttcggtgatgatgtgcttaaacattttgcgtatgcggttaaaacaaatatcggagaaaatgaccttatagcacgattcggcggagaagaattcatgatcctctttgatacggataatatcgaagctgttatgacggttatgaagcggataagaaaaagctattcggagttttctgagaaagaaaaaggaaaagaatttactttcagtgcaggcgtagctgtgtacggaagcagcaactcgataaccgagatattcacaactgccgacaagcgactttataaggctaaggcggcaggaagaaataagataatgatagaataataacagagcagtattatataaaaattgcccttgtctgtgaatacaatccacagacaagggcgttttgcttatttatacaacaatgcaaaaaccagcataatcagaattaatataatcataaacaaaaatgtcattccgattgcttttaattcgttgccgcttatatcttctttattgcaattattatctgcaagcactttccttttatcaacggttggcgttttatttactgccggcttggaatgctgttcggaaaacccgtcttttataagctgtgcaccgcaatgcggacaattgttataataatcgggtacgaacgaatcgcagtatctgcatttcattgatacagtcttccttattttagatagtcggtatcggcggcggaaccggtcggcttacaagagaaacaagctctgcaaccgagtctgctcttgcccatgaagccataccgtttttccatacaagcgtttcggcggtaagttgaccgtttgcggcaagctgagccatagtgttcatatcataaggtcctgttgtctgaccgtttacggctatatgataagctgctgtcgggatgggcggaggagcggctgccgcagactgaggcattgtattttgcattgcctgatttgacgcatttgcgttgttcattccgttaattccgctcatagcgttgttcatggcacctgccatattctgacctactacaccgccaacagccatagcggccatcattgcggcaggattgaagcctgcgccgccctgaccgccgaggtctacactgcctgcaccgtttgcccccatctgactgagagcctctgcgcctgctatgccgacatttgcctgtaactcggactggaatgctccgaggtttgcactctgcgtctgcttgtgcattgcatactgtccttcctcacgctgaacacggagcgactgctcatagttctcggcttctatacgctgtttgtcgtggatatttttgatatttgcggctgtctgagcctgaattgtatcgcttgttaccttgcgtgttaccgccataagctgttcatagccgtcgcttgtcttatcaatttctatagagttgatatctacgccggatacggtaactccgaaattttcacgaagtctttctcctatgtcgtattctatcttgtcgttgataagagcaatcttgctttcaatctggataacaggaatgttattttcagcaggagcggctgttaccgcatctttgatataccggcagatagcatcttttatctgcttgttgaagtcatccgttgagaactgtgtaaggcgatgcagctttacaaattcacgataatttgttattctgaagctgacagtacctcttactgctacaggtacgccgaagtccataaatctcggatcgtatacgtcaaaatacggtattccgaactttgtctgaatgatattcgctgtattgataaagtatacttcagcctggaacggtgttccgcctgcgtaagcaagtcctactatgcttgcaagtacaggcagattgcctgtgtcgagctttctgtcgcaaggaccttcaataaagtcctccataacgccgtcgggacgattatagacaaatacggctacctcgccgtcctttacacgaagcgatgagccccagcgtattgcattttcacggctgttattgttaagctccgcacccgccggacgccacttccatataagatatgattgctcgtcgcaacgtatctcgtccataaatccgcctgcttttggtttgccgaataatcccataatatttctccttgacagattgtaaatatgttacttcttttttgatttgaacattcgtgtaagcataatgattgcgcatataacggcaacgaccaatatcataatatatccgacgctgtctttgtcggcgcatctcggaatcaatagtccgaagcagacgagcaagccgatagttgctatgaatttaggcatagccgaatcgcatcgtgtcatcggaggaataattatcgcaccgagaatgaggtcaagcatagtaactaactgtaacgggctgaatccagaactgtcaacgttctgacagcagattattacaagaacagcaatacttatcgaccatgcaagagtaatgattacctgaggaagagaattacttatctttacaagaaaacttcctgcttttttagctgttttaacatatttgtcacgggtgagctttttctttgcctgctcgtacagctcgttgaattttgctttgtctgcatcggcagtaagagcgagcttagctttttgctcgacctgtctgaactttaccgcccatgcgtcacatatattctgttctgtattgccagttatgtttgaggatgcgagaattagaaattcaaatatatcttcctttgtattcggaacgggaaaatttctgataagcgatgtacgctgttcgtctgatgctgcgtttgcgagtgacatagagaattcatgtaaggatgccgatgattttccgcctcttatttcatagccgcatgacggacaagtggtaacaaaagcgcccagcacctctccgcatgacggacatttatgtatttcgccttcaaaaacagtttcacgttttgagttgcctgcctgatatgattgtgagttttccggagagccggagctttgtgcaccgcagttcagacaaaattttgcaccgtccggtaactgcgagccgcatttactgcatattgccatattttttctccctttagttcacggctttatcggaactaaagccgttttttaattatgggtaagacaaatcagtccgtatacctgtcggtatcggggattgcatcacatatatcgccgatgttgcagtcaagatactcgcagatacggagcagtaccgataaagccacctcctcgtttttgcggagcttggtcattgtacctgtcgctatattgagatcttttctgagcgtcgccggggatatatctttttcaattagtctgatccataatttcttatagctgattttcatgaaaacatacctttaaaggtatgcccgatcacttagtattatacactgcgcaattcaaaaagtcaacagatttcagcaaatttatagataaaattcgcaacttcttgcgaattttccggttccgacggaaaattcgttattgttgacactgaaaaattattcggttacagctataagaaaaaatgatctggcagaccttgttcatatcaagtaaagagtacgtattccggtgcaaaggattttcgtactctaaagtcggctcaaatacatataattatttaattctagtataccataaaaaagcgataaattcaatagcccatatgccatgattgtgacatacgggctgagattgtaccggtaacggagatttgcattaagctgtggcaattcatagcatacaccatatttgaaccattttgcaagaaccgatgtacgcttatgctgtttgaaaaaaccgccctgctttcgcagggcggttttcgcttaaaactgtgctgttgttacgtttgattcgctgtttgcggattcggcagtgtcgtattcgtccgacaggttatcctctatccacttagccatcatcagcggtgaaagtatgatgtccatcgttttctgctcaccgtcgctgacgctttccatagtaactatctctcccttttcacgtccctcactgcctattatatcgtaggtcagctgacaacggtacttgatggagcagagcgggctgtgtatgctttgttggctctgcatcgtgcagagcctttgggcatacacgcccggcatccgtgccggggctgaatgtggggctaccgcccctagaccccgtcgggggcggtagcccctgcgaccccattttttataatcaagaggtttatcgacagtctgaaagaccgcctttccggcggtctttttatgtaaaacgcatataatccggcgtttgtgcggcaaaatactataaaattatgtcgattgacttttttatgcaacagttgtataataaaataaatgtggcttacagcaaaagtatgatatggcattttgaaattaaggagctgaacttttgaacaagaccgaaatacttctgtcgtgtatgtttctgaacgacagcgaagaaatgataaagcgttctcatatcacctcggacacggttataataaatcagtgcaatgaggacggatataaggaagagcatatcggcgatgcatttgtccgtactttttcggtaaaggagagagggctgactaaaagccgtaacctcgccatatctaaatccgttgccgacgtgtgcattatctgcgatgatgacgaggtgttctcgcaagggtacgaagaagcggtgcaggaggcttacagcagtcttccgcaagcggatattatcatattcgatatggcgcaaagacctcataaatggggtgacagcataaagaaactcggctacagggatattatgagcgtaagctcgtggcagataacgttcagacgtgaaacactcctcgccaaaggcattcggtttgacgaaaacatgggtgcaggctcaggcaatggtgcggaggaggaattcagatttctgacgcagtgccgtaaggcaggcctgaaaatatatcactacccctatgagctggcaacggtggctcagacgcaatctacttggttcaagggcttcgacagggaattctttgtgaaccgaggaaatacgacaagatatataatggggcttcccttgtccgttctctatgccgcatattacgcttttgccaaaagaaaacagctgacggacaaaagtatgttcaaggcgttttcatatacgctcgcaggaataaaggaaaacagacttaataaactgaaaaaaggtaacaattaatggaaaagatactgagtataattatcccgtcttacaacagcaagccttttctggcaaaatgccttgattcgctcctgtgcgaatgtacggacaggctcgacataatcgttgtaaacgacggctctacagacggttgcgaacaaatcgcagaagaatatattgcaaaataccccgcctctataagccttataaataaagtcaacggcggtcacggctccggtattaatgtcggcagtgaaaaggctgtcggcaaatatcttaaagttcttgacgctgacgactggttccttaccgagaatataccggagtttataaaggcgcttgaaaatacggatgccgatgttgtgctgacacctcatcatacgataaacatttcaaacggcgaagtaaaaagctggcgttgctttccgccgcagtttggcagaatatacacaatggacgaggtaatgtcgcagtggaaaaacttcgaccgcagccttacgttccacggcataacctaccgtaccgatttttataaaaacgaaggaataaagctcagcgaaaaggtgttctacgaagaccacgaatacgccactttcccttgcagtaaggcaaagagcatacttccgctcgatcttttcatatatgaataccgcatcggcgatgtgacgcaaagcgtttctgccgcaaatcagcttaagcgcataggtcataccgaaaccgtactaaaacgtatgaccgccgagggcaagagctttacgggtgcggcggcgctctactgtgcaaagaaaacacatctcctgctgctgagcttccttgttacctcgcttttgtgcgataaaaacaggaaagcaggcaggcaaagagccgatgaaatgatgagctttatggataaggaataccacgaagtttatgagatgagcaaaaagcattgcaagatactgaaaacactcaacagattgcatataggtcttaccggatacaacagaattcttaactcaaagctctataacaaagtaagacataacaagagctttgattgacggaggtataaatgacacttgttcgcaaggataaaacaggcggatttcttgaagtaaggcactacaaggatttgcttatacagctcgtttcacgggatcttaagctgaaatacaggcgcagctttctgggatatgtatggagcgtacttaatccgttgctgattatgatcgttatgtacgttgtattctctaagctgtttgacaggaatataccgaatttccccgtatatcttcttgtcggaagaaccttgtacgatttcattgtcggtgctacaaacaaggcgatggacggtataacatcaaatgccgcactgcttaaaaagacctatgtttcaaaatatatgttccctctcgcaaaggtaacaagctgtatggttgactatgtgctgtcgcttggcgcactgctgatagttctaatcttcacaggctcgcctttctactggacgatgcttttattccctcttataacgctggaagcgtatatattcgcctgcggaatgggattcttcctcgctcagatgcacgttttcttccgtgacacaagatatatatacaacgccttcacaacaatgtggatgtatgcgtcggctatattctatcctgttgatattctccccaactggatgcgtctgctggtagaaaacttcaacccgctatatatctatataaaacaattcagagatattgcttacagcggctgtatctccgatatgaaaacgataatactcggtgtagcctatgccgcactgttcttcgtacttggtactgttattttcagagataaacaggacaagttcattctgtacatctgacggaggtatcggtatggaagattatataattgacgtaaacaatgtgacagtccgcttcaacaaagcgaatatgaaggtcgataaccttaaggaatatgtggtaagactgctgcgccgtgagcttatgttccaggaattcatcgcactcaaggacgttgacctgcacataaagaagggcgaagcgtggggacttgtcggcacaaacggagcgggaaaatcaacgctcttaaaggtaataagccgcatactcaagccctacaagggtacggtagacgtaaaaggctcggttgccgctcttattgaacttggcgcaggtatcgacccgaatatgtctgcccgtgagaatatatttctcaacggcacactgctgggatataaaaaggactttatacaggaaaagttcgatgaaatagtcgaattctcggagcttcaggacttccttgattctcctgtaaagaacttttcatcgggtatgaaagcaaggctcggcttctcgatagcgacctcggtacagccagatatacttatagcagacgaaattctctcggtaggcgatgtccgcttcaagaagaaatgctcggagcgtatgcagaatatgctttcaaacggcactactctgctgtatgtttcacacaatatgaagtctatcgaacagctttgtgataaggcgctgtggctcgaccacggagtacccgtaatgcagggcactgcaaaggaagtatgtgccgcatataacaagaaaatgggtgtctgaccgccgacctttaccggctgccgcaggagcttagaaggctcttgcgacagcttttttgcgaccggtttatccggcattatcaaaacgcaaatattaccgtaaaatcacaggcatttaacctgctttattgtgcattactactaatgcgtaaaacggcttaaattcttgacaaacagccgctttcgttgtataataatatgagtttgctttacgctttgaataaaatttctttacagaaatttttcagtctgtcgataaacctatatttttaataatacggggtttgaggcgtagccccaagcggggtgagggcggcagccccacactcagcccctttccgggggaaaggggtttggggattcggcaaggatgccgagatagaacgcccaaaggctttgcaggacgcaaagctcacaaagcgttcttatagggatagagaatccgcactatcttgtaaaaaacagacttttttctacaatctgcaaaatttctttacagaaatttttatcattattttttctttacccgattcaatgcgtatccgtttttacggctaataattatcacggtggtgaaaacttggaagaacagctttcagaaaaagaacttgccgaccttaaagcaaaagaacttgacatactcgtaaaattcgacaggatgtgcaaggagaacaatttacgctattttattacagcgggaacgcttctcggtgcggtaaggcacaagggctttatcccgtgggacgatgatattgacgttgtaatgctcagaaaggatttcaaaaagctgaacggcgtatgcaaaaaagcattacccgaaggactttttctgcaggacaagaagaatgacaagggttacccgttccactttgacaagataaggcttgacaacactgaggtcatcgacccgttccttgaaggcgtaaatatgcacaagggtatttatatagatgttttccctgtggacaagtgtcccgaaaacaataaactggcacaattcatgttcaaatgggtaagcacgacatcttatgcgcttatagcaaagcagaacaaggattttgactttgactataccaaaaagtcagcccgtatgctttatcactttatgataaagatgccgagaggctttgttattgcgatgcgtgactttgttgtcggtatcttcaatgtattctgttctggcaaaaagctgtgtaccgtaagcggtgcacacggcttccccagagaaacatataaaagcgaatggtttgaggagaagataatgctcccgtttgagagcggcgaatatcccgcacccaaagggtatgacagtcttcttaccaatatgtacggagactatatgaagcctccggaagatgatgaaaaaagcggtcacttcacaagcgttgaaagtgacaaataagtatcagaataaggatctatatgaaaggacaaaaagaatgaaaagagtaattacttacggaacatttgacctgctccactacggtcacatcgaacttctcaaaagagcaaaggcactcggagattatcttatcgtagtgctttcaacagatgagttcaactggaacgaaaagcagaagaagtgctatttcagctacgagataagaaagcagcttcttgaagctatccgctacgttgatctggttatccccgaaacctgctgggatcagaagataagcgacgtaaaggaataccacgttgacacattcgtaatgggcgacgactggaagggaaagtttgattttctcaaggaatactgcgaggtagtatatcttcccagaacacccgaaatttcaactacgcagataaagcacgaccttagcgacaagtaatataaagataaacagacagtcgcatgatttcacggaggaactaaaatgagcaacccctttacctacgccaataaggtacgcaaaaaattcaaggatccttactgggtagcaaaaaacaagtatataacctattatgagcagttaccgatagacgaaaaagtgatactgcttgaatcgcagaccgctacaaagattagcggtaacctgttctatattctgaaatatcttttgacagatgaaaaatacgccggatatacggtttacctttcatcttggggaagatatgtaaaaagcataacggctattcttgaacactacggattcgaaaacgtaaacattgttgtttatgcttccgatgattatatgcgtctgcttgcaagcgcaaaatatctgataaacgacgctaccttccctaactactggataaagaaagagggacaggtatatataaacacatggcacggcacaccgctcaaagctatgggtcgcaaggtgcataacgatgtattcttcggaaacgttcagaagaaccttgtaaatgcagactatctgctttaccccaacatctttacgaaagacgtaatgataagggactatatgcttgagaatatttcttcaaattcctatatactctgcggttatccgagaaacacagtattcttcgacagggacgcagagaaaaagataagagaagaacttgaaatcaccgacaagaagatatacgcatatatgccgacatggagaggtactgtcgataaggtcggcgtatcgaaaaacgatgcatatcttatgtattacctttgcgagcttgacaaaagacttaccgatgatgagatattctatatcaacatccaccctatggcaatgcacgccaagaatacggcggaagtcagcaaactaaagcatataaagaacttccctgcagagtatgaaacatacgactttttaaatatcgcagacgttcttgttacagactattcaagcgtattcttcgattacgcctgcacacgcaaaaaagtggtgcttttcccgtatgataaagacgaatatctctgcgacagaggtatgtacatggatatggacgacctgcccttcccccaggtatttgaccttgacgctcttgtagacgagctgagaagcgaaaagaactacgatgatgaagagttcgtaaagacatactgcacatgggacagcagtaacgctactgcacagctttgcgacagaacaatactcggtatagatacaggacttacagtagcgcccgttccgaacaacagcaaggaaaacgtgctgatatatgccggcaaccttgacaagaacggtataaccacgtcgctcagatcccttatgaaaaatattgaccttgacaagcgaaactactatatttcattctgtcagggaaaagcaaaaagacacggcgaacagcttgcaacattcagtgataaggtaaacttcttcgcagtagcggaatacttcaaccttacagccgcaaacaagaccgtaaacaagctgtacaaggaacaccttgtttctacgaatcagtatatcaaatcgctcggaaagcgtatcgaacagaacttcctgcgttcatacggcaatgcaaagtttgacagggttattcagttctgcggatatgaggacgagatgattctgctctacagtcagttcaaaggtcaaaagacgatatgggtgcataatgatatgctcgccgaaatcaagacaagaagcaaccagagaaaagaccttcttgaatatgcttaccacacttatgacaacgttgttgcggtaaccgatgatattgtcgcacctactcagatacttgcaggtaaggacaagaagatcaacatagtaaaaaacactatcgactacaagacgatccttgcaaacagcgaacagcctatagcccttgaccccaccacaaaatgttctgtagagcctgaaaagttctatgagataatgcaatcggacgcaaagaaattcataaatgtcggtcgttattcgcccgaaaagggtcacgacagacttatagacgctttctataagctctggcagaaggataacagcatatatcttataataatgggcggcaactcaagagcaaaaaagtacgaagagcttattgaaaaagtaaacgaaatgggtctttccgaaaatgtaattcttctgctttcggtaagcaacccttatcctataatcaaggcgtgcgacggatttatattaagctcgctgtatgaaggcttcggtcttgtacttgcagaagcggatatcctcggtattccgatagtatcgaccgatattacgggtccgagaacattcatgaagaaatacggcggtactcttatagagaattccgacgagggtgtatacaagggattacagatgttgtacaacggtgaaatcaagccgataaacgttgactatgaagcatacaatcaggaatgtgtagcagagtttgaaaagctgtttgaataatttaataatttaccgataataaaacggggagcatttcacttggaaacgctccccgttttttcttattcattcacctcaaacttataccctactccccatataagccttatactccattttgaagataggccgtcaagtttggatttcagcaggctgaccgattcttcgaccagtgcatcactgccctttgcgtcagggccgaatacttcataagcaagctgttccttgctgaacacacggttcggattcgctataaacgagcggagtatctcaagctcgttaagccccagcggatactccttgtcgcctaccttcgcacagttatgttcattatcaatcgacagcgtgtcacactcgccgcacagcttcccgtcatatttgtcgaatacctccgacagctgtcctatatcaagcggcagcgataaagtatgctcgccaccgtcatttttcagcgtatatatatcagccataagcgaggtgtggcggcattcctgctctgcatcaagataacagccgccgagtattataatatcggggtgaagaacaagacattcacgcacaacgtgctgtgtatcctcgcttatatcacatatcgtttttaccgtaaagccctctttttcggcatagttctcaataaaatcacatatatgctcgttgtcacaggctattataatcttctttgacatttcagtgcctccgtaaagtacacaaaattaaatattaaagcgataaatccttatcgccacagactgttgataaacttatataatttttgaaaatggggtttggggcgtagccccaagcggggtgagggcggcagccccacactcagccccttcccacggggaaggggtttggggttagggatagagaatttgctctatttttataaaaatagactttttctacaaactgagagcctgaacgtaaaaggctctttattttttacccctctctcacctctttgtcacaaaaaaatattgacttttttccaaattcgtatataatttaatatgtattttcaactaaaaatcgggtacggcttttttgctaccctgatgataaacggaaggaatcataaattatatgaaatggacaggactaaacgatcttagagaaagctatctgaaatttttcgaaagcaaaggacatctgagaatggcgtcagcgccgctggtaccgcagggagataactccgtattgcttataaacgcaggtatgacacctctcaagaaatacttccagggcattgaagaaccgcccagacaccgtgtaacaacttgtcagaagtgtatcagaacacccgacatcgacaacgtaggtaaaactgcaagacacggcacatatttcgaaatgctcggcaacttctcattcggcgattacttcaagcacgaggctacggcatgggcgtgggagtatctcacaaaggtgcttgaaatccctgaggacagactttgggtaacgatttacgaagaagacgatgaagcaggcgacatctgggctaacgaagtcggcgtaccccgtgacagaataatcaagctcggcaaggcagacaacttctgggagcacggaagcggaccctgcggaccctgctctgagatacactttgacagaggtgaaaagtacggtcctttcgagagctttgaacaggcaggagaatgtgacagaattatcgagatatggaacctcgtattcacacagttcgacaatgacggcaagggtaactatactcagcttgcgacaaagaacattgatacaggtatgggacttgagcgtcttgcctgcgtaatgcaggatgttgacaacctgtttgaagttgatactattcagaacattatgaagaaaatctgctccgttgcaggtgtaaactatcacgatgaccccacaacagatgtttctatccgtgttatcaccgaccatatccgttcaacgacatttatggtcggcgacggtatccgtccttcaaacgagggcagaggttacgttctgcgccgtctgttaagacgtgccgcaagacacggcagaatgctcgacgtaaacagacccttcctctatgaaatatgcgacacggttataaacgaaaacctcacagcttatcccgaacttgacgaaaagagagaatatataaagaaggtcatcaagaccgaagaagagagctttgcaaagacagttgacaagggtatgcagatactcggcgagtttataaaggagctttcagcagacgatacacacaagcctatcttaagcggcgaaaaccttttcaagctgcacgacacatacggcttccccgttgaccttacaagagagatccttcaggagagaaatatcggtatagatgaagaacgcttcttcgagcttatgaatgagcagaaagcaaaggcacgctcaaatcaggcattcaagggcggctgggacgaggctacagccaatgcgctcagcggacttacaaccacattcgtaggctacaagtcgcttaccgccgacagcaagattcttgctatgataaaggacggcgaggtcaccgatgtatgcaacgagggtgacgaggtaacggtcgttcttgatattacacctttctacgcagaaagcggcggacaggtaggcgactgcggtacaattacggcaggcgaaaacgtaatgcaggttatcgacaccaagaagacaggcgcaggacagtttatctgcaactgccatgtcgagagcggatgcttctacacagacgacagtgtaaaatcggctgttgatgaaaagaagcgtatggctacagcgagaaaccacacctgcgcacatcttttacaggcggcgctcagaaaggttctcggcgaccacgttcatcaggcaggctcttttgtagatccctacagatgccgtttcgacttcagccacttcagtgcagtaactcccgaagagcttgaaaagattgaaatgctcgtaaatgactggattcttgcaggtattcctgtagtaaccgaagaacttcctatcgaggaagcacgcaagaagggcgcaatggctctgttcggtgaaaagtacggcgatattgtaagagtagtacaggcaggcgatgtttctacggaattctgcggcggtactcaccttgacaataccgcaaaggcaggtctgttcaagattatttccgaaacatcggtagcttcgggcgtaagaagaatcgaagctgtaacaggctacaatgtactctccgcatacgatcagacaaaggcaatggttacaaatattgctcaggtactgaaaatagcaaacccctccgctgtaatgcagaagtgcgaaaacatgatgaacgagatgcacgctatgcaagctgaaatagaccgccttaacggcatcatttcaatgagccagatgaagaatgtaacagagggtgcaacagaagtaaacggcataaaggtattctccgctatgctttcaggcgtaacgggcgacagcctcagaaaagccggcgacaagctgaaagacgctaacgattcgttcgtcgccgtgcttgcaggcgtatccgacggcaagggcaacttcctttgtatcgcaagccccgaagctgttgccaagggcgcaaacgcaggaaagatagtaaaggaaattgcggctatcgcaggcggtaagggcggcggaaagcccgacacagctatggcaggcatcgcagatgtaacaaagattgacgaggctctgcttgcacttaccgatatagtaaagaatatgattggctgataaaagccggaaaggaaaaagtatggattgcattttttgtaaaattgtttcaggcgaaatcccttccgaaaaggtatacgagagcgataaagtaatcgctttcaaggatattaatcctatggcaccggtacatatccttatcattcccaaagaacatatcgacggtgtagatgagcttaatgaaagcaatgccggtatagtaaaagacattatgcttgttgcaaagcatcttgccgagtccttcaaccttgaaaacggctggagaatcgtttcaaacgtgggtgaagacggcggtcaaacagtgcgtcacctccacttccacttactcggcggcaaaaagctgagcgttgagcttgcttaaaaggtgaatagttgtgaggcggaaattagcggctgttggaggttcatatctgataggactgattttcgcctcaattttctttgattttgcaatttttctcatttgtggagtaatattacttgtagctgttgcgataataacagcgattttaacaaggaaatatgacatatccgcagcactgctctgctgtgccgcaggaataaccgtattcagctgtgtatccttgtctatgtcaaaagcggctgaaccgttattgaacggaacctatgacataaccgcaactgtggcacaaaaacaagtaattggtagagatttagccgtattcagcctttatacctatacctcagacggcaaggtcggtgtgattatgtataccgatgacattgatgcgaaaaagggcgatatgttacatttcaaagcccggtttgaaaagctgacaaatacggcatattacggcactgccgaccgatacaggagcgacggtataactttatccgccataccttacggcgacatttccgtaacaaagggagattacccgttatcgttcattgacgattaccgtgaatatctgatagggcgtattgacgatagctttcccgatgacagcggtgcgctgatgaaaggaatattcttcggtgacaaacgttctttttctgatgagctttacagtgatataaggctgtcgggagcatcgcatcttaccgctgtgtcaggtatgcacctgacgcttataatgaccgtactgacggctttgctgacagctacacggctcggatactcctaccgtgtaaggttcgtgataactgcggtgcttacagtaggctttatggcatttttcggctttacggcttcggtactgagaagcggaataatgattatcacggcaaacacaggcgctctgttttaccgcaggagcgattgtcttaattctgtcggacttgccgtactgatgataacgcttttcgaccctctctcctgccttgacgcaggtctgatactctctgcggtaactaccgtgggagcaggcgttgtcggcgtttcggcttccgcatggttgaaagacaagctcccgtttttaaacggcagactttgcgatacgttatgcgtgtcattgtgtgccgcacttgcgggaataccgctttcggctatatatttcggtacgttttcgcttgccggcataatcgtatcagtgataacagtccctctttttacactgtgcctatcagcgatgctgatatttgcactgacaggaggtgtggtaataccgcttgccgcaatagcgcacttctgctgtgacattatgcggataatattctcggcttttgccgccgtaccgttcctgcacttcagctgtgagccgtttacggtgattataacaatccttgtgatttcagccgttgccgctgtgtgttatcttctgcttaaaaagaaatacgctgttccgatacttgtcgtttcactgctgtgctttactgcagtaaacactgtactgcctcagattccggacgacagcataagggtgcttatgcacagtgacggagcaaacggctctgttgtgatactttcccgtgattattcggcggcggtgcttatcggaaacgataaaaaagagcttagcacaataaaaaacgtgcttctggaaaacaataagaccaatgccgacacgctcattttctgcaataatcagaatcccggaaatgagcttgtcaaagccgcacacgctatttccgaaaacgtatctgaatgtgacggctgcaatgatataaacggaggacttttttcggtcagatgccgtaacgatgccctgctcctgtcggcgtacaacacaaagatcaacatctcatccgcaggaaaggcacagacggatatgataaatatcctatggggtaaaagcagatatatctctgccggtacaccctgctttctgataaacaggtatcagaaagcgtcaaacggaatatctctttattttaccgagtgcgaattgcacataaacgaggacgggataaccgcccgatgcaattacagatagaaaggggaaacagtatgaagctggacgaggataagctgtcaacagccataaaaagtcgtgaaatcagccgtgtaaactatctttacggcgaagaacgctttcttgtaaagacttataccgaccgcctgcttgacgcaaccgtcggcaaggacaggaatgatataaatctcataaagctcgcaggtacattccctgttgacacgctaacggacagtatcgacagtatgcccctctttgcagacagcaaggctgttctgataagcgacctcgaccttgaaaagttcgatgataacggtatcgaaacgatactgaactccctgaaggatgttcccgatgaatgcacggtaataatcagtatgacgggaaacacggaacagcttaaaaaagcaaagaacaaaaaactcataaccgccctcacaaagcagaaaaatgccgcagtctgcgaatttgcccatcttacgacggcaagagtgacggagcttattatgaaaaaagcggcgaaacgtggctgtgtaatatcacgggctgacgctcagcatatagcggagcttacactatgcgatctttcccttgcttctaccgaaaccgataagctgtgcagctatgccggcactggcgaaataaccgcagaaatgatagacaagctgacaataaaacagcttgacacaagcatatattcgcttgcgacagagcttctgaagggtaatcgcagacaggcgctcctgatacttgacgaccttatcgcccaaaaaatcgagcctgttgttatactggcggctctttcttcgaattatatcgacttctaccgtgcaaaaaccgcacagggagcaggaaaatcctcacaacagacagccgatgatttcggatatgcaaaaaaccgtaccttcgttgtgacaaaagcgatgaatctcgtatcacggctcgatacggagcatataagaaactgccttgatattctgtttaacgccgaccttgccctcaagacgtcagcaataaactacagaacggtgcttgaggaaacgatagtgaagctctcccccgaaaaaagcaggaggtcgtactattgataaagctcagacgtgccgtaatagtcgaaggcaaatatgataaaataaagctctcctccctgctcgataccgttataataaccacagacggtttcggaatatataaggataaagaaaaaaccgagctgataagaactcttgcatctacctgcggaatagtgatacttaccgacagcgacagcgcaggacttaaaatcagaaatcatataaaaggctgctgtaaaaacggcgatataataaacgtattcgtgcctcagataaaaggcaaggaaaaacgcaaaaccgttccctcgtccgaaggctatctcggggttgagggacttgacacagagatactggagtctgctctgaaaaaagccggtgttgcgaccgaaggcgatacagcttacaaaaagcacgactttctgaccaaatccgatatgatggatgacggaatgataggctctgccaacagctcacagctaagatgtgacgtattgctggcactcggcttaccgccgatactcagcgcaaatactatgcttgaagtgataaacaggctttatacaaaagaagaatatgataacgcagtacgcactgcgtttgaaaataaaaaataaaaccgtacacgaaaggtaattaatttatggtcttttcaacatcgatattcatatatctgttcctgccgataaccctgctgatatattacattgctcctaaaaaaagcaagaacttcatcatcctgctaagcggtcttgttttctattcgtggggcgagcctatatacgttgtggtaatgctcatctcaacaatgatagactattttgcgggtcttgtgatgaaccactttgaagggaaaaagctcccacgcaagctatgccttattgtgtcggttgttatgaatctcggacttctcggcgtgtttaaatacagcggattcatcgctgaaaacatcaacgcaatagcgggaagtcagataatcgacataaacaatatgaacttcttcggcattgattttctgcctatgaatatgctgcctatcggtatcagcttcttcacgttccagtcaatgtcctatacgatagacttatatatgggcaacgtaaaggttcagaaaaatcctataagctttgcggctttcgtgaccctgttccctcagattgtcgcaggtcctatagtaagatatgacgatgtggcaaaagagcttgacgacagaacgataacgatcgaccttatctatgacggcattataagattcataatcggactttccaaaaaagtgcttatcgccaacagcataggcgcactgtggacagcggtaaaatcaaccgacatttcacaggtgtctgtagtaagctcgtggctcggaatactcgcattcaccttccagatttactttgacttctcgggatactccgatatggcaataggtcttggcaaaatgatgggattccacttccccgaaaacttcaactacccctacctttcaaaaagcatttctgaattctggcgcagatggcatatcacactcggttcgtggtttaaatcatacgtctacttccctctcggcggcaaccgcaaaggtatgccgagaactataatgaacctcgctataacgtggttccttacaggcgtatggcacggcgcaagctggaacttcatactctggggttcgctgtacggtgttgtcatcatacttgaaaagctctttctcggcaaatggcttcagaagattccggcagtattctgccacatctatacaatgctgcttgtaatactcggctgggtgctgtttgacacagcggatttgcccacagccttcgcctatgcagccaatatgttcggcgcaggcggcacaccgtttatagacagcacagcaatgtatcagatatccacctacggaataacattcattatatgcataatcggctgtacagaccttcccaagctcgcagtggaatatttgaagaaaaaactgcctctgcttatcaattacggcggaattgccggtcttatgggaatgttcgttatgtgcgccgcataccttgtagatcagacctacaacccgttcctgtacttcaatttctgagaaaggagtaaataagatgaaaaaagaaaatatctataagttcctgcttatcgggctgtttgctcttatctcgatagcagtaccagttgcaacgataatatcaagcgcacagcttcccgaaaatgcgttcagcgaaaatgaaaaccgctaccttgaaaaaatgccgaagttcaatttcgacaccgtaaccgacaaaacgtttatgactaagtttgaaaactacttttcggacagaatagtaatgcgtgaacagtggataagccttatgaacgatttcgacagattgctcggcaaaaaggagataaagggaatattcaccgaggacggcagaatgatgcagtcgtggagagaaagcgattacgataaggaaagcgtatcgaaaaaccttgccgctatggaaagcttcgctcagaaatatcccaagatcaagatgtactttatgcttgcccctaacgcacaggagatatacagcgatacccttccggcaaactgcggtgcggcagaccagaagctgttcataaaggactgctacgacagcgttccctcaatcacgggaattgacgtatattcggctctcagcagtgccaaaaacgattatatttattaccgcaccgaccaccactggacaagctacggcgcatatcttggctatacagaggcaggaaaagcaatgaagttttccgcatataccgccgataagttcagcgtagaacatgcttccgacactttcagaggcacgctctattcaaagacgctcgacaacagcataacccctgacactatagacatttacgctctggcggataacgaaccgaaggtcagcgtaaacgtatataaaagcggagcacagcccgacggaacgtatgacagtatgtatttccgtgagttccttaatgtaaaggataaatattccaccttcctcggtcagaacgttcccagaatagacataaattccgttcttcccgaaaatgccgacaacggcagtctgcttgtgataaaggacagctacgcacattcgctgataccgttccttgcaaagaattacagccatataaccgtacttgaccttcgctatataaacggcgacataaaaacgctcggtgtcaatatcggtgattacaagaacgttctgtttatgtataacgtaataaccttctcgcaggatacgaacgtaaagaaattaaacttcatattcaaataacaaatctcccgacggtattttaagtgccgtcgggagtttttgtcagaccgacctttgcaatcggtcacgccttgcactgaagcagttttttcatctcctcaataccttttacctgagctttgacagcttcttttagtattgctcttaactgaggacagatgctgaatctcaacgcatttctgcacatcgcaataccaccctcgtggtgcggtatcatctgccttatgtagcttatatttatatcgttatcggggcaagccgacagattcgttgatacccatcattgccgccatcagcagaattgtcgtgttaccgaaccacataatgaagttcatgaacgctacaagtcccatcgtactgcccgtatagctgaggaatctgaaagcctcgccgccggtagtgtgcttgataagctcgttgataggtccgatatcggagaatattgagaatatcagcattgcaaatgcagatgccatgataaggttaggcatatacattacagttttgaagaatccaagacatcttaaacgaagtcttacattagtaaaccagtaagcaaaaagtaatgaaatgattatctgcggaacaaatcccagtacccacatgataagcgtattccatgtgagtgcaagtatattgttacctgaactcatatcaaaaattgccacaaagttatcaaatccgacaaactccggtcctatccaactaagacccgacttgaagtatttgaacatactgtaatagaaagtctgaataagcggccaagcctggaaaacaaggaaaactaatatgaacgggagcataaatatgtagccccattttttatatttcccgatttgtccttttctggcttttaccggcgcgcttcctgcgttagctgcctgagccataaaaacactccttataaaaatctcagtatattctccatcttgagcagtcaagtatgttaataaggcggaaacatccgtaattcgccccattaacatacttgactgcgaattcacagaacccgcagtcaagatgaaggtcaatattgtttaagccacaaagcctttattatgcgttagcgggcttcttgagctcaggatacttaacaatagcagcctcatagaagttcttgagtgctgtatccttatcaacagtaccgtcgaagtattccttgaacttaccctggaatgtctcgttaagaccctggtcgtagacagaaatcttgctcatgtcgatcttgggagctgtttcaacgaacagagcgatgtggttctgaccgcctaagaatgctgacttgaagtcagaagcagcgagttccttcattgcagcttcgttgttgtagtagtcctgagtatcctttgtgaactgaagaccgaagtccttgtcgcagcagaatgctctcataacatcgccaactaatgtagcgttatctgtgccctttgcagcagcgagccaagaaccgccccagaagtaagcctgaggaccgtagcaaactgcccagtcaccgtaaccgccgttacctacttcgagcttaccgccctctttttccttaactgcaagtgagttacctgcaagtgtgaagttgatgccccatgttgagtagaagaagccgaataccttaccgtcgggaccctggtcagcagcccaagcatcagaccaaagagatgtcttgttgttgtaacccttgtctgtgtatgtcttagtctggtcaacccacttcatgatgttggcgtcaacgatgatttccttgttttcgttaacccaaggagcagcaacgttgtttgagaaggttctgtatgcatcatcataacctgagagcatcttgtaacccttatcagcagccttagcagctacttcgtcaaactttgtccagtcagcgagagcttcctgtaccttcgcgggatcatctgtgccgagaacgtccttagcaattgaacgtctgtaagcatacagaccgggagttgcctgccatgaaacacccttcagtaactttgcatcatcctgagttgtgcaaacgtcctttgtatactgatacatacctgaaagatcttcgtcagtaagaccgagtgacttaacatcaagtgtgtactctgagttaacatacttgagagcgtagtcagcttcgaataagaacatatcgatcttgtcgtcagcagatgcagcttcgttcttgggaaggtcttcatcgagcttgttctgataagcattgtccttgttttcagtgatcttgaaattaactgtaacaccctcaggcatcttagcctttatgtacttatcaaagtaattcttgaactcttcgttccatacagcgatgttaagagtcttgccttcgccttccttaagtgtgaacttatcggaagttcctgcgttgcttgaatcatcagtcttgcttgagtcttcagtcttgctcgaatctgttgtagaagatcctgctgagcttgtagcgttgcttgagcagcctgctactgcgcccagaattgatgcagatgctaatacagctgctaaaattcttttcttcattggtaattcctccagaagtattcattgttgtgaatagctatcgctttcactgcctgaccttacggcctcattaaagaggagccgtaaacaatccccggtaagaacaggcttccggttgaagctcctgtgacataacggtatatactgccgtatatgtaacaatggataattcactaaaaagacctgtagcttgtcaaaagttttgttcactttttcctcgttgacataatcatatcacagatttcacaaatttgcaagcattttaagcccgcaattgtgtttttttaccgtaaacgattacaaaaaatgtttttttggcacttttccgtcatcatgcacaaaaatctgttacatttttgtaacaattcggtcgcaacttgattactgattttctctattttccgctctataatcggatattcttccattgtaacgtcgtgtaaacgattttatgctaatttagttcacagaaagtttgtaaagtaattaatgtacatatagcacaaaaacaaagcgccgctattgttgaaaaagcacaatttaagagattttctgctttagcacttgaatttgttattaaaataaggtaaaatgatatagtaacaagtacggagggaaagcatgagatctatgaataaaatacagcttacaacagctttgataagcttcggtaaattttcatatatgtctttttctacgccgtattataagaataagtgtattttttaagctgtgcaattggattacacagctttatttattttctgaaaggatgttcgtaaatgaaaaaagtagccatagtaatgggcagcgattccgatctgcctatcgtaaaaaaagcggctcaggtgcttaaggacttcggagttcctacagagcttcgtgttctctccgctcaccgttgcgccgcagaggtttccgagtttgcaagaaatgccgagaagaacggcacaggcgttatcattgccgccgcaggcaaagccgctcaccttgccggagctatcgcaggtcagactcccctgcccgttatcggcatcccgataaaagcaagcgcacttgagggcatagacgcacttctgtctacagtacagatgcctgccggagttcccgtcgctacagtagctattgacggtgcggcaaatgcggcattcctcgccgtacagatccttgcggtatcagacgatgcccttatggaaaagatgaaggcataccgtgcagcgcagaccgcaaaggttcttgaggctgacaaaaaaatggaacaggtacttgccgagctttgatcggtgtactatatataatgtaatcaataaatacggcacagccgctgaagaaaggataaacaaaatggaaaagaaagaacagctttacgaaggaaaggcaaagaaggtattcgcaaccgatgatcccgaccttgttatcgtatcctacaaggatgatgcaacagcattcaacggcctcaagaaaggcactatctcaggtaagggcgttatcaacaacaaaatgacgaactatatgttcggtctgcttgaaaaagcaggtgttcccactcaccttgttaaagagctgaacgacagagaaacactcgttaaaaaggtttctatcgttcccctcgaagtaatcgtaagaaacgtagccgcaggcagcttctcgaagaagctcggcatcgaggaaggcacaaagctcctctgccccacgcttgaattcagctacaagaatgacgatctgggcgatcctttcatcaacgactactatgcgcttgcactcggtcttgcaacaaaggaagaaatcgaccttatctcaaagtacgctttcaaggtaaatgaatttatgctcgacttcttcaagaagctcaacatcgaccttatcgacttcaagattgaattcggtaagacctcagacggcacaataattcttgccgacgagatttctcccgacacctgtcgtttctgggacagcacaactcacgagaagctcgacaaggatcgtttccgtcgtgatatgggcggtgttgaggacgcttacgttgaaataatgaagcgtcttatgggcaaataatcacaacaattgaaaagaatctaacaggaaaaggcaggataatatatgggtggatttttcggtgcggcgtcaaacaacgactgcataaccgatgttttcttcggaacagactatcactcccacctcggaacacgcagaggcggtatgaccgcatacagccccgacagaggctttcagcgtgctatccacagtattgaaaactcaccgttcagaacaaagtttgaacaggacgctacggatatgaggggaaagctgtgtatcggctgtatcagcgataccgaccctcagcctctgctggtgcgttcaaagctcggtatttattcgatatgcagtgtcggcataatcagaaacgccgaacagctttcaaccgagctgctcgagagcggctgcgcaaactttgaaacaatgagcagcggcagtataaactccggctcgctcatcggtgcgcttatcgcacagaaggacaactttacagaaggcatacgatatgctcaaagcaagattaacggtacaatgtcccttatcattcttacaaaggacggaattatcgccgcaagggatcagtacggcagacttcctataattgtaggaaaaaggagcgacggatactgcgtatcccttgaatcattcgcattccagaagctcggctacagcacatataaagagcttcgtcccggcgaaatagatatgataactgcggacggctgtgaagtgctgagtgacggcgatgaaagcaaaatgcatatatgctcgttcatgtggacatattacggctatccgaatgcggtatatgagggtgtgaccgttgaaacgatgcgtacacgcaacggcgagattatggcggagaacgatataaagaacggcaagctgcccgatgttgactatgtatgcggtattccggattcgggcgtacctcacgcaataggctacgcaaacaggagcggtatcccgttcgcacgtccttttatcaagtacactcccacatggcccagaagctttatgcctaccaaccagacaatgagaaatcaggtagctaaaatgaagctgattccggtccacgagcttattgagggtaaaaaactgctgttcgttgacgacagcatagtaagaggaactcagatgagagaaacagtagagttcctttatgagaacggtgctaaggaagtacacatgcgcagcgcctgtcctccgataatgtacggttgtaagtatctcaacttctcccgcagcacatcggagatggagctgattgcaagacagataattgatgaggccgagggtgcagatggtatcagatttatcgacgagtacagtgacaccaacacagagcgtggaaagaaactgcgtgacgaaatatgccgcagactaaagctgacatcgcttgaattccagtcgcttgacggaactgtacgggcaataggcaagccacagtgtgagctttgcacttattgctggaacggaaaggaatgactccattgacaagcggtttgcatgaagaatgcggcgtgttcggtgtttttgcaaaagaaaagaccaacgttgccgcaacaacatattacggattattcgcattacagcacagaggacaggaaagctgcggcatcgttgtgaacgatgacggcgttttcaactcctacaaggacaccggccttgtgaacgatgtgttcactcccgagcgacttgacggacttggacagggcaatatggcggtaggtcatgtgcgttacggcacgaccggagcaaacgcacgtcttaatgcccagcctattctggtaaatcattataaaggaagaatggctctcgcccataacggaaaccttgtaaacacttacgagttacgtcacgagcttgaaaaacaaggctccatcttccatacgacaagcgacacagaagttataagctaccttgtaacaaaggaacggcttgaagctccctcaatagaagaggcgctcaaccgtgcgatgaataagataaacggcgcatattcgctcgttatcatgtcgcctgcaaagctgattgccgcccgtgacgagaacggcttcagaccgctctgctacggcataacaaacgagggaacatatatagttgcctccgaaagctgcgctcttgactcggtcggcgctaagttcgtaagagatctgctccccggcgagattgttgtattcgatgaaaacggagtacgctccataaaagatcattgcggcaagcgtccgcatactttgtgcgtttttgaatatatctacttcgcacgtcccgactcggtcatagagggtgcatccgttcacgaagcaagacttcgtgcaggcgcattcttagcgcttgagcatcccgtgcaggcggatatagtaatcggcgttcccgattccggaatagatgccgccataggctattctcaccagtcgggtattccctacggcatcggcttcatcaagaacaaatacatcggcagaacctttatttcgcccggtcaatcgtcaagagaagataaggtgcgtataaagctgaacgctgttgccagtgtcgtaaaaggcaaacgtgtcgttcttatagacgattctatagtaagaggcaccacaagcggcaggattgtaaaattactgcgtgatgcgggagccaccgaggttcatatgagagtatccgctcccccgttcctcaatccctgctactacggtaccgacatagattcgagagaacaccttatcgcttgtcatcattcgataaaagagatcagcgacataataggcacagattcgctcggctatctgagcgtggaaaacgcaaagaagcttgcggtacacgcaaacggctgtgaatgcggttattgcaccgcttgtttcagcggagaatatcccacgaatattcccacggaaatgcacaaggataaattcgacaggaaaatcagcgaaagcaaagaaaaaaccaccacataaggacatcagtccccaaacggaaggaattattattatgaagaacagtttttcagaaagctataaagcagcaggcgttgacgttaccgcaggctacgaaggtgttcgtctgatgaaaaaggacgttgaacgcaccaatatccccggtgtacttacaggcataggcggattcggcggtctgttccagcttgatattgcagatatgaaagaacccgtactcgtttcgggtacagacggtgtcggcacaaagctcaagctcgcaatgctgatggataagcacgatacgatcggtatagatgcggtcgctatgtgcgtaaacgacataatctgctgcggtgcaaagcctctttatttccttgactatattgctataggcaagaacgtaccagaaaaggtagccgctatagtaaagggtgttgctgacggctgtgtacagtcaggctgtgcgcttataggcggtgaaaccgctgagcatcccggaatgatgcccgaagacgaatatgacatcgcaggctattcaacaggtgtcgttgacaagtcgaagataatcgacaacagcaccgtaaaggaaggcgacatcataatcggccttgcttccacaggcgttcattcaaacggcttctctcttgtaagaaaggtgttcaacataaacagcaaggaagttctcgatgaagtcctccccacaggaaaaactctcggcgaaacgctccttacacctacaaagatatatgtaaagcccattttggagcttatctcaaagaagaacgtaaaggctatctcgcatattacaggcggcggcttcaacgagaacgttccccgttcactccccgacggctttacagcaaagattacaaagcacagctacgaagtgccttatatcttcaagcacttacaggaagtcggaaacatctccgaacacgatatgtacaatactttcaatatgggtatcggtatgaccgttgtagttgacaaggacgatgccgatgaagctgtacagatactcagaaacgcaggcgttgaaagctactgcatcggtgaaataatcaagggtgacgagggcatcataattgagtaatatgaaaaatatcgttgtacttgtatcgggcggcggaactaacctgcaggcgcttatcgacgctgaaaagtccgagggactcggcggaggtaaaatcacctgcgttattgcgtcaaagcccgatgcctacgcactgacaagagccgcagataacggcataaagacaagagtgctcgcaagacgtgactatgccgatgttgccgcttacagcaaggctatggctgacgctttaaaggaagagcaggctgaccttgttatctacgcaggctttatgacaatacttgacgagcaggtatgcgatgcgttcaggtataagatgataaacgttcaccccgcccttatcccctctttctgcggaaagggctactacggacttcacgttcacgaggaagcacttaaaaagggcgtaaaggtaacaggtgctaccgttcattttgtaacagcggaatgtgacgcaggacctatcattctgcaaaaggcagttgaagtcagaaacggcgacacccctgaaattcttcagaaacgtgttatggagcaggcagagtggaagattctcccccgtgccgcacgtcttttctgtgaaggaaagataaccgtaaaggacggcataaccgttattgacgattgaaccttatgtccgcattctcccgactaaacgggattttgaggacgttataacaagttatattcagaaaactgcgtgttccacgcaaaaccgcaacaggaggctatatggaagttttaacacttgaaaaagagcttaactctcttgcttatcacggcagaggcatcgtgataggaaaatccgcagacggcacaaaagcggtaatcgcctactttattatgggaagaagcgaaaacagccgtaacagaatttttgtagaggacggcgagggtatcagaacacaggctttcgatgaaagcaagatggaagatccccacctcatcatttatgcacccgtaagagttctcggcaacaagacgatagttacaaacggcgaccagaccgacactatctatgagcttatggacaagcagatgacattcgagcaggctctcagaacaagagaatttgaagatgacaagcccaactacacaccgagaatttccggtatagtccaccttgacaacggcgatatgaatttcgcaatgtctatcttgaagagcgcagacggcgacggctcatcatgtcagagatacacctacgcttacagcaatcctttaaacggcaagggaaaattcattcacacctacaagtgtgacggcaatcccctgccgagctacgaaggcgaacccaagacagtggttattcccgatacggatatagacacgttcacatcaatggtatgggaaaacctcaatgcagacaacaaggtttcactctttacacgttacatcgacattgccacaggcaagtacgaatcacgcataatcaataaaaacaagtaagcgaaaggaactttactacaatgaacgaacttcagttaaagtacggctgcaaccccaatcagaagccgtcaagaatattcatggaaaacggcaattcacttcctatcgaagtgcttaacggcaagcccggttacatcaactttatggacgccttcaacggctggcagctggtaagcgagcttaagaaggctacgggccttccctccgcaacatcattcaagcacgtttcacccgcaggtgccgctgtaggacttcccctcacagacacgctcaagaagatatactgggtagacgatctcggcgagctgtcaccccttgcctgcgcttatgcaagagcaagaggcgctgacagaatgtcatcatacggcgactttatcgctctgtcggacaagtgcgatgtttcaacggcaaagataatacagcgtgaagtttccgacggtgttatcgctcccgattacgatcccgaagcgcttgaaattctcaagtcaaagaaaaagggcaactacaatataatcaagatcgaccccgagtacgttcctgagcctatcgagcgtaagcaggttttcggcgttactttcgagcagggcagaaacgagctggttattgacgataagctgttctcaaacattgtgaccgagaataagaatatacccgagagcgcaaagattgatcttgcaatagcaatgattacattaaagtacactcagtcaaactccgtagcttacacttgcggcggtcaggctatcggtatcggcgcaggtcagcagtcaagaatccactgcacacgccttgcaggtacaaaggctgacaactggtacttaagacagtcgcctcaggttatgggcttacagtttgtagataacataagacgtgccgacagagataacgctattgacctttacatcggtgaagattatatggacgttctcgcagacggcgcatgggaaaacatcttcaaggtaaagcccgccgtattcacgacagaagaaaagaaagcttggcttgcaacaatgaagggcgtagcgcttggctcagatgcattcttccccttcggtgacaacattgaaagagcgcacagaagcggtgtagaatacatagcacagcccggcggctctatccgtgacgataatgttatcgacacctgcaacaagtacggtatcgcaatggcattcacgggaatcagacttttccaccactgataagctcagtaaacgggcggcacgtccgcccgttatttttaaattccgataaaggtatcactatgcattttacttacacagataaagacatccttgacggcagatttgaattcaggcagagcggcacgtttcgggtactgtctgcgtttgcacatttgaaaataatcatatcgtgtataatcgaagcgatgattgccccgtatactctcaacgtattatttaacggaggcgcaacatcaaataacacatcaatcataataatcaaaattgctctcgctgtaattctgccgatactgccgatatggtatatactcatagttgcaggcggcgaacagcagtacagctactacgccgatgaacgtcttatgcgtatagcaagcaaacgccatacctatattttcaggtactcggacatagaaaacgtgacctacaagcctatgaccttgtttacaaagcaaaaaggctatactgttactgttacgacaaaaaataccacgctgttcttccgttatatcatgccgtcatgcgcagaatttttcacaatacagtccacaccgttctatattcttcaacatccgccgataaaagcggaagaaaggaaagaccgatgaaaaaagcactattattgatttgcgccgcatcaattcttgcaggaatgtgcggttgctccaaaacgattgaaaatcccccttacttcactccaaaaaatcagaccacatcatcaacgaccccggttccccagacagtgacacctcagaccaccgcagtaactactgcggcaacatcaacgcaaacaacaaaagcggaaacaacgaccgcaaagcccgaaacctcgaacacgtcaattacagacaagtccgaaacaaaaaaaccgtcccctgcccctgcaaagtatacccctgtaggaagtcttgtcaaacataaagtaaacaaattctctctgatgtacgatgacggagtatacttcaataccggcatcagtgaatatgaggaagataaaaacgagctttatcttgtacattattccgatgacagcgaggtcacatctaatatcgttgctatgtgcagtgatgaggacgaagatactaaaggcagatcggtagccgagatcggcgaggaatttatgagctattacgccgtcggtgataatgtcgattcatcgaccaagagtatgataaaaataggcaacaccgatgcattttacgcaactgtaaaatcttcggacggagatttttcggttgccgcaacacagcacatatattttgcccgtcacggcaataaagtgtacacattgatagcactgcaccttgacgataacgaaaaagctgtcacaaaggcgcttgaatacacgctcgggtcaatgtcattcgacaattcgttaaacacatgacagcagagtcaaagtcattatctgcctcattgaccgctccgaagctgcccgataatctttttacggtaacagatattgatgccgagctttcaaaagtgcgtgatgacgaatcggattttattgcggcagatttttcgaggctgatatgtgccgaaaccgatttttcagccatctgtttcagaaactgcctgtttcacggatgtcgctttacagcctgcgattttaccggatgcacttttatagattgcgttttcaagggctgcgatatttcaaacagcgatttttccgaaagctatttcaaagcctgctcgttcatctcctgtaaagcggtcggaacagctttcaaatactcgttttataaaaatgtcagctttgacggcggcagctttgagctgtcagattttcagcgttcaaaactgcaatcggtagctgtgacagataccgacttctcctccgctctgttttcttcttgtgagataaaacagacggagcttaaaaacgttacgctggcaaggtctgtgtttttcggcacgaagcttgcagggcttgacttcacctcctgtaatatcgaaggtcttaccgtttccgatacgggagcggagcttaaaggcgcaaaggtcgatgtgtggcaggcggcaatgttcgcaaagttgcttggccttatcatcgaataatgaataaatcaaaagaaagaaaggtatttttaacatgaacgtacttgtaataggcggaggcggcagagaacacgccataataacagcccttgcaaaatctaagaaggtagacaagctgtatgccgcacccggcaacggcggtatctcgaaatatgccgagtgctttaatgtaaaggcaaccgatattgacggctgtgtcgagcttgcaaagaagctcagacccgactatgtattcgtagcccccgacgatccgctggttatgggtatggtggacaagctcaacgcagagggcttcaagaccttcggaccgagagcaaatgccgctattcttgagggcagtaaagttttctcaaaggctctgatgaagaagtacaacattcccactgcggcttacgaaaccttcacggacgcagacgaggctatagcatatatcaaaaagcagaacagcttccctgccgttatcaagtgtgacggtcttgcactcggcaagggcgttataatcgcaaaggacgagcaggaggcagaaaatgcagtacgttcaatgctccttgacggaaaattcggcaaatccggcagtgaaatagttgtcgaggaatttatgacaggccccgaggtaaccgttcttgcgttcacagacggcaagacagtaaagcctatgataagctctatggatcacaagcgtgcttatgacaacgatgagggtcttaacacgggcggaatgggtacgatagcgcccaaccccctctacaccccagacaaacagcaggaatgtatggaaaagatattcctgcctactataaaggctatggcggctgagggcagaccgttcaagggttgcctttacttcggtcttatgctgaccccgaacggtgctaaggtgattgaatacaactgccgcttcggtgatcccgaaacacaggtggttctccccttgcttgaaacggatattatggatataatcgaagctgtctgggaagaaaagctcgatacgcttgacatcaagtggagcgataaatcttgcgcctgcgttgtaatggcaagcggcggctaccccgaaaagtacgaaacaggcaaggtgataagcggacttgacgaaaacggtcagtgcgagggcgcattcgtttaccacgcaggcacaaagctggaggacggaaagttccttacggcaggaggacgtgttctcggcattaccgcttacggcgatacattaaaggaagcactcgacacagcttataaggcagtggatacgattagctttgaaaaggcacattaccgccacgatataggaaaaaaagctctttccgctttaaaataattcccgaaaacacttgcatttcatttccttttatgttataatagcatttgcgtgttagaataattttgggtttgtacgataaacagatctcggacatacccgtattcctataaggaggacatataaatgggaatattagaaataatcagtgctattgttctgattgttgcctgtgttttcatagtactcgtagtacttatgcaggatacaaagcagggtatgtcgcagacgattacaggcggtagtgcagacaactattatcagagaaattcaggccgttcgaacgaggctaagctgaacagacttacaaagattgccgcagtgattttctttgttgtggctctcgttgttaacttcatcgttatgtacagcggtaacttcaacaagtcgaataattcttcgacaacaagctccgcaacatcatctgtaacatcttccgttacaagtgacgattcgtcagcttcatcggcatcttccgatgcttcatcgacagattcttccgcttcttcatctgacgcttcttctgctgattcctcagtagccgagtcttcatctgaaacaagcacagaaacatctgcagaataattaatgcttttaaaagctgtcgcactgcggcagctttttttgtatatgcctgattgttccggcaacgttcgccggatataagtaaatgctgagctgttgaaaaaaacgccctgttatgatacaatataatcaatgattattaaaggcaacaccgcataattaacggctttcgcctttgccgcacgcttgcttgcatattttccgccatcttgcgcaaattttgcttgacaggcgccagcctgcccgcactcaatttatacaatctgacgaaaaatctgactgcgcaatcgcacgacaataattatgcggtatagccttaaacaaaacttactcggaggggcatcaaatgaaaaaaagaagtacatcgccatttgcggttttgcttttcagcattccttctcatctgtatggtcataaacttatttaaggggcatatcgtagccgctgtatgtagtcttggagcgtgtttcttgttttttgctctgtctttattaacttataaaaaaggcaaagacagcaacccgtatcaatccttgcaaattatccgacatcagatttcacacaaaatcttatacgctctaaggctgttctaagttaaccgcactataatatcaatatcataaaggacggtgatattatgaagctcctgtttgcagaagatgaggtcagtatggctgaggctgtaaccgacattctgacctatcataattatacggtagacacggtttatgacggtgccgacgctcttgattacgcaagagccgaacagtatgacgggataattcttgatataatgatgccgaaaaagagcggcttagaggtacttaaaacactaaggagcgaggggaacaccactcccattctcctgcttaccgcaaaggctgaggttgaggacaggatagcagggcttgatatgggtgcggacgattaccttccgaagccgtttgtaatgggcgagcttctttcccgtgtcagagcaatgctccgcaggaaagacaggttcacacccgatataatgacattcggcaatgtgtcgctcaatctcagcagctgtgagcttaaaggaccgttgcagtctattgtcctgcccaagatagaatacaagctgatggagcttcttatgctcaacaagggcatctatctttccactgatgatattctcgtaaaggtctggggctatgagagcgatgccgagagcggcgcagtatgggtatatatatcctatgtaagaaaacgtcttgccgctatcggtgcggatattgaaatccgagccaagcgcagtgttggctatactcttgcaaagatcggggatgctgactgatggtaaaacagttgcagaaaaagtttatcatatccgctatgctggcggtaacaattctgcttgtcgtgcttatcggcggaataaacgttttcaattatctcaccaccagtggcgataacgacaggcttatggagatgctctgctacagctttgaaacctcaacaaagtggaacgcagatacaaccgacaatactcagcccccgcagagcataaacggcactaagcaaaatataaccgacgcatccggcaatcagaatgataccgggtttgtgccgcaggacaacggcactaaaccgcccgacgataaaaagaacaacggctttggcagacacgataaaaacgcagtggattctgcacgctatgccgcagttgcgatcgacaaaaacggaaatatcataaggacggatgtaactcatatatcctcgcttaccgaggaagaagcggccgctattaccgaagcacttaaaaataccgctgcgggaacaggcacatacagcggctttcagtacaggataagcgaaactaagcgtgcagaaggaaaggttatcatcctgcttgacaacggtatgcagataagctccttctttaccgtactgtttatatcggtcggtgcaggaatattcggctggcttatgatgctgctgctcgtaattcttctttcccgcaaaactattgcccctgttgcacgaagcattgaaaagcaaaagcagtttgttacaaacgcaggtcacgaaataaagacgccgcttgccattatccttgccaatacagatgcaatggagcttcacaacggcgaaaacaagtggagcaagaatatccgtgcgcagacgctcagactcagcggacttatgcagaatctgctgatgcttgccaaaatggatgaaagctcaacaaagctcccgatgtgcgaatttgatataagcactgcggcagaagataccgtcggcgcatttatagagcctgccgccctcaaaggcataatgattgaacaggacatcaaaaaaggcatcaggctcagcggcaaccgtgacagtatagtacagcttatgacggtactgcttgacaatgcggtcaaatataccgaaagcggaggtgtcataagggctgagctttacggcagcgaaaagaacataacactcagcatcgccaacacctgcgagcctatagaccaccccgaaaagctgttcgaccgcttttaccgtggcgacagcgcaagaacgcagaaaaacggcggctacggcataggcttatcggtagctcaggcaatagcagaactccacaaaggctcgataaccgctgaaaatgtatctgcctccgcctcagaatcccgcaccgacaccacagataaacaaaacaccaatatgcttatgttcacggttaaaatataaaacaacggtttgcaggcggctgaatcgggtcagccatctgcaaaccgttttatctttaaagtgtccgatgtgtccactgccatctatgatattttcatcgctcaataatacagacttaccgtttccgatagagttccttcatcttgataatggtcgtaaattcgaaaaacaattttcattgccatcataccaatgttcttttctgttccaaccaaatgccagcagtaacaactgttttcaatagtgatttttcctgcgtacagcaatgcgccgaaatccacatcacgccgtaaacgtttgataatcagcttcttcttgccgctatgcatcactttcagtttttcatggatctccggctccaccatgctatccttactgattgtaatccgtccatcatatacgtgttcgctatttctgtattccggctcattgagattgaatggtgcgtactcataaaccacagtgttttcatcctgccatacaattctcgcagaaccaccaaagccacggctcattccatccaccacgctttatccgcataatccaatgagaagctgtcatctacaaatttcgataaaatatcgacgtccggtcgctgtgggtttatgttgccttgcaccatagcttcacgctgtgctttggctatatggctgaggtcattgcattccagcaatataccttcttcaaaaacaagttcaatcagtttcttgtatgcccaacccctttggaaacccatgtgaatgtaatactcccgcataaagccatctccgagaagtattttccccgtgtacggaattggaatgttaacatccttgtacacacgatgcccgaaatgcgctttcataataatctttttgccgccttgacacttgtattccttaaactccggcagtgccgagatctacacgtactgacacactctttccctacacgacgctcttccgatctctgaaatcggattgccggacggacttacactgaagaagggcgagcttaccgacggtgaatatgcacttgcggcaggacagagcaggtcaaatgagataacggcttatatagagaaagcctcaaagcccggcgatactaccgaccctgtaaatcccggcaatcccgaaacggacggttctctgtgtccgctgtggctgacgctgagtattttatcgggaggaacgcttgcggtcctcggtattaaaaagaagtgcggaaaaaggattttttcactgttcttatgcgctgtgatctcgctgacagcattgccgacagatgtatttgcagacgaggtcataatgccgagtgcaagcggaagcgttacggcaagtaaggacataaccgtaaacggtgctaaaaagacgataaccgcagatattacatataacgagaataagccatcggaagaagatgaggtcacagtgacctttgatgcgggcgacggtacgcctgtagctccgataactgttaaaaagggtgaaacgataagcagacttccagagtccttcggtgcgggcaaggcgtttatgggctggtttaccgatacggcattaacaaacgagctgtttaccaatactccgataaacgaagatatgaccgtatatgcctcgtttgtggaatctgccgatgatttccaatcaggcgtgagaaccacctactatgtggaggactgtgcggaatatcagccgatcacgcttatatgtgacgaagaaataacggcagataatgtatgggagtacatcaccttatttgcgtatacgggcgatactccggaaaacttcgttgtaacatcaaacgagaaggatgaatatacactcgttcccgaaaccgcatacacagccggttgtatgtaccgtatgacagcaggcgagggagttacattcaagggtcttgacgatacggtaaacgagtatacattcaagatatacaaagagcagactaatataatcgaggtcagggacaatatcaagtatctcgataaagccaagttgttcgctacggataaaaccgatgagtatatggttcaggcggattattttgaagaaaattctcttgctgtgggcgatgtgctttgcattgacaacggcacaaagaattttaccgaaaactgcctgtttgtaaaaattacagatacaataaaggacagaaacatttattacattcagacagccgattgcgaagcggaagatgtttatgacaatgttgatgtttattttgtcgagcctgcaaaaaacaagttccttgaggagcagatcgacaccgaggcgatagcggaagaagtaaagaacagcgagggcgtacagcagctgaaccttgtgcttgcggcgctgcttgcagaagatgaaaccgtaaacgagataatggagggcgagccgcttgttaccgatacagtaaccgccactgcttatgccgcttcggacgatgacagattaaaggatttctcggactattcacgtcctaaagaggatacgctcaagagcatcgccgcaagtcttgctatcggtctttccgtatccgtaaaggtcggtgaagcagaaaatgataactttactaccattaatccggattactggtcggtcattacattcgagttgaattataagactaccattaagaaaaaactcaaggtagatgcaacatttacagtaagcgaatatcttaatgtttcattccagggctataattcattcgaattcaagtggtttgaactgcctgagcttgaattcaactatgcggctaatatctatacgcagacggatattgaacttaaagttcttgtctgctcggtaggcgcaaacagctacaggaatatcacgagcgaagtcgcaaagatgcttggcagtgatgagaagaacgataccgcaggtcttgtaaaggatgtcaaggatatgcttaacaagaagggcggagagatagaaatatgccgtataccgttcttcacggcatttaaaccgctgtcgctgttccagcttaactttgaactcagccttgttgtaaagatgagctttgcaggcggtataggaagtaagttctcgatacttgacgcaacgcaggtaggtacacacggcaactcaaaggataaagagttcagtatgtacaaaaacaagctggtcgagggcgacaggtacagctttgatcttacggtattcggatatgtcggtgtcaagatgggcgtttccggacagcttaccgtttcgttcacgggtttaaggcgactgggcgaggtcggcgttgaggtccaggtaggcgcatatcttgatatatacggcctggcaaaatatcacgtcgtcaaaccggatcaccgatacagtacggtataccggacgctgactggcggattttatcttgaagcgggaatttatctcgaggtaaatcttgtcgcggaatcaaaggtattcaaattgcggcttgaagcaccgctgataccagaaatcaagtggccgctgttctcaatgggcgacaaaaaccttgttatatgccttaacgatgtgacaactccgatattattcagctcaaacggcacttactggggagaagtcaatattgataatcttccggcagtgtccgcacagacgcttgatatcacgacaggcgtgataaattacaatgcatctgtaccgtggagcaagctgtcgatgaatgtttcgggcgaaggcttcagaatgctctatgacaggagaggcaaatttatccgttacgagcagccatacagtatgtcaggcttctacaagaacagtacagccgaaggtgtcggtcagatacactataaaggcacgtcacttcagttcacaaagaccgcagaccccgaaatgagccttacaaagtcggtaaaggtcatctggtacgatgagtcgagagttaaggaagaggacgtaggcaagatattcactgtcaatttctacagagaggttgacggagttaaaactcttgttgaaacaagaaaagtacctgcgggcagtcttgcaggctcttacaacacaaataatgctccggacagctggaagtacattgactgcgagtggaaggaccaagatccgtacttcataaccgttgaccacgacaactacgaaatagttatacactgcaacaagagcgcagactcttatggagatggaatactatgataccgtaaacaaagagtgggtagtagaactgtgggcagtgaatgccggcgatgttcttaaagtacccgataactccagtgacgagtatatgaagctgacctcatggcacgcaacatacggagtaccgttcggttttgaaaagatgtataagtatgccggtgataagctcagagcgatagactccggatgccgcaaggattactatacaagcggtcagcctacagacaaaccgctttacaaggttacaggcaacacccagagagcggcttccgaaaacttctatttcaatcatcacaacgactatcagaacgttgcactccatttcagtgcaaattatgacagagcgctgatgaacgtaacgtacaattattatgattataacggcaataagaagtctgcaaccgtaaagacaccttacggcacaagaccggaatttttcctttcaagctggccttacggtaagaaattcataggctacacccctgacggcggcaaaaccgtatacgatgccaataccgtatataatgagcaattgccttatgtatatgaggatgtaacatatgatgcggtttacgaagccggaatattcgatgttgagatacagtattacgatgatgcgacccgtgaattcaagacatataagacgctgaaaatagagggcggctcaaaggtacctcagtcggtatttgacgaagcttggagcaagatcaaccggcaggagggtacaacgattcagttcatcgactggagcgatgtatacctgagtgaagaatacggcgatgcttacctcaatgagtttatacccgacaagacgctcatttacaagagtattatactccgtccgaggttcaaacgtaatgttacaattaagctggacgcaggtgacggcagactgatatttgaagaaagcaaagagttcaagagctacagtcaggataaatacgaggtagaaatttcacgttgggcaaccaaggatgccgacaagtacaacgattatcagcctacaggctggaagaacagcactacaggcgagatatatgccttaggtcagacggttaagctcgattattcgacaacgctgacagcaatctatcaagctacgcccaagacctatacggtaaatgtatccacaccgtacggtgcgcttctgaacggagaaaagaccgataaattcagcggcggatatgatgattatctcgcattcgttgaaaagtacaacaattatactcctgcagatgtcgagggcgagggatatactctcgtgttcaagggttcatcaagcaaagcgtccgaggacggtctgacgcttgatatagtcttcggcaactggcagaagaatgttcacaagcacacattaatactttacgcaaacggcggtaagctgacaggaagcgatgaacgcacagcagattacggtactcaaatcaagctgtcggatatggctgaagcgtcaaagacggacgacctgagagattatatcttcggcggctggaaagacgaggacggaaatatctacggtgctgacgatataataacgctgactaaggatacgacattgacagcagtatggaaaaacggcgcatacaaggaatacacgataacctttgtcctcgatgacaatacgataaaaagagtaacttatcactatggcgacgctctcccgacattcggcgcaccagaagaagctgacggatatatcttcggcggctggtcgtggtacggcactgagggcgcattatccggacagcccgacacgatgcctgcgtcaacgcttactgcaataggtacgaccacaaagtgctatatatcttacgaatttgacggtacggtatacggcacaaaggaggtcggcaagataggcgatacgataacccttatcgcaaagccgacaaaggattattacgatgtgaccgaatggtctgcagacggtatcactgtaacagacggcaagtttgtgatgcctgctcacgatgttacattcaaggcgacctcatcacccaagttctataatgtcaatatgacggttgacggcagcgcaagttccgacagcccgatgaaagcacagtatatgagtacagtaacgcttcccgaacctcccaaaaagagcggctatacttactactggcagtccgatgatgttgctatttatgaggaaagcggcgaatacaagtttacgatgcctcataatgatgtaagcgttgagtgcgtttacacaacggcgacctacaacgtctactatatgatagacggcgaagctacgccgtatatgactattaccgatgtccctgcaggcaaggaaatgttcgcttatatcgacccgccacgcaaggaaggctatctgttcaacgaaacgtggatatgcacggacgtttctcttgttaataaggaaggcagatacacaatgcccgacagagatgtttacttctgtggaagattcgccaagaacgatgacactatggttatgctcggcgtagaagtgtatgttgacggcaatccggaaacacattatatgctttacacgaacagaggcgaaaccgtaacgctccccgatatattcatggacggatatgcaaagtcatacgaaagcgataagctgacagtcacaaacggaaatgtcacaattccgacaggcgacgatgtctttgaggtatcgctcaggataaattttaccaagagctgataagctacggataaaagccaaataagaacatacagccccgaccgcaaggccggggctgtaactgcataatcgtataaaaaatcctcacgttttaccgtgaggatttttatgcttatgtgattacttaactatcgtaatatctgagccgaaccactttgttgagatttcgccgagcttaccgtcagccttcatctcgcccagtgtcttctgaactgcgtcacgcagtgcctgatcgttctttctgaatgcgatagcgtactgttcttcttcaagaccctctgccagcttcttgtagtccttaccggagttcttgatttcatagtctgcaactacttcatcaaggaatacaacgtcaacaacaccaagctcaagctgctgtaatgcttctacatttgtagcgatggggctgattgttatatcgtccttgattgcgctgttttcaagtattgtctgtgccgaagaaccgttctgaacagaaatcttcttgcccttgaggtcgtccatctttgcaactgtcgaatcgccctttacaacgaataccatagcgttcttcatataaggctctgaaagattcatcttttcctgacgctctttgtttatgctaagaccgttccatatgcagtcgcacttgccgacattaaggtcggttgtgagcgtatcccagttgacaggctgttttacgagctttacgccgagtcttttgcaaacttcctctgctacgtcaatatcgaagcctacgatctcgccgttctcgtcagtgtagcccataggcttgaatgtagcgtcaagacctaatatgaactgacctgcgtcctttaccttctgcagtgagttgtcgccctctgccttgctttctgtgacagatgtgctgtcgcctgctgttgcactgctgtctgcggttgaagaattaccgtttgagctgcagcctgcaagaccgagcgtaagagctgctgccatagctacggcaattgctttaagatttaattttttcatttttatttcctttctgagcgttttacacgccttaaaaattactttaatatagtaacacacaaatatgaaaaagtaaataggcaaaatgaataaaacggcggaaatttgcaggatttcagcaaatttccgccgtttttttgtttttaaagccgatattatcaataaagatattcgtattgtgaaatgtcggggcattttgagggctgaagctcgtcttccttgaagctgtatctgatattctgattatacatataccacaggcagaccctcataccgctcatttcaaggtgagtgccgtcctcaaaggcgtacttttccatcagcttgttatcactgcctttaagaagggcggtaggatcgacaaaatgatagtgactatagtagcagttatcaatcgcataccgcagtgcggaattatactcgtctatcttttcgttcttgcagaacttactgcgtacgggagttacagccataataatgaactcgctgttcgggcttgcctgcttgcactggtagagaagctgcatatagttttctacaaactgttctttcgtggtaaggtttacatcattaagacccattgagaaaagaacgtatttaggctgcttgttgtaaaggtgaacaagcacatctgtgcttaaattgcccgatgttataaggaactggtgtatgttccacgccgcaatgttgggtcgtgcaaggttgttttcctgcttgaagtatcctgcgcttgcgaagccggagcaaacgctgtcaccgacaagtgcgaactggtcgaaatatttgtacatagcgtctgtgatagtgtaatcaggtttaggctcaggctcaggctcaggtacgggcagaggttcttcttcttttgtctgagaagttgtcttatctgtatcggcagacgtgctttcggtctgcgaatatgtattgtcatagcttataccgccgtcggatatgttgacagcgtaagcgttattgcaggctgtgcatataatagccgccgcaagcggcagacacagcaatatgaaacgtttcttaggcgaaacggaaccgtatttattataaagcattatattcccttattccgtagggcggtacaaattaccgcaaaagtatatagtaaaccgatgaggttatgtttcttatttaattataatgctgattttacacttttgcaagaataaatttacaaaatgtcgaaatgggtcaaaatttcattgaattgcacaacgataaggcagatttcacagagtttttatgtaaagtgtattttttgcggattccggtacaatatgttgtgcttttacacgaagttacattgagaaatacaaggaattaaggaagggcggcggtgattgttttacccgctgtaaagcacagctatatttatgacgctgaaagaaaaagtatgattatcggcgggaatggcaggtaatagattacggcaattataccttatcgggtataaagagtggggaggaattataagttataccctttagggtgtaaaaactagaacaaatgcttgacattataccctaaagggtgtaaaatatattcagattataacagcggagatgattttcggtgaataaaatagcactgtttataaaaactaagcggaaagaagcagggcttacacaggaagaatttgcgatgcgttccgggcttggtctgcggtttgtccgtgagcttgagcagggcaaggaaaccgtgcgtatggataaagtcaacacggcgcttgcaatgtttaatatggaagcggtgccgggaagaaaggaaggcagacagtgatggtactcagaacggcttatgtttatgtcagaaatatttttgcaggacagctttgcgaaagtgacgagggatatacttttacctatgacaaggcttatctcgaaagcgaaaatgcaagtgccgtttcacttactatgcctcttagtgaagaagcatacagttcgaaaaccttgttttccttttttgacggcctgattcctgaggggtggcttttagatgtggtgagccgtaactggaaaatcgacaacagggacagattcggtttgttattggttgcctgcaaggattgtatcggtaatgttacaattatggaggaaaaattatgaaatgtctgtgctgtggaaaagatattgacaaaaacggtgaaaacgggtggcataaaagctgtataaagcgttttttcggtgcatcaaaattacctgaaatagaaattgatgatgaaacgctgaaaaaacttgccgatgaaacggtaaataacggattgaccgttccgggcgtgcagaaaaaactgtcattgcatcttatttcggaaaataagtcgccaaaactcactattgtgaattttcctacaggttatattctcaagccacaggtgccgcagtatgaaacattgcccgaagccgaacatcttgtaatgtctatggcggatataacgggaatttcaactgttccgcacgctcttataggcaataacggtaattatgcgtatattacaaaaagagcagacaggataacgaacaccgacagaacagcaatgcttgcaatggaggatttctgccagcttgatttaaggcttacgcaggataagtacaaaggctcgtatgagcgctgtgcaaaggtgatagaacgatactcgtcaagggtgggatttgatatgaccgagctttttatgcggcttgttttttcttttgtgacgggaaactcggatatgcaccttaaaaacttctcgctgatagaaactgccgaaaaaagcggtgaatatgttttatcccctgcgtatgatttgctgcctgtaaatgttattctgcctgccgacattgagcagaccgctcttacgctgaacgggaagaagcgaaatatacgcaggaaggatttttattcgtttgcctataaatgcggtattcctaaaaattctgcagagaatatgataaaaagggtagtatctttaaaagaaaaatatgaagctatgtgccgtgattcgttgctgtcggataatctgaaagaatgctttatacgtctgataaacgaaagatgcgatatactcagctgaaaaataaacccgacagatacgtttattgaatcgtacctgtcgggttgattttatagtccgtttgctcctttatatgcttcaataaatacaagcgcatctgtatttgatgccgctatttttgaattataggcggcgatagcactattctgtgatatatcttgatttgtgcttatcagtttatcgttttgcgtagtgatcgcacctaattcatcaaggcaatcctctaacgattcataaagcatatactgagtatctcttatctgatacagacagttgattgctgtgtcgagctttgaaataatagtatcctgtcttatctctttttcatatttgttatatgcaccgcctgttcccgtgagtgcagtacagcgtccgctgtcaaagtactcaagcagtcggataacggttatcatatttctgtatttaggatggataatatccagtgaatataattgattaagtgtttcagatatgttgttaattttatcttgcatatcattaatttgttgcttcagttgttgcttttgaatattttcattatttacacgggcggtatcgttattcacaagattattgtattgttgtacagcatttttatattttgaatttgcacgcattgcagaaatgctgccgtttagtattgtaaaggcgagtatacacaaaggaccgattatgcttatcgcaatttttatttggacagagttattcataaaatcaatagtatcataggagttgctggtcagattggataaataggatacaaatataggagaatcgataactaaataaatcggaattaatattgcaagtgtaatcagtgctgttataaaaaatttttttacacttacgcttttcggtggagtgaattgattgtaatatccaagtgtattgatttttgactgtatttttgcgattgctaactgcaatgtatacctttcgctctccagttcttttgcgattgtcagatgctcaacaatcacggacggtgcgagtttatctgcggcgtggtattctccgcctatacttttttcagcctgatattcaataggacagccgcagttagggcaagcgttcgctctgtcggaaaattctttgccgcactcggcgcattttatcattgccatatttttaacccctttaatttttaatgctcagaaaatttgatatccgatagtttaattctaatctgtttcaggttaaaagtcaagaccttcacactaaaagtttataatttaattataaaaacgtgaaaggcgctgataaaaatgtacagcagaataagaaacctgcgggaagattccgatctcaatcagacaacggtcgcaaaaatgctcggtatgtcgcagacgggatattcaaaatacgaaacgggcgaaaatgatgttcctacggcaatactgataaagcttgcggaatattataaaaccaatgtggattatatcctcgggcttaccgataacccaatctattataaagaaatataaaacccggcagatacgtttattgaatcgtacctgtcgggtttgtttcatattaaagcacctttgataaaaagtccttaagtcttggatttttggggtttgcgaagaattcatcgggaggaccctgttcaactatctgtccgtccgacataaacattactcttgacgcaacctcacgggcaaatcccatttcgtgagttacgacaaccattgtcataccgtcgtcggcaagctgtttcataaggtcgagaacctctcctaccatttcgggatcgagcgccgaggtcggctcgtcgaaaagcataacatcgggcttcatggcaagcgcacggacgatagcgattctctgcttctgaccgcccgataactgcggaggataagcgtctgccttatcagcaagaccgacacgctctaaaagccgcattgcctctgcgtcagcctcttcctttgtcataaggccgagcttaacgggagctaaggttatgtttttctttatcgtcagatgggggaacagattgaagtgctggaacaccatacccatctttcttcttataaggtttacgttagccttgcggtcggtgatatattcgccctcaacgcagatgcttccgcttgtcggcttttccataaggttaaggcaacgcaggaacgtacttttacccgaacctgacggtcctatgataactaccttttcgcctttgtagatatgctcgtttatcccgttgagaacgtggagattgccaaacgatttactgagatccttaacgtctatcactcttgccaagcctcctctcaagcagtttctggagttttgtcagaataaataccagtatcagatagaatgccgccgcaatgagaagcggggtaataaggtcatatgtctttgagcctacatactgcgccgctttggtaatatccgttaccgcaatgtagcctgctatcgaggtttcctttaccagtacgataaattcgtttccgagtgcgggaagtatgttctttatagcctgcggaagcacgataagccacattgtctgacctgcgccgagacccagcgatcttcctgcctctgtctgacccttgtcgatagactcgatacctgcacggacaatctccgcaacatacgcacccgaatttataccgaagcacaaaactgcggcaactattgcgtttgcgcctctgtagttgaacagaactgcgtttatgagcaacagctgtacaagtacgggcgtacctcttattacgaatacatacaggtcgcatatcttagctatccagccgatacctctcctgcctgcgcataactgctttactactgccacgaaagcaccgataagaaaaccgagaataaccgcaaacagcgatatgagcagtgtgtttccgataccgcttaaatagaattcataacggttttctcttataagcgccttgtcaatggcatcccatataccaagaaagaagtccaattcttaattcctccgtcttatgcctttcaaaaaatacgggcggcatttcaccgcccggtagttttatcagtcagcagaattattcagccttgctgtcagcgtcggcacctgcacctgttgtgtgcttgagtgtgaactcgtcaaccttgccttcgtcaatcagcttctgaagaaccttgtttaccttttcttcaagctctgtgttgcccttcttgaaagcgaaagcgtacttgtctgtgaatacctcgccgtcaagaatttcaaggttgtcattaccctttaccatttcctttgcgggaagctcgtccataacgatgcagtcaaccttgtcactctttaagtcttctgccgcctgaacatactttgtataacgtgagggctccttcttaagatcgtctgttacatatgtatcggcaactgttgacatctgaacggcaatctttgtgtcaccgccgagatcatccgcgctctttactctgtttgctcccttgagtacaacgataacctgctttgacttagcgtattcgattgagaagtccatagcctcctgacgctcgggagtaaccgagatgcctgctgctgcaaagtcaaccttgccctgctgtacggctaaaagcgcaccgtcaaagtccattgactgaatctcaagctccataccgagctcctttgcaacttcgtttgcaatatcaacgtcgatacctacaacatcgttaccgctcatatattcataaggagcgaaaccgggttctgtagccataatgagcttgccgcctgttgtgtttgactggcaacctgccatagcaagaccgcaggtagcggcaacgagaatgcctgcaattattcttttgatcttcataaaaatacctcttttatatttctttattttttgtgcgctttctgcgctatcgttaatattatagtgcatttcttttcaataagcaagagtttttcgtttttttgtgtaaaatacatataaaaaatgtgccgcagtgagatactgtggcacatcgggttgcagaaaaagtctgttttttataaaaatagagcaaattctatatccctaaccccaaaccccttccccgtgggaaggggctatattactggggctaccgcccctagtccctgtcgggggctccgcccctgcgacctcatttttatcaacgatatagttttttcgacagactgaatgtgccgcagtgggatgctgtggcacataatctttgcttttccggcttactttcttgagaataagccctttttctcgtaaggctcgcttgtaatgtctttaagctcgtagccggttggctgcataacctctctgatcttgtcttcggaaagcgcctctacgcttattatcacggtttctccctttgagtgagaagaagtgaccttctttacgggaaaagcatttctgatagcgtcgttgacgtgtgattcgcacattccgcacatcattccgtcaattttaagtgttgtctttaccattgtaaattcctccgttactttattgatattactttatagccgctgttttcaacggcttttttaagctgtttgtcgggaacttcgcctgaaagctcagccactgcgataccgtctgtatggctcgccgaagcacttgccacctgtggaatagcctcaagcgcagtttttacatgatgctcgcatttttcgcacatcataccctttatttttatcgtctttgttattttcgccgtgtcggacggctgtattgcaatattattcatcggctttgcttttctgtcgtgctttgtgctgtacagcctgcagaaattgagccttaacgcattcgatacgacgcagaagctggaaaggctcattgccgccgcaccgaacataggattaagcgtaagcccgagcggaataaatacgcctgcggcaagcggaatgccgataacgttatagatgaatgcccagaaaagattttcgtgtatattacgcagtgacgagcgggaaagccttatcgccgcaggaacatcggtaagtctgctcttcatcagcacaacatcggcggcatctatcgcaacgtctgttcctgcgcctatagcgatgcctgtatctgcggcggtaagcgcaggtgcgtcatttatgccgtcgcctatcatagcgaccttaccctgtgccttgagcgagcggatgaccgcctcttttccgtcggggagaacgcctgctatcacctcgtcaatgcctgcttttttggctactgcctttgcggtacgctcgttatcgcctgtcagcattattacccgtatgcccatatttctgagctgttttactgcatcggggctgtcgctctttatcgtgtcggctactgctatcataccgagcatacggttgtttttgcagaaaagcaggggagtcttgccctcgccagaaagacggtccgcttcagacttaattctgtcaccgacagcaattttttcaccgatgaacttaagacttccgccgtaaagcgtatcactgccgatggcagctgtaagtccgtttccgctgagtgccttgaaattatcgactgctactgacgggattttgtgctcagtgccgtaaacgtttattgcttttgcaagcgggtgttcgctctttgcttcaagcgacagtgcaaggctaagaagttcgttttcggcaacatcttccgcagggattatatccgttacgaccggctctccggctgttacggtgcctgttttatcaagcacggctatctgagtttttcccgtctgctcaagcgaaacggcggtcttgaaaagaatgccgttctttgcgcctacaccgtttcctaccattatcgcaacgggagtggcaagtccgagtgcacacggacagcttattacaagcaccgatattcctcttgcaagagcataagcaaaatcctgtccgagtaagagccacactatcgtagtggcaacggcaattgcaataacggtcggaacgaatattcccgataccttgtcggcaatcttcgcaacgggcgcttttgttgccgccgcatcgctcaccatttttattatctgtgacaaggtggtatcctcgcctacacgggtagccctgcaggtgatgaagcccgtctgatttatggtagctgccgaaacattatctccgaccgtcttatctaccggtatgctttcgcctgtcagtgcggattcgttgaccgtgctttcgccgtctgttactactgcgtcaacgggtatgctttcgccgggacgcacaacgaatatatcgcccttcaccacttctttggcaggaacagtatgctccgtgccgtttcttattacgtttgcggtcttaggggcgaggcttacaagccctttcaacgcatcggtggttttgcctttggaacgggcttcgagcagttttccgactgtgatgagcgtcagtatcatagccgccgattcaaaatagaactcgtccatatacatcataacggcatctgcattttggtgaagctgtgcatcggtcatcataaacagggcatatacgctccatacaaatgacgcacctgagccgagcgccacaagcgtatccatattcggcgagcggttgataaatcccttgaagccgtttataaagaatctgccgtttataaccattataattgcgcttagaagcagctgtacaagacccatagcgacatggtttccgtcaaaccaggacggaagcggaaatccccacatcatatgccccattgagaagtacatcagtatcacaagaaaaacgagtgacgctataagcctttttcttagtccgggcgtttcggtatcacgcagtgaaccgccatcggtatcggtgttttccgtttttgcgcctttcagccttgcaccgtagcctgccttttcaaccgcagaaataatatcctgcggtgacgctgtaccctcgacacccattgaatttgtaagcaggctcaccgaacacgaggttacgccctttaccttgcctaccgctttttccactcttgcactgcaggcggcacagctcatgccagtgacatcgtactgcttcataataagaccctctttcttttgctgtatatctttatattatgtccgtcttacgttatttcatcagcttttgcagagttgtgacaagctcgtctatgacctcgtccctgccttcttttatatctcttgcaatgcagcctcttatatggcttgccagcagttccttattgaaggcattcattgcggcattgacggcggcggattgaataagcacatcgttacagtatgcgtcattctcaatcatagcctcgatgccacgcacctgtccttcaatgcgtttaaggcggttaagaagagcctttttgtgcttttcgtcccttacggtatgcttttcacaacacggacagacttttttgataatcgttttattttcactcatagcgttacctctgatttttgctgtagctttaatataccctcacggggtattttaattatatactcccagggggtatttgtcaagaaaaattatataattttcgatagcacgatgtcagttctgctgttcggaatacagagcgaaatataggtgagacacaatttcttagatataaaaaattaaaaaaacgggtcgcagggcggttgcacggcaaaacagcacttcggcatctgtccgcacattttccgataaaccggaaagcactttcgaaatagtaattgtgcgtatttaccgaagaatacgatgcgaaattgtgcaaaacggaaaattttcagaatcccttgaaaaacagtaggatttatgctacaatcaaactgccggaaacgttttcggtaatttaattcagacaacaggtgagccattgactataaaggatattgcaagacttgccggctgcggcgtgagcacggtttcacggtgagatatatgtactaacctgcggacgtgtagcgttaagcgtccctgcattgacaggatatacaatgttcgggtagctttacgagttcagccaacaccctgacggggtgggggtgtgagtaaggaaagagggagcaagagggagaaaacctaagggacagggagaggggctgtcaagtccagcggagctttagcggagtgcacgagccttgcgtaagcgaggctcagacttgtacctgatccctttggttgtctccctctttcatattgacaagtgtacccattcgaatagcgaacccgagaagtgctatctcgcaaaaagaactatcggtagcttgttatcatagtcaaagcagaacggtattgcagaagtacatcaggcaaaaaactttttctacaagcaaacgggtgcggattatgataatccgcacccgttacctataccctctgcccgaacttaagcaatatccttgaatacagctccttatttatctcataataatctgtaaccgttgtctttctgtcgttttcataaagctcaaaacgcataattatctcgctgtagtcctccgtgtaataaaaaacgcacagccagtagcggcttttctccgcataataattcacaggttcaagcgtcagcaccgagtttatatcaccgtttaaaagcatattcagctcatcgggctttatatagcagaactgcaccttctttgtcataggcatagctttcgcttttcttttaagcggcgtgtctgcggtgtcattgccggcggttttctttttgaagaaaaacatatatgctccccctttttataagcaatataatttgcattccgatgctattctatcacactttaaacactttgtccatataactgtgcattttttcactcgaaataaaaatacaattaaatcaattatctgccaaacttcaaggctgtatcacaactttttcacatatgaacagtatactttagccatagtcaaaaacaataaagcctacgggcgtgaaaggacgatagatatgacagacggatttgaacgcaatgatatgaacaacatgaacaacatgaacagcgaaaacgagcaggtacagaacagcttctcgaccgccggcaattcacagacagacacatctgcaaatgcaagcggctataacgcaggttcttcctacacaagctcctatgacgcacagcagaatgcgtacaactcatattacaactacgcaaacggcgcaaacaatacgggtgcaaacaatacgggcgcaaacaacatacacgttgctcccggtgcaaacaagccgcctaagaagaacggcaagggagcactggtcgcaggtatcattgcggcggctctggtagtcggtggcggtgcaggatttgccggaacggtactcggcaacagtataaatgccaccattccctttgcaagctcgtctgacggtacatctcagggcgaatcggctgacagcggctcagaaagcaccatcgccgcaccgtcaacaacgctcaacacctcaagcacggcgacagccgctccccttgacgaaagcaagataaacgacagctcaaacagcactctgctgaatgccgaggaactttacgaaaaggtaaagaacactgttgtgctggtatataactatcagcgccagacaggctatgccgagcctgtaaaatacggcagcggcagcggcgttgtatttacttctgacggctatgtaatcacaaacgcacacgttgtagagggtgcggataaaatgacagtagtcgctcccgattacaagaaccccgataacacaaaggaatatgaggctacagtagtcggcagtgatacctattcagaccttgcagtgctgaagatcagccgtgacgatccgtttgaatatgcaacgctcggtgattcggacactgtaagagtaggtcaggatgtatgcgtactcggcaaccccaagcagttactcaactctcttactaagggtatcgtatccggtcttggcagagcctccgcttcaaacagcgcatacggcacaagcacaatacagatagatgcggctatcaacagcggtaacagcggcggcggacttttcgatatgtacggcaacgttatcggtataatcgactacaagctggtatccaacacatcagcgtcaatagataacatcggcttcgccattaccataaacgaggctaagccggtaataaacgaccttatgacaaagggctatgttacgaaccgtcccggtcttggcataaacggcgaggaaataagcgaatacagcgcatatatgcagggacttgaaagcggcggcgtatatgtaacatatatctcaaaggatatgcccgtagctaagagcggccttaaggtcggcgatataatctcaaaggtaaacggcacagcggtcacctccgtaacagatatacagaatatcattgcggagcttaacataggcgacactgttgagcttacggtttacagagcaggtgcaacaggcagatacaccacaaagactatcaacgttgagcttgccgagattgagcttagctgataaataagcataaaacaacggctgtgatgaacttcacgtttcatcacagccgtatttttatgtcctcagattaagcagtaccgacgacatgaacatctcgtcctttacctctgcgcaatatgtaccgccgtacttttccgcaatgctctttaccgattccacacctatgccgaagcccttgtgcttcgatgaaaacagcactccgctcaggtcttttttaagcgtaccggtaaaagtattgtctatgccgaggcaaagagtattttcgtccgtcattgcccttattactattcttctgttatcgccgctttcctccttgcaggcatctgttgcattttcgataaggttgccgaacagcaccgacagatccgtttcgtcaacagagatattttctgggatgaccgcctttacatcataatcaatatcctcgtttttcgccacctgtgcaaaatacagcattacggcgttcaccgtcttgttctcgcagaagctgataagcgtatcgtcgggcaagctctgctgatagctgttaagatatttttcaagctccccgtattgcttgtttctgacatattcctgcataagcgagatatggtgacgcacatcatgctttgcacgtcttgcgtccgctatcttttcctgcagattttcgtactgcaggttctgcatcgcaaggcggtggttgttgtcgctgagccttatgttcttctcctgctcgtttatcagcatcgctataacataatacactatgccggctcccacgtttataaacagcaggaacacagtgttgcctgtgtcaagcgcagtttcaaggctggatttgccgttgttgttatagagcatgtggtaccatatcagatagaaggtcgcaggtatcagccacagataccgccactcgatacctgtaggctctttttcaactgcgggagtatacaccttttttgtgtagatgaaaagcggtatccacaccaccgccagcacaaccagcattataagcgagaacgaccagcggtacgactgtactgccagttcgggaaagatcttcccttctatgcactttgatgccgccacgacaaaattcgccgtgtttgagatcataagcaaggtgaacagcgccttgccgaaatttactttaaccgcaaaaaaatagaaaaccacatacaccgcagtgcttaccacactcgcaagcgccgccttccctcccgaaaagaaagccgcccacagcccaagccccatctggataaacgatataacaacaataatgcagaccgtgattttcgcagaaaagcgaagccttgaacggaaaggataaagcgcaagcgccataaacggcaggaaattcaatagtgaataaacgcatatttccgctattctgtataacggcggcatcataactcaccgccctttccgtgctttatccgtggataaaatattatgactgtaatctccggtgctttgtaagtagtatttatcatagccgacctcctacaatataaccaatatctataatagcacacaacagactattttacaataaaaaatcagagtgattacatctgtatattatggtttgggccgaaaaaaagccccgatgcaacctgcaccggggtaaagttatctctgagcgtttaccgtatcggtcactctgtgctttacttcatcgcttatccttctgctgtcccttatcttctgcgccgccgccagcttgacagcaatgcttatcgggctgtgttcaaggtatttcacgataagctgaggataccttacacagtacaccgatataccccacgccaccgccatatcccgatagtattcaccgccgggaagcctgtcatatattgtgagcgcttttcttactgtcggctcatcggaaaatttcgagaacataagaactgttccgacacgggaaacaaattcttctttcctgtacatcagcccttcggcaagacggagcagatcgtccgcttcactcttttttaccttgatgcaggagcagaagcaatcgcactcggcccagttatctatcatctcggcgtagcgtataatatacggctctttttcgcacagcggaacgtcggcaaaaccgacagccgcaccctttatgattatttcttcaaagctgtcatacggcagttcgaaaatcttcttataatccgccttatgcccctttgcgatagccttaaggtcgggcatacgcacgccaatcactctgtatttgctcgtatgcactatcttctcgttgaaaacacggaacttttcttccgaaaggctttcaagaagggaaatcagctcgcctcgctctgtcatttatacctctcctctgtttcaagtaaaaacttcttaatatctatcccctgcgtacccatataacagcctatgccgccgcttgcagggactatcctgtgacacggtatcagtatcgggagcggatttcttttcagcgccgaaccgcacgcacggacagccttgctccctgccatttcagccgtctgcatatatgttacacgctcaccgtatggtatcttctgcacggcggtgagtatgctcctgaaaaacggcgtgccgatgccgcttatgtcatacggcaaggagaattccttcagccttccgtcaaaatacgcaaggaactgttccttagccttttcgcatatcgggtcggggcggtcgggtatattcatatcgaaaacgatattcgttatattcctgccgtccgttatcaccgttacagtgcggtctataggcatatcaaaggttatgttgctcatttgcccctgtttgcctttccgctgacctcttttgcttcaaggcggtataccctcgtccttgatgcgcatgagctgtcgggcttataggttttctctccgtactgcttaagtatcaagccaagtgcggacagcttttcgggcatatcggttatttccgtcattacaccacagcctgcaacgctttcataaagacttgttatactgccttcaacataatcacggcagttgtcaagttcaaaagcgactttgttgttctcgtctaaaagtcggttctttttgccttcagtggcagtgtgtatataaaagtacattctgccgtccttttcttcatatccgaagttgaacggcagtacataaggatactcctcgcccgtaaaagcaatgcgtattacttttgaacgatcgataatatccattatctcattcttgtcggttatttcacggtcttttcttctcatttgtaaacctccgcttttaataaaacaattatacgacaagaaaagaaacgtgtcaaccgctatataagcacgggctgaagctgtttattttccagtgccgcacctgccgcctgcggtatcagcgaaaaatccgccaccagtgagcaaggcttcttcagcggatcgtcctgtccgagcggaacgaagtaatagttcctgcagttcataagaaatccgatattcttaagcgaccctgcaagcgcatcatttgtcgcacaggcgataagcacaggtcttgctcctctgaggtggctttttaccgccatagtgacaggagtatcggttatacttcttgcgagctttgccatcgtgtttcctgtacacggagcgacaatcattatatccgtcagccttttaggccctatcggctctgcatccgcaacagacattatgacacgctttccgcagatattctccgccctttttatatgatcctgcgcagtgccgaaacgggtatcgacagttcctgcactcagcgacattaccggaagaatatcacagcctgcgtcacgcaatgcctccatcgccgaaaatgccttagagaatgtgcagaacgaacccgtcatacagaatccgacctttactccgcaaagtaaactgtcaagctcacggctcacggttaccgcccctttctttatcgcagttgcttatcttgtcaatataagtttcaagtatttcctccacgcagtcggctattatctctcctgcggtcacaggcgctgtccgtgacggcagaccgcctgcccttattatccttgccttgccgtcatagtttttcattgccgtcttatcaatgccccactctgacgccagctcgatataaacggcttcgctgtcaaatgccgaaagctcgctttcgcctatcacggcgcacggcactgtattatatatcagcgttacctcaggcagcgtgttgcacagtgcgtcaaagccgacggcgtgacagcccgacattctggcttttgcacgtttttcacggcttcttgccgctactgtaacctcacagcccatcgccgtaagatacagcgcaagctgtgaggcgattctgccaaagcccagtataagcaccttctgaccgagcatctgtacaggcgttgcgtttatcccgacagcgagcgcaccctcagccgacggcaccgcatttctcagcatcactgcctcgtcggcataatgatcctcgcagaaaaactcgttttttgcacagaaatttttcaccgcaggagttatcataccgccgataactatgccgtgcggctttagcaatgccgtcagcagtgaaagcggtatcggctcatcgcaaagcggagcgtttatgtttatgccgtcacggcttgcagggataccaagcacggcggcatcgcacttcccgtcgggaagcatatcacgatcgctttgcccgtaggtatacacctcgtgctttctgctcagcctgtcggctgtgtaacgtaagcggacatctccgccgagtataataagtttcatattcgtttaccacgctttctcaggaatttatatctgcgccgtatgacgtatgtatgctttatgaatatcgtgtataaccttttgaaaacaccgataaatcaccttaaaacgcatattacgctgttatccgctacatttttgctatcatattgtatgattttgttctgttttttgtgaagaaaagcgaaaagacaataaaagcccttgttttttccaaatgtatatggtattatatgcaatagagggaaacaaaccccgcacacttgttgccgacaggcagcaaatacagaaaggatctaagtgaaatggctactaagaagacaaatacgacaggaactaagactcccgtagctgaagctgtaaagactgaagctgtaaaggctgccgctgaggtaaaggcagatgccgtaaaggctgtaaagacagttgagaaggttgctgaaaaggcagttgaaaaggtcgctgaaaagacagttgaaaaggtcgctgaaaaggcacctgcaaagaagcctgccgctaagaaggccgctcccgctgctaagaagcctgccgctaagaaggctgctcccgctaagcccgctaagaaggaagctaagaaagctgctcccgcagaacccgacaagttcgctcttgcagatatggtaagagaaaagtttgcaaagaaggacgtttcaaaggtaaacgaaaagattgctatagagatcaaggcttacggcgagaaggaattttacatttatattcttatcgatgacggtaaggtaacagtagagccctggggctacatcgacaacgatgtacatatagatatgcccatcgctgacgttattgctgttgtaaacggcaagtacgatttcgttgcaaaggctataagcggcgacttctacgctatcggttgctttacaaagctgctcaaggcttacgaagcacttatcaagtaattttacaaaacagaatataagcgttgacgcttaaaataataattgcaggcgtaattcccattgcgtctgcaaattatattatatgtggatatgaagaaaaaacggtagggaatacatcagaataaggacaggtaccaataatggaaaaagttaaaaaggcagtaatactcgccgcaggcttcggaacacgagttctccccgcaagcaaggctattccgaaggaaatgctgaatattgtcgacaagcccgctatacagtatatcgttgaggaagtcataaactcaggcataaccgagatactgatagttctgtcgagaggcaagcaggaggtcgaggatcactttgaccgcaagcccgatcttgaggctcagctccttgcaggcggaaagacagaattctacaaggtagtatgcgacattgccgaaatgggcaagaacatcacatacgtccgccagcagatgcagaacggcacaggcggcgctgttatgtatgcaaagcagtttgtcggaaacgatcccttcgtagttatctacggcgatgatgttataatcggtgacgatccctgcacggcacagtgctgcagagcgtacgagaagtacggcaaggctgtcgtaagtatgaaggaagttccgtttgagcttgtgctgaaatactgcacgcttgacgtaaaaccgcttgaagacaacctctacagcatttcggatatgattgaaaagcccaagcccgaggaagtaatctcaaacttcgccatactcggcagatgcgttcttcctgctaagatattcgatattcttgcaaccctcccgacaggcgcaggcggcgaatatcagcttaccgacgctatgaaacagcttgcaaagagtgagggtatggtgggcgttgacttcaccggcacacgttatgatatgggcaacaagctcggcataatgaaggcctgtgttgaggttgcactgaatcaccccgagataggcgaggatttcagagcatatcttaagacgctcgatatataaatataacaacaaaagcggaacgtgaaacccacgctccgcttctttttatcattatgttgttttctttttaaacccgtatccgctcatataatctatcatcccatactcgtcaataagattggcaacagcaggtataaactcattctcccacttgtatttatcgggatagagcgaccttgccaccgccatataggatttaagcgtattgtcaggctcaaagccaagcccatccgagcttttcggcgcattcgggaacggattctcatataatctcgtataatgagcgcacacgtttctgagatccgacaggcacagcattctgtcctctaccgttctgtagttaagatcaaaatgctgtgaaaccatatccttcttatccgccgatttcatatctatcagaaaatatgtcagcgttccgaagctgaacagctctacagccgcccacaccggcattataccgccgtactttctcttgtggtgctttacgaattcctcgttctcgtttgcctcgataagccgctctatcttcgacaaaaacgcctgatggttatgatgcggatcgaatccggacgcattgagatagcccagcgccccgtacttcatagcgtgataatttgagattatcgccctcattgagatctcgatttcctcaagataggtcatcagcatacggcgcagtaccctgtcaaaatcatagaccttcattatctgctcaaaggtcgtaccgtccctgtacttgccctttcgctccagaaacggcgcaaagtaataggcaagccggtaatagttgatatttgtaaggcactttcttgcatactcctcatcatctattatacagcctctctgcctcagtatctcgatctgctgttttatggtagcaggcgttttgttgaactgcattatttgttttcctccggtttttcaagatcaatgaaacgtccgagcgtaaacgagtatattatcatctgctttaccggcacggaaaattccttctccagcgcctctttatatatatcaagctgtaacttataatcgtccttgtatttctgctcatcgtccgttttgtctgtcttgtaatcgaccagcactataccgtcatcttcgataaagaacatatcggctataccctgtacataaggctctgcgccctcaagcatttcacggctgtccgccccgaatattgcaggatcgtagcactgcgtgtcaagcctgtggaaaataggatactccctgtacagctttccgttcttatccgccttcacaatacgcttcgcaacgtcatttccgtagaatcccgctatatctcctgcgtttatgctgttttgctcagccttgtcaagaaaacctgcggtactgtttttgatatagtcactgatttcgtcctcgctgagtattttctcaaaaggtatatgctccatcagcttatgatatgcgtcgccacggcgctttccgctgagtttgcccgtattgttttcggttaggaatgaaggctttcctataaacaggccatagttttcctcgccgtttttttctctgagattagctgcaagctcggtagctgtaaattttgcggaaattttcgtcagcggctcatatgcgtatgccgcattgagctttttctcaagctcgcttctgaactgttcgtcaacggcaatgccggtgctgtcgttatttttatcatctgtatattcatcggcattttccgccccagtattaagtgcaggaattgtgaggctgtgttcatcgcctccgtatgcaagcggataaaagatatatcttacatcgccgtagtcgattataccgctttgcatatcgtttaccttatcgcactcggctgacagtgcctcgataagccacgaaagataactgcttccgttacacttcccgaccttttttccagccctgtttacgtcaagcacagacatatattcatcacacgcctttgaaatattggcggtgaatatcagcttgttttcggctctggtcgccgcaacgtacagcagtcgcatttcctcgctcgcaagctgtttttttacctcctgagccgccgcatgatatgcaggcgactggattttgctcatagtggaaatatcaacgctctttgacgctaccgcatattcctcgcttatcacaacatcgcccgtgtagtcgtcatcgttgaatgacgatgcacagtttgcaacaaatacaacggggaactgaagtccctttgacatatgcgttgacattatctttactccgtgtccgcctgctgtctgtgccgcagtaagaccgcccatattctcgaggttgaaaataaggtcaccgagcgtaccgccgtccttatagtccgaatactcacgggcgtatgaaacgagcagttcaaggtttgcctgacgtgttgccggatcatcaccgacactgagcagctcatcggcagaaatacggtcatatatactgcggataagctcctgaggtgaagaagcggttgcggcatttctgaagctgtcaaggtcatttacaaatacggcacatttagcatcgggctttatatcctttgtaagttcgtggagtttttcgtattccgatgtatcgtagcctctcactgcctgcataacacagctgtaaagaggttttctcttcattccgacaatttcctttgtaccaagacaatatttttcaagttcatcggcacactccgccctgattttgcttatatcaaagccgaatgttcctgttctgagccgtgccatatcatcggctgtaaagcaataaagcggtgacataagcacctttgcaagctcggtgtcgttatacggatcgtttatgaccttaagaagcgacagcataagccttatttcaggtcggtcaagcaggcttgccttctgactatacgttacattcagtccgttagctgtgagaacattgacatagtcggcaatgcggtttttaggtgaacgcatgatgattgcaaaatcatcctcggtacagggtcgtttgtcactgccgaccttataaccctgtgctatcatctgctttattcttgccgcaatgtacgccgcctcggtaacgactgcgttctttctgtctttctccgaaacaatgcagacctccgtcttatcctcgtttgctatagggctgtcgctgtccttttcaagtccgcagataagtctgccgttttccgcataatcaacaccgccgttctcctctgtcatcattctgtcaaacagcgtgtttattccgtcaataacgcacctgttactgcggaaattttcgttcagcggcagcttgtcgaaatcgtccgatttgcagatagacgaaaacacctccggctgtgcccctctgaagccgtatatcgactgctttatatctccgacaaaatacagtccctgcttgttttcggtcagcattttgaatatttcgtactgaagctcgttgctgtcctggaactcgtcaacaatgataaggctgaaggccgacctttcacggaccttttcgccgttttcgcagagcatacggtacgctcctctttcagcgtccgaaaaatcggcgcagttacgcctctgcttttcctcgcagtacgccttgtcaaagcgcagtacaagatttttaagcgcagttacggcaggcagacttttatccatatcgctttcaaatgaggttatcttctcacaggtctttttgagatatttttcaaatacgctctttacaccttccctgtgggcttttaccagcttttccgcacttctgtcctgcggcgcacgttccttcgggaacgaagcgatatagccctttacggtatcgtctatactaaaaccgtttttgacaagagcggtcaccgccttgccgtagctgtcctttataccctgtgcataatcgctgtgcttcgctatcgcaccgtcgttatcctttgttccgccgtcatattccgttattgcgctgtcaaggctgtccgcttcgctctcaaaacgctccgcatacattcctgcaaggccgattagctttttctttatgtcctgcattatctgagggtcgtccgagcggtcgagccacttttccggctcggtatggttgattgccttttcgtgaacagtaagtataatatcacgcagacggcggtcatcctttgctacatagttttcgacaatcacgtccctgtcggctttgtcgccgtttgcgtaaaagtcctcaagcacatccgacagcacatcgtttttcagtgcgccacccgccgtttcgtctataaccgaaaatcctgcggatatattgtcggcaaggtcgatattctccctgagcagcgaaatgcagaacgagctgatagttgatattctcgcctttctcagcctcattctctggttacgcagaaatctcacgtcggcggagcttacggcctcgtttatcctctgcctcataagagcgtcaagtcttgccttaagctcatccgccgcctttaccgtaaatgttaccacaacgatttttgacgggtctatattttcgtttttgtcgcatatcagccttacgacacgctgagtcagaacggcggtcttaccgcttcctgcgcctgccgatactattgccgggtttctgccctgatttatcgcctttatctgagcgtcagtatatttcatcacttatcccccttgcctttcttcgcctttgcaacaactatatcctcaccgaattcaacagcctcggcggacccaacatcaacgcacgaactctgtttcattccgcatatatccttgaaatcgcagtattcgcaggataacgcctttccgtcatcgacaagcggtcttgcatcgacaataccgctttttacctgttcggtgttttcttttacaaccttttctatcctgctttcgagctttttcagcttatcgcccgctatagtcacagcggaatagaaattggtgctgacctccttgtccctttcaaacttcacgccgctgtataaaaggcgttcctcctcctgctgagtaccctcaacggcaaagcccttctccttatgctcatcaagccagatacctcgcttaagctcgtcagacggtgcttttatatccttgagagaagtttttccggacggatggtacagtgcggctgacggcgtaaagccgtttgccccgttgttttttgcaagtgtgaaaagatacagtaaaagctgcagatcaagcccgtagtagatacggctcagctttgcgtccttgtttccggtcttgtagtctattactcttatctgaccgccgcttttgtcatcgttatacgctatatctacacggtctaccgttccgcctaccgttatcgtctgacggcttttgtctgcaagctctatgtcaaagctgtacggcgaaatgtcaaagccgttctcgctctttccgctttccagcttaagctcgaaatatgacggcacaaacctgctcttttcaagctcctgcgccatatattttataagatagaacgcagttaccgaaagtgcgttataaagcgtgttgaaccttgcgctcatattctcctcggtaagcagatacttttccctgtactccgcaagcgcctgttcgataaggtcctttattctgtcatcggaaacgtgaggatttccgttttctcttgcaccgtcatacatattttcaaagcagtatttcattatatagtgcattatatttccgtagttgctcgcattcatcgcaatgcctgcggacgatgaaaggttcataccgtagcgcaggaaatatgcaaacttacagccgttcagcttttctattgccgtaggcgaaagggctgtctgcggaaaaactatcggcgcaatatcgcttatcctgtgtatgtcggagtttccgctgttattgctcataaccgcctttatcctgccgattgagcttgattccttttcgttttccgaaagcacggcttcaacagctttcttctgtccgtctgtcaggcgggaattgttgatgacatactgcttttcagccgacttcacgctttcggtcatataaagtgcgtcgagattatccacgtttataagctttgcaccgaagtgctttgctatatcggcaatgtattccgatgcgttttccttttcaccggtaaacgtgataaacagcttctcgcctgcaagcgtcatagccttatatgcgtcaagcaccgccgatgaatatctcgcctcgtcattctcaagctcaatatcgttttcggcaagacgctgtacatcatcagatgtgaacacgctgttgccctcgggataaatgtcggggaatgcgccgtcggcggctcccatcacaaataccgccttaacttccctgctccttgttcttgcaggatctccgaacagcacgctgtcaagaacattcggagtgcgtgatatgctgatacgggaggcacagctatggataagtgcggagaactccgcaagcgtaagaggagtatcgtcaagcgtttcatacagcgatgtcagcatttccgacacggtacgccacagctggttatattcctcggtaagctcttttacatagcggagttcccttgtagagttgtcctgacacttgccctgtatagcggcgcttatatccaccttgtcgaacagaaaagcggtaaacttctttacaagctccctgccgccgatgccacgcaccgacttagcaaattccacaagaggtgtaaccgttgcgattcgtatctcctctaccctctgctccgatgcgtttgttatatgcggcatgggcttatcccacttcttgcgtttaagatcccagcactccgcatattcctccataagatgctgttctacaaggtgtctttccttgagcgtcatagggactgtcttgccgttattcttttcggacggcagacgcacaaaaccgcttcttatataccgcagtatatttgtacctgtaggattatccgccgctttgagaagcgcttcaaagaatctcagcatcggcttctccgagatcggtacgggaaggtcggcgaatacaggcacatcatatcttgccgccgccgaatttactgcgtccttgtattttgcgggagaagcgcatatcaccgcaatatccgagtatctgtagccctcactgcgtaccagctttctgatatttgcacacacaaaatcagcctcgccgctgacagaggacgaataagccattgttatgccgtcactgcccgccgtgctatcctttacccccgtctgcaaaaagttacgcagtgccttgagattgccgtttttgtaacggggagccttgccgcaaagacgggtatgttttatatcctccctgttgcctctttcgaacaaccgctctgtcctgtcgcacgttgcaaagacctccgccttgtttccgtccgtacagagcgcaacaacaaagttcacacccttatccgcaagcgctcttaaaaaattctgctgtgctccgctgaagctgtcaaagccgtcaatatatatcgttgtgttttcgtcaaagctgtcgccgtttcttatcacctgtgcggcaagcgtaagattgtcctgcctgtcggcatatttctcggtcagctttttatcataaacgctgtataccgccgcaatatcgcccatcttctcggcaagatggacaggcagccgttcagccgtatttttttcgggagaatacagtgttttggtcagttcatctgcggatatgcctgccgccttgagttcgtttactgccgaaaggcacatctctacaaagccgtttttccttgcggcattgccgtaaaacttaagatcgccgcacagccctctgacagcaccgctcattatggctgtctttgctgtggtatccgcataggttttctgagggcaatgctttttcaatatgctttcggacagcgacataaagcccattacctttatgtccgaagtcttttcatcggtttcctttgcaacacgtctttcgctttcaaaaacaaactgatccggaacaagaagtatcctgcttttgctgtcgttcttaagaagctcatagagtgcggctgtcttgccgcttccggcaggacctgtgatgatatgtgtcatactttttatttccctccgtaaaatatattccgtaaaacgagataccggtttgtaggaaaaacctgttttttataaaatagagcaaattctctatcactataagaacgctttgtgggctttgcgtcctgcaaagcctttgggcgttctatctcggcatccttgccgaaaccccaaaccccttccccgtggtgaagggctgtgtatgcttggttggctctgcatcgtgcagagccttttggcatacacgcccggcatccgtgccggggctatattactggggctaccgcccctagtccaagcaaggatgcttgcagtcagccacacaaagccactgcacgagcattgcctgccgtgcaagcactggtcagtattacgctgataagggttattgttgcgagtatggtgtgggtacgtttacgtttcattttggggtcctccttttcttctttcgcagtatttactatctttagtatatcatattttgatttgatagtaaacatattatcagcgaaaatacaaacaaatcttaatccattatattggtaattgtcacaactgttgaaagttcggatttaactgaaatagtttcagtttcagcaaattgtattatataaaattcataacatcatatttcaattgactttagatgtaatctaatgtataatatagctaacgctataaacaaggagctatctatgagtaaatatcaaaatacacctagcaataaaaataagacacaagctgaattcaacgactcgctctattcaaatatattatcattaatttctgttattctgtcagtgttgagtttggtttgtgctatttggattggaaaaattgcaaacgaatttgctacaaagaattcacatttaaattatcaattatctgtggagaatccaatagcaatagaattaaaaaatcaagaattgcatgtagtagaggctcaagtgaacaaagaacgtccaaattttaattataatataatgtcatttaaaataaattttgaccctctttatatttccggagaatattgtaatgtaattttcgcatcgtgcggcgacgaaggcgtagacatgagattattcccacgatataatttaaattcagatgggcagagcaatttgggatatcgtttcaagtacggagaattattagtgttagattatactactcaaaatcaaatttcttttcacatgaacaaattcagtaatagtaattctaactattctataatgcatgtgattcttcaaggttacaatggcgactatcaaatttttactatgatctattctacaatcacctttgaagcatacatcctagataatatttccgttaattgcttttctgaaattgaagaacttaaaaacactctttctatagaaaagtcatccgaagaattaatctcgcaaattagagaagaaagaactatgattataaatagcctttaatttaagtacgattttccagttcaaagaactcataaaagcaaattgccgccagtggcgacaattttgacacttttttggatacatacacccaataacagaaaacttagaagaatgtaacttatgttaatcgtaacgttgataagaaggctcttattattgagtgggttgcgtataaatctgaatgtatcaaggagaatgttcaccagatttattatcgtaattgtgacattaaacattatatcaggcaccaaaagaaaatttacaatcattaaaatataaagcggagtgtcagtcgtatcagatttgattgtttgttttttatttttcgccttgaataatgccagcaaattaaaaactgtattgaaaatgtaagcaattaatgttacagtaaacaatatcatatttttctccattctatcatatttgaccgtaaatgtcaaatgctcttcttatttgtcttttcaagtaatattttatcgtacattcaaatatcttcactgttttctttgtagaagagtagcgcttttataacataactctgatagtcttctttaagaacggaatcgggtatgtacgattttatctgcttatatttaatagcattcggcggtttatgagaagattccttttttgctgatttatcagtaaaaagggaagtgacggtttcgttatccgttaaaccgccgttgtcaaaccattctctgagctcggcggctttattgattgttacatcatatttctgcataaacggtacgagtatagcttgttttgccggttggatataagatatttcaactgcggctctgattgacagcttatcatcatcaaccatatcacggatttctttgataagatatgtaagccgaatgtatctgcgaacggtgtccttactctctccgaacatatctccgatttgttcatcagtacgaccgctttttgtcgccactggcgacaatttatcggttgagggtctgccaacactttttttaagtacttcatatttcattttataagcaaaagctctttcacttggcaatatcttttctcgctgaagattgctgtcaaccattataatagttgcttcttcgtcagttaactgttttacatacgctttgagtgtttcaagcccgacaagctcacaggctcttttgcgccggtgaccgcttatcagttcgtatctgccgctgcctttttcacgaactatagccggattcataatgccattgtgctttacactttctgtgagctgtatcatatcatcgttatcaatgactgaaaacggatgtccttcaaagctgtctataagatctaagggtatctcatgtacactatcgttatctgacaccgaggaataaaaggaaagcccgttaagctttccttttgctttaatattggaaaaatcaaaagccattttatttgcaccttcctataaattcgtttgtaagatctgcatattgactgccgagctttgtatttatagtcattgctctttgttctgcggtactattgctcgccataacgctttttgatatacggctgttgaaaacgagattaccgtatctttcggtcaacgcttcatcaaccgcctttgccattcgtgtgttatcgttcattgtttcgataactccatacagtgtcaacgtaggattaagttcttttgcaagtgtcattatttcttcaaactgaacaatgccgttgagcgcaaatttttgtgtctgcaccggtatcaaaacgccgtctgcggctaccagtgcgtttactaccagtacgccgagcgatggcagacaatctatcaggatatagtcatacctgtcaaacactttgtgaagaagcaacctgcggagtatcatttcacgtcctattgctgtggcaaggaacatatccgctgttgaaagagttatgtcagatggaatgtaatcaacgttgtcggatttgctcgtcaggattgcctgttctatgacctcatctgaaagcttgcgtgacatttctgcggtaagcaggtcagttattactatttcttcattttcacctgaaaagcctagataatccgacagatttccctgaccgtcaagatcgatacatagtaccttcattccgtttcttgaaagatttgcagctatatttacaactgtagttgttttgccgacaccgcctttctgatttgcaactgcgataatttttgtttttctcatggtaaacctctttctgctgcataaagcagctgttaaatttaagcctttttaaattaaaaagcaacgggaaaggacggcaggcttacttttccgtcctacagtgtagctatcactgtccgttgcaaaagaaacgacataatcacaattcccatcataagcacgctttaaaacggtcttctacctcttgtcgttccttgagagctgccggaattgcaccggctttacactgttgctctcatacacaggctgcctgaacgacagcctatttaattgccgccaatggcgacaattaaaaatcatcccataaccatcgttatctgattgctgacttcttcagttgcttgcatctcctcagcaaattcagttgaaattaattgaacggttttactgtattctttcattacacggtcaaatgattcctgcagaagttttccgtctttatcatccaggctacgataattatctacgaaatgcttactgcggctatccggtatttcaaaaccgtatcttcgtaacatcagcatactgaaaatatcagcttcgatttctttctgttcaatcgacatcttattactgttagcagaaaaatgaagcaattcatgtccaacttcatggagcaatgtcgaaagccttccggtatcgtttaaaagcggattaagctctataatattgtcatttcttgcaagtccacgtattgtaaccgtttcctcgttcatatcctttacttcaatattgtgctgtttgcaaaaatccgttatatactcggcaaattgtttatgtatttcactttcttctccgaacccttcgctgataacggtcggatataactcaatcggtaaatttgtctgcgatatatcaaaaacacttcctatgccgaatccaagcctttggtagctttcaatgttaccctttttatattccaattgcatttgcttgtctgctttagacagctgaatccaatcaccgctctcgtttttcaaatatgtgattttttgcggtacaaaaattttaatggcttttgcgcctttttttattccgtaatacggcagctctccgttaggaagtttgtgttcttttgcaagctcatctgtaatttttttgatggcggcaaaagatccgacgaataatgcacctgggttttgagcgtaaatcagcatggtgttgcgtgtgctgtaattataaaaacgtgactgaaaatcaataaattcaagaattttttcaggatcttctttaaagttattgactatattctgtataatttttaaattttcttctttggtcaattctttctgttccagccaagctttcttatcataagttttcggcatttttcaactcctcctttattttctcacgccacttgtaaggtaatctgtcaatgcttatcatttcagatttatcggtaatcatcggattatctccgatgtcgccacacctcgcatcgcagaagcctataaatccgttttcacattcatagatcgcaagcccaccaaagtgcaatttgattgttgcgtttaaataaatgattgtatccatttttattcctttccgccatatttggcaaataaaaaatgcacagacaagctgtgcaatgagtttatatttaattgtcgccagtggcgacaattaattttaaataaatttgtatggtaaatctcgacaaaatatgatataattctatcacaaaatcactttcaaaaaaggagtgcttgctatatgaaacccaaaaatgtgactatttatgaagcatacaagatgtttataaatgaacaactttttcgtaacaatagtaaacgtactttgatttggtacaatgaaaacctatcagcattttttaattggttgggcgaaaataaaaacgttgatagtttgacggtcgaaaattataaatcgtactgtacttttcttcaacatgattatgttaagcgtaatggtcagccgttgaaaagcagcagtgtaaacagcagagtcagagcaataaaggctttttataattattgtattgaagaggatctacttcctgactttagcaaaaaattaaaagccaccaagataagaaaaactgaaaaacttccgcttgatgacgatgaaatacatacattggtcagtgcattcggtgattctgcacttgaagaacgcaatagatgttgggttatactaatgtgcgattcagggttgcgccgaggagaaattatcaatttgcaaatcggaaatgtacacctagcacgtggatttatgatagtaaccggtaaaggagataaacaacgttttgttccattaggagaactatcaaaaatttcattggcaacttacattcgcaaatatcggaatgaggctaaagaatcggagcctgtatttgtgaatcgctttggagaaaaatgtacgataaatacggttaaacaagtattccaaaagctgaagaagcaaactggaattttaagattacacgcacatctcctaagacatacatttgcgactaactatcttgttgacggaggagatttagaaactctccgtctgcttatggggcactcagacttgcaagttacgatgatgtatctacatctcgccgaaaacaaaaagcttttgcaacgcaaacatcagagccacttagatatgataatcaactcgtaaggcttttgtttttcttttaagcagggtgtcccgggttcgattcccgggtggctcaccaaacagtaataatccgaacactatccaaattgatggagtgttcggatttttgttttatctatgacttttctataaaacaaaacaggagcaaggcaaaatgctttgttcctgttttgatgaacacaatcttaacaacatttcatttcattcgtcgcttacagtatagcagtcatctctattttatttagatgtgaaaagaatttaattgaatcaatacctaatatttcattaagcaataaattgcgcaaagttatatttttaccacaaactcatcttttgcaattatagaaattgagtttaagatgatatcccccatataatcagcaaacttctccaaacttttaagaagttctttactggttacataatctccaactctgcttgttatttgtagggaagccttaacattttgcttaataaaatttccattcgcatcttttttcattatatcagtttctacatttcgttgaataacaatctcgtcttttatctcatttggtgaaataccgtgaataatattgtttctaaagtttgatgctttaatataattctcatctttgtgcgagttattaagaaaatcatataaggatggatttgttgttttcaacttatttaaaacttttttgacaaaaccaagaccttcttcaattccaaattcgtaaaactcattaataaaaaggtataatgtgtctcccatagattgtaccttgctgtaaaggtcttccataaaaaaacagtaccaatatcgaattaaataatgttcgtcattaaaatggggcatatattgaacagaacttccatttatacctggactaacaaaccattcatcatcgggtatgcccttgtcgaaatagtgtcttgccaatgcataagaaattttaatactttcaactttattattgtgagcttgaattaccgataggattttcgtaaacaccatttttgaattcatatcgtcagaacacttgataatattgctgtcaatcatcattttatcaaaaatatttgttgataaatacctgtcccattcttcgtctgtaggaatttcaaatgcatctgtaatatttttgctcatgataaatcaccttttcaaaaaaataataattatcgatatacttagtatttgcaatatcattttaatttaaacattcgacaatacgaaaatactgtttttttgtctatatacaagcactcattaaacatattatacctaagaaatatattttaccacttgtgtttacaatccttacattcgtattgtttgccaattttagaagatgcaagaccaacggtcgcaacagaaacagtcctattaagtgtcgaaatcttattaacgtttgtagaaccacatatcggacattttaatttgttattattacgagatgggtaagaaggcacagctttggttccgtaatgtgctatatttgatgcaacatctttgtatttttcctgcaccgccgcttttttcttttttatatatccatcccaatcattttgttgttccatccaatcatcgtaatctcttttgtagcaattatacattataccataatcaagatacgttatgaaagctgcaacaggaatacctatcactattaacacagctaataaaacagagaatatagctgtcgaaacaaagcaaaggaaaaacaaaattattccgacaatcaatgcccacgatagtaatgataaattaccattataataaaacatatgtttaaatttacttggcttaataggtttcggagaaggttttaactcatctattatttcaagttctcgattaagttcattttgtactttcttccattcttcctcttcttttttctgatagtacgctttttctttttctcgttcaaagtgtttttttattgcatatccacattctggacaatgttcagctgtatcagaaacgttcatttttccacagtcaggacaatttacaagagccataacaaatcctccgttaagctatattcataaatatgatttatatttattataccacaaaattcggtattttgcaacatatttcttattattttattatttaaatctataaaatgacaatttacatgtctaatatcaattagcgctacaataaatatgattttcaaaagcataaagcacccaccatttacatagggcaggtgcttttctgcttaactgactttgtttttcttccatccctcaaatgcctttttattttcctcattatcataaaattcacgaatacagggataaaaaatacgtctaagtgattcgtaaacagattgcggaaaggtcaaatctgcaagttcaatatgtgtttcaggcatagcaaagctcctttcggggaaacgcaaaaaactttactttgccacagtgaaaactgtaagcctgaaactttctggggcatagaagatttaccccttattatttatataacacataaaaatcgataacaatataccaaacagtaatcgtaataattattttccgatgtagtgatttaccgaagtgttagaacggtaatgattaagcaccgttaatgacacatatagcaccgctactctgtcgtattccaacgctctcccttgttgttctaacctttggcaattttcgcccctaacaatgtacagtttttctaaatcctcacgcagtttattaccgtttctttcaaagaaatttttgataaaagctttataatattctctgctttcggggttattctgcatatctgcaacaacactgtttttgcggtatcggaaaaaattttgcgacaaaacttgacatcggggcagatatagtataatatatagttataattatcagaaaagagaactgtatgaccaaaaaggaaagagcagagcttgttatagacgggcttgcagagtgctatccggatgtgaaatgcgctcttgtttataaaaagccgcatgagcttctgatagcgacaaggctttcggcacagtgtacagataagcgagtaaatatggttactcccgcacttttcgaaaaattccccgatattgacagctttgcggcggcagagcctgacgaggttgcggaatatatacattcgtgcggactatataagacaaaagctgtcgatattgttatgatgtgcagaatgctccgtgatgatttcggcggtgaaattcccgatacaattgaagagcttgtaaagttgcccggggtcggaagaaagacagctaatcttatagtaggcgacctctacggtaagcctgctcttgtatgcgatacacacgttataagagtgagcggaaggctgggtcttaccgacggaacaaaggatgcgctgaaggttgaaaaacagcttgccgcaataataaagccggatgacagattgatgatgtgtcacaggcttgtgtggcacggtcggcttgtgtgcagtgcggcaaaaccgaattgcagcgaatgcaggctgagcggtttttgcaagtttttttcggggacaaaataaaataacggcttggagtgagtattatgaaagggaaggtacgcaacgcaataataattgccgcaggcgtgcttatccttaccgtaatgctcactgttgttttatattactataacgacaaagtaatgcgtgataacgcatgggtgttctctgtgaatgaaacctcatacgatgaaagctcgtattcgtatgtgcaaaaaccggatcttaattcagcagatcttgaaacgctgatgcagataaaaggcgtcggacggaaaacggcacacgatattataaactatcgtgaaaagcacgggaaatttacatctatgtcacagcttaaagagataagctcggtagatgatgaagtatatatgatactgtgcagtcggtttacagttgcctcgtcgggatattacactaaaaacgagtcttacggcattcgcaaggtaaacctcaataaagctaccgtagacgagctgatgagcgttgagggaataacggaggaaatcgcaaagaatattatattgcgccgtaaagaccacggagattatacctctgtaagagagcttcttgataccgagggcataactataactctttacagcaaaatttccgataaactgacagtttgattttatattattttagtgagaaattgccaaaaaactattgattttattgcggtgatttggtatacttaattaataaagcataacgctttatatatttacaggaaatacaaggcgttacggaggtcattatggattataatatcaaagacgtatccggcagactgaaaagcacaagagagtaccttgatatatctgtcggcgaaatggcaaacaaaacaaacgtcaccacagacgaatatatttcacttgaaaacggagaaaaggatttttcgctttcattcctgaatcaggcggcggacgcacttggcatcgaacttatagagcttcttacaggtgttacgcctaagctcaatacatattcgatagtccgtaaggatcaaggcttgccgatcgaacgtcgggaaagatttgcctatcagcaccttgcctatctttttaaaaacaagaaaatagagccgttgctggtaactgctccttacgatgatgaggagcagaaaaagcctatacacctgtctgtacacgacggtcaggaaatggactatataatatctggaacgttgaagttccagataggcagccatattgaaacggtaagtgaaggcgactgcatttattacgacagcatgaatccgcacggaatgatagccgttgacggcaaggactgcaagttcttggcgatactgatctgataaacaaaggaacggaaagaaaagtatatggaacaggttaaaaattactacaagagatttgtaaaagaaggctttgatgagaacgggatactgaataagttcgagatagactgtcccgataactataacttcggttacgatattatagataagttcggagaaattgaccctgacaggagagcgcttattcacattgaccttcaggaaaaccgtcacgatttttcctattcacagctttcgaagctgtcaacgcaggcggcaaatctttttaagtcatacggtataaaaaaaggcgacaaggtaatgctggtactgaaaagaaactaccagttctggattgcgataatcgctcttatcaagctcggtgcggttgctatacccgcaacgcatctgctgacaacacacgactttacctatcgctttgaacgtgcaagcgtaaaagctatagtatgtaccggctataatcccgatatagccaagtatgtcgatgaggcgcaggaagaaatccacgctgacggtcttgttaaatttatagcaaacggtcacagggacggctggattccgttcgatgatgaaattgccggaatgcccgaaactatggagcgtgtgcagacagatacaagggagcatatgctgttatatttcacatcgggtactacaggctatcccaagatggttgtccataatcacagatatgcgctcgcacatattcagacggcggcacattggcagaatgtcgattctgacggtgttcatcttacaatatccgatacaggctggggaaaagccgcctggggcaagctgttcggtcagatgtcgctcggtgcatgcgtgttcgtgtatgattttgacaagttcataccgaccgatatgctgaggataatgcagaactataagataacctcattctgtgcgcctcctactatgttccgtttctttataaaggaaggacttgaaaactacgatctttcgagtcttaaatattccgctattgcaggcgaggcactcaaccctgaggtgtataacaagtggcttgagtttaccggccttaagctgatggaggctttcggtcagaccgaatcgacagcactgcttgcaaatcttgtaggcatgacgcctaagcccggctcaatgggcaagcctactccgctctatgatgtcgacattgtcgatgatgacggaaatccggtgcctgtcggagaagtcggtgaaatagttgtccgtgccgagcgtggcaaggatggcctttttgacggttattaccgtgacgatgagcttaccgctcaggcatggcacgacggactttatcatacaggtgataccgcttggaaggatgaggacggctacttctggtatgtcggaagaaatgatgatgttatcaaggcgagcggttaccgtataggacctttcgagatcgaaagcgttctgatagcacacccatctgtgcttgagtgtgccgttacgggtgcacccgaccctataagaggtcaggtggtaaaggcgacaatcgttcttgcaagaggatatgaaccgtccgatgagcttaaaaaagagcttcagacctacgttaagaagaacactgcgccttataaatatccgagaatagtggagttcgttgacgagcttcccaaaactatcagcggcaagataagaagggtacagattcgtaacgaggataacaagaaaaacagttaatgacagaattcgccgcaggtaatacttgcggcgatacttttagagggctttatggagtattacatctatctgttgcagatattcggcggcggtaacccgaaaattcacgaggtgataaaggcatacggtaatgcaagacttgcgtatgagcatatcagcagcggcgatatgtcgcatataccttctaaccgtcacgagtatgtccgcagagcgtcgctcgaacgctcgaaggtgataatggattattgcgccgggaataatatcggcattgtcacaattgacgacaggaattatcccgaacagcttaagaatatatataatccgcccgttctgctgtttactgcgggagatataaactgcctgcagggtaagctggcagtgtcgatagtaggccccagaaagccgtttggcaatgcgataaggcttgcggaaaacatatgctacaatcttgcgagaagcgacattgttcttgtaagcggctttgcactgggcatagacaggatagcgcacaacaacagcatccgtcaccacaagccgaccgtggctgtgcttgcctgcggaataactattgattatccgaataattcattcgggctgagaaagaacataatcgacaacggcggacttattctgtcggaacttctcccggatacgccgtgcaattccgattatttcaaattcagaaaccgtattatttcagggctttcaaagggtactgtcgtgataggcggctacaacggaagcggaagccttatcactgcaaaccacgcatttgagcaggacagagaggtattttttactatacctgacgatacgctggataagaaatacagccgtgttatcagatttctgcgtgacggggcgcattccgtttatgatttctatgatattatcaatgagttttatcctacttatcgtgacataatcgacgatacatatcttgataaggaacagctgacgagctttgtgatgcacgaggatgtcagggaaacgctgcctgctgaggatgagccgacggtttgcgaagcaaaggaaccggagccggcgaaaaaagatgagaagaagcctctccctaaggtgaaggcggcagacgcaccacgctttaaaattacaggtgtcaaggataaggaaaaggaaatagattatttccgagtaactcccgaaaatgtgctgaaaaagcggaaaaaagcgggaaagcctgctacactgaatgacacggcagtaaaagaaagaattcctataatagcgccgattgccgaaaccgataacacggatgtgagtgaggcagagccggtaacggatacggaagaaaagcagagcggacaaattgcggaagccgtagaaaacgcatcgggagccgcagaaattctcggcatcattgcaaacagtgacggagtaacgtttgatacgttgctttctgcctgcagcttatcatttggggaactcagcgagatactcgccgaccttgaaataagcggtgctgtatcctgcggtgcgggcggaatatacacggtaaagaaggagcggcaatgaatcgttcacagcttgacaaatacataaccgactattacggcgttagagccgaaagattgtttgaaaagaatcccggttttcaggtttatcgtcataatgatacgaaaaagtggttcgctatgataatggatttgcctgaaagcatactcgggcttgacgggcagaaaattatagatgtcgtcaatctcaagtgcgaccctatcctcatcggatcgctgaggctggagcagggcttttatcctgcgtatcatatgaataaggaaaactggataacggtcgcccttgatgaaagagtacccgatgaaaaactcaggatgcttgtcgatatgagttatgagctgacaaggaaaaagctcagaagaaaaaataagtaaagaataccgcctgtgaatgcgatgagcaaacacgggcggtaaatgttttatttactttctcataagtcttaatgaattgaagatagcgattatcgaaacgcctacatctgcgaaaacagccgcccacatattagcaagacctaaaacgccgagtacctgaattatcagctttacaccgagtgcaaatatgatattctggagaactatgcggtttgtttttttgctgattgcaaatgcgtcggcaagctgcattgggtcgtccttcataagaacgcagtctgcggtttctatggcactgtcagcgcctgtgccgcccattgcaacgcctatgtcggcagatgcgataaccggagcgtcatttatgccgtcgcctacaaacattaccttttcattgcccggaagctccgacttcatcttaagcgtaatttcgctcttgttttcggggagaagctctgcgtagtaatctgtgataccgagcttttcagccgccgcagccgccgcagacctgttgtcgcctgtgagcattacgaccttcacaccgtgatttttaagcatctttacggcttcagccgagtgttccttaggcatatctgcaatttcgataagacctgcatatttattatcaacagccacataaagcactgtgccgtttgcttcggggcagtttatgctgtagtcagccataagtctgctgttaccgcagagaacagtcgcaccggaaatcacagccttgatgcccttgccggctatctcactgcactcggtaatctgtgactggtcaatatccgcaccgtatgcctttcttaccgaaacggctatagggtggttggagttgctctcggcataagccgcatatcgtaacagttcatccttgctcattcctgcaggctctgtccttgtaacctcaaactgaccttttgtaagcgtgcctgtcttatcgaacagtacgaccttagcctttgagattgcttcaagatagttactgcctttaaccagtataccctttgacgaagccttgccgatacctgcaaagtatccgagcggaacagaaatgacaagcgcacaaggacaggagattacaaggaagataagacctctttgtacccacgttacgaaatcaaagccggtgaacaggggagggataagcgatattataaccgccgcaagtacgactatgggggtgtagtattttgcaaataccgagatgaagttctccgtctttgtctttttctcgacagcggattcgaccatctgaagcattttgtataccgtgctgtcggtgaaccggcgtgttgttttaagtgtgataacacctgaaatgttgatggcgcctgcggggacttcatcaccgaccgttatatctctcggtaagctctcgcctgtgagggctgatgtatctattgatgtgttaccgctttcgacaatgccgtcaagcggtatcttttcgcccggctttactcttattatactgcctgtttcaacgttttcgggatcgactgttatatattcgccgtcaatcagaacatcggctgtttccggctttgtcttgatgagagaagatatgcttcttcttgacttgttcacggctatcgactggaagaattcgccgacagtgtagaagagcataacggcgaccgcttcttcgtattctccgagtacgatagcgccgatgcttgcgataagcataagcgtgttttcgttgaagaaattcttctttgctattgcttttattgaagtgatagctacttcaagtccgcagataacgtaagccgcaagatacatcgtaagtatcgctatcttaggcacaagctgctctgtaccgatagttttttcaaggataaaagcaactatgaacagaatgcctgcgcttatcatcttgactatatctttagtatagcttacctttttctcaacgtggttttccttttcactgaccgttacatccggttcaacggcagttaccgttgctgttacctgctttagcagctctttgtctgagattatttttgacggtgttacggtaagctcctttttgatgaaattcatctttgcactgttcgcataatccgacttttcaattgcctctcttacttcttccgcacactgtgcgcagtcaaggccgtctattatatatttcttttctttaaaagtctgtctttccctgacggttacatcgggttcgtacttagcgacaacttcggtgaccgttgtcataagctcatcgggcgaacacgaattttccgcttcaacggtaagctcctgcttcataaagttcatttctgctgattttatatgttcgtccttttcgacttccgcacgaatctcctctgcacagttagcgcagtcaagaccttctaaaatatagattcttttcataagctaccacctttgatatggttgaagttttgaacaattgagtaactgttcaaatgtattgtccgaaaaaacaggagatgctatctcctttgattttcccgttttactccataatatgctcaagcgcattgctgaacaccgtgtttacatggttgtcgctgagcatatagtaaacgactttgccttgcttttcactgcgtacaagctctgcttgccgtaatactctcagctggtgagagattgccgatgctgtcattccgagcagggcggcgaggtcgcacacgcacatttttgagcgtgacagcgagtagaggattttaatccttgttagatcggaagagcacacgtctgaactccagtcactccgcgaaatctcgtatgccgcgtaccgaattcgtcaacctccttgtgcgaaagggtgttgatatgatgataaagctcacgtcttagctctgtgccgaagccctgcgacgcaaccgatgccacatactgacatataagcgcaaatccaagaccgcatacaccaagcagaacaagcactccgcccatcttccagatataaccgctgtctttgtttgcaatgccgacgtctattatctttgccataaccagaggaacgataagctcgaataccgcctcggtcagcttgaaaataggtccgagtattacgttttttctgtattttttaagatacttaaccagttttagcatatttcaccgtccaataataatgacatcggagcaaaatccgatgccattacgaatatttaattattatcagccaagaactttcttgatttcttcgggaagtgaggcagcgaagctgtcgcctaccaacaggctgatctcgtcaacgctcgttgttatgagcattacatcggcacatatgttttcgcaagcctggaataccttagccgcaaaacctgcctgatcaatcatttcctcactcttgataactatctttacattaccgctgtttacacagggtgttattccgtgcaccgcagttattctgggtaaaacggtaagcagtgttggtatatcatcatcgctgaacgtaaagccgaatgagaacatatccgacttaggaggtgtctgcgagatcatatctacattgataccgctttcggctaccgctgaaagcgtagttgaaacaaaacgctttcttgacggaacatctgaaaatgttacgattgatatgttttcgtatactttaatatctgtcatattgacctccgttatgcttcggaaagaagatccgacatctgataaagacctttttcacagccgcttaagaatactgccgcattgacagagccgactgcgaatacctgttttgagcctgcgctgtgagaaagagttatcacttcatcacgtcccgcaaatataacatcatgctcgcctactatcgtaccgcctcttatcgagtgcataccgatttcggttttctcacggggctttctcacgctgtggcggtcatatacatagtgcatcttgttgccaagctcttcgtttatcgcttccgctatcattattgccgttcccgaaggagcgtccttcttgagattgtggtgcttttcaactatctcaatatcaaactgatcgccgagtacctttgttgcacgctttgcaagatcaacaagaagatttattccgagcgacatattgaatgtgaagaacacgggaatctgacccgccgctgtctttatctgctttatctgttcatctgtgtagcctgtcgttgcaataactacgggaacattgtttatcttgcagtagtcgagcagctcgtcaagcagtgaggggtgcgaaaagtcgattataacatcgggcttttccggcagatcgaataacttcttgtaaacggggaagcctgcgtactgttcacctgctatatcaatgccggctgttatttcgcagtcatctctcgtattgacaatgtcatttattactctgcccattttgccgcaggcacctgtaattacaattctcgtcatattaacgtcctttttctgaatttactttgtaagaccgagcttttccatagatgaaaacagcttagctatctttgcgtcttccattcttataagcggaagtctgcactcgccaacattcttgcccattatgttaagtgcttccttaacgggaatggggttgacatctatgaacagatcgtttgtaaattcaaggagccttagctgtaactcagccgctttcttataatcgccttcaagacagtagcttgctatctcgtgcgtttcggcaggaagacagtttgcaagtaccgagataacacccttaccgccgagcgacattataggtactatctggtcgtcgttacccgaataaatgtcaaggtcggtttcagccgctatcttggctactgcgcttatgtttccgcttgcttcctttgcggcaactatgttgtccttctttgcaagctccttgtacgtttcaacagaaatgttcacacctgtacggctgggaacgttgtagaggattatcggcaggcttacgctgtccgctattgcactgaagtgtgcgacaagtcctctctgcgaagtcttgttataataaggtgtcacaaggagcagtgcgtcagcaccgagtgcctcggcttcttttgaaagctgaatggcataagcggtatcgttactgcctgcacctgctatgacgggaactctctttgctaccttttcaacgcagaagcggatacattccttatgctcctcgtctgtcatagccgcagattcgcctgttgtgccgcacacgactatagcgtccgttccgccggcaatctgctcatctatacgatctgcaaaattatcgtagttgatgcttccgtcctcgttcataggggtcactatagctactgcagagcctgtaaaaattgtctttttcatcggatacctccgtgttcaatgaatcaaaatcagtcgaaataaccctttgcggcataaagctcagccatttcaactgcgccgcctgcggcacctcttaatgtgttgtgagacaggcagacaaacttgtagtcgtactgtgtgtcttctcttaatctgccgattgaaactgccataccgccttcaaggtttctgtgcagcttagcctgaggcatattgtcttcttcaaagtagtgaaggaactgcttgggagcggagggaagatcaagctcctgcggtgcgcccttgtattccttccagatattgaggatttcttcctttgagggcttgttctcgaagctaacaaatactgcggcaaagtgaccgtttgatacgggaactctgaggcactgtgttgtgattgcgggagcggcagcctttacaatcttgtcgccctcaatcttgccccataccttcagaggctcctgctcactcttttcttcctcaccgccgatataggggataaggttatctaccatttcaggccatgtttcgaatgttttgccggcacctgaaattgcctgatatgtgcaggcgagaacctttgtgatgccgaacttgcgtaaggggttgagagcgggaacgtagctctggatagagcagtttgacttaactgatatgaaacctctctttgtgccaagacgcttcttctgagcttcaacgatagccatatgctcgtcgttgatttcggggataatcataggaacatcgtctgtgaaacggttagctgagttgttggacataacggggcattcgtgctttgcataagcctcttcaagagcctttatctcgtccttcttcatatctaccgcacagaatacgaagtcaacctgtgatgcgatcttttcaatatcggcagtagcatccataataacaatgtcttccatagccttgggcataggcttttcgatgagccatcttgagccgacagcctctttataagtctttcctgcggaacggggagatgcggcaagcacctttacgttgaaccaggggtgattttccagcagaacggcaaaacgctgtcctaccatacccgtagcaccgataatacctacgttgtagtttttcattttagtttccatccttcttttttgcttttagcatattttcttaaaaaagccgcttgtaaaaatgattacaggcggctttgtatgcagatgtgataaagttgtgtgatagctctccacctacagcttaaccgcttgatgacaatcgtgcatatattagacacacgaccagatacataagctccgacacttatgttcttcggcgacaaagccttttcccgctgcaatctgtcggcagattgacgcaacgggtacttttctttaatcgcacctctacctgctttgtttatattatcatatttattgctgtttgtcaatggcgaagcggtaaaaaataatttgattttttttcgtaaatgtgttattataaaacagtatgcaacatccagaaagaaaaaatgcgtgaaaaacgcaaaaaacagaggaaaaacaatgcttaaatcggatttttattatgacttgccgcaggagcttatcgcacagactccgcttgagccccgtgacagctcacggcttatgaaaattgaccgcaaaagcggcgaaataacacatgaccgcttctataatatatgcgattatcttgaaaagggtgacctgctcgttctcaatgactcaaaggttttccctgcaagactttatggcgtaaagcaggaaacgggtgcggcagtgcagttcctgcttcttcaccagatttcacataaccgctgggaggttatggtgaagcccggcaaaagacttaaaatcggtacaaaggttgacttttcgggcattctgacggccgagatagtcgactatgccgagggcggcgacaggatagccgagttcacctatgacggcgacagcatatttgaagtgcttgaccgtataggtcagatgcctctccctccttatatcaccgaaaagctgaaggataaggacagatacaacaccatctattctcacgaggtaggctcagccgccgctcctactgcgggacttcacttcaccgaaaacgtgtttgcaaagctccgtgaaaaaggcgttgacactgcgtttgtgacactccacgtcggacttggtacattccgtcctgtaaaagaggacaatatactcgatcataagatgcacgttgagcattactccataccgcaggaaaccgccgataagataaaggcctgcagagagcgtggcggacgtgtcatttcagtcggcaccacaagctgtcgtacacttgaatctgccgcatcgcttgacccgaagggcgagatcaaagcctgctcgcacgatacgggaatatttatatatcccggctatgagtttaaagcaatagacggacttattacgaatttccaccttcccgaaagtacgcttataatgcttgtaagcgcattcttaggcagggaaaagacgctgaacgcctataatgaagctataaaggaaaaataccgtttcttcagcttcggcgacagtatgataataatatgatgaacatcgttaaagtaagcctgcccgaaaagtgcaggataatttgcgtcagtgatatacacgcacattatgatgagtttgcaaggcttttgcgtaagtgcgactacaataatgaaagcgactatctgttcattctcggtgatattctggaaaagggcaggcaaaatatcgaaacactgcactttatacaaaaattatcccgcgacaaaaaatgcgtatgtatcaagggtaacaacgatacgatggtatcgtgtatggcgtttgacgatgaaaaggaaaagtttctcgaaaggcttacataccgccctgtaaacgcttatatgcaaatggcggagagcatcggtattaccgatttaacgacagattttgataacaagcgtaatgctgtcaaccaaaaattcgctaaagaactgtcgttcgtttcggggcttccgacggctatagaaaccgaaaaacacattttcgttcacgcaggtatagaaaaccgcacggactgggaaaacagctcagagcagtttgtcctgtgcgcaccgtggtggataagaagcggtcacgctcttgataaatatgttgtcgtgggtcacttcccgacctataattttgcaagaggaaaaaacaccaatctgccgataatcgacacggataaaaggataatagcggttgacggcggctgttcggtaaaatcggcaggacagataaatgcttttataataactaaggacggagaaagctacagctatgacaacgtatttgagccgtccgagccgtgtgaaaaatgtacggtcatcaaggattatacagccgctcggcattattcttatcttgattatgaaaagagcgaccttgaaatactcggcaagtcagacggactggtgtcggtgcgtgataagcacagcggcaacagcggacttatacttgaaaactatatcgcccaatggggtgacggacattatcacggctggactaatcttgatgcgtttgtttgcgttaataaaggcgaaacattctgcgtttattataagaatgaaaaatactgctatggcatagcacaaagcggagaggtaggaatgataccgcttgactgcgttgccgtatttaaggagaaatatgtttaaagtattaaaaacagacggtgtagcaagacgaggagaattccacacacctcacggtgtgatacaatcgccgttttttatgaatgtcggcacatctgcggcaatcaagggcggtatatcatcgcttgacctcaaagacctcaagtgtcaggtggagctttgcaacacctatcatcttcacgttcgtccgggagatgatataatatataaaatgggcggacttcacaagtttatgaactgggatagaccgatacttaccgacagcggcggatttcaggtgttctcgcttgcgaaactcagaaagataaaggaagagggagtatatttcaactcccacgttgacggcagacgtatttttatgggacccgaagaaagtatgaggatacagtcgcatcttgcctcaacgatagctatggcatttgacgaatgtatagaaaatccctcgccgtacgattatgtaaagaagtctgttgacagaacgacaagatggctgcagcgctgtattgacgaaatggcaaggctcaattctctgcccgaaacgataaaccgtcagcagatgctgtttgcaataaatcagggcggaacttatgacgatataagagccgagcatatgaaaacaatagcgaatatgaacgttgacggcgtggctatcggcggacttgctgtaggcgagcctaccgatgttatgtacaggataatagaaaccgttatcccgcacgctccgacagacaagccccgttatcttatgggtgtcggtactccgtcaaatataatagaagccgtttacagaggcgttgatatgttcgactgcgttatgccgagcagaaatgcacgtcacgctactgttttcacatggaacggcatcactcacgtcacgaatcagtgctttgaaactgattcactgccgatagaccccgaatgcgactgtcctacctgccgcaatttctcaagagcgtatataagacatctgtttaaatcgggagagatgcttggcggaaggcttgccgtacagcataatctatatttttacaatacgcttatggaaaagataagagcggcgatagacgagggaacattcgaggaattcagaaatcactattcaccgcttttagcgtcaaaacttgtctgattttctttgaattatcacataagggtgatataataacaaactatgatttaaagcgaaaaggagagcgtatgaagcttataaatataggctacggcaacaccgttaattccgacagggtagttgcggcggtcagtgccgatgccgcaccggtaaagcgtatcatatcggcggcaaaggataacaacacagccatagatgcgacctgcggcaagaaaaccaaaaccgttataataaccgacagcaaccatgtagttctgtcggcacttgatatatcgcatttcacaggcataaccgcaggtgaagaggtaaatgaataacagggggaagaacagtatgaacaaaggattgcctatagtaatttccgcaccgtccggctgcggtaaggatacgatacttgaacagctttacaagaaaaactcgaatctcacacagtcggtttccgctaccacaagagcaatgcgtgagggcgaaattgacggagtaagctatcacttcacgactactgacgcatttgaaaagatgatagcaaacggtgaagtgcttgaatacacgcagtattgcggcaactattacggtacgcctaagaaagccgttacggatatgcttgaacagggcagggacgtaatactcaagattgaggtcgagggtgcgatgaatataaagaagatattccccgaatgcgtgcttatattcatacttccgccttcaatgagcgagcttgaaagaaggctcagaaaaagaggcaccgaaacggaagaaactatcgccgccagaatagcacaggcgagaaacgagcttcagtttgcagacaagtttgattatcttgtagtaaacggcgagcttgaaaaggcagtagatgatgtgaataccgttatccttgcggaaaagatgaacacaaagcgttcactttcgttacttgaggaaatcaagaagtcataatgagcggccgctatgataaggctatcgtatcggtagtagtcgataaggcgctttacagctttgataacgagtttgattattatcttccgcagggagttaaggcaagcgtaggtcagcgtgttatcgtgccgttcggcaaaggcggtaagaagcgtgtcggccttgtgaccggctttaagcagaatgcggattacggacggctcaaggatatatactgcgttataaatgacggagtgatactgggtgacgaggctttgcgtcttatgcactggctgaaggacaataccttctgtacttattttgacgcagtaaagactatcctgcccggaggtatggctctgaatgtatctcagagatatgccataagcgatgagttcagaaaagctccggacagctttgctcttgaacctgcagagcaggcggtatcggctatgctcctcggctgtaaaagcgacagagagcttaacgatatgatcgaatacggctttgacgaacagcagaaaaagctgattgggcgtctttcggaaaaaagcgtacttgtttcgcttgatattataaagcagaaagtaggcagtgaaaccgaaaaaaacgtcaggctgacagatagctatctcagcggcgagtatgccgacaaaggcggaaagccccttaccgcaaagcagaaaaaggtagccgattttctgacggatgccgattctgcatcggtaaaggaagtatgctataattgcgttgtaacatccgccgttataaacaatatggagaaaaacggcattgtagaatgctttgacaatgaagtttcacgctctcttaccgcaggagcaaaggcggtaaggagcattgacgatatagtgctgtccgatgaacagtccgccgtatacagcggaatgtccgagcttatggacagcggcaagccacagtgtgccttactgaaaggcgttacgggaagcggcaagaccaccgttttcttaaagcttatcgacaaggcgttaaaacaagggaaaacagctcttatgcttgttcccgaaatatcgctcactccccagatggtgagaaattttaccgatcttttcggaagtaacgttgcggtaatacacagcaacctttcgctcggtcagaggacagatgagtacaagcgtatcgaaaaaggcgaggcgaggatagtcataggtacaagaagtgctgtatttgcgccgcttgacaacatcggtataatcgttattgacgaagagggcgagcatacctataaatccgaaaaatctccacgttatcaggcaaggagcatagcaaagcagagatgcttttatcataatgccacgcttcttttagcgtccgcaactccgagccttgaaagcgcatactttgcgtcaatcggcagatacaagctgtttgagatgaaaaagcgttacagccagccggtacttcccgatgtgtatcttgtcgatatgaaggtcgaggtcgaaaccggcaaccgttccaatttcagcagggcgcttgccgatgagataaagaataatctgcaaagaggagagcagacgatacttctgctcaaccgcagaggttacaacacctatatgaactgcataaagtgcggcgaggtgtataaatgccccaactgcaatattcctcttacatatcataagacgaacaattgtatgatatgtcactattgcggctataccgaggtattcacaggaaaatgcaaatcgtgcggctcgaagttcatatacagcacaggtacgggaacacagcgtatagaagatgaaatatcgacattgtttccgtccgccagagtattgcgtatggacgcagataccacgatgagcaagttttcctacgaaaagaatttcgataaattcaagaacggcgagtatgatattatggtcggcactcagatgatagcaaaagggcttgattttgagaacgtgacgcttgtcggcgtactgctgatagataaatcgttatacgcaggcgattatctcggttacgaaaagacgttttcgcttataacacaggtggtcggaagatgcggcagaggctcgaaaaaaggcagagcgtatctgcagaccttttctcccgaacattatgttcttaatcttgcggctgaccagaattacgatgagtttttcagacaggaatgcgagataagaaaagcactgctgtttccgccgtactgcgatatatgcgaaatagggctttcatcggttgatgaatcggcctgcaaaaaaggctcggacagcttcgtaaagctgtttatgaaaaatcttgagggtcacggtatccctataagagtgcttggaccgtctgcctgctcggtggcaaaggtaaacggcaagtatcgctacaggattatcataaaatgcaggaacaacaaagaattcagatcggttatgaaggctacactgcttgacgcatataaatcaccggcacttgataaagtcagtttcttcgctgatatgaacggcgagattatataaacaaaagaaaggatttttgaaatggcaaagagaataatagctaaggacggcgacgaatcgctgagaaaaagatgtaaggacgttactgtatttgacgataagctgtggacgatgcttgacgatatgtacgaaacaatgcaggaggcaaacggcgtaggccttgccgcacctcagataagcgtactgaggagagttgtggtcatagacgtaggcgacgaacacggaaaaatcgagcttataaaccctgttatcacttctatgaaaggcaaacagcacgagcttgagggctgtctttcagtgccgggtatgtggggatatgttgacagacccgcaaaggtaaaggtaaaggcacaggacagatacggcaaagaatttgatattgagggtacagagcttttagcgatagctctgtgtcacgaaatcgaccatctgagcggtattctgtttaccgataaggcagacgaactgcttacgtccgaacagcttgaggaacgtaaaaagtaagggggaaatcatttgaacatagtatttatgggtactccggatttcgccgtatcggcactggaggagttacacaagcatcataatgttatggctgtattcacacagcccgacaagcctaagaacagaggaaagaagatgcaggcacctcccgtaaaggagtgcgccgaaaagtacggtatccccgtatatcagcctctgtcgctcagaaagggcgaggatgctgagaagtcgcttgagcttcttaaacagcttgctccggactgcattgttgtggcggcttacggtcagattcttcccgaaagcatacttgagcttccgaagtacaagtgcatcaatatacacgcttcgcttctgccgaaatacagaggtgccgcacctatccagaagtgcatcatagacggcgaaacagaaagcggagtcacaacaatgcttatggcaaagggacttgatacgggcgatatgctgatgagcaggtcggttaagattactcccgatatgaccggcggagagcttcacgacagccttgcggctacaggcggagagcttataatcgaaacgctgaaggcctgtgaggagggtacgataaagcctgtacctcaggacggcagcctttcgtgctacgcaggtctcatcacgaaagaaatgtgcaggatagacttctcaaaaaatgcaattgatgtatataatttcataagaggtatgtcaccgtcgccctgcgcctatacttttataggagataaaagattaaaggtttactttgcggttatgacggatattacctccgacaagccgtgcggaactgtcatgaacgaaaacgacctcaccgtagtatgcggcgacaagaaatgtataagatttaccgatgttcagggagagggcggaaagcgtatgaataccgcaagctttctgaacggcaacaagctacagcgtgacactgtgttgaactgatagcgtcaaacggaaaggagaacggatatggaatttatactttatttactgctgatagcagcctttatcttttctatttttacctcgatcaatgtaaaaggtactttcagaaaatacaacaagatgccaagctcaagaggaatgtctgccgcagatatagcaagacagattcttgacagcaacggactttataatgttcaggtaacaagagtatccggagagcttaccgaccattacgaccccagaacaaacacagttgcactttcggctcccgtttatgacagtgtatctgttggagctatcggagttgcggctcacgaggtcggtcatgcgatacagtatgccgaaaactacacgcctataaggataagaatggcaattcttcccgttgcacagttcggctcatcggcgtggatactgttcttcatactcggtattgtgtttaatatgccgatactcagaggcataggcatcggactttttgcggcaatagtgctgtttcagctgataacgcttcccgttgagttcaacgcaagccacagagcgcttgccacaataaagaaccaaggcatactgttcggtgcggagtatacaggcgcaaagaaaacgctcacagccgcagcaatgacttatgtagcgtcgcttgcagtggctttattacagcttttaagacttatcgcaagctcaagaagagattgatttggagagatgaatgaaaaccgcaagacagataacgctcgaccttcttatccgtatggatacgcagggggcatactcaaatataatacttgaccacgcattcacgcaaaatgatgcggacaggcgtgacaaagccttctcggcggcccttttctacggcgtacttgaacgcagaatgacacttgactatcttatacgctattattcgggaatcgaattcgataagataaagacagcggtcgttgagatactcagaatgggcttctatcagcttctgttcatgaattccgtgccggacagcgctgcggtgaacgaatcggtggcactttgcgattactgcaacagtacaaaggcaaaaggctatgttaatgctatcctcagaacttttctgcgtaatgaaaaacagatagattacggtaatcttacaggcgaagcaaagctctctatcgaatattcctgcccgaaatggcttgtgaagaagtggaacagcgagcttggcgagcaaagagcaatgcagatgataaactcctgcttcggcagaccgccgatatatgcaagagtaaataccgtcagatacgctgttgacgatgttataggcgaacttgagtccgaaggaatatccgcagcaaagaacagccttatagatgcctgcatagagcttgccaacaccaaagggatagagcaaagctccgcatataaaaagggtatgtttcatattcaggatatttcgtcgcagatatgctgtaaaattgccgctcctatgtttaacgaaacggttgttgacctttgcagtgcgcccggcggcaaaacgttcacctgtgccgaaattatgaacgacaggggcagaatatacagctacgatttgtatgacggaaaagtttccgttattgcgaatacggctaaacggctcggtcttaccattataacagccgcagaaaacgatgcgacaaaattcaaccccgatataccgaaagctgacagagtggtatgtgatgtaccgtgttcgggactcggcgttatcagaagaaagcccgaaataaagtacaagcctatgaaacagcttgaaaccctccccgatacacagaggaagataataaacaacgccgctgaatatgtaaaaccgggcggaactcttgtctattcgacctgcactgtaagcaggacggaaaatgacgatatagttgatgagtttttaaaagagcacagcgactttgtgccggtagttgttcctcttaacatcaaaggtcttgaggacggctacaagagaacaatgcttccttgtgatgtgaacggcgacggtttcttcacggcaacactcagaaaggtgaaataatacatataaatggaaaaaacagatattctttcgctgtcgaaagaggagctggaagaaaagattctggctatgggcgagaaaaaattcagagccggacagatatacgattggttacatattaataaagtagaagaatttagcaaaatgaccaatctatctgcacaactcagagaaaaactcgacgatattttttggataaactcactaaaaattcaaaaaaggcttgtatctgacatagataatacggtaaaatatctttatggtttatctgacggagaaaaagtcgaaaccgtacttatggaatacaagcacggcaacagcatctgtatatcaactcaggtcggttgcaaaatgggatgtaaattctgcgcatcgaccaaagcgggattcgtaaggaatcttgagccgagcgagatgctgctgcagatatacgaaagtgaacgtgacagcggacgaaagataaatcacgttgtacttatgggaataggcgagccgctggataattttgataatgttgtaaagtttctcagacttttatcggcaaaggacgatatgagcctgcgacacgtttcggtatcgacctgcggacttgtgaacaggatatatgagctggctgaccttaaactcggcatcacgctctctgtttctctccatgcgccgacaaacgagctgagaagctctataatgcccataaatgacagattccgcatagaagagctgatggaggcgtgcaagtattatttcaataccacgggcagaagaatcagctatgaatttgcgctgattgacggagtaaacgacaacagacaatccgcagacgcacttcttaagctgctgaagggtcagaactgtcacgtcaatcttattccggtcaatgagataaaggaaggcgtatttaaacgcagtgcttctgttgaaaagtataaacaaatgcttatagacggcggacttaacgctacggtcagaagaacgctcggtgcggacatcagcgccgcatgcggtcagttaagacgtgataataagtaagaaatcaagggagaaccattatatatgaaggcttacgcaaagaccgatataggtaattgccgtgaagaaaatcaggacagctactggataggtgagcttggagatgacgctatagcgattattctgtgcgacggaatgggcggacagaatgccggcggatgtgccagcacaactactgttgattttataaaggacagactgataaaaggcttcagacacgatataaccagaaatcagataagaaatttattgataacatcggtaaccgccgcaaacagtgttgtttatgatatggcaaacgcaaaccccgaaaaagcgggaatgggtactacctgtgtggcaggcattattttcaatgaaagagcctatcttataaatgtcggagacagcagatgttatttcttctttgacgacaatatgcagcaggtgacaaaggatcatacatatataagaaagctgattgaaaagggaataataacatacgaggagagcaagactcaccccgacaggaacaggataacaaaagctgtcggagcacagccttttatcacgcccgattatttcgagcttgatgtaaagaagggcgatatgcttcttttctgctcagacggactaagctcctatgcggaggacgctcagatagcggaggttatagcaggtgcgcctacggcaaaatgctgtgatcagcttgtagattatgtcaacaaacacggcggacgggataatgtgaccgttgctgtggtatcaatataaattccggcttaccgtatgagtcggaggtataatacagtacggagaaacggtggattttatggataacaatacagacaacatgataggcagacgccttgacggccgttacgagcttcttgagcttataggaacgggcggaatggctgacatctacaaggcaaaggatattactgaggacagaatagttgccgtaaaaattcttaagaatgaatttgccggcagtgaggattttctcagaagattccgcaatgagtcaaaggcaatagcactgctttcgcatccgaacattgtaaagatatacgatgtcggcttcaacgagcagattcagtatatcgtaatggaatacatagacggcatctctcttgccgaatatatcaagctgcagggcgttctgaaatggaaggacgctgtatatttcactatccagattttaagagcattacagcacgcacacgacagaggaattgtccacagggatataaagtcgcagaacgtaatgatgctccccgacggcacaatcaaggtcatggatttcggcattgcccgttttaaccgtgaaacagataaaactctttccgaaaaggctatcggttcggttcactatatcagtcctgagcaggcaagaggcgaaatgaccgatgaaaagagcgatatatattctgtcggcgttatgctttatgagatgctgacaggacagaaaccgtttgacggagaaacaccagttgcgattgcgctccagcatatgcagactccgccgaaacctctgcgtgagatcaattcttcaattcccgaaggtcttgaggagattacgctcaaggctatgcagaaagagccttcgatgcgttatcagaccgctggcgagatgataaacgatattgaagaattcaagtctatcaaaaaaaacagaagtattcccagtaaaatgttgagtatgttcaaaagtgcctccttattctaagcgtgggcaattacatattcccttgccgtgttttcactgtccagtatattgccgagcgttacctctttatgctcccttacattttcacaagcgtcggcaacaagctctcctatgcggtaaaacggtatcttatcctcaaggaaaagtccgacagccgcctcgtttgcgctgtcaagcacagtacaggctgtaccgccccttgctatcatcttttttgcgtatttaagacacaggaacgtttcctcgtccactttttcaaacgtcatagtgccgacatcaaaaagcgatagcctttttgccggtgacggtaacctttcgggataggtcagcgcaaactgtatcggtattctcatatcgggtacgcccatctgacctatgaccgaaccgtcctcaaactcgaccgcagagtgcaaaatgctctgtctgtgaacatttacctccactttttcaggagtaactccgaacagccacaccgcctctataagttcaagtcccttgttcataagcgttgcgctgtctgttgttatcttctgtcccatgttccagttagggtgcttcagcgcctgtgcctttgttactgttttcagcttttcatagctgtatccgaaaaacggaccgcccgatgccgtaagcagtatacgctcgatactgcttcctccgcttgccataagcgactggaatatagcggaatgctcgctgtctatcggcagtatcggcaggtttttctccttcgcctttttcattacaagttcgccgcccgtaacaagcgtttccttgttagcaagcgccaccttgttgcctgcgtcaagcgccgcaagagtaggacgaagtccaaccatacctacgaccgaattcacaacagcgtccgttttcagtgatgacacctcacacagcccatccattccgcacagcacctttatatctgtatcggaaagccgctgcttcatatcgctgtaacggttttcatcatatatgcagacagcttccggcataaattcacgagcctgcttttcaagaagttcggtgttttttgcggcacaaagtgcaatcggtttaatgccgtgcatacggcatacgtcaagcgtctgtgtgcctatcgagcctgtactgccgagcagggctatattctttataatactcaattgttacctctttatgacaaataatgccgaagagtattccgcttcggcattgtaatatgattatacgattatgctattggggttatggggaagtatatctggaacatcatatatgcaaacggtgcggcaagcagaacactgtcgaaacggtcaagaataccgccgtgtccgggtaatatattgccgaaatcctttacagaacattcacgctttacaagtgacgcagaaagatctccgactacgccgagtcccgatataacaagcgccataacagtgagatacacccagttcacgctgaatgtatgcactccgccgtttattatgctgtcgataagctcatacgcaaagctcattataaccgcaaaaacgcccgatgttattatacctccgacaaagccctcccacgttttcttggggcttatcgcaggacacatcttatgcttgccgaaaaacgttccgacaaaatacgcaccggcatctcccacccatgcgctcaccatagtataaactataaggaacatagcgtgatccgggaatcttgagcgtataaatgctatcgagcagagcgcaagaggtatcgtaatcgatacaaacgcaacaagtgcgacctgctcaaatcgagccttctcgtgattgaacagcatcccaagtagcattattacaacaaagccgaagtaaatcagctttacgttgttcctgagcggttctatccagaaaataataggtgttacagccgcaaatataaggcttacggctgatgtgaacttattcttcagatatttggtcgtaactaacatttcatataccgctatgacagaaaaagccgtcatagcaacatagtaaagtacctcgttgttaagtgctattattaaaataccgatcggtatcgctaccagtgcggtcactattctggttaccatcttgtagttcttttcctttcagaaacgcattacagtccgccgaatcttctgtttctccttgcgtactcgtcgcaagccgcaataagatccttctttgaaaaatccggccacagaacatccataaacaaaagctccgcataagctccctgccagataaggaagtttgaggttctctgctctccgctcggtcttataataagatcgacaggaggaatgcccttagtataaagataattgtcaaaatcgtcttccgtaaagccgtcaagatcgaccttaccctctttataatcccttgcaagacgttttgccgcagtcagtatctcatccttaccgccgtaattgagcgctacaagaacatacagaccgtcattattctttgatatttcttcaatctcgacaagccttgcctgtatatcatcatcaaacgcagacttatccccgagaaaaattatccttgtattcttctgagccatactgcgtatatcgtcaagatattttacaagcagcttcattatggcgtcaacttcatccttcggacgtttccagttttccgttgaaaacgcatagaatgtgcaatattttattccgatgtcacggcaatcctcaacagtgcgcctgaataccttcgcaccctgtgaatgacccgcctttctcggaagtcctctttttttcgcccacctgccgtttccgtccatgataaatccgacatggagcggaacacaggtcaaagcgtccttatttaaatcagccaatttgattaccggcaattaaactgtcatgatttctttttcttttgcactgcaggcagcgtccatttcatcacagtatttatctgtgagcttctgaacatccttctcgcagttcttaagatcgtcctcggttatttcgttgttcttcttcatagccttgaacttttccatagcgtcacggcgaacattacggacagctaccttaccttcctcggcgatcttctttacctgcttgcaaagctcttttcttctctcctctgtaagctgggggaaggttatgcgtatagccttaccgtcgtttgtgggagtaattccgatgtcgcttgcaagtatagccttttcgatagacttgagagttgaagcgtcccagggagtgataacaagcactcttgcctctgaaacggcaacagccgccatagcgtttatctgcgtgggaacaccgtagtagtcaacggtcaccttatccagcactgcgggatttgctctgcctgcacggattgaagcgtattctgtttcaacagcggctacgcacttgcccatcttgtccttagcggtattgattacgtctttcattggttaatttcctttcgggtatatattactgtttttatttaccttcagcttacttgtcgctgactaccgtacctatctttttgcccattacagcatcgaaaatattatccggtctgctcagatcgaatacaaggataggtgtcttgttctcactgcacatagccgcagcggcactgtccataaccttgaggctctgcacgagtatctgctgatgtgtgagcgaatcgtacttaacagcatcatcatacttatgcggatccttgtcatagataccgtcaaccatagtcgccttgagcagtatatccgcatttatctctgcggctctcagtgcggcggcactgtctgtcgagaagaacgggctgcccgtaccgcaaccgaatatcactattcttcccttttcaaaatgccttacagccttctgtcttatatacggctcagctatctgcttcatgtcaatggcagtctgcacacggacctgacagccgaggctttcaagtacatcggcaactgcaagtgcgttcattgctgtagcaagcataccgatatggtcagctcttactctgtccatattctcgcttgaacggcctctccagtagttgcctccgccgacaacgatgcctatctcggcaccaacgtcatagcacttctttatgctcttgcatatttcggtgaccgtgggcatatcaagacccatcttcttgtcccctgcaagtgcctcaccgctgagctttaaaagtattctcttatacttcggttgattttcggacatattgttgtttttcctttcagatagggtattaaattttcattaataatcaagaactcttatgcggccgagcagcttatctccgagctttgcaacagcctcgttgcagtccttttcgctgatagcgggagtaataaacgcaagctcgccctccggagcgtcttttcttgtaagataacttaccttgccgaacagagcctcagcctcgtcctttgaaacgccgtttacacggatgtaattttcaagaactatcttgtctgtatcctcaatgaagtcctgatcgctgtcctcccagtagagcgacttgctcgatgagttcatcttcacagcgataacaacgtctgctacaacggcgcttgctgtcgggaacttgcccgcacccttgccgtagaatacaacgtcgcccgtagagtcgcctcttacgagtattgcattgaacacatcgttaacgcctgcaagctggctgtcctcgtggataaatgcagggcaaaccataacagctaccttgccgtcatcctgtcttgaagcccagccgataagctttatcgagccgccgaaattctcacagtatgcaacatcctcaggtgtgatcttcgtgataccttcggtatggatattatcgggataaacgtgcttgccgaacgaaagcgatgcaagtatgcagatctttctgcaagcgtcgataccgtcaacatcggcagaggggttacgctcggcatagccaagctcctgagccgtctttaatgcgtcgtcaaacgccatgttgtcacggatcatctttgtgagtatgaagtttgtagtaccgtttaagatacctgcgatttcatctatgcggttagcagaaaggcactggtggagcggtcttatgatcgggataccgccgcctacgctcgcctcaaagaagaagtttacacccttctcgtgtgcgattttcagaagctctgcgcccttcttggcaacaagctccttgttagatgttacaacgctctttcctgcaagaagcgaagactttacaaaatcgtatgaaggcttgataccgcctataacctcaaccactaccgaaatttcggggtcgttcagtataacgttgaagtcctttacaaacttgtctttataaggactgtcgggaaaatcacgcagatcaagaatgtactttatctctatctcctgaccggctttctttaaaagaccttccttattcttctcaataacctcgaccgtgcctgagcctacaacaccgtagccgagaactgctatttttgccattgaaaactatcctccgttttcttttgttcgatttatacagttttaagtatatcatgattttttatgcctgtcaaggtaaaaacacaactgccgctcctacaaaattttcattgcaaaaaagaaatttcacacagctgtaaaaaaacagctgtgtgaaagcatttttgcttgcagcgtcaaccgctcctcaacatacctttgtacgcctgtcggagcagtttccttgtctgcgtgtgtttctcatcgtctgcggcatcattgccaagttttattgcattcttccgaatgaagatattcaatgtttttgcaagtgaagctatacgccttttcttgctcccctttgttcttttccttttactcttgaatgatattgcgcccggtgtattcggagaaacgaatataagacttccgtagtcacagctgagatgttgacagaagtgtcagaacttatttcaactaacgtttatctgccgccgacaacataagttaatccatacatcaatatttacggaacttgatgcggcacattgccgcccgccgcaccgctatcactccttgactacttcgtagtccttgccgcttgttgcacgctttaatgcctcaagatactgcggagttctccacttgtatgtcttcctgtttacctggctgccgctatcccatataaacgttgctataccgtaatcactgcacagcttgttcagcttttctataaagaatatacaggaagaaagatcgcttccgcttgccgcatattcaccgattattacgggtattcccttgtcaacgaagttctttttcatcttgccgataagcgtttccatttgccggacttccgaatttgtaccccatgtgtgctttctatcgcaggtgcagaaatcccacggtgtgtagtaatgtaccgacaggatacatctgcccgctttgtcgtcaggcattttataaagcgaatcgcaggtgcgctctatatccgtataatatcccgcaataagcagatgacgctttgcattgtttccgcctgtcgcacggattatgtcaacaaaatcctgattaatcttatttatcagattatatgcgtccgccttatttttattgtaaagcgtatcaaatccgacctcgttcatcgactcgaaaatcagatagtccgaatagtttttgaatctctctgctatctgcttccatatatttttgtatttcttcaggaatgtattataatccttctgcgactcctcgattatccatgcaccgaacttaggatcaccgccgccgtcgtgatgtacatttataataacatacattccctgcgagtatgcataatcgactacctgctgtaccctgtccatccattccctatctatgttgccattggaatccatatgatctctccacgtcacaggtatacgcaccgcatttacgccgttctttttcagtgatgtgaacagctcttttgtggctttaggattgccccacagcgtttcatcaaccttttctcccgcttcaacatgctcgtttatcttaccgtcgccgtcacggtcagcctgacaaacatcaagcgtattaccgaggttccagccaaacgtcatatcttcaaccagttgctgtgaagttatatttctcatctttcctgcgatctgtgaaggcttattctcacttgctttcgttgtatcggtactgctttcggttgacttagatgtatgctctgccgcagttgtcgaagacgtgcttgtcacagagctttcagctttgatgtctgcataactgctcacattctgtgattgcgatgtagcagatgttcctccggaagcattttcaccgcttgttaccgcactctgcgcacatcctgcaagcattgatacagtcgatgcaagtgcaattaatgacttcaatacttttcttttcatagtaaactcctttaccgtaaatcgtttattcttgtaagacgtctgtttttcgttttataaagcatcgcttttctcgacaattttatcttattattttaagtatatcatgatttttatgcctgtcaaggtaaaaaacacagttacttgcctttaacacgaaaaagaataagacggatgttattataacgaaagcacgataaccccgtcatttttactgccgtcacgcttttcagacaggcatttcggcaatcaacaatcgtatcggctttataacggttgactaatccgctttgtcttgttataatagtataaagattttttgatattaaatcacagacaaaaaccgctttatatcggtctacagataaaaggagaagataatatttggaaaaattcactcaattgctcgccggacttggcggagccttattgcttatattcgctgtcgtagcgtctgtaatgctcaacagcacttatgtccccgatgacagcgatgattcttccgcacctgtgactaccgccgctacgaccaccaaagcccccgaaaccactcccgttaccacaaagccgcagacgacaactcctgtcaccacaaaggcccctgaaaccacaacagccgctacagagcctcttgagtggggagaagaagccttcagcgccacaatgtatgtaaatcagtcctgctacagcagaataaaggcactaatgggttctgaagccgttaaacaatatacatacggcgaggcggtaaacgttgtcgcaaaaaccgacacaggttattataagctcaatgacggcgaatatattcacggcgattatctgagcgaaaccgaactttgataataaattatgaataaagcaagaaacgttataacagaaaaattcacggcattatttcttgccgttataacgctcgctctcgtcagcataaacgcaggtgccgccgaaagcggtgattcttcgaccgacaccgttaaaaagcccgaaaagtgttacgagcttgtgacaggcggaaacgaagaatactacagcaaaataaccatcaacagccgttccgtgctgataagcggatgctataaaaacgatccggtcaccgacatcaccttgcaaaactgcggtactgtttcatcaactcttaaggtaaacccggacgggacattctcctccgtccttaacccttccgagcctataggaagctacgaccgcatcgttatcacgctgaaatcgggagcaaggctgagctaccttataatgtatgacgataaccgctacttccccgacaacaagctcagcaagcagaatctgtcggtgcttgaaaaagcagtaccaacctcagcaaaatcgtgggcaggctatgtcaccgatgagcttacagaggaaggcgtaaaacagacgcttgacgaggtcgcctatcttgccgattatatagcaggcgatataaaggacgattacaaaaagctcgaagcgatagcaaaatgggtatccgacaatatctattacgaccgtgacgcaagagaaaattcggtaactcagtccgagatatgtataaagaatgttctcaaaagccgcaaaacagtatgcgtcggatattccgcacttttcagcgcactgtgcgaggcacaggggctttatgtcgtaaacgtaaaaggcacggtaacgtcagacacggtagattactccgaccttgccgacggacctgtaaaccacgaatggtgcgccgcactgattgacgacagatggatatgggtagactgcgtatggaacagcaacctgaaattccaaaacaacgagtttatttccttaggagcaaacaccgaaatgtattttgatatttcaccgcttgccctgtccttcgaccattgcgcatatcttgccgaaaagcgttattatttccgtgccggcgaatatttcagccaacaggacacaaccacccccgacagcagaaatgaaagcaccccctcggcagatacctccgtatcggcagaaacctctgcagctgcaaccaagcctcagatctataccgctcccgaaaattatacgcccgttacgagcaatattcagtcgcacgaagaaagcaacaacggcaatctcacatggatagccgtactgactttattcgttgcggtattcatagtctttgattttatcagcataaagaaactgaaaaaataagccatcggtaaggcttcagccttattgacatacagaaaacacaaaatacgaaaggaattcagaccaatggtagttattgaaatggaaaacggcaaaaagataaagatagagctttatcccgaaattgcacctatcacctgcgcaaactttgaaaagctcgttaaagagggcttttatgacgggcttatcttccaccgtgtaatcagcggctttatgattcagggcggcgatcccgaaggcacaggaatgggcggcgcaaaggaaaacatcaagggcgaatttgctcagaacggcgtaaagaacgatttaaagcacacaagaggcgttatctctatggctcgttcgatgatgcccgacagcgcaagctcacagttctttataatgcacaaggacgctcctcatctcgacggcggttatgccgctttcggcaaggtagttgacggtatggacgcagttgacgaaatcgcagataccgaggttgactggaacgacaagcccacaactcctcaggttatgaaaagagtttatattgaagactaacagcgtttaaaccacgcaaggtttacagcacaggcttctgtattacgcagaggcctgtatttattataaaaagttttttataaattttctcaaaagcgtgacctttataaaaatatcctgtctttataggtgaacaggctgtttaataaaaataaaagggagtgagaaatatggaagacagcaggattatagaattattctttgcgagagatgaaaaagcaatatccgaaacccacagcaaatacggcagatactgttactctatcgcctacaacatacttgccgtgaatgaggactgcgaggagtgcgtaaacgatacgctgatgaaagcgtggaatgccattccgccgcagaagccgaaaaagctgtcggcatttctcggcaggataacacgcaacctttcgctgaacagattctttgagaaaacagcagataaaagaggttcgggacagacagccgccgttcttgatgaactggctgaatgtgtttcgtccggtgttactacggaagatatttccgacaacaacacgctaaggcacgccctcaacgattttctcttctgccttgaacccgaaaagcgtattatctttatgcaaagatactggtatatgatgccgattaaggcgatagccgccgaacattcatctaccgaaagccgcataaaaatgatacttctcagaacacgaagcgaacttaaggaacatcttataaaggagggtataacgctatgaaagaaaaacgcttactgaatgaactcggcaacgtaaacgatgatttcatcgaacaggcaaagccgaaaatcaaaaacaacagaaaaaggctgtacgctgttatcggatcggtgacggctacggcggcagtgttcgtagcagtattcgcaaccggaaacggtttactcaaaaatgccgataatgatttcaacaattcatcatcagcaatcacaaacgaatcaacaaacgaaacaacagctttggcgtacagcaatattaatatttattatctgaatggcacaagcacggaaaaagcaagtaaatatcttgcctgcgaccctaaagttattttttccgagtggaaaaagctcaatagcatcggcgatgatgtacgttttatcaagtgctttatcaacagcaacggcaaagagaaaatcaacgaaagcacagccacctacattgtcggcgacaaagcgactcttgaactgacaatatcgagtgatataaagaaatattacgaaaaacacggagaagaaccactcctctcttctctcaaaaaaacatttaccgaatattccgacttctgcacagattacaaactcataattgaataaaccgataaagcactgtaaaccaccgctggtttacagcgcttctctttataacaaaccgccccgtgaaaaacacggggcggtaaaatattcttataatattatcagtcagccaaaaaactgctcataagggtatgaccctcagcaatataatcgcccgtcttagccgcactctcctcgcagaagcaatcaacaccgtccagcttctttctgctgtcatagatcatgaacggcacaggagcgtttgtatgtgttctcagttcaagcggcgtgggatggtcgggacagataaggatttttatatcctcgtccttgaattcgtcaagcagtttgccgagtatcttttcgtcaataaggcttattgcctttaccttattgtcaacctcattacgatgaccgcattcatcgggagcttcaacatggatatatacaaaatccttgccgctcttcagtgcgtcaacagccgcctgagccttaccgtcaaagtttgtatctatgtagcctgttgcaccgtcaaccttgataacgtccattcctgtgaacttgccgatacctctgagcagatcgaccgcagaaatcatagcggcactctttccgtacttttcggcaaaaggagtaagatccttgcgaacgccctcgccccagaaccatatgctgtttgcaggacgaagacctctttcgattctctttaaatttacaggatgatccttcagcagatcatagctcttcttcatcatctcgataagcaccttgccgttttcattcacaccaagatgcgtctttatcggcttgcctgttatatcgtggggaggagtcagcgtgcctatatcggtcgtaccgtgatcccatatcagacaatgacggtagcttacaccgctgtagaatctgaattcatccgtaccaagcttttcgtcaatgaactttataagctctgcggcttcttctgtagatatatcatcggcacagtagtcgagtattgtcttatcatcgtaaaccggctcgtccgacagcgttacaagattcgttctgaaagaaacgtccgtaggcttcatatcaatgcctatactgcctgcctctaaaggacttcttcccgaataatatattgcaggatcataaccgagtacggaaagattcgcaacgtcactgccgggcttaagattgtcctcgaccgtctttacaagacctactcttgatacctttgcgagcttgtccatattaggcttgtgagcaacactcataggtgttccgcctatatcctcacggggaagatcggccataccgtcgcaaagtaatactgcgtatttcatttttttgttatccctttcttgcataaaaaatccgaccgaaaatacggctgaaaaaaccgctttttcctgtcttatctattaaagtatagcacaatgtctgcaataaatcaatataaaaattgcaaagcgacttgtttttgctttatcttgccgtatcggtaagcagaattttacacggatattttccgacataaaatcaaaaatatcatcaaggacggtgatattttgaatatttccaaaaaagaatacgcacagcttgccgaccgttattccgcaccgagcaagctatatatgacagtgccgaaagcgtttgtgataggcggacttatctgctgtacaggacagttctttaccgatttatatattatgataggaaacgatggggatactgcgtcagcgtacacctcaataacgcttgtgctgataagcgcattgctgacaggcttcggtcagtatgagcggattgcaaagcacgcaggcgcaggcactctcgttcctataacaggctttgcgaatgccgttgtttcccctgcccttgaattcaagaccgagggactcattctcggtacgggcgcaaagatgttcatcattgcaggacccgtaatagtctacggcataacggcggcatttgtctacggcataattctgtttgttataagtcttttcggaggttgatatggctaaactgatttcagagggtacaatagagcttgaccgtggtgtgtcggtttattcctgtgccgccgcagtcggaaaaatggagagcgacggacctctcggcaactgctttgactatgccgcagagggagcagaacttggacttaccacttgggaaaaagccgaaagcacctttcagcaatatgcctttgatattgcccttagaaaaggcaagctcataaaagaggatatttcattcatttttgcaggcgatctgcttaaccaatgcacaggctcggcttacggcctgcgtgacaccgatatatcgttcatcggactttacggtgcctgctcgacaatggcggaaagccttgctatggcttcgctttttgcggatatgaggctcggtgaatatttcgccgccgttacctcgtcacacttctgctctgccgaaaggcagttcagatttccgataaactacggcggtgttcgtccccctactgctcagtggacagctaccggcgcaggctgctgtataacctcggtagctgaaaaaccgccttatgtaaagcgtgtcacgataggcaagataaccgatatgggcataaaggacgcaaacaatatgggtgcggctatggcaggtgcggcatacgatacgataaaccgacacctgctcgccaccggaacatctcctgccgattatgacgtaatctacacgggagatctcggacaggtcggctcggagcttatgtgcgagcttttccgccgtgacggaacagaaatcagccataagcacaaggactgcggtcttatgctctatgaccgtgaaaaacaggacgtgcacgcaggcggctcaggatgcggctgcagtgcctcggtactgtgcggacatatcctgccgcagatagccgagggaaagctccacagagtgctgtttgccgctaccggtgcgcttatgtcaacaactaaagtacagcagggcgaaagcatccccggcatatcccaccttgtagaaatttcagacgctttataacaggagaaaatttatgcagtatttatgggcatttttagtcggcggtgcgctttgtgcaataggtcagttacttatcgaccttacgaagctcacccccgcaagaatacttgtagcctacgttgtttcgggcgtgattctcggagctgtaggtctttatcagccgcttgtcgattttgcaggcgcaggtgcgtccgtacctcttacgggctttggcaatctgcttgcaaagggtatgaaaaaagctgtggaagatgacggcttactcggaatcttcacgggcggatttaccgcctgctcggcaggagttaccgccgcaatgatttttgctcttgcggtatcgcttatcttcaacaggacagacagaacaagacaggaataaaaataaccgccgacctcacagccggcggttcagtctgtcgaaaaacctatatattttttaaaaatggggtttggggcatagccccaagcggggtgagggcggcagccccacactcagccccggcatggatgccgggcgtgtatgcccaagggctttgcaaggacgcaaagcccacaaagcgttcttatagggatagagaatttgctctatttttataaaaatagacttttctacaagatgaaccgccgacctcacagccggcggttcactttatccatatataaataactcagttaagatacataaatccctgtatcacaacaccaataatcataataagcgcaagcacccccgcacctatcttcatacctattccgagcctttcacgatttttctgcttcatactcttacgctccttgaacaatatatttaaattatacaccgataaatttccgctgtcaagcagaatgtacctgcataaccggcagaatgtccggaataaactgtatcattatctttccggagtgtgatattatgtttatatcggtactgcaaaccgcactgcagagccttatcttctttgctctgcattttaaaagcaacggttcatttcccagacagctttccgcaaaggaagaacgtgaatgccttgaaaaagcggctcagggcgaccttgccgcccgtgacaagctgataaaccacaaccttcgccttgtggcatatatcgtaaaaaagaactaccccgacagcaaggaagcggacgatcttatctcgataggcataatcgggcttatccgtgccgcagaaacctttgattacagaaagaacatcagcttttccacctatgcgggaaaatgcataaataatcagataagaatgtacttccgtaaaacaaagcatcagcagacggaggtttatatgaacgacccgatggactgcgacaaggacggaaacgccgtcacccttgccgatattttcaaggacggaacggacgttgccgaggaggccgctcttaacatcgagcttgataaaatgtacagatatatagacgaggagcttgacgagcgtgaaaaagaaatacttacaaagcgttacggtctgtctaaaacatcctaccgcaccgacaggataatgacccagcgtgaagtcgcagacgagcttggcataagcaggagctatatttcaagaatagaaaagaaagccctcgaaaagctccgctcacgctttgaaaaaggagattgatacagaagtataaatgaccgatttgtagaaaaaccgattcttattaaagcgacacagtgaaatatatcgccaacatcgcttaaaacactttccgtactgacaaggtattaataatttcgtgagtgtatctgtacaactgcactagcattgacctttcaaaaaaacgctactaacctgagatatatgtactaatatgcggacgtgtagcgttaagcgtccctgcattgacaagatatacaatgttccggtggttttacgagttccgctaacaccccagcggggtaagggtatgggtaaggaaagagggatgccacgctgagcattgctttagcaatgctcccgctcctcacgtcgctcaagaggaataactcatttgggagaaaacctaaggcggacaaaaaatcgtctgtagccgattttaccgcataaaaatgcggtgttgctcacgcaacagtccgagaacgttttaccataaatcttttgtctgacggcaaaatacggcgtactgccgtgtcggtttacaccgacttgattttatggtataattatagtaacaacttaaacggaggtggaatcatgacagatacagagatcagcagatatatggcactgctcttaaggcataagcccgaaatagcaggacttgtacttgacaaacagggctgggcggatgtcgatatgcttctgaaatgtataagcgaaaatatggagccggtgagctttgagcggttgtgcgaaatcgtgaaaaacgacagcaaacagagatattcgttcaacgaagataaaagccgcatcagagcgaatcagggtcattcggtaaatgttgacgtagggctgaaggccgctgtgccgccggaatatctttatcacggcactgcgacaagatttgtcgaatctatcgacagcggcgggattatccgcaaaacaaggctttacgttcatctgtcacaagataccgaaaccgcaacgcaggttggtaagcgacacggcaagccgtttatataccgtgtaaagagcggagagatggcaagggacggatatgtgttttatctgtctgaaaacggcgtatggttgacggaaaacgtgcctgtgaagtaccttgaaaaaacgtggcaggatgacgcttgacttttttgaaaaccggtggtacaatataaaaagactgaataggggagctttttgctgagaggaagttcgacttcgacccttgacctgatgcggataatgccgccgtaggaatttcacgatatttctatagcttttattatccccgactgtattcagccggggaatttttacgttaaagcaggtattcggttaaatttatttaacggaggtttttcaaatgaaaaacgaaaaggtacttacacttgttgagggagcggtgatggttgcgcttgcgaccgtgcttagctttgtcaagatcgttcatctgccgtggggcggatcagtcactctgctgtcgatgctaccgataattgtcttcagcatcaaaagaggtgtggcaaacggtcttgcggcatcgtttgtgtttgctctgatacagttcattcagggctgtgcggacgggttattcggctgggggcttactcctgtggcgcttgtggcgtgcatattcatagactatatttttgcatttacggtgctggggcttgcgggaattttcagaaaatacggaatgcccggagtgattggcggaagcgttatggctatgggtctgcgccttgtgtgccattatataagcggagtgctgatattcggctcattcggagagctgtggaacggctttaccgtaaacgagccttgcctttacagcctgctttataacggggcgtatatgctgccggagatagtgtttactgttatcggagcggttgtattggtgagtgttccgcagacgaaaaggctgattttcaaaaacgtataagagaatgaaaaaccaccgttgcgggtatgcaacggtggtttctgctgtagaaaaagtcttttgtttaatgtgcttgtgttatatcgttcagcttagactatgatagcaggctaccgatagtgctttttgcgagatagcacttccggagcgttcatttaaaggcaagggtggtggcgatttttgagggatagtgcggttttgggagggttggtgcaacgggaggcaatccctccggtagtcgcccgaatttttttcgggcgacagcacctcacctttgacaagggaggcaagggtgatggcgatttttgagggatagtgaggttttgagaagggctggtgcgagcgatggattatcgttcttttgcaatggtcgtggggatagagaggttcggtgcaacgggaggggcaagcaaggcaaggatgccttagcgtgtgtgccctaagttttgcacggatgcaaaaccatacaagcacacacagaccctcgccctacgaaaagcgagatgtgatagtttaaatgcaaaaccgtataagcacacacagacgattgcagtacgaaaagcgagtgtgatagtgcggttttggaaggggtgatggagtgacaatccctccggtagtcgcccgaattttttcgggcgacagcacctcacctttgacaagggagacaagtttagtgcgaggcgagggatagtgcggttttggaaggggtgatggagtgacaatccctccgtcttgacggcagaagagtttgtagcataaaaagggtgggcatatcgcaagtaaaacgcaacaaagcaacagtttgtgtcttgccgtcaatccacctccctttgacaagggaggcaaggacatagtgcagggcgagggatagtgcggatgtgaaagcgtatcggtgcatatagatgttggcattacgaaaagcgggtgggatagtgcggttttgggagggttgatgcggggcgagggatggtgaaatatttcactgtgtggggtttaataatcggtttatcgacagactaaaaccaccgttgcgggtatgcaacggtggttttgtatatcatggttatttcaggaagccctcgattattttctcttcggcttcttctcttgtaagacccagcgagcagagctttaatatctgttcgcctgctatcttgccgatagccgcctcgtgaataagtgcggcatcaacattagccgcattgagagccggctgtgcatcgaccttgccgttatccgcaagtatcgcatcacaggcggaatggcctgtgcaacggttgttgccctcgactacggagtaaaatgcctgatgggaatttcctcttgcaacagaacgtgaaacaaggtctgcgccgctgtcctcgccgttaagctcgacatggaactttgttaccgcctcctcgtcaccgtcggtcattatacgctcacggacaactatctttgcgcccttgccgagtacggcggaagtgcttcttgttgttctgtcaacacctctgagctgtatcgtatccatctcaagatatgaatcctcgtcaagaacgcagtctgtgacggggtcaatttttctgagtcctgtgcctttgcctgttccgatatgcttttccttgtaaagcactcttgcacctttttcaaggaagaagcggtgaatgccgttgtgacgagcctgttcctcgccgtcattatgcacgccgcatcctgctactacaacaacgtcagcgccctcgccgatatagaaatcgttataaacaaggtcgtcaacgtcactgtgggtaacgcaggcggggatgaataccgtttcaccaacagtaaatggctttacacggatatttatacccggcttgtcttcttttgattcgatagtgatattctccgacgatcttctgccggcgcacttgctgtcctcacggatattgtatgcgcccgcaaagcccgatacctcgtcataatcggagattatcttaagcatttcggctgttgtgccgttgaaatttacgtccattatattgctcactgacaaccgcctccgtttctctggggacatctgcaggcgtattctccgccgagcagtttcggaaggacttcctcacggggtcctgccgtgcgtatagtgccgtctgcgactactattatttcatcggcaatcgaaagaatacgctcctgatgcgatattataacgagcgagcctgtggtgccgttgcgtatttcttcaaacgtttccacaagtcttgagaagctccagagatctattcctgcctccggctcgtcgaataccgacagcttgacatttcttgcgagcacggtcgcaatctctatacgctttgcctcgccgcccgataaagcgccgctcatctctctgtcgatatattcctccgcacacagaccgaccttgccgagaagcgcacaaagctcattgtgacccagcttttctcctgcggaaagctcaagaagatctcttaccgtaagacccttgaagcgtaccggctgttgaaaagcgtaggcaatgcccagctttgctctgcctgtgatgtccatatccgttatatccgtaccgtcaaggagaatcttgccagatgtgcatttttccacacctgcgatgagctttgcgagggaggtcttgccacctccgtttggccctgtaattaccgtaagcctgctgtcaagcttacaggttatgccttttataataggttctccgcttggaagctgccattttacgtcctgaaattccagcaaagtagttacccctttcattttttatcatattatcgtaccatattaacgtgattatgtcaagaggcggcggtcggtattgaattttttttcgttttgtgataaaatattatgaaaatgatatgcggtttatttttgaaaggtaggcatataggaatgaaggtttctattattgataacagcttgtgtgattcatcgtttgtaagcgatgtgaagcctgaggcaatcaaggcttatacggacgcactgcacgagttcggggtaaactatatcgaaatgaccacagacagctttattatgataccgcctgcaagcgatatgtcgaagataatacttcgtatgacctcggtgcgtgacctgctgtatataaattcgttcgattttgcctatgttgtcgtgcctgcatacctgaccgaccttataccgaaaatcgaaaggccggttatatcggagctttgtctgcacgggtcggactatatgagggtcacggaaatgtttgaaaagaactttgagcttgacaaggtttcgatgatacgctttgttgacgatttcagaaaaagtccgcaggaaatggcacggatgctggcggaataccgcaggaaatactaccgtccgatagatatatgcccgacaaacaaatacacgaacgctgtcagcgaggctatagcggcggtgatagcgaaaagcgacagcctgactatgagattcggtgattacgaacaatatgcggaactgcaggattacactgtttcgcttgccacgctgttcggcgtagcgccgtcaccgcagatgataatggcgctttataaatgcggctgtctttatgcgatgatatacggcaggcaagcaaaaagcacgcttgacgacctgagatcaagccagatttcgccgcattatgttactaacgttgacaagccgaagccatttctgccgagtgagcggacaaagacctcgtcttacgttactcctcccgaaacaaaagaaaaagagggcggagagctgctttacagcaagctgagaagtatgatgcttgacgcagacagcgcagaggagcttgaacaggaaatcgagcagttctgtacacagctgtacaacaagtatggcgacaagtccggacattgagccgctaagactgcaaaacaactatatgtataaaaaatccataaaaacgcaggctatatagtgcaatatgacgaaatgttaagcggctgaaaaaaatgcttttatttttacggcagatatgctataataattttatactgtgtcggtgtgtacccaaatatcattccgacgcactgttttatgagatacagagccttaaagggcgttttattatatcgaattctatattttaaatgaatcgaggaagtgtgacttttggaaaagtttattataaaaggcggcattccgctgagaggcgaagtgcggataagcggagcgaaaaatgcggcggtagctataattcctgcggcgatacttgcagaagataagtgcatacttgaaaatgtaccgtcaatcagtgatgttgatgttgctcttgagatactctcgagtatgggagcgcagataagaaggctgagtaagtcgaagatagaggtggatacgtcaaggatcaaggacggaacggtaccttatgagcttgcacgctccacaagaggaagcagttattttttaggtgcgctgcttggcagattcaagaaggcgagcgtgccgctaccgggtgggtgcgaccttggcagcagacctatcgatcagcatatcaagtgctttgaggcgctcggtgcaaagactgatataaagcacggtatcgttgacctttcggctgacaggcttatcggtacgcagatatatttcgacaaggtgactgtcggaggaacgataaatgcgcttcttgcctgcgcaaaggcagaggggctgacgataattgaaaatgccgccaaggagcctcatatagtggaccttgcgaattttctcaactctatgggtgcggatattatgggcgcaggtacggacgttatcaaggtgaagggcgtttcacagcttcacggcacagagtattcggttatccccgaccagatagaagcgggaacgtttatggtggctgcggcggctacctgcggtgatattacgctgaagaatgttataccgaagcaccttgagcctattacggcaaagctgcgcaagataggcgtttatgttgagatagaggacgatacggataatgttagggtagtcggcagacctcattatgagggtactgatataaagacttctccgcatccgggatttcctaccgatatgcagccgcagatgacaacgctactggcgatgtcgaacggtacaagtatggtaactgagagcatattcgatacacgtttcaagtatgttgacgagcttcgcagaatgggtgcggatattaccgttgacagcagggtagcggtagtaagaggcgtggatcatcttacgggcgctccggtaaaggcgagcgacctcagagcaggtgcggcgcttatcattgcaggacttgcggcacagggcactacggaaatcgaagatattcaccatattgagcgtggatatgaaaatatggaaataaagctgagggcacttggcgctgatatagtaaagcgttattatcccgatgacgaaaagatgagaaaggcactctgatggcaaaggttgttcctgtatgctcttcaagcaagggcaacagcgtttttgtcggtgacagcacctccggcgtacttgttgacgcaggatgcagtttcaaggcgctgagggaaggtctggcactctgcggtataccgtttgaggcggtgaaggctgtgcttgtgacgcacgagcatatagaccacacgaaagcactcggacagataacgaaaagaacgtctgttcctgtgtacgcatcggacggcactgcaagaaagctgttttctgacaagctggtagagcagacggcggttattcatccgctgtcggaaataaagagcgtacctgtcgatatggatattgactttttccatacaccgcacgacgctgcggaaagcgtagggtacacactgaagtttggcgagcataaggtcgcctgctgtaccgatttaggctatgttaccgatgaggtgaaggataatctgctcggaagcgacacggtatatatagaggcaaattacgatcctgtgctgttaaagggaaatccgaaatatccgccgtatctcaaaacgaggatttcgggggaccacggacatctttcaaacggctgttcggctgagttttgtaaggagcttgtcgcaaagggtgcgagccgtctgatactcggtcacttaagccaggagaacaattctccgaaaatggcgtatgaggctgtggagaaaacgctgaaaaacgcaggaatgtcatgcggagttgattttacccttgatgttgcgcctgttgtgacacagggaaaatacataattatctgatgaatatgcactgcattttctgcttggtggtaactttgcagttgtgcggtgctttatttttttattgcgaaaggaaaaactatggcagtatatcttatacttatggcactcgtgcttgtgcttgcttatccgctcatcgagcataagccgaatgtggtgaagaagctctgttatgttatcgtgacattcggagcaatgtatctgataagcgtgttcagatacggacttggaaacgattattattcgtacatctatattttctggaatatcaagaatgcacccggactttcgatattcaactacgggtatgagccgggctttacgatcgtcacaaagctgatctcgatgtttaccgcagatgtgaatataatgtatgcggtgtacgcactgctgatacttatacctacggcgtatgcgatattccgttacagtgaaaatatatggatgtcaacgatgatgttcatatcgctgacgttcttctactgctcgctgagctttatccgtcagtcgatagcgtttgcgatcatactctgcgcttacagatttatgaaggaacgcaatcacttcatggtgctgttgtttattttcttagcgtgtctgttccacagtacagtaatagtgctgataccgctgtatctgattgcggcgttcataaagcctacaaagataaccgtaccgatatatgcgatattgacagcgcttgtatatctgctttcgtggccgatattgcggcttgcggttgtgcttcttccgcagtacaagggctatcttgagctgagctttatcacgcagggctattcacctgtttatattatagtgcctgcgataatcacggcacttgcgcttatcgcacatttcacgggatacggaaaggcatatccgaaagaatcggcactgttcacgaactttgcgatattcaactttattatatggtttatagcgacaaagcactttgttatcgagcgtttctcgatgtatctgtacattatgatgataatgttcataccgtcaatagcaaggtactatatgaactgtgcaaaggcttatcttgcacgcaggaaaaatcccgacgctgtggttgaattcgataaaacggttgacgaggtcatccgttccaagcatcccgaaaaatatgcacataacgccggcaccgaacccaaaaaggaaaaagcggtttcacagcccgtaccggaaaaggcggaggctgagcttagcgatatagaaaaggaaaagcagagaattttagccgagatcatggctgaggacggcggcgacagcgatatagcgacaaagcccgttgaagctgtggaaaataaaaagcccgaaaagcagaagaagtattcgtctgtattcggagagcagtttaaggctgacgaaagatatatgccgaagaacagggtgttcaaaaagagaaggaacggttttgtaaacttcgttacacgtcctgttacgatatttgcggctttccttgctgtagtagttggtgctaatctgtggtacaactatttcggtcttacggtatcggagaagggtttccacggagttatgccgtacaagagcattgttccgcagtatacggaatttgtgctttcaaaagaaagcaaggatgaaaagaatacgaacctcagaagcgaggataatttccttaactatatgtacaggctgaaggagggcgagaatttcaccgccataatctcggcaagaggagatgtgacgggcggatataacgacggcgctttatcggctgtaaaggaactggggcttgaaaaactgcttacggctcagaaaaatcagcgttatattgcgataatagaaggcggtaaggtagtccgtgaggagctgtcgaaagacaggatcgatacaggcgttattgatgtactgggctataagacgcagataatcagcgacgcaggtgaatcgattgtcaaaatgggcaacaagaactactcgctcaatgagcgtggaatgaatatcgtggtgcttgacaacacaacaagaaacattgttgacaaggtgcgtttcaagacgtattacgttatgctgtcggcaacaagataagggcggtaacacttatgagaatgagaagaaaaaaataccttgatgaacgtcttgacgcttgcggcaacgtgaatctcggctggcttgtggattatgccgcagagcaaagaggtgaaacacagcagaggacgcttgatgtgcgggagatattcggcaatgataatcctgttcatcttgaggtaggctgcggaaagggcggctttgcggttgaagcggcaaggcgtaaccctgatattaattttattgcggtggagatggcaagaaacgtaatagtcagcgctatggagcttgcggtaaaggaaaatctgcctaatctgaaatttcttatgggtaaagcggagtatcttgaaaaattcttccccgaaaattcggtagaacgcatttatcttaatttcagctgtccttatcctaaggaaacgtataaaaagcaccgtcttactcaccctgtatttcttgagatatataagcacatacttataccgggcggtgagatacatcagaaaaccgacaatatgaagctgttcgagttttcgatagagaatctgtcacagtgcggcttcaagctgaagaatgtcagccttgatctgcataacagcggatttgaaggaaacattgtgacggagtatgaaaagagattttctgagcagggatttccgatatatcgccttgaggcagtaaatccgacaaaataggctttacttttcgtaaaaaatggtatatactgagtataagcaaacggggttttacccggaaaggatgtttagtatgaataaggcaatgatatttttcggtattgcggcggctgtcggtacggggtatattttagctaagaaatatatagataaaaatcctgaggctgtggcggctatgaaggaaaactgcagtgataagctccacaaggcttcggtctactgcacgggcgcagtaaagacgggcagtgaaaagctcacaaagagcgtgaacgagatcgtatcggcaggcagggaaaagagcgcagagcttatgaagaaggcggctacaacaggcacggctttcaaaaacgagataaacaatctcaaggatatggtagtgtcgataaacagcggagttgatgttgatatttccgatgttgacgatgatgcggacaagaagagtttttcctttaccgagggcggagtggaggacgagataatcgaatctcccgaagaaggctcggaggcattataaaatccgataaagcacaatgaagtgtcacggcggtattgctgtggcacttttgcttttaatatgtttttaaggaagtgcggagtgatggcagatatagaaataaggacggcaacgccctttgacgcagaagaactgctcggtatttattcttattatattataaatacggcggtaacgtatgagattgatgtgccgtctgcagaggatttcaggcggaggatagaaaaaacgctgaagaaatatccttacatagtggctgagcgtgacggaaggattatgggatatgcatatgccggagtgttcaaggacagggcggcttatgagcgttctgccgaaacgtcgatatacgttgatgtgaatgaaaagcgtcacggtacgggaacagcgttatatagggaacttgaaaaacggcttgcggatatgggggtaaggaatgcgtatgcctgcatagcaagcacggataaagacgatgagtatctgaatcacgacagcatcaggtttcacgaaaagcaggggtatacgcttgtgggaacgtttcataaatgtgccgataaattcggcagggagtatgatatggtgtggatggagaagattatagggtagtgggcgatgtgttaacggtatgaaaaacagccttgcgggtttcgcaaggctgtaagatttcagaaaaagtcttttgtttaatgtgcttttgctatatcattcatctttgactatgataataagctaccgatagttctgtttatcggacagcacttctcgggttcgctattcgagtgggtacacttgtcaatattaacgagggaaagaaccaaagcaatcaggaaaacaactgctaaacaattacaatccataccatagttggctctgtcaagccgagtaaaagaagctcacctttggcaaggaaagcaattttagtgcgaggcgtggcggtggatgtgcttttgagaaggttgtgggaatggagaggtttggtgcaacgggaggggcgagcccctcgccctacgaaaagggcgtgtgatagtgcgaatgtaaaagcatataagtgcatatagatgttggcattaagaaaagttagtggggtagtgcggttttggaaagggttggtgcggggcgagagatggtggcgtgacaatcccttcgtcttgacggcagaaaagtatgcaatataaaaaaagtgggcatatcgcaagtaaatgcaataatgttaaggcttgtgccttgccgtcaagccacctccctttgacaagggaggcaaggacatggtgcgaggcgagggatagtgcgaaacaaacagagcgttcatttaaaggcaagggtgttggcgattttcgagggatagtgcgtttttttgaagagtcaatgtcagtgcagttgtaatgatgtactcacgaaaatattaatgccttgtcggtacggaaaaagctttcagcagtgttggcgatatgtttatcggtacggatttaataatagtcggttttttgacagtctgaaacagccttgcgggtgtcgcaaggctgtttgttataatataagaatggggtcatataccgcaacagctgtcgcagtggtcgtcctttatttcgcctacaaagggggtggggtcgattccctgtcttgtgtagtagtcggcaatagccgccttgatagcctgctctgcaagtacggagcagtggagctttgccggaggcagaccgtcaagcgcttctacgaccgctttattggtcagcttcagtgcttcggataagggcttgccttttatcatctcggtagcgatggaacttgtggcgattgccgcaccgcaaccgaatgtcttgaacttgacatcctttatagtgttgtcctcaatcttaaggtacattttcattatatcgccgcactttgcgttgccgacctcgccgacaccgtttgcatcttcaatctcgcctacgtttctggggttggcgtagtgatccattaccttttcagaataaatcatcagtaatacttcctttctgataaatcaatgtttactttattttgaatgtttcgcccttgacgatgtgatcccacaggggcgacatacttctgagcttatttacaataacggggagaacctcgagcagcttgtctatctcctcctcggtcgtgtactctgacattgagatacgcagtgagccgtgcgctacctcgtggggaagtcctatgctcagaagaacgtgcgaggggtcaagtgagcctgatgtgcaggcggaaccgctcgacgctgcaatgccctgaaggtcaagctggagcagtaaactctcgccctctacgccctcaaacgagaagttcaggttgctcggcatacgcttttctctgtcgccgtttaaatgaacacggtcaatcttcattatctcgttatatatcctgtcgctgaattttttcagcttttcgttcttggaatctataccgtttacggcatctgttatagctacgccgagtcctactatagcaggaacgttttctgtgccggcacgtctgcctctttcctgagcgcctccgtcaataaggggaggaaggcggtatttcttgtttacataaagaacaccgcaacccttctgggcgtgtatcttatggccgctgagggagagcatatctatattctgctcttttacgttgatgtggacgttgccgatagcctgtactgcgtctgtgtggaagatgacacccttttgcttacacagctcgccgatctcggcgatgggctgtatcgtgcctatctcgttgttggcgtacattatcgtgacaagggctgtatcggggcggattgcgtttgctacgtcctcgactttaactataccgtttgaataaacgggaaggtaggttatttcaaagccctccttcttcagagaatccattgtgtgcagaaccgcatgatgctcgaatacagaagtgattatgtgcttcttgccttttagtgccatcatttttgcggtgctttttatcgcccagttgtcgctctcactgccgcagcttgtgaaataaacctcgctgtcctcacagccgagcgcctgtgcgacctgatgtcttgccttgtttacggctattgcggaatttcttccgagagtgtagatagaggaggggttgccgtattcctccgtaagatagggcagcatagcgttgagaacgttatcgcttatctttgtggtagccgcattgtcaaggtatattgttgttttaagcatttatactatcgttcctttcttcctgctttatgctaaatgccgtttaacgcactgtaaagggatgcggtaaagacgacagatttagtccgatttatattatacacctaatagcctacaaaatcaataggtttaataaaatttttcaaaaaaatatcggcagtgagatttttctcactgccgataaatcagttattcacgattgtctgcaaaggtgaaggtcggattattcgattgcaatcacgttattgccttcaacctgaggtgcggctttcggaacggatacctttaagataccgtcttcaaactttgcgtttacgtcctttgcctgtacgccgtcgcctacatagaagctcctgctgcactgaccctcgtaacgcccacgtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcgtttacgtcctttgcctgtacgccgtcgcctacatagaagcttctgctgcactgaccctcgtaacgctcacgtctgatgtacttgccgtccttcttctccttttcgtccttttcaagacccttggaggcgctgatggtaagatagccgctgtcaagcttcagcgatacatcttctttcttgaagcccggcaggtcaatgtcaagctcatagctgttgtctgtttcacggacatcggtcttcatcacgttctttgcgtgcttgccgtaaaggggatcgttcttgccgaacattgacggcatcataaaatcatcgtcgaagaaattgtcaaataagttttcattgaaaattgcgggtaacataagtcatttctccttccgtatatcggacggtcggtttattatccgaccgtgtaactgctatgtgtgtgcctgctgtcgtttattcgatagcgataacattatccgtttcgacctgaggtgcggctttaggaacagatatcttcaggataccgtcctcaaacttagcgtttacgtcctttgcctgtacgccgtcgcctacatagaagcttctgctgcactgaccctcgtaacgctcacgtctgatgtacttgccgtccttcttctccttttcgtccttttcaagacccttggaggcgctgatcgtaagataaccgctgtcaagtttcagcgatacatcttctttcttgaagcccggcaggtcaatgtcaagctcgtagctgttgtctgtttcacggacatccgtcttcatcacgttctttgcgtgcttgccgtaaaggggatcgttcttgccgccgaataccgacggcatatagaagtcatcattaaagaaattgtcaaataagttttcattgaaaattgcgggtaacatatgtcattcctccattcattactaagcggtctgtgcttttaaacgcagtgccgatcatttgctgcccttgtaccttccggagaccctctctctttctttgtacaactacattatagcacactttttagcactgtcaatagtagagtgctaaatttcacaaaatcttcttaaaagtataacaattttgacatttaagggcggaaatgcgaaaaataagtgcgtgaatgttggggatattaatattgaaatgcaaaaaagccctctcttaagcacgttgtgcttaggggaggggttttagcttttagtgtggggcgagacggcggatgtactcttgagagggttgcgggaatggagatggtcggtgcaacgggaggggcaagcaaggcaaggatgcctgaaatgaacgcccaaaggctttgcaggacgcaaagccaacagagcgttcataaagaggcaagggtgatggtgcagggcgaaggatggatgttctttcaaaatggttgtggggatggagagggtcggtgcaacgggaggggcaagcctgtatagtgtgataacatagtttacagaatgtgcaaggacatagtttacatatttatgataaaatagaggcataaaaggcggtagccccagtaatatagccccttcccacggggaaggggtttggggttagggatagagaatttgctccatttttataaaaatggactttttctacaagctgaaagccgccgtgcagatagcacggcggctctcgttattaagcatcacagattacttaacgatatacttgtcaagctcagccataagctcatcgcaatcatcgctgtgaacacgaagctcgaggggctttgaaagatccaggctgaagatacccattattgactttgcgtcaattgcatatctgccgcttacgatgtcaacttcgtagttgcactttgtaactgttgttacgaaattcttaacgtcttcaatagtattgattctgatattagctgttttcatacaaaaaacctacctttcatatttcaggtcaaatttcggctcctgaccgattgatttcattttaccaaaatgtaaggcggttgtcaattgcttttaaatgatttaacttaattttttcaatcggagataaccgttagcctgatttcccgttttcgccttatcactgtaagtgtttatcgcaccttacagctatataataacacatttcacgatacggtcaagagtattattgtcaaaaaatcgtcacagcttgcaaatttcggaataataaagtataattaggctgttgggagtttagttttggtgaaactcaccacaatttattatggaagtgatattatcagatataccgtacagaccttcgggtgcaaggtcaaccaatatgaaagcgcttcggtagcaaaggctatggacgaacacggatacgagaaaacagacgatatttttacggcggatattgttataataaacagctgttcggtgacggaaaacagcgacaaaaaagcgaaacagcttataaacaggataaaaagcagcgaccctatgaagatagtcgtgcttacgggctgttttccgcaggcttttcccgaaacggcttcaaagctgtcagccgatatagtaacgggtaccgagcataaagacagcattgctgatatgatagacgtttttaccggcaacaaggtaaaacaggttaccataccgccaagacccattaaaaagcaatatgaaaagcagaaaaacgccgatatgggcaagacaagagcgtttataaagattgaggacggctgtgacagattctgcagttactgcataatacctaccgccagaggctctgtaaggtcacgttccttgcaggatataaccgaggaagtaaagtttcaggtatcgtgcggtcataaggagatggtgcttgtcggcatcaacctttcctgctacggtcaggaaatcgggctgaggcttgcggacgcaatagaggcggtatgctcggtggacggagttgagcgtgtacgtttgtcatcgcttgagccggagctgctgacagatgaggatatagcaagaatggcggcgcaaaagaagctctgtccgcattttcacctgtcgctccagtccggaagcggtgctacattgaagcgtatgaacaggcattatacgcctgatgaatactatgatatagtcctgaggctgcgaaaagcgtttcccgattgtgcgataaccaccgatattatggtagggtttgcaggggaaaccgacgaagaattcaaagaatcctgcgaattcgcccaaaaagtcggttttgcggcaatgcacgtttttacctactcgatcagagagggtacagcggcggcaagacgcacagaccacgttgcgcacgatattgccgtaaagagataccatgctatgagcgaccttgcaaaaaagctgaaagaagaatatttccgctcgtgcgtgggaaagacggaaaaggtgcttattcagcgcagggaaagcgaagaatacgcaaacggccttaccccgcagtacgttcccgtgcgcatatacggcagtgacgcaaacaggcaggatataattactgtacaaattacaggagcatcgggcagtgatttttgtgtcggagaagaaataaaatgcttgtaatcgggcagatattgtagtataattaaaaggtattgatagttttgtgcctttacacgcttgcaaaagcctgtggcactatcacaaaaaacgacggaggaagtttatgtcagtttatcgcatttatgtggaaaagaaaccgcagtttgccgttgagggaaaagctgttctctcagaccttaaaaccgcacttcagattaaaggtatcaaggatgtgcgtatcgtaaaccgttacgatgcagagggtatcacaaaggagaattttgaaaaagctactcccaccgtattctcagaaccgcctgttgacgatgtttattattcactgcctgagattgaggctgatgaaaagatgttcgcaaccgagtttttacccggtcagttcgatcagagagcagactcagccgctcagtgtatacagatgctgtgccagggcgagcgtcccacagttaaatacgcaaagctgtatatccttaagggcgatatttcagatgaggatttcactaagataaagcactatctcataaatgccgtagaagcaagagaatgcggctttgagcagtatgaaacgcttgatgtaaagtatgatattcctaaggacgtagctgtgcttgacggatttatcggtctttccgaagacgagcttgccgagtttatcaagaagtacgcacttgctatggatcttggcgatataaagttctgtcaggaatatttcaagaaggagcagagagatcctacccttaccgaaatcagaattatagatacatactggtcggatcactgccgtcacacaacattcggaacaataatagacaatgcgaagattgacgctccctacattgccgaaacttataaggaatacaagctcgacaaggaggagcttggcagaagcgcaaagcctgtctgccttatggatattgcgaccgccgcagtaagaaagctgaaaaaagacggtcttctccccgaccttgacgagagtgaagaaataaatgcctgctccgtaaaaataaccgttgacgttgacggcaaggacgagcagtggcttcttatgttcaagaacgaaacacataaccaccccactgagattgaacctttcggtggtgcggcaacctgcctcggcggcgctataagagatccgctttcgggtcgttcttacgtttatcaggctatgcgtgtaacgggcgcttcggatcccctgctccctgttgacaagacgatccccggcaagctccctccgagaaagataacaacaacagccgcacagggctattcgtcatacggtaaccagattggtcttgcaacaggtcacgttgccgagatatatgaccccggatatatggctaagcgtatggagataggcgctgtaataggtgccgctcctgccgagaacgttgtccgtgaacgcccagtccccggtgacataatcatcctgctcggcggcagaacaggccgtgacggttgcggcggtgctacaggctcatcaaagtcgcacagcgttgaatcgctcgaaacctgcggtgctgaggttcagaagggtaacgctcccgaagaaagaaagctccagagattattccgtgacaagaacgcaacaaagctgataaagcgttgcaacgactttggtgcaggcggtgtttccgtagccataggcgagcttgcggatggtcttgaaatcaacctcaacgcagttcccaagaagtacgacggtcttgacggcacagagcttgccatctctgagtcgcaggaaagaatggcggttgtagttgacaagaacgatgttgacaagttcatcgctcttgcaggcaaggaaaaccttgaggctactcccgttgcgatagttaccgaaaaccccagactcaagatgaactggaacggcaagactatctgcgacatttcaagagaattcttaaattcaaacggtgcggaaaagcacacggatatatatgttcccgctcctgctgtcagctactctacaggcagacacaacactaaggaagaatgggaaaagctcgttacagaccttaacgtatgctcacagaagggtcttgtacagcgctttgactcaacaatcggtgcaggtactgtacttatgccttattctggcaagacacagcagacacccgtacaggctatggcggcaaagctccccgtactttcgggcaacacaaagacagcttccataatggcatggggcttcgatcctttcgtaagccgtcagtcgccctatcacgcagccgctcttgcagtagtcgagagtatggcaaaggtagttgccgcaggcggtaagagcgaaaagtgctggctcacattccaggaatattttgaacgtacacagggcgatcctgagcgttggggcaagccttttgccgcacttctcggtgcatataaggctcagattgcactctcaagcggtgctataggcggcaaggactcaatgtctggtacatttgagcatatagatgttccgcccacgctcgtttctttcgcagtttcaaccgcaaagtcagacaagataatttccgctgaattcaagctcccctgcagtgacatttactacattgaacctgcatacgatgaaaacggtatgcctgactttgacagcgtcaagaaggtatttgctacagtagaaaaggcaattgccgacggcactgccctgtcagtatggactttagctcacggcggtattgcagaaggcatcttcaagatgtcgctcggtaacagaatcggtgcaaagcttaaagctatggacgatgaaaagctgttcggtctgcactacggtgcattcatcatcgaggctaagggcgcaatagaaggcgcagagcttatcggtgaaacggtgagcgactacacgattacggcaggcgatgtcaagctcgacattgcagatcttgagaagaagtatgatgctgttcttgagcctatcttcaagaattcgctccccgaaatgccgaggcccgtatcggttgcttacgataagggttgcgacttacttatcaacaaggctcccggcactattgcaaagcctaaggtacttatccccgtattccccggcactaactgcgaatacgatatggctgccgcattcaacagatacggcggtgaagctgaaatattcgttatcagaaacctttctgcaaagaatatggaagacagcgtaaacgaatttgcaaagagaatcgaggacagccagatgatagctgttcccggcggtttctcaggcggtgacgaacccgaaggctctgctaagtttatcaacgcattcttccgcaatcctaagatcaaggatgctgtagagaatatgctctatgcccgtgacggtcttatgattggtatatgcaacggcttccaggctcttatcaagctcggtcttgtgcctttcggcaagatagttcctctgtcaagcgaaagccccacgcttacatataacaccataggcagacaccagtcacagcttgctcttactaagatttgcaccaacaagtcaccgtggcttatgcactgcaaggtgggcgaggtttacaacataccgatttcgcacggtgaaggacgttttgtagcaagcgacgaggttatcgctaagctcatcgaaaacggtcagattgctactcagtatgttgaccttaacggcgagcctacaatggatcttgcatacaatcccaacagctcgatgtgcgctatcgagggtatcatttctcctgacggccgtgtactcggtaagatgggtcatacagagcgtataagctcggatacctgcgttaatgttgacggcaacaaggaacagcttctgttcaagggcggcgttgactacttcagaatttaacattaaaaccgcataaaatctgccctgcaacgtatttagaacgttgcagggcatttttgtgtgcaaaaatacagagcaggcttttgtctgctctgcgatgcttttacttacttattctttctttttcttgccttatacgttacaggaactgctccgccggcaacagccgctaccgcaatccaggcggcaagtgacgatgcacctgtttcggggtttctctttccgaattcttcgggagctttttcaaacgcacaagctatacactcataatggcctatacccggctctgtggcggtaggctctttatctaccacccacttgaactcgtgatcgtcaagatcgattatattgccattgtcatcaacgtgccagtgcttattctcatcgtgtttccattccttcttaccgctgagcttagaaagtgctttctcctccttgatgccgcaaacgttacaggatctgtttgctttaccctcagatgtgattgtcggctcaacgagagttttccactcggaccagtcgtgtcccttcggagaaatctcctttatatccttccttgcgtcacagagtgaacaatgaattgattcagagcctgctgccgtgcaggtaggttccttatctgttgtgtaatcctcttcccactcgtgagcttccgaatctatatcggtatcttcatattcggtataactgcaaaccttgcattttcttgttttctgaccgcctgcaacacaggtagagtcttttgatacagtccactctcctaatgtgtgatcgcccaaatcgccgttttcaaatacaagcattgtatcatttgtatgcgctccgcattcgcacgaatagaaatacctggcaggagttaagcaatccgcaggagctgcaagcgtatcctcatttacggtctttacatcaaatatatgatttactttattgatttttgcctgacagttcttacaaagattatagtgtccggtaagatcggaataatacagtttaccgtcactctcgtgttcaaccttataactcagcgtgaaacgtgccagagccttatcctgagtgcctgcagacgcatccgcataagcggttctgtctgttataacgatgaaatcttctgtataagttcctgcggctaaattgctgtcgggcttaactgtgaatgttgccgttgcgccctttgcaagctttgaagagccgtcatcggctgtaccccattcattgccggcagtgtatgatactgtgaacgaagaagtatcagttatgtcaccgtttgctttattaaggtcggattcctttactactctgtactttgctatagaaccgccctctgtgactttcagcttaaacatcaaaggcgttgccgtacttccgttatcaaaatctgtaccgaagttaacagttgacacaggattgttttcactgtctgttacagatatttcaacatctttaagacttgcgtctgcggttacaataaggttgcggtcaaccgaaagtgcgatgaattcgcctgtcgtgctgtcgaactcgtacttatcgtcaggtaccgcattaccgtcagcatctgttaccgtaacgcctgagaaacggtattcatcgggatcgttcagagcaaatacaagccttgaagaaactcctctcatagcaaagacatttccgtccgttacggttgtttcattcgtattatttgcctttatgcaatagggcattacatttgtgcgcggctcgctgtcatctattatttcaccgtcaccgatgcggacaatattaagtctgtttgattctgataatattgtgtcggggccggcaacatcgattaaagtatttccgtgcgacagctttattttatagccggtttccgcaatacatttaccgcctgcataatccagcgtatatccgataccgtaagcaggtgtgagcctgcggataacgccgccgttcgtctttgttatctgtgccgcactgccggcttttgttatactgccgtttgtaaatatcataccgttgtcaacagacagagtgcctgctacggaaatatcgccgtaggtttcaataacagtgccgtcagttaccttcgccgttccgtgaccgattatatcgagctttgcattttcgtaaccgttcgcagacaggagcttaaaatcgccagaagtatcggcggcatcggaatcatcaagcttattgacattgagaataccgtttacggcatatattccgcttaccgatgttccgtcatttcccggcttgcctttataattatcctgctgttcagacggtacatgggtatttgtaccggggtttccgcctcttccggctgtaacgttaagtctgccgccattaagatacacctttgtattatcggttatagccacactgccgttaccgccgtcgccgccaacgccataatacgattcatttgtatcgtagttagtgccataacctgcaccgccgcctttaccgccatcgccgccgataacagttacagtgccgcccgcaaccgtgaacgacgaaacatttaccgcatctttgccgtcctcaccgttttctcctttagtcatatcgggaccgctatccgtcataccccacctgccatcatcgcctgtggctccgataaagccaataacaccgcttgcgctttcactctcactataaaaagttattgttgcgtctgtgccggcaataccatggcttacaattacctctgcgccgttcttgagtatgacatttacatttcctttgagatccagaggatttgttgtatagatattaaagataccgtcagccacataccacgtttctttaccggcaatgccccatgcggtatcgtatgaagctatctttgtataatcagttaccgttccgcttataaccgtaccgtctgcggacagtccgtaatagctcaccgcttcatcggcaattgcgtttatcgccgtaaaggacagcgatccgactgcaagcacggcagatgttgctatgccggctatgattctggttgaaaattttcttttcatttgtctctccttatccgagaaattttaaataatgatatgcattactcatctatcatacaattgtaacatcccataaagagaatttcaacaaatatggcacgaacggtcaaaaaatggcggcgaatggtaaaattaccttcgccgcctgactataatgaatgattacttatcaaaaccgagcaatttcttcgttcctgctttttcgagcgcaactgtcagaagcacacctgctataagccctacagcgccctgtattgcgtttccgaaaatgcctgccgccgctgttgccacattaccgtaaagtataatagcataaacgaagtagcctgccaccataattatttctgccacagtgccgccgattaccttgccgacaagcgacttgaaataagagccgttcataaagcactttgcaatgtagaatgccgctactgccataagtgccttgattatcagcgttgcaggcgcataataagcataacctgtaagcagatccgccatcgcagagcctatgcctgccgccgcaactccccacggcgagccgataagccataccgatgtaagcaccattacatcaccgagatttacatagccctttgtaagcggcataggtatctgtaccaccattgtcgcaacacaggtaagtgcggcaagcacagccgccgtaaccattaatgtgagattttttgtctttaccatttcttttatcttctttcttttgtatttggcttatttgccttttttcatatcattagcggagtaaacgacctccgcatagatagccgcaataattctgtacagctcgaccggtatcgtttcaccgctgttgagcattacaagaagcgccgccgtgctgtcgtcacggtaaacgggaacgccgttctcgtctgcgatatttataatcttcttcgcaagctcgccaaggccggacgctaccacgaccggagcatagttaaggtcgggattgtacttaagcgccgccgcagcctgctttcctaaattacgcttggacattaagacccttcctcctgtcaattattttcgggaaaacctcagtcagcacatgaggctttctcagcaccgcagtttcaaattttgcgggcttatagccgatatttcttattataaggtcaatcttatcggtcagcttttttatcttgaagccgaacttttctggataaagaagcgacagattgatgttttcacccagtgcgtacatatctacctcaaaacgtcctatagattcaacgtcaaatgtcaggaacaagtggtaattcttctgtccgacaggcgtgttgttggggttgttctcgtcattatcgacccacagctcaccaaacgcctttgtatcctcaatctgcaacggcaggatataatgtgcaagaggagtgaatacacccggtgcattcagaaggctctgcagaagatttgacgcattgaaatcgtccagcgactgaatagcctcgtgatttatattcttaccgataaaatcggtcagcttatcaagagtagacggtgcggaagggatattgctcgaaggcggcagctccttacgctgtgccatctcatttactatattggtgaaaaactcaaaaagcgtgtcacgctgaggtatatccggcatttcacggagaatctcgttgagataatcgacaagtgccgccatatccttgatcccctgaaaatcacgatgcactgcaggaataatctgtcggctgtcagtgcctgtgagcattgccattattatattcttaagtgtctgcaatccggattgttttccttcatcaaacggcgatgtcagaaactccagtttatctctggacaaatccagctccgaaagatagctttcatcggataaatgcgacttaataaacaaagacagagttaatttttcagctttattgtcaaaaatgcttaaatagtcttgattttcagactgatttagtgtattattataactatcaggaatatccgacatctcgctgagctgttttttgctgaaaatctttttaagaagatttccaaatgcaacagacagttccctacgcatatcatcagacggaatatatgcaaggagatttgcaaagctctccttgagcataccgttgttggtgttgtagcgtgaaagattatgtattatgagcggaatgaacgtctgtgttctttcatcgttcagaagacttgcggaaacgtccttcagcagtgcgagcgtttcactcttgagcggctcgaacatatcagccgcactactgctcttccattgtgaagacaaatcggagagcttacgggagagtgactcgttaggtgaaaaatattcggacaggaatttgagattcgcaccgagtgcattaagtatctcctgcttgtttgacgaatagttgagtgctttcaggagctgaccgatactttcttttatatcggggcttgtggtggtcttcaggataccgtggagcagcttgtaaaactcatcaccgctgaacatcgtgttctgcttttcctggttctgaatctcacggaccagcttttcgggagcaagataaaagcttttgataagttcatccatatcgtcgtaaagctctgtgtaaccgttgatcatcgtctgctcgagcagatccgagcttaacaggttcttgagcgtttcgaccgccatagtgggatcttttatctgaacagtaagcggagcgagattctttctgcccatcatcatagcggcggcggaatcgttatcctgcgccgtagatgctttgataggctgagcaagctcgaccatatcaaacggttctatattaccgtcatactgccggtttgtgaacgaatagctcttactgttggaaacaggagccgtaatctgtggaatgttgggcatatatatttcctttcagatgcacattttaaagccgtgcatcgcattgcttgactttaagtttagcacatttcaagggatttatcaatatcaatcttacgattgcataataaaaaaaatcagggaaaggcggttttgtatatggcaaaggttgaacccggcatggaatctatgctcgaaatgtacatatttgaaaccaatacgttgcttgaacagctcgatgaaattcttctcaggacagaggatgcaaatgtattctcgcaggaggacatcaacgagatattcagaataatgcacacaatcaaaggctcgtctgcgatgatgggatttgaaaatctccagcatcttgcgcacaagggcgaggatatgttctttgtaataagggagaagcccgaaattgcgaaggacgcacattttgtatatgaacttatatttgaggtttccgatctatataaggctgagatcgagtatatacagaattcgggggatgacgactatacgcctaccgacttctcggaaacgttcaaaaagctcgaagacgcaacggaaagattaaaggcaatggaaagcggtgctgctcctgctgaaagcgctcctgctgaaagcgctcctgcggcaaagcaggaagcatctgccgctccttcaggaagcaacgttgagggaagcatgaccgtccgtgtattcttcgaggacggctgtaagatggaaaacctccgtgctttccttctgctgacaaagataaaggaagttgccgaagttatcagctgtactcctcccgatgttgaatccaatgcggatacggcaaaggatattgtcgagaacggcttccttgtaaccttcaagggcttcgacggagacaatgatacggtaattaaagccatagaaggtgcagtcaacgttgagtcttatgagataatagacacaccgtctgcggcacctgccgaagaaaagcctgctcccgcaccggttaaagaggctgcccccgttgccgcccctgcaaagacggaggaaaagccgcaggctcagcctgctcctgcaaagcctgccgcaaagagtgcggtcacaaaggctcaggaggacattaaaaaggctaacggcggtcagaagcatagccttatcagcgtaaatctgtcaaagcttgacacactgcatgatattgtcggtgaaatcataacgaccgagtcaatggtaatagcaaacccggatcttgagggccttgagcttgagagcttctcaaaggccgcaagacagctcagaaagctgacagacgagcttcaggatactgtaatgtctatcagaatggtaccgcttgcaggcgtatttcagaagatgggcagaattgtccgtgatatgaagataaagctgaacaaggaagcagagcttgttcttgaaggtgaaacgaccgaggttgacaagagcatagtagataacctgaacgatcctcttatgcaccttgtaagaaactgtatggatcacggcatagaggacgatataaatgtccgcattgccgagggtaagcccgaaaagggtactgtaaagctgtctgcaaagcactcggcaggtgaagttatcatcaccgtttcagatgacggtgcaggcatcaactgcgaaaaggttcttgaaaaggcaaaggaaagcggacttcttacaaagcccgaaagcgaatatacaacgaaggaaatccagaacatgattctcctgcccggcttctcgaccaatgatacggttacggaatacagcggcagaggcgtaggtatggacgttgtacgcagtaatatcgaacagtgcggcggtacacttaccgttgaaagcgaagaaggcaaaggctccagcttcatcatcagaattccgcttactcttgccattgttgagggtatgaagctgaaagtcggctctactatctttacagtgccgatttcatctataaaggaaagccttatggttgcaaacaaccagctgctcaacgatacaaagcagggcgaaatgataatgataagaggcgtgtgctatcctatccttcgtctgcacgaaaagttcaatatgcctacagaggtcacaaagcttgaggacggtatcctgcttcttgtcgatgtcggcggaaagaatgtctgcctgtttgcagataagctgataggcgaacagcccgtggttgtaaaaccgttcccgaaatacctcagccagtacaatatcaaggcggagggtctgtcgggctgtaccgtaatgggcgacggcactatttcgcttataatcgatgtcaacaatcttatcggctaaggaaacggaggctttactttgtcagagaattataatgataaattacaggaacttctgaatactcagaaagcaatggaggacgcaaagaaagatcctcagaatacagaaataactaaggtactgaccttctatatcggcgagcaggtatacggcattgaaatacctgatgtcatcgaaatcattgaagtgccgcccataaccgccgtacccggcgtaccgtcttatatcaagggcataatcaatgtccgcagtaagattgttcccgttgtgaacataagaagcagattcggcaaggaagagattcctttcaatgaccgcacctgcataataatcgtttcgacaggtgatgatgtatcggtcggacttatcgttgacagcgttgcggacgttattcccgtaaccgaacagcatatatcaaagacaccggagcttacaggtgtaaactcgaataaattcatcaagtccattcttgaaatgaacgatggaataaagctcgtccttgacgtttcaaaactgatagacgaacacgcaagcgaagaaatgaagtaaggcaggtgagccgtaatgcttaaaataacagataatgaattcaaccgtctggtatcattcatgagagagcgctacggtataaacctttctcacaaacgcacacttatcgagggcagactcggtaatatgctcgttgagcgaggattcaaaaactatgacgagtatcttgactgctgtatgaatgacagaagcggtaaagagcttgacggtctgcttataaagctgaccacaaatcatacttattttatgcgtgaaccggagcattttacttaccttacaagcaccgttcttccgtttataaagcaggccaacgcaaaaagcaaaacaatgcgtatatggagtgcaggctgttcaagcggagaagaagcgtacactacggctatgcacataagcgaatttctgggcagtgaaaaatcctcgtgggatacaaggatactcgctaccgatatttcgctgaaaacgcttgcaggcgctcagaacggcgtatatctggaaagcggacttacggatctgccacccggctggcttgagaagtattttgacaggatagacggcgaaaaatgtaaggtaaagccggcgcttcgcaacgaagtgattttccgcacgttcaatcttatggagccgataccctttaaaaaagctccgtttgatctgattttctgccgtaacgtaatgatttattttgaaatggaaacaaaactggctttagtaaagcggttttacgatgtgttaagaccgggcggatacctgttcatcggtcacgcagaaagtattccgagagattcaaccgattatgaatatattaaacctgctatttaccgcagaccgcttaaataacggctttgcacaatatgacggcataatgccgcagacggaggtgaggttttgcctctacgcatacttataacaggaaccagtgcagctgtaagccaggtcacaaaaacgatcatcgaccgcagtctgcataactgtagatctgaaatagttgactataaacagctttctctttctgccaaaaaagcagactatgattttgccgttataaacgatctgatggcggatgtatattatcgtctgccgtcggcactgaacgatgttccgtcggtgctcataaccaataatgacagaatactgaatgacccgaagcgattcgggctttttggtgcaatcaaaaacacaagcggcggtgcggcgggtcttgttgcttttgaaaaagagctgatagctatcatcaataacggcactcataatacgctcgagcgtaaatctgccgataaactgcattttgataaaatcatgcaatcgcccgacggcagcgatcctgctgttcttttcaaaaaaacgacagcgccgcagaaaaacaagcagagcgatataatcagaccttacagcaacagcggtaagattgaaatgatagcgataggcgcaagcacaggcggcacagacgccataatagaagttgtgcaggatcttcctgcggatactccgcctatcgtaatagtacagcatatgcctgtcggattcacgaaaatgtacgccgaccgccttgaccgcatatgcaagatgaacgctaaagaagctgaaaacggcgacagactgcaacagggtcttataatacgcggacacggctcggaactgctagagctacacagggaatcaggtgggttatatgccgaaaccgcctttacaccggatgtgcctaacggcgaggtgaccgtcgaatttacctttgattccaagtttatcaaggcagataccgatatcgtagtgtttgagcgcctgtacaaagacggaaaggagcttgccgtccatgcggatattgaggatgaaggacagacggtaaaggtcaaggtgccggaaatcggtaccaaagcctctgtggatggcaaaaaggaaatcaccgccaaaggcacgattaccgtcgaggacattgtttcctataagaacctgactcccggcaaggagtacactatcaccggcattctgatggataaggctgcgggaaaaccgtttacagtgaacggtgagcaaatccgcagttcctataccttcaagcctgaaacggcagacggcgaggtaaagatgacctttactttcgacgccagcggcattaccaaaacaacggaaatcgttgtgtttgaatccgtttcctgtgacggagtggagatcgctgtccatgcggatattgaggatggcggtcagactgtgaagctcatcccgccgacgcccgatgttccgcagaccggcgacaacagcaatctcggcttctggatcggcttgggagccgttgccctgggcggccttgtctctgtcggaattatggcgatcaagcgtaaaaaggacgatgacggcgaatgatgaaaaaggtgtatatctgcgctcctctcggcggcaatgtccatgaaaaccttgaacgggtaaagagatacgccaaatatgcgctgctgtgcggtacggctccggtcgtaccgcatttctatgcgctgtgccttgatgacagcaagccgaaggagcgggaaatcgggatggcggcggggctttccctgctgtggttctgcgatgaactgtggcagttcggggatgaggtgaccgagggcatggctgccgagcttcagttctgtaaaaacctcaatgtgaaaacccgaaagattcgggaaacagaaattcaaaaattgattggaggaaatcgcttatgaaaaagaaaacaatgagaatcctgctctgcgtcatgatgatggcgattgtggttacggtttccgccgtacctgccttcgccgcaggcgatgtggcgggcgccattgaaaacacatggaatacggcgcagtcgcagattaagacagtagtcaacaatgtggtatttcctgtcattgacatgatccttgctatcctctttttcgtaaagctgggaacagcgtattttgactaccgaaagcatggacagtttgaattcagtgcgacacgttcctaactgaaaaggttaggcacaagttgcgtaatataatcgaaagattgaaaggagctttcagaaatctacgcagttcttggagaactgatattccgacaggtggaatgacggagtaacgccccgaaacgcctgccttgatactacggtgtgcattcggtataggtaagaataccgtttgtgcaaagcccgttgaagtcggcagagagtagccctaccattgcaggaatgcagatgaggaaagcggtctggaggcagattgtgctacctatatgccggaggtctatatctacctatggtgagaatgtgaaaagtagcgagttcactgacgaacaacccgaatgaaggagtctagacgaatggtgcatagaaatgtgcatacgcccacagtggcgggtatgtgaggtaaagtaaaactcgaatttatgaaataccttgtgctgttacaggcagcacccagcatacaggcttagagggacacctaagggtagattttatgataggaatatcggaacgtggaaaggtcgaaacgtggagtgattacacacaatgaagcgtttacagggaaagcagttttgtataacctgtatttattcggctgagagcagagccatagtacctatgaagcggcgataacaagccgtggagggataggctcaagtcgttaacagtaaaaacaagtaaatatacaaccatcaaaggttcgagtatgactaagaaaagcaaactctcgctaagggggtatgctgactttgacaaagacaaagctaccgaaaatctccgccctgcgaaacattgaatactatgattttcaagaggtgttggacaagctgtatgcagacagtgaaaactccaaagagttcaaaaacttaatgggactaattacaaatccgcagaatatactgcttgcctatcgcaatatcaagaagaacacaggaagcaaaaccgcaggtgtggacaagaaaaccataacccatttggaaaaatgggaacctgaaaaactaatcggatatgtgcaaaaacggctggactactatattccacaggctgtccgcagagttgagatacctaaaagcagcgacccaacgaaaaagcgtccgcttggtatcccgacaattatggacagactgatacagcaatgcgtgttgcaggtgttggatccaatctgtgaagcaaagtttttcaagcgaagcaatggctttcgccccaatcgaggtgcggaacacgccatttcacaggcgtataaatttatgcagggacagcacttgcactatgttgtggatatcgacataaaagggtttttcgataatgtcaaccacggcaagctgttaaagcaaatgtggacactgggcatacgggataagaaactactctctatcatttcagcaatgttaaaagcagaggtcgcagggataggttttcccgaaaaaggtacgccgcaaggtgggatcatttcaccgttgttatccaatatcgttctcaacgagttggactggtgggttgcctctcagtgggagaacatccctacaagatttccatacaaatgcagaacgctgaaaaacggaacgcccgacaaaagcaatgtctatgccgaattgcgtaataccaacctgaaagaatgctatattgtccgatatgcggatgatttcaaaatcttttgccgaaacaggaaagacgctgtaaatatgttcacagcgacaaaatcttggctgaaagaccgattaggtctcgatatcagcccagacaagtcgaaaatcgtgaatttgaaaaagcactattctgaatttctcggcttcaagatgaaagttgtccgcaaaggcaaaaaggcaagcggacaggcaaaatacgcagtccaatctcatatgtccgataagtcaaaagcacgcatcaaaaagcaagcggcagaagcaatgagggacatcaagcaccttagttcagacgaacaaaagaaaacgatagtccgttataactcactggttatggggtggcataattattacagatttgccacgcatgttagcctcgatttctcagaaatagctttcttagtcaaaggttccgtgaaaggaaaactcgaaaaccaactcaaaaagagcattgcaacgcctttgaaaagtcctgtgtatatccattacgcaaaaagcaaagaaatgcggtatctaggcaatacgcctattataccaattgcttttgttcagcataaaaaccctatggataaaaagcgggtaatcaacaagtacacagtcgcagggcgagcagaaatccataaacggctggaaaaggtcaacatgagcattctgcattatcttatgcgacaccccgctgaaggaagcattgagtacaacgataacaggttgtcattgtactgcgcccaacaaggaaaatgtgctgttctgaatgttccgatggaaataagcaggatacattgccatcacaaaaagccaatggcgcaaggtggtaatgattcttatggcaatcttgttcttgtggatttaagcgttcacattctgatacacgccacgaagcgagaaacgattgctatgtacaaagggattcttaatctgaacaaaaatcagatggaaaaggtcaacaagctcagagccattattgggttggaaagtatctgaaatagatttgtctttgaaattgtgtaaattaccttaatcgctgttgacgatggaacgccgtatgaggggaaactctcacgtacggtgtgaagtgggggaaaatccggaagatgcaatatgcggctccgccgcatattgcaccaaggattacctatcactatcggctccggcaatcctttttgcctgcttaatcttcaccttgacggctccgctgtatatctggtcgattttataaaaatatttatccgcaaagcctctggactttcgcagtcctttccggtattgtgttgtgtcgggaaacggaggtgattctatgaaaagtttgctggaagatctgtactatcagaagttcagtctgaaaaacgacagtatagaacatcagaaaaggctgtgtgaagtctcttcattgatagaccgtaatgaaggaaaactgagagcacagctaaacgctgaagaactggaactgttcgaaaaatatttcgactgtatagacgaaatgaggtcgcttgaatgctgcgatgaatttctgacgggattccggctcggcggccgaattgtaatggaaatcgttttcggcgcggataatttacagcttcgggattaacaacacaacaacagagcgaacggcgaaagccgtttgctttgtttggaatatatggaggtgatgacctatctttgattggttaggcgatattttttcgggaattggcgacgccatcggaagcgcctttgagtttcttggcgaacagatttccaatgccatctggaacaccatgctccaatggttttatgaaaccatatacggcgctgttgcggatttctttacgacgatgggaaacatgggcgcggatatcttcggactcgattgggtgcaggccaccattaagctgtttactctctttgggtggacactctttgtggcaggcacggtggtcgccgtatttgataccgccattgagtaccaaaacggcagggcaaccatcaaaaccacggcaatcaatgtcctgaaaggcttcttcgcctgctccctcatcggcatcgtgccggtggaactgtataaattctgcatcagcctgcaaaacaccttttcccacgacctgtcggcaatctttgctggcggcagaagcattgatcttgccggtgaaagcacatccgtattggagggcagcttcgctgtagcaaataacatcagtattaacctgttcaacattcttgctatgatcgcctttgcttactgcgttattaagatattttttgcgaacatcaaacgcggcggcattctgctgattcaaatgtcggtgggcgcactgtatatgttctccgtaccgagaggctatcaggacggcttcaaccaatggatgaagcagatcgcagccctgtgcctgacagcatttatgcagacaaccctgctgttcttgggacttttaaccttccccggcaatatgctgttagggcttggcattatgcttgccgccaacgaggtaccgaggattgcccagcagttcggacttgatagttccgtccgggtcaacatgatgagcgtagtccatgctactaccacggcagtcaacctgacgcgcagtgtggcacgggcggcaaaataaatacggcttttttgttaagtttcgtgtatcctcttgacattatttcggcgtaccgatataataataacagagaggatgtgatcggaatgatgatcgagagcctgctgaaaaagcgaaacatgaccaaatatagattagccgtagatgcgggaatcccgcacgctacgttaaatgatatctgcagcggtaaaaccaagctggaaaaatgctccgccgaaacggtgtataagctggcaaagacgctcggtgtgtcgatggagcttctgactgccgagggaatccatcaggcagagcgggaacgctcctatgagtatggtctgcctgcctatttgcagcatgacttggacgcatataaggacgggctgaaaagcaaatcgccgctgcttgactgcctgtggggtgaactgtatggcagcatcaatattgctgagattaacgacggtgcgatcacaaaggaacacgcagattatttgagagcaaaatacctttaagggagtgagaatgaatggctgaaacaatagattttacaaactgccgtgtggtactcggcaaagcgtataacggagcgaacggaaaaaagatcgctgtggaatatagcggcacgctgtatatgctgaaatttccgccctccggcaagaataagcctacagagctttcctacacgaacagttgcttcagcgaacatgtcgcaagcagcatcttcaatctgatcggcgtcaaagcgcatgaaaccgtacttggaacctttaaaatcggcggtaaggaaaaaatcgtctgtgcctgcaaggactttacggcagacggaaaaaaattctttgatttctgctccatcaagaatacaattctggaatcggattcaggcggcacaggaacggagcttgaggacattctcgatacgattgaaaagcagcagtatgtatctccggaggatctgaaaagacatttttggaatgtgtttgtagtggatgctctgctcggcaatttcgaccggcacaatggcaattggggctttctgttcgatgaaagtacgggagaaacaacctttgcgcctatctacgactgcggaagctgtctgttgccgcaggctgatgagaggatcatgaatgaagtgctgacaaatgaggatgcgctgaatgcaagagtttttcagtatccgacctctgcagtcaagcaaaacgacaggaaaatcaattaccgggatttcttaatgagtgctgagtatgatggctgcaatgaggcggtaaagcggattgtacctcggattgatatggacgaaatcagtgcgtttattgacggagtgatctatctgtccgatctgcaaagaaagttttacaagcactatatcaaggcgagatatgatttaattctcgctccggcttttgacttggcagtcagtcttgaacaggagcaggctgatccaacaataggaatgtaacaacagaatattgtaacagaggacgctgaacagaccggcgtcctctttgttttgcaagggagtgaagcagtataaaagaaaacaaggaattggaacgctcagatatcgccattgaccgggacatagaggtagactgcgatatcgggcaggaaattacggtgtatatcgagacttggtttgatgtggataaaaagttcggtacgcatacagccgacgatgacagcacatgggtaaacctctatgccgcatacaatccattttcagattcactgatggtcggatatgaaatcgattatgaaagcgatccaagtgaatggcatgactatgagccgactgcaggcgaggcgcagctcattaaggatatgattacagaaaaaatccgggagctgtacgatcagacgccaatggaattctgcggcttgggtgaagatgtctatgtgtataaaagcagtgcctcgctctcttcaaagaaggctgaagaaaaggatttaaggcttcgggcataccgcaaggcaaacggatatgagcttggcggcggcatcagcatatcggcgcccatgagtcagtgcggcgctgagtttcaacgcatgatcgattactgccatagccggagaatctccaaaatattggtggacagtatgcgcgacattggcaggacgcttgacgatgcggcaaaggtgatcggcattctttgcagtcagggctttaccgtagagcttgctgacagcggcatgatttatgaaaatcaggaagaaacgcaatcggaggaatccgatcaaggctttacgatgggaggaatgtaagtgacaacctatctctatccgcagaatctgaaggctacagctaatctgtggctgtggggactgcgggattttacgattttatgtatcgccgcactgctatcggtagtggcgctggtgcagcttggttttttcattccggctgcggcaactctgtgcttcggctttctgacgatccgcatggacgataccaccgtcctcgatttcatccgatacgctgtgcggtactttatatcaacccagcaatactttgaatggaggtgagcctgtggcaaaagcaaaagaaacccggcagaaaaagaaaaaaggacgctctacacaggagctgatcgggattaaaacctttaccaaatacggtctggaaacggcaaagggcgaattgctcttttaccttgtttccccgaccaacatctcggttttatcccataccaatatcgaaatcaaaatccgccacctgatgatggtgctgtccgctatccctaatgtggaaatcacctgcaccgactcctgtgagtgctttgacgataataaaagctatctgcagatgcggctctcggaggaacagaacccgaaggtgcggaaggtcttgaaaaaggatgtggaaatgctcgatcatgtgcaggcggaaatggcaacggcaaggcagtttttgtttatcacgcgctgcaaaggcatgaagccggagcagatctttcagactgtcaaccgcaccgaaaaggtcatctccgagcagggcttcgaggtgcagcggatgaagaaggccgagatcaagcgcttccttgccatctatttcgaagcttctatgaatggggatcagatgcccgatacggatggcgaacagttctatgaggtagacgatgacgaggaaacggaagattagcacggcgatcgtttctgttctgctgtcggcgcttctcatcatctccggggttatgatttaccgggaactgtcctcacggcagaaagaaaaagaggattttgacgccctcgcagagctggtggaaatgccggtgacaaatccgcccatcacatcggagccgcctgcgggaaccacagagccgagcgaaaccacagaaccagaagaatctctgcgggatctgtcgccgctgtttgagcagaacagcgaatgcatcggctggctgtgcatccccgatacggcggtgaactatcccgtgatgcatacgccgagaaatccgcagaaatatctgcgcatgaatttctacggcgaatacagtcaaagcggcgtcccgttcctggattatcggtgcagtcttgacagcggaaacctgctcatctacggtcataacatgaaaaacggcacgatgttcggagaactgaagaattacaccgattcatccttctgtgccgatcatccgaccatcgaattccagaccgcagacggtctgttctgctatacggtatccgaagtaaaaatcaccgatacctcagataagtggtatgaggatatcggcggtaaactgtttgaggataagcggcgccttgtcctctccacctgttacggaggcggcaacggcaggctgctcatcattgccacagaagtcaattaatcaatattcaataaatcagtcgttttgcagacagcaaggcggctgttttttatacccttctgtctgcgaggcggcagacaggaggtaattcaatgttcaaacgaaaaccaaaggtactcacccctgcggaaatggaggtcatccgtacaaaggacttttttgactgcattctccccagcacggtgaaatttctctccgatcattatattctcggtgacagctatcgctgtgtgtgggtaattcgggaatatccgccctctacagaggaacaggcgatcctctcccagcttgccgaccgcagcggcgtaacgcttcgcatctatcacaggctggtagaaagcatggagcagcggaaaatcattcagaacgccacccgtaaaaacaagctcatgtccggcggcaacgatgtgaacgaaaccattgaagcggagggcaatctgcaggatgtgatcgagctgcttgccaacctcagaaagaacaaagagccgcttttgcattgctcagtgtttattgagctgaaagcaaggaatatggacgctctgaaagagctgcaaagcgaggtcgcaatggagcttactcgttccaaaatctccgtggacaggctgacgctccggcagaaagaaggattcctctctgttctgcctgtgggcgccaatcagtttggagcgcaatatgagcgagtgctgcccgcatccagcgtggcaaatctgtacccctttaatttcagcggcaagaccgatccgcagggtttatatatcggaagggataagtacggcacaaacatccttgtggattttgaccgccgcgcagaggataaaaccaccagcaatatcctcatcctcggaaacagcggtcagggcaagagttatctcctaaagctcgtcctgaccaatctcagggaatccggcaaatcggtgattgtgctggatgcggaggcagaatacgaggatttgaccgaagccctcggcggctgttatatcgattttatgtccggcgagtatatcgtcaatccgttagagccgaaagcatggagcgatggaaacgacggcgacagcgatcccaatacccctgccgcattccgcaaagtgactcgtctcagccagcacatcgcctatctgaaggactttttcagagcctataaggattttaccgatgtgcagattgatacgattgaaattctgcttgccaagctgtacgcccggttcggtatcacagactccactgattacagcaagctgaagcccaccgactatcccatcatggaggatctgtacaagctctgcgaggaagaattcatgacctacgacagaggaagaaagtacctctacaccgaggaaactctgcaggaggtgtgcctcggcatccactccatgtgcgtgggatcggaaagtaaatactttaacggccacagcaacattaccgatgacgccttcctgtgcttcggtgtgaaaggactcatggataccaatcgcaggctcaaggacgctatgctgttcaacatcctttcccacatgagcaaccagctcctcggcaaaggaaatacggcggcagccatcgatgagctgtatttgtaccttaccaacaaaacggcgatagagtacattcggaacgcgatgaagcgtgtgcgtaaaaaggattcggccatcctgattgccagtcagaacatcaacgatttccttatgccggaggtctgcgagctgacaaagcctctgtttgccatccctacccatcagttcctgttcaaccccggctctatcgatgcaaaagccttcatcgacaccctgcagcttgaacccagtgaatatgagctgattaaatatcccgaaagaggaacctgtctgtaccgatgcggaaatgaacggtatctgcttcaggttatcgcgccggaatataaatccgtcctcttcgggaaggcaggcgggcgatgagcgccacagttgccgccgccttaaagaaaatagccgtagccatccttacgaatcccaaagtgctgaaaaccatcggcgggattgttctcggcatcatcattattatcatcatgcccattgtggccgtggtgtcgatcttcaatggcgatattgaaatcgacaccgaccgtctgcaaacgatggtggtggagaacctctctgccgaggaacagcaaaagctgcagtttgtagaggacaccatgtattccattgaggatgaaatgaaaaccgcaggctttggcggcaaagtaaaggaagcacaggtgctttatgtgcttgcgctctccgactatgcttcggaggatggctttgtctcaaagctggtcgggtgctttgctgaagatcagacagatgcacagcttatctcagcggttaactccgcattcggcacgcagcttaccgccgaagatttcggaaagatcatggaaaatatccgtgctgtggcaatcgacctctccggctacaccgatcctgctacaaagaataatcttgatcttgtgcagtgggcaatggaagcacaaaaagctggatggggctatgtgtacggaacctacggtaatgtatttgatcaggcgatgtttgattttaagctggaacagtacccggacgaggtcggcggtcatgaggatttcatccgtcagaattggctgggcagacggactgcagactgtgttgggctgattaaaggctatggctggcttgatcccgaaaccaaggaagtcaactacggtacaaacggtatgcccgacatcggtgcggacgccatgtatgaatatgcctcggaaaaaggaacgattgataccatccccgaaatccctggtctggctgtttggcacgaaggtcacatcggaatttatattggaaacggcaaggtcgtacaggcggcgaacaccacggcgggagtgatcctgactaatcttagtgacacggcatggacgcactggctgaaagttccgtatatcagttatgttgaagaacaggaggaaacgacaggatgaaaacacacgaatttataaccactatgcgggatgatctgcactgccaagaagacagcacaattctcgcatggcttgcttttacaggagaagtggcagacaatacggaatcggactatgaaaacgagttagatgaaactatgcgggcgctgtgtttcgtcaagaataattttaatgcggaagttctgcaaaaaagccttggctttcaaacactggcaaacgagattatttatggagccgctatgtttcacgcaggcgcttcggaggaaaaggttagagattacgcgatgaacggaatactggaatgtggatatatcccatcgagctttgatgagatcggcactctcacattgatacaacttggagattcaaaagatcaagtattcattgcggagaacgagccatacagcatagtgctgaatacggtcggacaggtagcccgtgaagcccgacaatcaggaaaagcaatggatatcttgctgaaaagccatgccgagacaaatctgcggctgaatgacctttgcgggtgtgccattggcagctatatgatgagcatcttttcaaccacatctgctgtcggcaatcttatctgctgtgatcctgaaaccctcgatataaaggaaataccctgtccaatgttaaaccgacaggaaaatacagaaaaaacagaagaatcgaaagcagcaaaatttctgcttagaaaaaaggtagaagacaactttgcggagcttaaagaaaagtggatgcagatgctgcctgcagaactgatagaacgctgcgaagaaatcgaagcaagcatacgaatggtggagactcttccttctgccgtgtcggacgaggatgcagaatatctgctccgcttcaaaaatccgcttgaagtgatcagcagcgagtggattagcagaaacggcatagatgcgtttgttgtggatgatgaaatgagccatctgctgtgggcgctgcgggatcgcagcgatgcagagcagttctatgaaatggagccggagtcctcagacgaggatgaggctcccacattgtctatgtagaagaggaattaggaagccaaatatgtctgaattgataactttctttttggccgttgttttcgctggacttacagcaaaaggtgtggcattgttttggtgcgccgaaacaggcagaaataaaaaaggagcgattctatgttagacgaaaacagcagacagaacatccgcagacacattaacacgatctgcaagactgccctcgcagtgatagaggttatgggaacagataaggaaagcgacctcgttgaccggcttgagcaaactgcaggcgctattgcctcacactatgaaatggagccagaactcatggaggaattccacaccgttatcatagcagcgagaaaacgaacggatctgaacgaggaaggtcttcagtttattgatgtagaacaggcgaaggacatgatctatgcgctctgcgacaatcttagcgatccaaaagacatcatgcgctatgtgaggacggcagacgaaatgatggcagtatgggaaaccgagtaaacagtgcaaaggtaatacgcaatattctaaaacggggcggtcgttttcgaccgcctcaatttgtacagaaacggaggacactgaattgagatacagaggatttgaaatcacctcctgccccgacagcggcgtggaacggtataacagcgctgaaagccgggatgagctttgcgagggatttttttgtgagatatacccggcaggcgatgatccgtacgccaatcagcttgacaccttctgccttgcagaaggatatgaaatccccgacacatcggatgcggcgctcaccgccggaattataaaacatgtagatgagaactactatgaactattggaatccaaaaatgaagtaaagcggaaacgaatggaggaattggtgggcaggctggtgtgcttgctgggtgaaagcgaaaatggtgcggagctgtacaatatgctttccgaaaccattggtatgaccgatgaggaaatccgggaggtcggctttcaatcccttgcaccgttctttgaccgtgaccaatacgcccagaccattgccgactggctgattgaggacggaacggaaagcaccatctccggcaggtggagtgccccctatgggaacatcggaaagcgctttggagtggatctgcaaaccgatgctgatctgcggaatatggtcagccactatctttatgacagctcggacatcgttgcagatttctgtatggagcaggacaaggtgacgcttgatttcttttattcccattgcccctatgtccatgaagatgaaacggaaaacgagagcgtggaacagaccatgagttaggagtgagaaataaaatgcacattacaacagaaaacaaaaaggaatacctcatcagcgaggtgctggagcttgaccatgacgcttacgccgactacagaaacaggatgcggaatctgcccgattcgatgaaatccgaatatgatcccggcgtggagcatctcttcctccttgtagttggcgatggttacaaggacggagtcattgtagatttttccggcagagcctatgaaggcatccctgcttttgctgataacgtacgaagccagcttgaaaaccatatccgtcgccttgcagattactgtgtccgggaaggtacggagcataccgaggacggcaaatggtcggtcagctatgatgagctgtattaccatttcgacagtactaccataacgagccgcaatggaatgggcagattgctctgggaggaattacagcagagagaagaaatcaacgagctgatcatgaccgaggactgcatcgaaatgacctaccacatggaatactgtgagaactgtcaggagggcggcatcaagggcgcgatgagtctcttttctctcatgggctgcaacctctatgatgttcacctttgcgacagcgatgaagatcacgagctggcaaccgtggtagaactgaatcaggatacgctgacggaggacggcaggcgcgaatggtcggatgtgctttctgcaagggtaacctccatctatgtgggagccttcggtgtgcagatcgggctgaccggatgtccggcagaacggcttcgggatttctctttcatgctggcggggcattgttctgaaaaggagtatgaacgctgggtaaaacaggatggcaaggagtacgctgccgcaaaggagcagagccagcctgcagtcgatacccggtacagcgcggatctcgttgccacctacgaggaactgatgaaagttccgggcgaagaacagattacggcttacttcggagactacggcctgcaccatttcaagtacggcgttaccgagaagcaaatccgtcctgtacacgatagggtgctgggtgccatcgaaatggggggaaacgatttctggagattcacaaagcttccggcaggaatgaatatatcgaaagattatgctatctctcccgaatatgaagatacatcatggcagcctgttgaacttccgcatacatacaattccgaagacagcacaggcagaatgacagctgcagacgatggggactactaccgtggaactgtatgctaccgcagaaaccttgcgctgagttttgaagaatgcagcggaaaagaactctatctggaatttgaaggtgcaaatactgttgcggaagtctatatcaacggcaggtttgcaggagagcacagcggagggtattcagcattcagatttgatattacggactatatatacccaagcaaagacaatctgatagctgttatcgtatcgaatgctcccaccgattatattgcaccgataaccgacaatggcgatttcacaaaaatgggcggcttgtacaggggtgtaaagcttattgcagtcgagcctgttcatattgctctgaaagacagcggctcctgcggagtatatataaccccacgcaatatttcagaaaaatctgcggatataggcatacttgtcaagctggataaagccgaaaccgcagaggctaaagctgtgatatatgatccgcagggaaagcctgtaacagagtttttcggcagagcggacaaagacaggataacgctttcgggaaaaatcaactgcccgaaactctgggacggagtaaactctccctctctttatcgtgcggagataaccttattctgcaacgggaaacccgtcgatagcattgaacaggaattcggaatacgctcgtaccgcatagatgccgataacggatttttcctcaacggaaagccatatccgctccatggggtgaactaccaccaggacagttacgaatccggctgggcaatgactgacgctcagcgtgagcgggattatcatatcattcgtgacatgggctgtactgctgtaagaatggctcactaccagcattgtgaccacgaatattcattatgcgacaggctgggtctgtgcgtttggacggagataggcataatcaataaaatgtctgccgatgacagcgacgctcatgttctttcagacggctttggaaataacgcaaagcagcagcttcgtgagcttatcaggcagaattacaatcacccgtcagttattgtctggggattgtccaacgaacttcaccagatgaccgatgaaatattcgggctttacagcgagctttatgaaattgcctgcaaagaggatgatacaaggctgaaaacctttgcagacaatcagttttacggcagatttctggagcttcctgccgatgtggtcgggtataaccgttattttggctggtataaggaggcaggcagtgcggagaatttcggcgaatggcttgatctataccataacgaaaaggaaaagcgccctgtctgcctttccgaatacggcggcggtggggcgatttcgcagcacaaggataatgtagattgggaaagcgacatagaccctgtcggagtacggcattatgagaactatcagtcgcagctgcacgagatattgtggaaacaattctcggtcagaaagtacctgtgggccgaatttatatggtgtatgttcgattttgcgtcctacgggcgaacagagggagatacaaagtcgctcaacgacaagggactttgcacaagggagcgtattccaaaggacgtatatttcttttacaggtccgtatggagtagcgaaaaaaccgtttatataactgaacgcaggcatgaattcagagcttgtgatgtgccttttgtaaaggtatattcaaatgcagacgcagtggagctttgtataaatgatgtttcgtacggcagaatatcccgatgcgaacttcccaatgacgagagcactgttttcgtgtgggaaaatataaagataaaacccgacacaaaaaacaaaatatgtgctaaagcatatttcagcgacggaacatcaagaaccgactatgcattctggacaggtaaataaacgtgtctgtatgtttttatttatcataatagaggtcgattatgaacgttgttattctgatgctcgctgtaacagcctgctatacaatatgctcgttgaatgacaaatacgccgctgccaaagccaacttctccggcgatgaatttacatttctgatgtgctcgtcgatgtcggtgttccttgctttaagtctgccgtttcagaatttaagtttcagcttgacttggcagtcatttctagcggtattactggttgtggtgtgcaaaatgcttgaattccagatgagcgcacgggtgctgaaacagctttctgcttttgagctgaaagcgtggctcgggataaccctgtttgcgtcttatttcactgatattcttttcgggtctgaactcagtgttttcaaactgatttgtatatttgcaacagccgcaggccttgtatttattgcaaagtcgtctaaatgtggcagtgtaaactataaacagataattctgccattggtgctgtatcttatttcaaaatatgggtatgggcttattataaggagtttctcttcgtatgcttcatcaacaatgcagcttcttccggctatggtgataatttcgctgataatgctgccgagagttcatatcagggagcttattaagaataatcgaagcggcgttgttaaggtagtgcttgccagaattcccaatacgctcggaatgctgcttgaaaatgcggttatatctataagccttgcaaattactcattcattcagccaatgatccttgtaacgcttttcgtgataggtctgatccgcagagaaaagcgttcacggctcaatttaatcggaagtattatctgcatcgtgggcatagtggcttttcagttggcgtaaatcttaaacattctgcgatcactagcacctgaagctagcgcttgtcaagctgcggaacaagttccgctttcaccaaatcgaagatttcgtgctgtggaacaagttccgctaccaccaaatcaaagatttggtgcaattccgccactgctgttttaaaatgtatcagcaataaaaaaacaagccgtatttctacgacttgtcttggtgcaggtgacgggacttgaacccacacgactcatgcgtcactagcacctgaagctagcgctctctgtctgcagaacaagttctgcttccacgaaatcgaagatttcgtgctgtggaacaagttccgcttccaccaaatcgaagatttcgtgcaattccgccactgctgttttaaaatgtatcagcaacaaaaaaacaagccgtatttctacgacttgttttgtctaatcgggacgaaaaagatgtttttgcgttttttgcaggtgaatttgaaccctcacattcttttagcagagcgtttggattacctctgttccgccgacgaagaccaccttgatctgatctttggattctacaactatacattcgagtatctgccgcacaatttggtcatcgtaggtcatcggatggtttgtcagtccttcaaggatggtgaagatttcatcgagccgggatttcgcattttcccgtttttgcttggcgtctgcgatttggtcaagctgatgctgcaagcgattcttttcattcattaatcgacttgctttgtcttcatcgaagctgtccaatgtattggtatctaccgcttggagcatggctttgaattctgcgtcaatctcagcgattcggatttgcagatcgagactgtcatcttcggtatcggctgcctgcaatcccatgccgacatgcagctttagggttttcagcacatctgcattttgctttgccgtttttattatagcacccataatagcttcctgcaatacgctttcctcgatggtcggtgattcatggcaatatttcttgccgtagtcaaggcggttaatgcatcgccacacgattttcttctttccctttgctgtccatgtgcatcggcggtaaggcgttccgcattcaccgcagatcagcagttcggtcaaggcgtatttactggaatatttgccttgctcggttttcgtaccaacctgcttgactttgcgttttccgttacgccgcgccaattcctcctgcactctgccaaaggtgccggagtcaatgatggcgggatgattgttctcgacatagtatttcgggcgttctccattgttgaccttgacttttttgctgaggcagtctgcaatgtaggttttattgaggatggcgtcgcctttgtatttttcattggtgaggatcgaggcaattcttcctctgcgccattcaccttcaccggaaggcgttggaatcccgtcggcgttcagattatctgcgattgtggcaaggctgtcaccggcaaggaaccgttcgtagattcgtctcacaatttccgcctgttcgggatcaatttccggcttgccgtcttcacccttgcgatatccgagaaagttcttgtagtggaatggtacattgccttctttggcgctctgtgctttgccccatttcacattggcgctgatgttttcggattcgctctgtgcgatggagccgtagatggtaatgtaaaactcggcgccgggctgggtgctgtgaatcccttgttcctcgaaaaatacatccacgcccaagtccttgagcattcgggtgtatttcaggcagtccacggtgtttcgggcaaatcgggctactgacttggtgataatcatgtccaccttgccttgcctgcagtgccgcatcagcttgttaaactcatcacgctttcttgtgcttgttccggtgatgcccttgtcagcatagatacctaccatcgtccatccatgctcaccattgattttatccgtgtaagctctgcgctgaacttcgtagctgttgagctgatcttcctgcttggtagatacccggcagtaagcagctacacgagtctgacggtaagcgtttttgatttcttcctgtatgttgactgccgctgggataatgcgcacaactttaggcagcatcggttgggttatggctgcttgcatggtcttcattctcctttctgatgatttgaccgttgatcagcgtaaggcatacgcttctatctgtgttcagtgtgatggctttgaccgttcttgccacaaggctggcagaaaaatcagaaagcgggcttgctttctccaagtccgctttcatcttctttatggtataggtggtatggtcgatgcttttgtatttgagcgagaggcagcggagcattttccggcgcagagcctctttatcaaactctacgctgtcgagcgttctgccgatctcgttttccgttttaagtatctcaatatcggattttatttcggtatccgccggtattttaattctgtcgggatcagcgattactatgttcagcagttccgtaatttgaggaaggagattttcatctgcgacgacgatcagctccccgcattcacgattcgtgcagaaccatcgctgattgcatttgcatcgactgtcgtgacggcgatgcatctctgctccgcacttgggacagaggacgggcgtttccaacttgtagatatcggtactgcggtcagttcctttctgtgtgttccgactcatcttggtgctttgaattgcttcatagactgcttcgtccaggatgacgggataggcgtctgtgccgaggtatcggcggtcttctaaaatccgcataagtcttgctttgttccaaccggtcacaccgggcatatactcaaccgcctgttcattgagctgctttgatatcgtcagcaatgactgcccgccaagataggcgccgcagattgctttgactgtttccgcctctgtcggatttacagtgataacgccttccgcatactgatatccgaagggtatgtttctgtttttcatgccgagtgacaccgtcctttctcgtcaattttctccgtcagctccacgccgccgatcagcttgaaggtgatctccgcattgctgttcaccgtaatgctttcaacggtttggctgaggatttctgcatccggttcatccgcaggctcatattcctctataatttcatagagttctttcagcttgtcgaactgttcgtcttcctcatcctcggagagctttttccgtcgctctgtgcgaagggcgctgattttgttattgatttcagaggatttcgctgcatagtcggatgcgttcagcacaccgcttgtgtgcagtcttgtgatgattaagttttgagcggcaagatcggcaacggctttgtcaatctccgtaattcgtccgtagttcttactcgtcctgctctgcataacctcaatatcatggatcagcgttccgaggagtggctttcggtaatcctttagtttctcaagcatgatgagaaatgcgtcatatacagcgtcttcacggactctgcggttggcgcagtctgtatctcctgatgtcttgccggagcatacccaataggcggttcccgccgtaagcagtctgcggaagctccgcccgcagtcagggcagcgaagcataccggtcagcggatatgctgtttggcgcttacaggaaggcgtatgccttgctttctgtaattcctgcgcagccttatatgtttcacggcttacgattgcaggattggcgttctcaacatagtattgcgtctttgctccgtgattcttaaccttgcggaatggcagggtttctgtggtgtagctcttttgcagaagcgcatcgcccatataccgttcattgttgagaatataatggatggtggagtgataccactttttctgattgtatctgcgggggatattctcacggttgagggttgtggcgatggtttgctttccaactccctgcaggtacaaggcaaagatacgttgtattacagaagcctctgtttcatttactgtaagctgaccgttttctaattgaaagccgtatgcgggggtgcagcagttgaactcgccggattccatccgttttttgtagctccaacgcatattccccgatatggactcgctttcctgctgcgcagccataccggggaatgtgacgatcatttccatattcagtttgtcggtatcaatgtcctgttcttcaaagtagacgctgacgccgaattccttgagcattctaagcgttgtcagaagctcctgcgtattacgggcgaagcgtgataccgatttgacaatgatgcggtcgaccttgtcttttttgcagtctttgatcaatcggtgcaattcatcccgcttgtccatgcaggtgccggtcagcccttcgtccgcatagatatctaccagcttatactgcggatgcttccgctcgtagtccttgtagtatcgaatctgcgcggcgaaggagtgaagctggtcggcggaatcgctggatacacggcagtaagctgcgagacggatgatttcttttggctttttgttttcagccgtaatattgattacattcattcggcttgactcctttcttattttttgcctttcggcaacacatacaatactgcaaaggttcggaaacatccagcgcaaatcggaagatttatcactttagacataataaatttccgcatcgtaatgtgctgcgctgatggctgcaatcctgttgtattcatcctgtgtgatgagcttcattttgagaagcatccgcagcatatggatgctgtaagcaaaagaagcgttgtttatatccttcatctgagcagttcctccattgttttgattccaaggctgacgatgatggcgtggtcgattctgcccatatcgttcttgctgagtttgccgacatattctccaagccggcttttgtctatcgttcggatttgttccagcaggacaatggattcggatttcagtccggtgacggaaatccttacatgggtgggcagcttggtttttgtttttctgctggtaatggccgccaccattgtggtggggctgtgtctgtttcccatattgttttgcaaaatcagaacgggacggactccgtcctgttcgctgcccacaacgggagataaatcggcaaagtagatttcacctcgttttatttgattcatggcaatttctccgtataataagtaaaaaggcggccgtctatcccaaatgggcaaacgaccgccttgtctatatcaatcgtttttgctttctgtccgtatttatccacgatacccccggacggaagacgaattcgtcttcgggaacgcatccaccggccatgcatttggcctcataggaatctcacctctccgtggttctcaccgaggcgccatcctttgttgcgacggctcacggctctgctcggccgcttcaacgctcgactttaggacgtgacgcaagtatctttaattcctctgcctgtcatcgccgtcggtacgggtgcgccgtaccgtctgaatcctgaaaccatcggacaaaggtatttgattatccgtgggatcgctcatgtggcttgtcggttatcccgacaacagaggaaatgtaatgggtgcgctgtactattcagttgtcaaagatccatccaccaccatgcagaaccagtggcaggtgaggttttttatcccctcactattgcttccacaacaccgaaggcaaaaaacgaaaggtcaaatcaaaaatttttttacaaaattctcaaactgtcgcttgtaggagcgggcggtttggagcgatacaccgtatttctgcgctatctccgctgtgcattttgtttttcttccggcaagataggcttcatacaaatctatcgcccacggtttccacagccgaagtgcgctttctaattctgtcatccgcatctgcgatacaacatcttcttcaatgcagtgcgcgtctgcaagtgtctcagcaatatatatttcatttgagccagcgagaaaatcgtcgaaggagaggtggacaaagtctttgccatatttcctattccgttccgagacagtatgtctgctgttccaccggtgatgttcctctcggctcacttcaatgaacatccgatccacctcatcgccgtcttcaatacaatccgcaataaagtatctgtgttcttccttcggcagcctccgggtttcggcaagtatgctgaaccattcggcggcagacacctctgtaagtgcgatttctccgttgtctttttgttttctgaccaaaaatgtgtttttcatgtcgtaatctcctgaattttgaatttttgatataaaaggttgaaatcaaaaattcggagattacgggtatttggctatatacggttgccaataggcattgggcataacaaagtccttcctgcttttaagcgggaaggacgcaaataaaaaagagcatgacttcacagcttaaaagctgcttgtcatgctctatctcgaaagtccttgttctcaccgaattggtggatataggctcttttccggcttgctttaccgaagaagacttcggtgtgtccggcggatgaaactatgtacaagacatatcttgtattttcaattcagtttagttcgtcgtcctgcgatagatggatgagaaatttgccggagcatttgggacatttcaaaataatcctgttactcttgttacttagagttgtattgcggatagatatggcgatcactttatctccgaccggcttatcgcacagccgtccctttttgcaagatggacacctcacatagtcgctgtccatactcgaatcttcatgtatcttctcaatccaaagcaaaggtatcacatcctttcattttgttcagtttttactgaacactatgggtaaaataaagggcagatgcggtactcataccgggggtgctgcatcgtacagttctataccgtatcctgccctcattggtgttatatcagatgatggtctttcaaccgaatttccatcgcctttcgggaaacattaaattgctccgcaagtaccgaaaccttgtccgtgccggaaacacgataaaacgaccgctttatttgattgatcggcatcagcaaggctcctgcaagagcgtcggcctgtctttcaatgtatttatctgcatcggaacttttcgagatgcttttgagcatagctgccgtatcgcctgatcctgaatacagttcctgatggatcagccagtgtgccaattcgtgggcagccgtaaaacgaaggcgaccgtcagatcggcatcggagaaggcttgcgtcgaggatgatcgtacctctctccataaaaaccagctcgtatttccgctgctccatgttatacagagggatataatcatcatcgaatacggtttctccaagtattcgaccgttcttgcggatatattgatactccaacgacagtccgaaggtttcaatcatatcttctatggggatgctctttggttccagactgagaaccaaagacggatcatatttctttagtgcattccgcgcgatagcttcaagcaaagcgggacgtatatatctcggttcagtcactttttttcctcctgtatttttcttctccttgcttcaagcattgagatgaattcttgccattcctcgtctgtcgcatccacatcctttgctgtccgcagagcaactctgacgatatctctatccattatgtattccggcaaatcttgcgacacagtgggcgagtttttggatttggcggcgagatcatagaagtgtgttctttcctcatccgacagaactaataaactgaccatccgctctaatatatcctcgcttggggcgggattgcgatccttttccatgttgcacatatatacaggagatatcttcagcatctccgcaaacttccgtaaggatatcttgcgttcttgtcgtttaaggttcaagtaagtcccgaacgtgttcggcttctccatagcagtttaccttccttttctgttcaatcaaaactgaacgctgtgcctatattatacaagaacactcgtttgattgcaataggtttggaaaaaggcaagggcatgatggggtcgtttcaccccatcatgccttgaaacggtatattgtaaatgtttaatttttctttatttacgggctttttcgagcatatcctgatactgttccaaaatctggcggggagcgataatctcaatattcccgcagaactgaaacacccaagcgaagaatgtttggctgaccgagatctctgcttctgctcggaagtgtgcgcagtccaacggcgttgtctccacgttctctccgaagcggtcgattatgactttcatcatattgttcttacagcgcaatgtaacccgttccgttttaccgtcatacatatcgaataccttgcgggcaaattccggcaggctgaaatcttccggtggaggaacaatactcttttccaatatctcgatctcaacgatgcggtctgctcggaaagtgataatcttttcgtgcttctcgctgtatccgaccgcataataatggtctttattccacattagtccgtatggactgaaacggtacctttttccatcgttgcggaatactctttttctttctgcattgtactcgtaatagcggaaggatatttgacattcctgattgatcgccgtatgtataccgtctacgatataataaattttctcgttgacgggttttactctgtccgcaatatacagatgacgcttgagatcttccgcacgatgtgtgcttgtgagataggtgagcttctcgataagctccatgctcttttttgcagtaatgaattttgaggattccactgcatcgattagtagcttgagttccggcagttcaaacattctgcgaccgatagcgtaacagttctgtgcctcacgttctgcgatgatatcaaagccgaactcctgcaaaagctctatatcttgcttgatggttttgcgatccaccacggtgttcagaccggcgaagtattcttcgatatcgcttgtggtaactgtatgctcgtcatctgtctgttcgtgtagaaatttcagaagatacagaagccgtgtttttccgctcaccgtcatggtatccacctcgtttcgcattcagaatagttatttcttattgacttctattatccctctgcaccggcaataatcaactgctcaacgatctcggtaaaaccacgctccgaagcatacgaaagtgccgtttgttgttcgttatcagccagatttacattggcgttgttctctatgagcattgccgaaaagtcgttttgtccgcacatagcggcaacaatcaatgctgtctctccgttttcattttgtgcatccacttccgcgttggaatccaaaagctgttttccaataaagcgattcccctgtgaagcggcatagtggagggcggtatttccgttaagtaagcgcagcttggtatctgctcctgctctaagcaaaatattgacaacagcgagatttccctgcatacaggcaatcaaaagaggtgtttcgccaccatcgttgaccgcattgacattttgctgatttgccagtgtacggacaacctctgtctgaccattgtaaaccgcctgatgaagcggagtattgccgaccacatcggaggtatctgcgttgccgagcagagcgataatatcacgcagaccaaaggccgttgcatagtcaatcgccttatgtccgctgttgtcagcaatattgacatcagcgcctttttctataagatattttgccgtttcggtacgctgctctgcaagggtataaatcagtgccgtttttccctcattatcagtagcgtttatatccgctcctgcttcgactaacatagcggtaatgtccttgttgccgctctgtgaaacggcatgaagcggtgtgagatttgtattgtttgcaattccgggatcagcgccgttgtcaagcaataattttacaatatcacgagcgcctttcatacaagcgtaaaaaagcggcgtatttccagcagtgtcccgtttgttataatcaatgccgccttttttgataaatgcctgtactactcctttttgtccgtttttacaggcgttaagaaaaatcaaactgttatccatgtggcttctccttatgaattcattaaaatcagctttacaagcggctcgttattctgttccgttgcgatttcaagagcagtcttaccatcgttgtttacagcgtctgtgtccgtaaaatcaaactcaaagagcatttcggccatttcttttgcaacactgtcatttacattgcgcgcagcatagtgaagtgctgtgtttccgtcctgatcgctttccgttacgcttgctccaccttctaacagtgctatctgaagctcgtttgcgtctgcgccgttctgtgacgagatgagcataagggcgttttgacctttaagattggcggcgtcaagattacattttgacgcaattagagcggatgcaaatttatagcaaagcttatccctttggtctgcacggcggcaggctgcaatcaaagccgtatctccggcgtcactgatcgcggcattcttatccataccggcagatatcagaagcgagagaatctttttgcagacggtatttttatcttcccgaatgcgaaaatccaagttgaaggtgtcgccgtcatgcagcacttgatataaacaggtttgaccgtccgaatttttaaaattagggtcagcgcctgatgctaacagaagttcgacagccttttcgtcaaggtaggaacaagccactgacagcggagactgtcctttccatttgccatcgtcggcaatctcattcagatcagaaccgttagctactatgttccgaatagcgtcataatcttttctctcaactgcatcctgaagcatcataccgccggtgagtcctgttgtatttgtatcctcagaatatgtaccatcaatcaaagcggcaagtcgtttatcggtacagtccattgcatattccaaaggagatcgtccatagccgtccttttcatccatatcaaagccgctgttataaaggattttcacaagctgaaaatagcgttcctgattttcacgctctgtttcatcggacggatcgttgtactgtcttgcatagtccagcgcacagtgcagaacattttcgccgttttcattggttcttgtgagctttgagccatgttcgacagcaacgtcgatcaattcccattgaccgtgcattccggcacttgtgaaaactgtttgaccgtctccctcgctgcgggtcatgacgctggctcctgcgtcaagaagcagacttgcgcaggcttttttatcttccgaaggaagaaatccatagcgttcattcggatcggcaaggctgaacaatgcgttttcgccatacttgtttttggcattcgcttcaagaccttcgtcaagcagctttttcattgtaacggcatcggcatactttgcagctatgtgcagaagcgtgctggttctgttgttttcttctgtagcggtaagtccaatttctttcattgcgtcaaagattgtttccttatccgcaccgctttcataaagtcgttccaaatcatagaaattcataacatgctcactccttatttaatgattttttgattatatcaatatttttataatttccgccagataaagcgggcaaaacctttttcagttcctctgtgtttcccattgcaaataatatatctgctttcaggcggaggatggagatacggcatctttcgggataaagcacaggcgtgtcaaacagcatagcggctttatacccatcattttgcgcctcgtacctttcaagctcttccggcacagtaactgttttagacgggagagcaggaagtaagcgcaaagtcctgtccaaataggacaatgctttttcatagttttcggacatataaaaacacactgctatattgtataatacagcgcactgtttttggtcagacgcaagaaaatataggtatgcttctgcgatccgtccgcatgaaagtgcaaaaataccgttgttaaagcaattctttaactgttgcggcgaatcacgaccgcccgaaacaccaccggcaaatcccttaaattcagccatagcaaatcatcctctattgtgacaacttaattcatttctgtaaatgtaaattctttttcttttgtatcaaagcctactgtatattttttattttcgccaacttcaacctcaatttttgcagggccgaaggtctccattacatttttatacataacaccgggacgctgtgtcattgcctgcacttcaagaatatgtttgccaggcagcaggagatagacttgttttgttccctccggataatattccgtatatggagcgccgtcaacttgaagaattgtaatttgtacggacttgataccctttattgcagattctgcatagacggacgaagcttcaggatgtgcttctctgaattcattcttcttaccgcgtctcttttgtaaataaaagaaatacacaatcagatagaccacaaaaacacctgcaatcaaaaatacccaccaaggcatagtcttaaaagattccataaagtattccattttttattctccttttcttgtctcaattttttggactttttgtttttcgccggttactccgagagcatctaaaagactgttatactgctctgatcctatgtacgagcaatcatagtagtaactctcgtcaccatcataaactgtaaggctgaaataaggctgaaatccgttccatctgttattttagatgaaaacgaacaagttgcgatttcatggcaagtggtttttcttttttctatgaacgtcaccttggtatcatccactatgattttaagtttcgcaccggaaagtataagaccaactgctgcgaacaagacagcaaaagcaataaggccggcaatccatagcgtatgggtaattgatcttgcgataacaaaaacaaacacaactgcaaccactgctatcagcagatgatagataagcgttgtcgtttttcgtttatatactcgttgcaaggatacacctcctttcaatatataattcctttagaacttgtcggtcaatcgtcgtattcatcaaattcatcttcattgacaagtccgcggataaattcttcaaagctgtcggccagcggcgtgatggcatagtcgcactcctgatcgatatgcaccactttaggctctccctgcgaaccacactcacgatagtccaaaaagatcatatcatgtccggcgctggggcagtcgcagatcgccacaccgatggcgggatattcccattcgtcgatcataaactggctgccaagctctccgcagagagaataggtctttttctttccaatgccaaaaattcccgtgatcgccacatggttttccgcccaactggtcggagtatttgttgggaaacaggtattgaccggaataccaccgttatgctgtttcatcagccagatgtaagaggcgggcagcttgtaacccagttccacctcgatctccgtgatcagttcatcggagggcggatcgcagacatattccttcaaagcgtagtcacagtcatcccaaaatcctgtgaagtcaaagccttcaaacggtgtgctttttttctttttattggggcttggtttctgttcgcctgctatctgctcaacaatgcacttttggcacagcggatactccgcaataaaatcttgtaccgctgccaacattttatcatagctttggccgtagaaatataacgcagtattctgagggccttcccaccagctataaaagcgtcccactccatccatacgggattccagttgctcgatggcgtagttgatgtcacagctttcataaacttctttcggtaattcggtaccgttcagatagagagccatgccctccaaacgtcccaccgggcgctcacttcgctcatcggcatccgcactccacagcagcttagaaccttttggcacgccaatatcttcgatgatcgacatcaattcttctatcgtttcgtccttgccgtctgccagcgtgatctcaatgtcgcagtctttgacttcaccgcttgccatcatcattgtgccgccgccatcaacaaaccccagcttttgagcggccagacgatcatcaagctcgtcttccaaatcgtggcggtgcatgggttgaaggcgggcgtttatgttcaatgtaacaaacttggatttttgatcgtttcgcttttcaatttcctcctgacactccacaatcaccgctttggcgttatcatcgccggggtcaagctctgcccaacgttgcgcatagggaatcgcctgttcttcctgttgcggcaaatactgatatgcgtatgccatacgcatattccattccgctttgtctttgccttcctcgcgtaccgattccaacaaatcaatcgcccgataaagcgctatgttgccttcttcctcgtcagtcctctcgtcatggtcgccgattatggcgtagttttccaatgcacgaaccagcgcaaaggaggcacggtagtccctctgctgctctggaatggtttctaacactttgatacatcgagtaaattcgtctgcatcgttccactgctcaagctgatgatagaacgcatctgcattttccggggtatagggaatatactcaaaatcttcaaaagaattttcaatcatctttctgacctccttcttcctttcggatatgcccctttcaatattcgatcttcaagctgtcgccctccacagcaacgccttgactcttggttatcggcagtttttgatctgctgtaaagccaatggtctcgccgtcctgcaaaatcacatcttcggtgatgacatagtttgcagtgctggtaagaaactcgagcagctcaataggctccacgctgctgtccagcacctccatctcgtcatagccgaaattcctcatcccggcggtatagccgcagagacctttttcgttgttgtgcagtccaatccaaacaagattggtaatcggaaactcatcctcgttaagcgcttctgcaaactttagataatatgtcggttccagcacaatatcgccggtatagatacctatcacaccctcttgcttgcaggcggaaaccacggcttttactaacatcacaccgctctctttcggaggaagttctttgccaagctgagcgatcagaatgtgtgccttgtgctgttttactttctccctgccgtccggccacataaagtttctctcggtcatgatttccgcctcgccgtccgggatcggaccgggcatcagcgagatggcaagcatcgctccctgataggtaataataaaggtgtcatcgcgttcgtcatcctcattgtcctccaaggactcatcttcaatgtcccatgtctctttcagatcccgcaggagtgccgccttgtcccatttggcttcggaaagcagcacatagttgatgaacgtaccggcattttctttgcgctcctctgcctcttttgccttattcatataatactcgcgcatatactcaaccaatgcggttgcctgctcgacagcagttgcctcggtatattcctccatctcactaaatacatgaccgcaatgctccagatcgtcgtcctcatagccaccgcagacgcccataagccacttgccgagcattgattttttgtatttgaaaatatagtagtgcatctcgtgtaggtcaaattctccggcgcattcaatctttgccggtgcttttcctaactctgcagggtgggaaagccactcaatcatagatttcgttgccgcatttagttgttcttttttcatggtgtttgctctctctgttttcattctttattcgtttctgtaccgttaaagcacactcactcgcgtatagtcagtcaaatcgctgccaattatttccgcgattctcggcacggtggtttccttgttacagagcgctttcagttccgtatcggtggcgccgatgagcttgacaaattgcaccctgccgttaggtgtaacaatttctccggcctcatctaaagctgtgataaaaccggtgagttttgactgttggcgattatccatcccctcggtttgcccggtgtagatatactcattcggttgaaagatttctccattttggaatgtaagccgggcaagcgcctgaaagataccgcagattgtttttatctcggcattctcatccgcaagtcccgcctttttcagctttaaggtgaactcaaaaccatagccgctccactccgggtcattcgtctctttttcgtagaggtcactgagtccgtatgaaacaaaatgccaatagtctccgccgtcatagacactaatcccgcgaagcggatcgttaccgccaagctgccaaggaatcagtgtgccatagtggagcggattattctgcccgggatagagcttttcaaaggctttcgtaatagcatcccaacctcgggaatcaatttcctgttctgcatcatccggcttcatgcctgatgttgctccatctttagattttttgcttttgaatttatcaaacaagctcatataaggtactccttatcaaacaatttcatcaacgccaatcacgcttcccgaacggcttcgcagatgtcaccgatatcacagtcaaggtagtcgcagatacgcagcaaaatagaaagagcaacttcttcgcccttgttgagcttgctcattgtaccggcagaaagcccaatatctcttctaagtgtgactttggtgatgtctctctgaataagcatcatccacagttttttatagcttattttcatataaatccctcttatttctatgcttgtaaggccgattgaaagagtttttcaaattatagcataaaaagtcgagtttgtcaatgatacgctccaaaatttcaaaaaaagttgcaagaactcgacactttggctttcatagaacatcggagcatctgagattcgctcaggcattagattatggcttaattctttttccatttctaatgactgcatgggtataatgatcaatcgacattacaatatcatagccctttgtgttggtaaagaattcaatgtcatctgcaaacattataacttttcggagaaatcccatgcatccggtagagttgaaatagtagttcacggagatgtgactatgatgttttacgatcttcacatccaattcgtaagtttctgatatttcaatagctgtcttaacgaacgcctccgccgtctttgcccgttccggcagaagaacatactcaatttccctaaatatctcgtttatgatttcatcgaaagtcatgtgttttttggatttatcctttacagatatcccttgctctatcatagagaattcaatctcgtcaatagacttttcaaggaatgtctttttgtagattacttctgtttcaagatgtattctatcaaccatttttttcacctaaattaattacagtcaatccctttttgaccgctttctttaatgtctgtgctgcgccgccccagtcatgagtgacatagcagagcgcatacgcagagttgtccacaaggtacttatttcttgccggaatcgcagctttgaagtgatacttttcaaagccttccggatagactattgaatcaaaatatttcttttcaagtatgttgaaagagaggtatggaatgacaagatagctggaaatatgaggagaggtcttcttgagttcaaagacgattcgcgcacacatccagtcaaatgtccccattcctccgctgagaaaaactgtgactccgttttcgatgagttttctaatctcttcacgaacatcctctggatttaagcggtagcattccttgtgtccgataaaagttgctgtattttctttccccatcatatacacctcctcagtttctattatatcatgaaattatgaaaaaatccacactattagttattctatcttcctaatagtttgtgtatagttctgcgtgtttaatctatactatcagtgatattgaaacaccaataggaggtattgcgatgggacttgagtcaatcggtaaaaacatccgaaaataccgattggtcaagaaacttcggcaagaggatttagctgaaaaagcagaactcagcacaaactacatcggtatggttgaacgtggagaaaagataccttctcttgaaacttttatcggcatagtgaacgctttaggagtatctgccgatatgattctggccgatgtgattgacgtagggtatactgtaaaaaactcgcttctggcagaaaaaatggagaaactttcagccgaggatcgtgagcaaatttacgatgtcatcgatacgctgatgcgccattcatctcagtcaaaaccttaatcaccttagaattaaaaggcttgtagaattctctgtggtttcgacagccttttcctgtatatatagtttgtatatcttattcgcttaacagacagagaaaaaagactgtttctcaattgaaggatatatcagatctactcgaatttctctcagtccgtattcgtatataatttccagatatatttttcttttctgctgtaatccttcttaaagtgggaggttcaaggcggcccatgatgaaccgcccctcagtccaccgtttgggcagacttctcccttgtaagtcattaatatttttcaaagcagatagtaccgatttgaggtcgcacttccgttgtcccggaagtgcggctcttttcgtatcagtcctgctttttctaaatcccggattgcccgcttgacggtgctgcgggatatcgacagatcctttgcgatggtattaagccccggccatgcctttttctctttgtccatgcggtcatgaagatagatatacacgagcttcgcccgatgtggcagctccatgcggtacagaaaattaagcctgcccatcggatttcacctcctgttcctgcacagcggttggctgatggcttctgcggtttcttggtgcagtctgcaccgcagttcctccgcttctccgtttatccttatcctgtggccttgtcgatttgggatcgttcttttctgctatctgctgctcttgaccgccggatgcactgctttcttcaggcggagccggaggctccaacagctccgggcggtatttcttcacgatgccgtccatgatgtccttctttgcggcatactccaccttgcggtttccctgatccggtatctcgtaagggtgcttttcatcaaaccgaatgccccacttgaagaacagcttcagcctgaccttcatgggatagaagccggttttcatcaccacgaactgaccttttggcatggatttcagctcgtccggcgtcatcagaggccgttctatcatctgcagagattcggacggatcgttcttgctccggctgacagagccggacataacggttcggctgcccaacgctttggacagagtttccgccgagcttgactgaggagcaaagccgccgaagatggtgagctgggtgttgtccacgatgatctccgcaccttccttgccgtaatttttctccaattggctgaatgactggatgatcgggacgatctgtaaacgccttgatcgggaggcggagaacatcatctcggcagactcaatcttcgggagtgtgccatactcatcgcagaagaacacacagcgatttttcagcttgccgccgttctcatctgccacggcgaggatttcccggtatagctgctggatgatcaggctgatcatgaagaaggtcgccggattttcctccggcatgataataaacagcgccgacttctccttgcagaatttctcagcgtcaatctccgtatcaaagcagaggatttgttccagctccgaatcgaggaaagcgttcaaacgggaaagcgctgtactcataacgcttgccattgactgctccgccgtattcagtgccgcacccgcaaaccatttcgccttgtggtcatttggcaacagctccatgagctgctggaactgattcttgcctttcttgccggagggagcaagcaattcctgaatgattttaaacaccgatacgatgtgccgctgctccggcttgcagaattccgctaccagcaggatcgttgccgtaaggagtccttcagcagcatcataaaaataggcgttctgcccaaagctggcggcatccatgccggagaggatgatagtcttggagatgatcttggcatatttctcacaccgcgctttgtagaccagcttgtcaggattcgcctgatacagatccatatatttgtttacgaggtgcaggaggttattgccgttgctccttgtggggttccgcaaatcgatcaccgacacatggtagccatagtcctttgcgatctgcccgtagttgcgcatgatatcgcctttggtatcggtggaaagccagctcatgccggaggcgcaggcatactcaatgcaggggtatagccaataggcggttttaccgacgccggccgcaccgatcatcagcgcatggacatctcctgtatcgatcatagcggtggtgctggcattgctgcctgtgcatcccaccacaatgccctgcggaagcggctcgccttccgcagtggtcggcgccttaccgcttttggcctgctcacgccacctctccggcgtaaacgggatgtgctggtaggtcttgcggatttcccgcttggttgcccagcgggctgtgccgtgctgaccgtcaccgactgtccggcttttgatgttgttcagactgtagatgtgggcaagcaaggtcacgccgccgaggacggcgaacatcaccgcgcccaccacaatcagcaaagtgatattgcccgtcatagggcatcacacttttgagggttatttcatcactccattccttttaggtttttctctttctcataacatcggctgcatacattctgtttcttcctccatttcttctgccggatataataaatcctcgttccagtccttatggatcggtacgaggatttcatgcggaatgccaagtttttgtagttcttcggatattcgtgtatttccgatttgtccggcgctgtcgttatccaagcacaaatacacttctttgatattgggattgtccttcatcatctgatgtaaaaccctgcttgagatacagcaagccgctgcatagctgtgggttttccaacgatccttatgcatggagataaaactgagcatatcgataggcgcctcaaacagatagagcttatcgctattgccatgccagtgaaagctgtactccggcacacagctatccacatttcctctgtaggtgcttgtctgaccagtacctcgcttgtgtgcatggcgggggatgccgttcctgtcgtatcctataaagacggcgttatgatagtctgcggattcgtagatcatatttcggtctgcaaaggcctgcagcacatccttatccacaccacgggtttttgtcagatacgcaaaggctctatgcatattatcgttcttcggcggcagctcaaagggcttcttctccttcacaacgggaggcgatgttttgagcgtgcctccgcagccgcccagcagatattccatcgcctccgggtaggtcttgttatagaacctgcggacaaagtcaatggcgtcgccgccttcttgatcgtactggtgaaaccacaggtttccccggacggttaccttctgggagccgtcacgccattccagctccgatccggagcgctttaatgtttcgccctgccttcgaagcagatcggcaatgtcggtctgccttgcaatctctttctgttcatcggtaaaatgaatatatcctgtaggcaattttcttcctcctatccttgtttcatgcccagcgcctctttcttatcctgaatctttcgcctgagcttgcggtcaatgagtgtgccacctttacctctgcgctcgtcctccaagcggttttgtatgatccgactgatgtgatgcagaagccggaaggctcccatcgccgccgaccagttcttgttgcttcggatgctgtgcaggagctgctcggcgtattggttgccgtgttcggcagaagaggtcagccagcggatggcttctgcatagtcctgctgtacatcttttccgtagagatacagcttgccgagctggtactccgcaaaatcattcccatgctcagcggcgatttttaacagccggattgcctttggcacatttttgaccgtatcctcggtcagcaagattttccctgcgaggtatgcggcataaggctgttctttttctgccgcccgttccagatagaataacgctttcccgatgttctgcggaatcacttcacccctatacagcagcttgccgagcagatattcggcaggcgtaaatcccttgtctgcggattcggtgagcaggcggatcgcttcgggaatatcccgcagaagcaccgtaccgtcaagatacgccttgccaagaagatatgcagcataggagctgccgctttccactgcctttttcagcaatgtagcagcccgatccgcatcctgttcgatgacttcaccctgcaggagaacctttcccagcaggcactgagcatcggtgttgtcctgtcggacggcttcttccaaccagcgcagggcgtaatcaacattctgtttcacgatctcacccttgaggaacagttttcccagcgtatactgtgcgtaactgtggcctttctgcgcggcggtgatgaggtagtcgagcgccttctgcgtatctcgttccacaaagtccttgtttagatgcagcctgccgagaccgtataaggcgtcggcgttatccagagcagcggctttttcaaagtattcctttgctttggacagatccttctccgtaccggtgcctgtcagattcatttgcccgatccggtaatacagcttatcgtccgccatgttctgctcgatagaaagaaaccctttgtatgctgccgcataccattccgtggatttttctttgtccggcgcagtaccgatcccgccctgatacatcctgccaagctcatacatggcgtaagcgttgggcttggtttcatgttccgccgccatcctatagagggagaaggctttctcatcgtcctgtgctacaccttgaccgcgccgatagaggctgctgagggaatacgcagcgaagggattgttttcactgaccgctttttcataccattcagcggctttcgtgtagtcctgttccactccgtatccaaaagaatacagcttgccgatgcggtattggaagtaatctttctttttttctgtcttttcttttgcagtaaaagcggcaaaggcttttccaaaccattcttgcgccaccgcttcatccgcaccacagcccagtccggacagatacatcctgccgagatcgtgcatggcaaagccgttgccggtggcagcctccgcactcatcagtgcaaaggctttctgcggatcgggaggcgctgtcttcgttccgtacagataattccgcgcttccttatacgcatccgtccaccatgatttgttttttctgcctctgctggaggatggcgaagggatatccagctctgtgggttcgctgtatggaatatcatccggcatctcatcctcctgcggctccggcgcatctgcgtcatcttcatctgcaatgcggtctgccgcaatgttcatcgcttcctgtatcacggcattgcgtatggatttgaattcctgattctgcgacagaggaacacgctccggcatttccttcgtgtaggtttggatcactgcttcacgcttttcgtaccacagatcatagagggcggcgaggcgctcgtcctttgccagctcatccacgatggagtcgatgaggtctttcacatctgccttgaggtagccgtacacctttttcccgctggttttagagagccggtctgccagctttacaagcagagtttccacagccggattgtcataggctccgttattgattttcgcaataatctctcctatgagtttccggctttccgcctttaacgcatcccgatgctccgtctgctgctcgtaaacgcacagcaggtcttgggcaaagatatcctttgcgaaggaagaccgcagattgtttacgcctttcttggtgagatatccttcgcttgggacaatggaatacgcaatgagatgcacatgaggatgatggctctcgtcatggtaggcagcgaaccaccggaggttttccagcgggattttcagatttttactcagggcttccgtctgtgtccgcagcatatcccgccagcggtatccgtcatcgaagccaagccttgccgcatcctcacggcgcagggagaggatggccgtccacacatttccctgatggagatttagttcctccgatacttttgagagcttgatctccacaccgtcatcggtaaacagaccatgagagccgaaccgctgcgccctcggacgggtggcgatatagtcagcataggttttgccggacatcatttcctgtgcgttgtcttccaacgcgcgggtgataaattcagaagcgtcgcccacggtcatggtacgcagatagtcatcgtactcatgcatctccttcgcatcgggaaagtcccggaggatttgtgcaatcaagtccttctgctttttggaggcggggagattctttttgctgtcatcgatcttatccacgccttcacgggtagcaatatacttgagataactgcctgccttgttacccggtttgataaacttgaacttggtaatgagcttcgccactatgacacctccgtttccttcgggaaaaccgcttgcggttttcgggcggctgcaaatgattctttattttctgatccatttcatgcgatcgctgttatcctttctgccagtccacagcgtcatcgaaggacagggagccgttcagccgcttgacctccttcacgcactcgccacgcagacggttcagcgttacctcgtcgatctcgttggtggccgccaccacattctgcaggacggcaagctccacggcgatcttgaacagcatccggctcgtccggttgtcgctctcggcaacgatgctcttgagcgtagaggttaccacgctgggcagatatccgttctgatccttcgaggtcaggtagcctgcatagaagaggacagccttctcaatgaactctgaccggctctcacaattgtcctccttgtagatcgcctcaatcttttcgtaggtttccgggtacatccacagggcaaatttcttcttattctcgaacatgattcatctccttccaaacccggtgcaacgcctgccgcaacgccgagtatttcccttgcagtacggcggtttcaggcaggcgcaacccctacagcaggctttgaggcggttttacaacccctacggatttggcaaggtgaaagtgcgaaaaacccttgtgcggtcggcattgccgtccgctgtgagccgagccggggaagcgtcagcaaccccggctctttcacctgcttgcagatcgacccggtaccatctgatagcacggggcttttataccactttgcacaccttgcccaaacctgccccaaacggcttgtattatgcttcggcgggtgtttcctcgcgcctgcctctgaaaaccccacaaatcggcacacagtggctcacatgggcggcatctgcatcccgtcctcctgcggcgtcaggtactcatcgaaatcctccaaagtaccttcttcttccatttcaggaatgtcctcaacctttccgccgcctgcaagatgctctgcagcgagcttcatctcccagggaaaaggacaggcggatatctctgccagcgagatcatctgtccggcgatttcatcaccgtgtatttcccggatcgtgcggaggcgctccgcaaattcattcagaaacatttcggcggttttgtattctccggcaggcagctctccatatgagctgtcgaatccttccagctctttagcccactggcaccatatctttgcagcataatcgctgtcaggacgaatggaattcagatatgcggtaaacgcttcacgatccatagtcgcaccctctatccgcgtcccggctttcttatccgcaatcatatgcgtatcgatttctttgccgcagagagaagcattgaatatctcacggcggcaatcctcgctgcgataatcggagcggtatgccttgtatgccgcaacagaaaaatcatgcagagagtaagtctgccattcgttatcgccgctgtcgcatatactgactctgccttcatccagatcgaattcaatgagcgcggtgatacgtttgtccgaacggatattgtcacaggcttcattgaatttttgcagatcaatgggattggtttcaatgaatgctgccgcaagggtttcaggcttggcggataactcgtctcggtcatagagccggtatcggtaagccgcctgcataggcgttttgaaataatcgcttgtaaaatgacagtcttcaccgttctcccgaacatgatagaccgcgaagcgccgcgcagcttccgctgcttcacgctcagcagcttccttcagttcgatgctcgcctccaactgagcgatatcttccgcaggaacatattgctgatagagcgcatcaaaggcttcgcacagtttatcttcaaccgtttcgccggtcttttctctgagcgcatccgacagtgctttcacccggtactcgttcaggtacagcgtaatgtcaacatggttcatttgtttttacctccacggtactttcagcgcccacggcagaggaaagagaaggcttcggctttttcggtcgcgctgctggtgcggcaggtgcattgccggagcgcatctcaataaaatcacgaacaccggcagggacggttttggcatacagggtgtcgagagatttttccagctcggattctacctgcatatttttctgcgcgagatacatcttcagcgcagacagcttctcatcgtcaaaggtaatgcttacggttgttttcttcatatcggtttcgctcccttcttgtaatcacatggtttgcattggttcttcatcgtcttgatcggacatttccaattccataagctcatcgcggacattcctccaccttgcgtcgggagcagtcaggcaaaggtatttccattcatgttcgtgagtaaagacatacagaaaatctataaactcatagctgtcttccatttctgaaagcgtcatttcctgtgccgaacaatcagtttctccgcaatcccttcctaaagcagttgtaacatctttctgacgattattgttgtaccagtcatgcggatatgccggatcaggttcgatcttcgctccaagcgaatagatatctccaagagacaaaagcgcgtctatccttcccggtgtggcataatgctctgccagcagggctcctgtatattcaaggtatccgtccagcatacaaaatattgtccggtattttccgtcgccaagatctttggcaatataacagcgcgtacccattttgatttacctccttacattgattgtgccggttcttcatcctgctcctgatcggagttccatttctcatggaaggcttcctcggcatccttcagatactgctgcgccagagcaggatattcaccgaacagcggctcagccttcgcaaagccataatgctttcctgcagcttccggattgtgtctggcaagaatataccggagaggaacgaattttttcgggcgacagcacctcacctttgacaagggacgggcatggatgcccgaagttgaacgcccagagtttcgcaaggatgcgaaaccaacagagcgttcatatggcaagtgtggtagtgcttttcttgggatagcacttctcgggttcgctattcgaattaatgcacctgtcaatattgacgagggaaagaaccaaagggactagggtgagggacttgcagcccctaaccctatcccttaggttttctccctcgtgctccctctttccttacccacacccgtaccccgctggggtgttggataaactcgaataaccacctgaacattgtatgacctgttaatgcagggacgcttaacgctacacgtccgcagattagtacatatatctcaggttagtggcgttttttgaaaggtaaatgtcagtgcagttgtaccgatacactcacgaaaatattaattccttgtcgttgcggaaaatgttttaggcagtgcctggcaatatatttcacttgaacggtgtctgtagggcgccggttttttgtattatgtgccgcatttatgaccgttcgtgccgttataacaaccgttcgtgccaaaaagttgaaatcacaaagcaaatgagttatgatataattataaaattataaggggagaagtatgctcatctgcgtttacgataccgcaaacgaggcggagatactgaaagcgaaaataacacaaatcgcaacggcggcatatcgaagaattgcctacagggcatgtcagaggtatgagagctttgcgaaggagtgtaagacggctgaccttataatcgtgcttgccgacggagcggacggtatggagggcgttattgcggcaaagaatgccgacagggatacgcctgtaatatggctgtcggacgatgagggattcggggcgcagtcatacaggcttggctgtacctatttccacaagaagccgataccgcttgaaaagctgaaggaggcactgcataagtgcaggtgcatggcataagcacgggtaaatctacaggaggaaaaacatgaagaaaaaatttgtacggctcataagtgcggtgctgtctgcggcaatgacgttgacggctgtaccgttatcggcatttgccgagggcgaggcacatacgcatgacggcgagagcaatgtcatcacgacaccgcttgatttcagagaaaagacggcggacgaaaacggtgccggctggagctgggattatgacacaaagacgctgacgcttgacggagtgaacattcaggcgacaaccgacagtatgagcgtcgtaacagtccccgacggtacggagatagtgctgaacggtaacaatactatcgtacagaccgataccggcaaaagtgatacatatgttctcagtgccgtaaataataaagaggtcaattgtgacggcacaatgacaatcagcggcgacggtgtgctgaatgcagagaaccgctctacagacagtatggcacgctctctcggcggatcaataatcctgaacggcggtacagtaaacgcaacaggtactgtaaagacaaattcgcttgaaatacataatgacggtgtgctgaacgcaaatgcgacaactgcatcttttgagggtgtggctgtcaatgtcagcggcggcattactgttgacggcaacggcagtcttactgcagtaggttgtgctaatgaatctacgttaaacagtgcaatattgcttaccagtaatttcggtgacaaaatttccgtcagcgaaaacggcagtattactttgcctgaaggcaatgcagcaagagtcggaatatactacagcggaaacaacggcgacggaatggatgccgaaataagcggcggtaaggtcactgcttacggtactaagtatggcatttacaaagtaaaccttataatgaacggtacaggctcggtttacactacgggcggttcatacgctatcggtcaaactgtaccgacaataaacgaggacgaatttgtagtaaagggttcgactgagttcaaggctgaggaaagctcagtgacagccaatgccgagtttaacagcggctattatgagattggcagagcggacgctaagacggtagttataaagcctgatacttctccccgtataatactcggaaaccaaatcggaatattcaagactgaagagtatgaaataattgaagacatggacatgactgatatcaagctcaagggtacggtttactttgatattactctgaagaatatgagcgatgaagagtttgcagacgcaagaggctgtttcggcggcgatgaacccgatttattagcaagcataatcaagaccgattacggctgggtgtgcatggtctgcgataccgagttttcggttacatacgacactgataatactcttacaataaagtgcggagatattgtatccaataccgttcaggtaaagtcgaatgcaaaccgtttcaacaaggttacacagggtgacaacacaaacagaacggttttctatacaaacacttcgcaggaagagaaggacaattacaagcttgtaagcacctatacggttgacagtgaaagcataagctataactggtacagtacgaacagtgcatacagtgcagatgagctcggtgcggcagtatccggaagcaacggcgaattcaagcttgcggataatattcctgccggaaattatgttctgtattgcgatataacctattcagacggtgacagcacagaaactgttacagaaaaatttacatttacatataaagaatgtgcacatgaaaacggttattccgacggtaaatgcacaaactgcggagcgttatgtgatcacagcaatattgatattgacacgggtaagtgtaacgagtgtgcgcatcagtttgttgctacaatcagcacagacggcaatgcgccgacaggctatgacacgctcgcagactgccttaacagtgttactgccgataccgaaaactatgtaaagatctatcaggatatcggcgatgcatcggcaactgcaactttagatactatagatgtaaaacacaatgttatgatcgaccttaacggtcacaagctgaacaatatcaagcttggggtcaacaaacttggggtcaacaaagacgtcacgcttacattaaccggcacagcgggcagttatgttacgcaggtgtatgttcgcaaaggcggcggatcattcataattgacagcgaagcaaatgtagaatttaatacaatttttgttgaggacagtgcacggcttgctgtaaacgatggcgcaaaagtaactacagaacagttgactgtgatagcatccgtgaatgatgacggaactacaacgacatctgtaaagctcgctacgggaatgaagttaggtgggctgacatatcatcgccaaaacaattccggcgctctgaaattaggcaatcttcttgatgttacccggcaggcactgcgacgtgaagataacggcaattatcttgatctttataaagaatatggaagtatgggttattccgttgcgcttactgttgtagagcatactgacgctgaccacaaatacagcactggaacaggcaagtgcgaggagtgcggaaagccctgcgagcatggcggtgatataaacacggacaacggcatctgctcaatctgcggtgcggttgtgtctgtcgcactctatacagacaagaacggaagcttaaagtatgtagataccgatgagcttcactctttactgaatgaatacaacggaagcggtacgataaagctgtttaaggattattctaaaccaagcgctcagtatgacttatacggagaacttacaattgacttaaacggacgccaatttaaaatccggagtattactccttgcaaaagcggaaagcttacgatcaaaaacagcggcaatccggttatgctcggttgtaatgtatatccgacaaacgacgcttcatacgccggcggtacgcttataatagacggcgatgtagttttagacacttcgatctatgtatatgattcgagtacggttatattgaaagccggtgcatatccagccggactttacgccagggacagcaagacattatacgatatgctcggagagggtaaggctttcttcaagactgacggaactcttttcaatgcaaatgttaaggaaatatcaagcagtgaaacgctgacaatcaaagaccacagccatacctatgttgacggcgagtgcggctgcggatatgtttgccctcacagcgatgttaacagcgaaacgggtaagtgtaacgagtgtgaatatcagtatgcggctgttatcgtaaaggatggggctgtagcttctgtttataaggaaactgagatgggagcggcttttgaagcggctgacagtgacgcaaacaccggctgtacattaagagtatacaagaattatacaggcagctatacaacactcagcggtaagttcacgctgtggatcgctgagaaagccaatgtaggtacgttaactgtttcgggagatataaccgttacgggatcgggaaaaaataatcgtatttatggcgatttcaatgtagcggccggcggtaagctgacatttgacgaaaactgcggcgctatgggaactgtgtcggtaggtgcaggtacatttgactgctatagtacattttctataacactcaatataaacgatgcaagcagtgacgtaattcttcacggcggagctttcaaaacaatatgctataacggcggcggggacagagcaaacgcagaaatactgactttgttggctgagaaccgtatgtttatgaagtctcccaatcctgagccgatagacggctcaaaaacactgttgaaagacggttttgcaacacctgttattgtaataccacatgaaggtcacagttacgacagcacaacgggcaagtgtacgatttgcggtaagcggtgcggtcatacggatgttgacagcaaaacaggtgtatgctctacctgcaaatatcagcttactgcgggcatttcgggcgcgggaacagcgaagtatttcgataatatagacgacgcttttactgcggcattatcggcggaaaacaacggttgtacgctgacattgtataagaactgtgagattacacagaacgtagaaatcggcaatacaacggttactgtcgatgtgaacggatgttcactcggcggagaggcagatataagtgtaaataacggtggtgtgctgtaccttaaggacagcaggaaaagcacctactacggatgcatagacgcaccttttagtgtaaacggcggtacgcttataaacggtactgcagacggcggcagttcagccgcagatgtactcaatttagtcattaacagtgctaagtgtgtcgaaatatacggcggcatatttgagaatgtttatattgcacacgcaagcggtgtagctttatacggcggaaggtacaacaccatctgcggcgaggaaagcaacacacccgtaaacgctctgcttgcaaagggctatgcgtttgcgatcttaaacagtgtcacacatctccccgaaagtatagttgacggcagtgcggtgacactcagcgaaggaattagaaatgtcacagttgtaaagcatactcatacatacaccgaaacagagacaaagtgtgcgtgcggtgctgtgctttatgcaaaggtgacatcagccgacggtactactaacgaatattttgacagcattgaagaaggcttattatatgccgataaggctgaaaacaagggctgtgttttcactcttgtaacaagcggtaagatcaatagtggggttaggctgtcaaacggtcagtttactattaccacaagtaattatggtactatctatgattacaaccagacaataactattgacggtgcagatgttattgctgaaggttatatgttcatcaggtgcaaggttaatgtgaagagcggatctcttacattgcctgagggctcaggcgccggatttgatagtattgctatatcaggcggtaccgtaactgtcagcgaaggcgtcaatgttgacaataatgcgggtgctgataatttatttgtaagcgaagacgcaactgacgcaaagcttactataggcggcggtacttacggcaatgtctatctcggacagtttaaattaaaggacgtaatcgcaagcggtgtgcgtgtgataagctacgacaatccgacagatccgactgctgagaaaacagcaaaggctttattatacagcgatatagccgaaaaaaataattttgactccgaaaacaatactgtaagctattatctgtttaccaagtgcgagcataagaatgaggacggcagttatgcctttaatgacagcggtatatgcaaatactgtaactctgagtttgccgcaagcgtaagctatacggttgacggaagtgcaaagacagagctgttcagcaatatatgcgacgcttttgacaaggctaatgagataggtacggctacagtaacgctgtataaggatattacagacagcgaacgtacacaggagattaccgttatgggcaatgtaacgcttgaactgaacggtaaaacactgggtggtcgttatggcatagcgcgtatatcggtatctgacggtggcacgcttactgtaaacggcgatggcgatatggatacacctatttacgttaatgaaaactcaaaattagtcattaacggcggtggatacttcaattctgtgtcagttaaaaaaggaggcaacgcagaaataggcggcggcactatacaaggtctgtccgttcgcggtaacgtaaaactcagcggcggtaaattcaacgacatcgagatatttaacggcaatcttgaatctgtactggcagacggttatgcgtataaaaatgctgacggcacttggctttcgattgatgagcgtgaaaaagatagctatttgggcggttctaaaggagcgttatccgtagaagaagcacccataaagagcgcaagtatttcgtgggcaggcggagaagcgcctgttatataccgtaacggagcgaaaaaattaaaagtcaatgttatatgcgatgtggcggacacttcaaagcggataacctattcggactatgtaaacggcaataatcgcagtaaagattctaagctttctgttaactggtatatggtattcggttataaaatcggtgagattgtagcggaagacggtgaggttgaatattacactgtactgaagtgtgacggatacgaatataagtcgaatgcacttaagtttacacttgcgacctgctcgcaccctgaggatagctttaataacgaaaccgacggtttggtattctgcggtatatgtgatttattgatagaagccgaggtagtagatgctgacggcaagtcgttaggttatgcggatatagagagtgccataaagctggcacaggagaacgagggcagcactgtaaagctgatttcggaaagagtacctgcgtccattaccgtgacgggcggtaagtttactgttgactttaacggtaaagaggcatattgtcagttcactgtcaacggcggtgacgtgactttcacttcttcggcagtacaggacgtgagcaatcaaaatctgccaagcggaatcacagttaacggaactgacgctgaggttacaattgacggtaaaatcaagctgggaagagtaagaataatcagcagtacgcttacagtaaacagtaccgatggttatatcggtgaactgtcaatagaaggcggaaatgctgttatagacggtgcaaatattgatgcactgtcaataaatggcggagcgactgttataaacggtgcaaatattgatgcactgaaagctaacggcggagacacggtcatcaatgatgttaatgccgattctttagctatgtgtgacaaccgctccggtggaagcgaatataacatctctatcgtaagcggtaggttcggcagtttcacttgcgaaaatggaagcaattatactttaggtagggcaattgcgagcggaagcgtagtttcggccgatagtatgaatggcattactgtttacacatacgaagctattcagaccatgaccagtacctatagaatttttgttgataagtgcaaccataaggacaaaaacggcagttatgtgcttgacggtaatccctgtccttactgcaatgaggaaattgttgcaactgtaagctatactgccggcggaagcgaaaatacggatctgttcagcgatatttatgacgcttttgaaagggctaatgagataggtacggctactgtaacgctgcagaagaacatcacggacgatattacagatacgatagctgttacaggcaatgttacgcttgaacttaacggtaaaaggctctcacaacccggtactgatgtatggtattccatagaagtaacgagcggtaagctgaccgttaacggcagtggcttaataaaacgtgttgccgtttgcaacggcagcgatgcggaaatcaacggtggtactctctctgacttcataattaaagacggcggtaacgctgtaattaaaggcggtcaattctacagcttacaggtttcaggcgaaggcagaaacgtaggacagcttcttgcggacggctatgcctattggagttttatcgattccggcatctggtctactattgcagagcgtgaaaagcaggatatagctaatgtagaagtaaggacagcgccgataaagagcgcaacggcgacagcaaataagactgtgctgtaccgcaacggcggaggtgcacggcagatcttatttaacttcaatgttaatacaagcgacggatacacgataagcgatgccaataaggtcacagtcggtttatatgtaggcgataccttaataagagagctcgacttcgtcggaaattcatatacgtttgcaaatgcagatgaaatttccgatactgacggcactgtaaaggcacatcttgttatcaagttaaacggatacgaatatgtgaccgatgatgtcgagtttgaaatggcgacctgtacgcatccgtatgacgcattaacgacagacgagcatgattactatcgttgttcgttatgtgatgccagcataaatgcgatacttgttaaaacaaacggcgacaaggcatgctataccgacaatgtgcccgaagcatttgaagcggcacagcttgaggagaacaacggctgtacattagaattatacagaggtgtgaacagagactgtgagatcacacagggcagctttaccgttttattcaagaaaacgggaagtgcatctgctgtgatcaaagtaagcggcggaaatgtcaagatcacgggagatgacggctgtacattatcgaagtatccgggaagctcggtgggatatctcatagctgtaacgggcggcacggtaacgtttgatgacataactatcaatgatgacagtatcagcgtaagcggcggcaagactgttataaacggcggtacttataataagctgagcgtcagcggaggtacggtcactataaacagcggtacattcagcagcatagatgtaagcgcagagggcaaggcactgaaagatctgctcggcgagaacaaggcgtttacgacaagcgacggaaagctgtttgacgcaagcaaggtttcggaaagcgataattcacttacggtaatcgaccacagcaagcatgagtatgacgaaacaggaaggtgcggctgcggttatcagtgtgcacacagtgagatcaatgcggaaggtgtatgcaacgagtgcaatgcaaagatgtatgctgcagtcactgtaaagagtgagaccggaacaacggtaaaatactttacaaaacttacggaagcgtttgagtttgcggcaaagaacgaaaacaaaggctgtacgctgaaaatgctcagagatttcttcgatagaaatactgacattaacgtaaacggcggagaacttactgtcgatatgaacggctttggtgtctatatcaatagctttaacggatccggaacccaaatcactatacgcagtgacagtaagtgtacttttggggttgaaaatggatttagcatggacggcggcactgttactttctcgggagaggtcagcgtagtttgccagaatgtgaaattaaatgccacatatttctcctcctatgttgaaacgctgaaaattgacacgctgattttagaagacggtgttctgcttaaacagctggcaagtatcacgaatgctaatatcgctaatatagactgctcaagtgaaatttatctttatcaaattttagcgagcggcagccgtgtcgattctcagctgtacagcgatctgaaagcaaacgcttcgtcaaacttcgataacgtaagaataataagatgcgaccacccggacggtgtgggcagagataaccgttgcatatactgcaattcattgatcgctgcaagcgtaagctataccgagaacggagcggaaaagacagaatattttgttaaggaagatctgggaaaggcgtttgccaaggcaaacagcgttgcaattgcaacaataacaatgctgatgtcttccgcttatgatacagactacctccctgttacaggtgatgttacacttattgcaaatggcgataacgccatcttgtataatacagtaaaggtcgccgatggcggtaagctgacacttagaggcaacgccaatattttcgctgtaattgccgagccgggctccaggttgactgccgaagaagccacaagaatcgcatatctcaccgtaaacggcggagatgttaagctcagcggcggacaatatgataacattacggtaaaagatggcaagataacagatattctcggcaacggctatgcgtataagaaaacagagggcggtgcatggctgacgcttaaagaacgtgaggtgtcggaagcaagcggtgttaccgttgctaaggcaccgatagtacaagcaacgcttagcacagaaatgaacaagctgtatcgcaacagcaacgcaaattccacgctgaagttcaacctgtctcttgctaacggctcgaacctgaacgactcgtatgtaagtaagagatacggtataaactcctatgtaagcggagatataatttatagcagcttaagcgcacttgtaaaggacgctaaattgtcggcagacgaaataattgataaggcaggcgacagcgatgttgccgagatatacttcgtagttactaccggtgacggctatgaaataaagtcgaacactgtaagtatagaccttgttgattgtgatcattctcaggtggtcgatcctacagcggacaaggaaaccgcaggtaatattaccgagccgacatattgcgagatatgcgagagcaagttcaatgcaaagataacaaagggcgacgatgtcaagtattataacaatcttgacgaggctgcgaaagacgctcagaagagcgaaaacgagggctgtaccttatatccgctttataacaagaacggatacggcggtcagttagtcataaccgaaggtaacttcacgctcaagtacgcagttcgtacagcgttctcacgtccgatcatcataaacggcaaggcaaagctgacggttacgggacgttgtgcggtgacagcgtttgagaatcaagacgcatttatagtgcagggcggtgatgtcacatttgaggggcttgctacaggcagcaatgtgaccataaacggcggaaatgttacaatggccgcaaacaatataaattgccttacaataaacggcggtaatgtatccatttcgtcaggtgggtttgccgaaatcataactaatgccccgaataaggtgatagccgattatatcgatcccggcttctgggtacaggacagaggaacaaaagagtggatagatatatacagtcttaataaggcaacggcatcatcgacaaacggacttacggtacggttatgtccgatgcagataatcaagccgattgatactgtatattacaccaacggttattatccaggcgacataccgtcacttcaaataaatgcagagccgtggtattcaaacgaggttgacgcaaaagttgcttatcagtggttcgccattgatgaaaacggctacgaaacagtgatagagggcgctacagacagaaagctgtcgctcgaaaatctcacaacgggcaggtactactgccgtcttacctacagcaatgctacaacggcgggagtttcgatggcgtcggacgttgtaacggctacgataaccgaatgtgagcattccggaggagaggctacctgcaccgaaaaggcaaagtgtgaaatatgcggtgcggagtatggcgaacctctcggtcacgactatgttgtaatcaaagtagttgagcctgactatcgcaacgaaggctacagcgtatttgaatgcacaagatgtaaggattcatatatcggaaaccgtgttcccgtaaagcctattcccgatgtggaagaaatagcggttgaaaagacaacatacaatgaagtcgatataagctggaagaatataagcggcgttgacggatattatgtcgaatgctatgtcggcaatcagtggaagcagatcggcttcagcacggacggcgacagagtagcggcaaagctgagcggtctttctgcaggtcttaaatataaggtaaggatagcggcttatgcaggaagcttcaccgccaagttcagatgtttctatgttgatactgttccttctcccgtatggaatataaatacggtgaaggctaccgatgaaacggtaagaataagctggagcagaaacgccagagcggacggctacaaggtagagtggtacattaataatcagtggtccgtaaagactgttaccggcaacaataatatatcggcggttatagacggactttgtgcaggaacacgatataaagtaagggtaagcgcatataagggcgacctttacagtccgtatacatatggctatatcgatacgctcccgtcaaaagttacgggtattacgaagacagtaacatcttcttcgtttacgcttaaatgggataagaacgaaagtgcggacggttataccgctcagtactatgcagacggtaagtggaatgaaaagacgctgaccggcaataacaaaactaccgttacaataggctcgcttaagggctacaaaacctacaaggtcagaataaaggcttataagggtgagcttgagagtgcattcgacgatatttatatcactaccgctccgacaaaggtcagcggtcttaaggtaaagagcgcagttgactcaaaagcagtagttatatggaatgcggatgcgaacgctgacggatataacgtagaatattatatcggcggtaagtgggtcaaaaagaccataaccgataataagacagcaaaggctgtgcttggcggacttacaccttacagcacatgtaaagtaagggtaagagcgtataaggacaatctgtacggcgattacagctatactacggttactgcagtgctttcaccggtaaccaatatcaaggttgtatcggcaaaaagcaactcgataaccgttaagtggggtaaaaacgccagtgcagacggatataaggttgaaatttacaaaggcggcaagtgggtcaaaaagacgttaaagggcagtacgaatgctactgtcactattggcggactcagggccggaagcgtgtataaggtaaggattgcgtcttataagggtgcaaatacaagcacttatacttatgcaaatgtgaagacagccaaataagctgacagtaaaaaaagagaacaccgggcgaccggtgttctcttttgtgtatcagatgcgtttttactataagaacaaactgagccgtaagcaagggtgcttacggctgtagtttgtttattgctttttatgatgccgccgtttcgctgtcctgcggtaagcagaattttgaaaaaggcgaatccggtgcggctcacagccgccgcttacttgaagtatctgttcagcagaccctcgaaagccttaccgtgacgggcttcgtccttagccatctcgtgaactgtgtcgtggatagcgtcaagatttaactgctttgctctctttgcgaggtcaagcttgccctgtgtagcgccgtgctctgcggcaactctcttttcgaggttttccttagtcgatgcacttacaacatcgcctaaaagctctgcgaactttgcagcgtgttcagcctcttcccaagctgccttttcgtagtaaaggcctacctcggggtaaccttctctgtgagcggctcttgccatagcgagatacatacctacctctgtgcattcgccctcgaagttagcctttaaacctgcaagaatctcttcatcctcaactgcctttgcaatgcctaccttgtgctcgtctgcaaatacaagcttttcgctttccttaagctctatgaacttgctgccgggaaccttgcactgggggcagaactcgggaggtgtatctccctcatgaacgtaaccgcataccggacatacccactttttcatagtaaattacctatcctttcatagtgataaaatcattattttcttattgtttttaatgaaatcagtaacgtttactgatttgttggttttattataaccgatacttcggcatttgtcaagaggtttttgaaaatttttttggggaaattgggttagttgtggattactaaaaagggcgaggttttggaagggttggtgaggggcgagttgtgattgtgaacgcttagaagttttagggatagaagttctatcaacttcaatccccaccgtcttgacggcagaccgacttagtaattataaaagtcggatatatccccactcgaatagcgaacccgagaagtgctgtccgataaaaagaactatcggtagctcattatcatagtcaaagctgaatgatataatagaagtacatcaaataaaagactttcaaaaagctaaaggctgacgcataatcacgtcagccttttctgcatttaattttatgtcgctcagttcttgctcagatattcatcaatgctcttagccgcctgcttacctgcacccatagcgagtattaccgtagccgcacctgtaactgcgtcaccgccggcataaacaccctcacgagtcgtctgcattgtgtcttcgttaacaacaagacaacctctcttgttggtgtcaagaccgggagttgtgcttctgataagggggttgggagatgtaccgattgacatgatgaccgtgtcaacgggaagctcaaagttgcttcctgccttagcaataggcttacgtctgccgcttgcgtcaggctcgccgagctccatctcaatgcactccatagctcttactctgccgttctcatcaccgagtatcttgacagggttgttgaggttcttgaagatgatgccttcttccatagcgtgatgtacttcttccttacgggcaggcatttcttccatacctctgcggtatacaatgtatacattttcagcaccaagacgctttgcacatcttgcagcgtccattgcaacgttaccgccgccgacaaccgctaccgacttgctcttgatgataggcgtatcataatcatcaagataagccttcataagatttgttcttgtgaggtactcgttagctgagtaaacaccgatgagatcctcgccctcgatacccatgaatgagggaagacctgcacccgagccgatgaagatagccttgtagcccatctcaaacagctcgtcaaccgacagaacacggccgatgaccatgtttgtctttacttcaacaccgagatcctgaagattttctacttccttcttaactatagccttgggaagtctgaattcggggataccgtaaaccagaacaccgccggctgtatggaatgcttcaaatactgttacttcgtaacccttctttgcaaggtcgcctgcacaggtaagacctgaagggcctgcacctacaactgcaaccttcttgccgttcgactggggcttaacagcctttgcatcgctgtgcttcatgtgatagtctgcgcagaaacgctcaagacgtccgatagatacgctctcgcccttgatacctcttacgcacttgccctcgcactgattttcctgaggacaaacacggccgctgattgcggggaggctgtttgtgcttgtgattatctcatacgcttcttcaaacttgccctctgcaaccttcgctacaaattcgggtattcttacgttaacggggcaaccgcttacgcagggcttgttcttacagttaaggcaacgtgatgcttcttccattgccatttcttctgtatatcccattgcaacttcgaggaagttcttgtttcttacgttagggtcctgttcgggcataggaaccttagttaatgacatattaggcattttcttatcgtcctttccttactgctcagccttgtaaagtctgcagtgttctctgtcgtgagcttctttttccttgtatgtcgagttacgcttcatcagctcgtcaaagtttactaaatgaccgtcaaagtcaggaccgtcaacacacgcaaacttgatttctccgccgacatttacacggcagccgccgcacatacctgtaccgtcgatcataataggattgagcgatacaagcgtcttaatgccgtaaggacgggtaacctcacagacaaacttcatcataggtacaggacctattgcaacaacgagatcatacttgttgcctgcgtcaataaggctctggagcttgtttgtaacaaagcccttttcgccgtatgaaccgtcatctgtcgtgatatagaagtttgtgcttgccttcttgaattcgtcctcaaggataactatatccttgtttctgaagcctgcgataacatcaacatcaacaccctcgttgaataactgctttgcagaaggataagcgatagcgttacctacgccgccgccgataacacataccttctttgcaccctcaaagtctgttgccttaccgagaggacctacaaagtcgagcagtgcgtcgccctccttgagctgtgataaaagcatagtagtctgacctactatctggaatatgattgtaatagtacccttttctctgtcatagtctgaaatggtaagaggtattctctcgcccttttcgtcaacacgcagaatgatgaactgacctgccaacgccttcttcgcaatgaagggagcgtctacctccatcagtacaacgttttcgttgagctgacgtcttttgagtattttatacattgaaaaaacctttcctttcgttatatatgggagcatctgtaaaaatacagacgcttcagttcgccacacataagtatagcagattgacggaaaaaattcaagcgttttcgatatttatatattgaatagcaccattacttaaagtaatgatgaaaaacgacccgtcacggcaaaaactctttgcatccctgattttatgcggtttgagcgaccttgtgacacacacgtcatatatcgacctttttctcattgacaaaaactgcattatgagatataattataatgttattgtaaaattgggttatatgtgtaaagactgagaaatgcctttattcaaatccgggaggcttaatgaaaaagaaaaaatcgaataagctgaatcttattatttgtgcaattgcattcgtatttatgatcttctatgtgtattttgtggacggatttgataatcttgtcaattcaattcagaagataaatgtcggattcctgttcatagcgatgggccttatgatagtatactggctgctggaggcgctcggcgttcatgcggcgctgagggctacataccctaaggcaaagttcagcagaacatttatgacgaccctgctcggtcagtatttcaactgcatcactccgtcgtcaacgggcggtcagcctatgcaggtgtattacttcacgaagttcggcgttcctatgtcgcacgcaatgacatctctgctgagcaagttcataatgtatcagtttgtgcttacaggctattccgctgtggtgcttatagcccgtttcaataatttctctaccgactacgcaccgcttatggcgcttgtaattcttggatttatcataaatactatcgtaataatactgctttttatgctggcgtttttcaagaagcccgtaaagaagatggctatatgggctgtaaaactgcttgcaaagatacacattttcaagttccgctttataaagagcgaggaagacaagataaagaaaatcagatccgtagaagaaattgtagacgaatatcatgataatttcgtgttcatcaagaaaaaaccgtggcttatcataagacttatcatttataatgtaattcagctcacggcttacttctcaatctcgtatgtaatttatctcggcttcggactttcgggtacggattatctgacgattatttcctgtcaggcattcgttctgatgatttcaggctttatgcccctgccgggtgcgctcggtgcggcggagggaagctatacgctgttcttcagcaatatattcatcggctcggacggcacaaaatatgtcggtatctcaacatttatatggagattcttaacgttctatcttccgataatcgcaggacttattctgtccacctttgtcggaaagtttatgaatgtcgaagcccccgacaagtcaacaatcaagcttaccgaagaagaacttaaaggcgacccgatagactgattgcttgaaatttacaaaatattcttacggcagagggtgtatgctttctgccgtttgctgtatctggggcgcaaagtgaaacaagccggaaacggctctgcaaagccaatgcaaccgcaaatttacatgaaaatattcaaaagcaacatgaagtttatagaccttatacgctgatcatgctaatatgacgacagacagaaaagctgtcggaaaggatatgtatatatgagcttaggaacaaatattcagttttacagaaagcaaaaaaatatgacgcaggaggatttggcagagtttatgaacgtgtcacgtcagactgtgtcaaagtgggaatctgacactgcgtttcccgaaacggataagcttatcacgctgagcgattactttggctgcacgcttgacgaactgattaaaggcagtgcagaagaaaactttacggaagatgccgcaggatatgataaggaaatgaacagctttacaagggctatctgtcttggtaccgcaactgtgcttgcaggtgttaccacactgctttttacggtaggtctgggacttgacgaaacaatagcaacggcaatatttatgctgtttgtaacgatcggtgcggcagttttcattgtcagcggaataaaacacggcaatttcgtaaaggaaaatccgaatatcaagccgttctacagcgatgaacagaaaagagatttcagaaataaatttcccgtatttattgcaagcggtacggtgcttgtactgctcggcataatcgcattgatggtaatgcagagctttgtcgataaggttgtacctgatgttatgaccgaggaaagctttgatgcgctgtgcgcggcggttctgcttttatgtgttaccgttgccgcaccgctgtttatatacggcggtatgcagtatgcaaagtatgatattgaagagtacaacaaggaaaataaccccgacaagccgttcgcggacagacttatgtcggctatatccggcggtataatgcttgcggcgactattgtgctttttataatgggattttgttttaataactgggaattgtgctggataggttatccgataggcggtgttcttatagggattgtaaactgtatattcggcgctgtaaaaaaataagcagatacttgcataatttttgtgaatatggtacaattaaagagcgataactgttacagttcttacagcaacagctatcgtaataaataatttgaggaattttcaccgtgaaccctttattgattgtactgtatgttttactcggacttcttgcggtatacgccgtactgtttcttattgcggtactccgtgccgtatttatgaagaaagaatttgcggacgataagccgttcgatccgtataaggacggtatcgactgcgacgcccacgcagagcatctgtcaaaaataatacaggtacctaccgtaagtatccgcggcagaaacgacaacaccgagatttataaattccacgacctgctcgaacagcagtacccgaatatccacagggtatgcgagcgtgtcgatattgacggagcgttgctgtttatatggagaggcaaggataagaaccgcaacccgatatgccttatgtcgcatcaggacgttgttcctgccgacagcgaaaagtggaagtacgacgctttttcgggtaagatagccgagggcaagatatggggcagaggtacggtcgatactaagggcgcattatgtgccatactcgaaagcatagaggagcttataaaagagggcttcacccccgtgtgcgatgtctatgtcggaagctccaacaatgaggaaataaccggcgacggagcagtaaaaacggtcgaatatctttatgaaaagggtatacatttcgatttggttatggacgagggcggctctgtaatgtcatacgaggacagcgtcaagggcagaatggtagcccataacgctatgataggcatactcgaaaagggcagagccaacataaagttcaccgcaaggagcagaggcggccacgcaagcgttccgttcaacaataacccgtttgcaaagctgtcaaagctgatgtatataatcgaacacagaaacccgttcaagaaaaggataacccaccccgcaagagtgcagtatcacgctatggcgccatatatgcaccacttcagacaccgcctgctgtacggaaatctgtggcttttcgccccgatagcaccgtacataatgcacaggataggcggccctgcgggagcggtcgtaaagaccacctgcatattcactatggcagaaggaagcaaaggtgcaaacgtgattcccgaaaaagcaagtgttaccgcaaactgtcgctttatggtgcacgagcctttacctcagtcgtataaaaagctcggaaagctgtgccacaagcttggtatttctatggaaatgctggcaggctttgacgttccgcccgttgcagatatgaactgctatgcgtataaatatgtcaacaagaggataaaggaaaccttcggcgatataccgagaataccttatataatgctggcaggcaccgactcacgtcactatacgaagatatgcgactgcgtactgagattcgtaccgcttatgatgacgggcgcacagctcaacagcgcacacgcaattaacgaaaacctcagcgtagaatcgcttgaacgaggaatagttttctatcacgatttcataaaaaattacggctcagagctgtaatgcggacataaccgtgtcggaaatctctgaaagataaaatataatgattttattaaagctgtactgtaaaatttattgctgccatcgccgaaaagactttccgtaccgacaaggcattaatattttcgtgagtgcatcattacaactgcactgacattgacattaaaaaaaacgcaccatcccttgccccgcaccatcacccttgcctcccctcgaaaaaggggaggtggcacggctggtaaaagttaggcttttatcaatacaaagttcagaaaatctgtccttaatatctcccaaacaaatccgagccgtgacggtggggattgttcccccttagcaccatcattacgctgttaccctctgacatttaaaagggtgaggttctgttgctcggtcaagctgggccaactatggtggggattgtaattgcttagaagttgtttttctaagtactttggttctcgctctctttcatattgacaagtgtacccattcgaatagcgaacccgagaagtgctgtccgacaaatagcactatcggtagcaaatgcttaatggcataaaataaaaatatttgataatgtccttttcctacaacctgttgcggcggatcgttccgccgctttttcttacccactcggcatttttgacgaaaaaacaccgcccgaattgcaaaagtcattgacaatacccaaattagatagtataataatatagtacgcaggcgaaattcgccatagcggaattcggaaacacggtaattcaccgtaatttaacatggaggcttttggtaatgagagtttacaactttagcgcaggtcctgcggtacttcccgaagaggtacttaaagaagcagcagatgaaatgcttgactacaaaggaacgggtatgtccgttatggagatgtcccaccgctcaaaggcatatgatgcaattataaaggaagcagaaaaggatatccgtgaacttatgaatatccccgacaactacaaggttctgttcttacagggcggtgcgtcacagcagttcgccgcagttcccatgaaccttatgaagaacggcaaggctgcttacataatcacaggccagtgggctaagaaggcatatcaggaggcacagaagtacggcgaggctgtagctgttgcatcatcggcagataagacattctcttatatccccgattgctcggatcttgatattcccgaagacgcagactacgtttacatctgcgaaaacaatactatctacggcacaaagttctggcagttacccaacacaaagggtaaggatcttgtagccgatgtatcttcctgcttcttatcagagcctgtagacgtaacaaagtacggcgttatctacggcggtgttcagaagaacattggccctgccggtgttgttatcgctataatccgtgaagacctcatcagagatgacgttaaccccgcaactcccacaatgctcaagtggaagacgcaggctgatgccgattctctttacaatacgcctccctgctacggtatctatatctgcggcaaggtattcaagtggataaagaagatgggcggccttgaggctatgaaggctcacaatgagaagaaggcaaagattctttacgatttcctcgatcagtccaagctgttcaagggtacggtagagaagaaggatcgttcgctgatgaacgtacctttcgtaacaggcaacgaggagcttgacgcaaagttcgtaaaggaagctacagcagcaggctttgtaaatctcaagggtcacagaaccgtaggcggtatgagagcttctatctacaacgctatgcctatcgagggtgttgaaaagctcgttgagttcatgaagaagtttgaagccgaaaacgcttgattataaccgtataggtacaggaggatataccaatgtacaacgtaaagacattaaataagattgccgcttgcggtacagaccttcttgacagaagcaagtacactgtaggcgacgatatagacaatccgcaggcaatactcgttcgttccgcttctatgcacgaaatggagcttggcgatgatttactcgctatcgcaagagcaggtgcaggcgtaaacaatattcccgttgacaagtgcagtgaaaagggtatcgtagtattcaatactcccggtgctaacgcaaacgcagtaaaggagcttgtaatactcggtctgctcatcagcagccgtaaggtcacagccgctatcgactgggcaaagaccttaaagggcaagggcgacgaagtaggcaagcttgttgaaaaaggcaagagccagttcgtaggccctgagataaagggcaagaagctcggtgtcataggtcttggcgcaatcggcgcattagttgcaaacgcagccgctgagctgggtatggaagttataggtgcagacccgttcctttctgtacagggcgctctcaacctttcaaacaaggttaagtatgtaaagagcaacaaggaaattttcgaaacctgcgactatatcacagtacacgttccgcttactcccgaaacaaaggatatgataaacgcagacgttatcaagacaatgaagaagaacgtccgcattatgaactttgcaagaggcggtcttgttaacgaggacgcagttgttgaagctctcgcaaacggcggtatggcggcttatgttaccgacttccccggcgacaagatactcggtgttgacggtgttgttgcacttcctcacctcggagcttccactcccgaaagtgaagataactgcgctgttatggctgcaaacgaaatcaaggattatcttgagaacggcaacattgtaaacagcgtaaacctccccaacgtttcaatgtcaatgacaggtgacgctaagatttgcgttatccacaagaatgttgaaggccttatcgcaaagattacaacctgcatcactgaggcaggtatgaacattgagaacatggagagcaagtcaaagaaggactatgcttatacggttcttgacgttaagggcaatgcagacagcgtagccgacaagataagagcaggagaagctgtgatttctgtaagagttatcaagtaatcaaaaacaatcagataaactatgaaccgccgtgtttcgcacggcggttcaatctgtcaaaaaacctattgttattatagctgtactgtgaaacacatcaccaacatcgccgaaaacagtttcagtaccgacaaggcattaataatttcgtgagtgtatcggtacaactgcaccgacatttatccttcaaaataacgctactaacctgagatatatgtactaatatgcggacgtgtagcgttaagcgtccctgcattgataggatatacaatgtttgggtggttattcgagtttatccaacaccccaggcggagtgggggtgtgagtaaggaaagagggagcacgagggagagaacctaagagatagggagagggggcgcatagctcccttgccctagtctctttggttctttccctcgttcatattgacaggtgtattgattcaaatagcgaacccgagaagtgctatccgacaaaaagaactatcggtagtctactatcgtagacggagctgaatgatataacagaagcacattaaacaaatttttatgcttatgtacagaatacacaaaatcccgccgataatttcggctataatttaacgcttgctaccttgcaatgcaaggtacattgtgttatacttagtacaacgaaacagaaaggagcgttgtatgaatccacaacttaaaagaggaacgctggaactgtgcgtactggctctgctgtcagaccgtgattgctacggatatgagcttgtaaatgcaatttcggagagcatccatatcacagaggggacaatttatccgcttatgaaacggcttaaagacgaggggtgcatcacctcctatcttgtagaatcaagcgagggtccttcaagaaagtattattcgctgaccgacaccggcagaaagaagctgtcggtacagataagcgaatggtcggatttctataagtccgtcaataatatactcggtattgattgaagaaaggaattgaattatgacttacaacactaaagcagagtttatggcggctctgaaatcacaggctgagaaatattcattatcgttcggggaaatggcagaggattttgaacgtcatttctctgagggagaggaaaacggcgaaaccgaaagcgagatatgcgcaaagcttggagatccagttgagatagtaaaggagtatgtcggggagaattcggaaaatgtacaaagcagtaatagcaatgagcagaatatcactgccgggataaatcgtgttgacagcaatacaggcaagatcagcggcggaatgataacaggtgttatactgcttgatctgtttgtacttgactgggcattgcctacgttggcatcacttgttatagtttatattgcggtagcgtttgcttttattgtttccggtgtggtaagtatcatttccgttatgctaccgtttgtttctgacagtgttacggcacttctgttcggcagaatgttcaatgtatttgcaggaatggttatccttggactcggcggaattatggcggcgttcacgccaaacgttataaaaggttttgcaagtgtgataaaagcggtagcaagacttcatgtaagaacgtttgcaggaagaaaggcaggtttctgatgaaaaagataatactgataatatcagccgttttgctggcattaggaattttgggctgtgcagttacggcattgccgacattgcttgaaggagagaagtatatgaataacataatcgacaaaaactcagaaaagcaggagtttacttttacagatactttttcaggacttgatataagcgtactcagtgcaaatgcaaatatttcatacaacaacggtaacgaggtaaaggtaagctatgttacggtggataaaaacaagaaaatagaatgtaatatcactgacggtacgcttaacattaaagaaaaatcaggattttcattcttttcactctttacacttgcaagcgttccgacaaagatagaaatatcttttcccgaaagctacagagataacggtacgcttgaaaatgcagatgtaacggtagcttcaggctcgctgtcgggagatatgccgcatactgaaaaaagtacaaaaattcagttatacagcggtaagataaattcaagtgttgccgcagaaaattttgatattaatgtatcatcgggattggctgatatatcttcaagaactcataaacacacaaatgtaaatgtatcggtactcagcggtaagattacacttgacggattcataagcgaaaagagcaaatacagtcttacctccggtaaaatcacttcactgaatgcaggcggcggtgaactgtacacaaatgttacatcgggttcgcttacgcttggctgtgcagaaaagattacaggcatagatgcaaaagtagcaagcggaaaggcgcatatctccataccaaaggacacaggggcacaggtaacatacagtgttgcttcgggttcgataaaaatcggtcttgacggaagaaatgaaaaacttacaggaagcggcagtatttcatacggaaatgccgaagcaaatattaatgtcaacgttgcaagcggaagctttattcttgatacatacacactttcggaatgattctaaaggttacaaaccggtaacaaaatagttacagttttgtcataaatattgacttacctttttttgcatgatatattgaaatcaggaaaaagaacatatcttacagatgctatactatctgattcaacctcgacagacaggaggattaaatgaagattgcaaaaaacataagtttaggtatcgggatgcaagtattggtgttgctaatgcatatacttattcattctattatgtacgttatggacggcagttttgatgacatccagatagcttgctcattcgttgcggtaatacttataacgtatctggcggttctttgttttgatttgcccgtatacgtaatattctgcggtgcggttattacatttctgtttgtcttgatattcgaaaacgagggggtgtatttattatactatctccatagtggaagttccccattttttaatcccgatgtttttaccgatgcggtaattatagtattagaaatgcttgttgtacaattgccctctttcgctctggcgaaattgacaagattagtctgcaaaaaaactaaactgtagtgtttcggtataggaggcttcatgaagcataattttacaagcagaaagattatcggttctttgtttttcccgatattaatatgtctgatattcggaacttcttttatcattttttctattggcaaagaattaaacgctttaaggctcggctgtttgttcagcgctctacttggcggatttcttccgatagtaattacgctgattaccaaaaccgatacaagcttttatcttaaagacagggctattgtgccggcaatttctttagtttttatctttattgcttgtcttctgaacgaactgttggattctatctattatgcatggtgtgctattttcttgttcgttattttatcaacattttattttctgcgaaagtgcagaacgggtttagaacggttaattgtcattatttcaaatccgattctgtatatagcggtgtgtctgatatgcttcggttgtgacttaactgtattgcttgattaataatgtatatacgggttatacaattatatctgttatgcggctgatgccttttagggctgtcagccgcttttctgtataatgaaagcccccatttgtcgcaggtaaatgtgcggcagttgatgcgcctgccgaacagccggaaaaggttacaaaccggtaacaaaatagttacagttttgtcataaatattgacttgcagtttttatgtgatatactaaaatcaggaaagaaaatacaccttacattacatcaatgaaacgtaaaactatgaaaggactgaaaattatgacaaaactattaaaaacaatcacaacaatagctgcacttgcaactacattaataacggtaagcatttatgcgtccgctcaatcgcccgttgacaacggcagtaatgcaagagcagaaatggcacagaacggacttattgcagggcagacagcggaaagcaacgcattccccggctggatagtgttaagcacagcaggtgcggcagtccttgtaggaggaattattgcaggctcggtcatcagcaacagaaagtcaaaggacgataagcgttaaaaattacagataagatttacggacagcttcacggctgtccgtttcggtttacccggtgcaatccgtacaaaacagtatccgcaccgcaagacgcagtataaataacagcgtattataaaccatagctcagcttttacttgaaattttatgaaaatgtgctaaaatataatcagacagaattgcgtgatacgaacagatttcactgtcggtataatgcgccaaaaagtaatactccggagggtaaaatgtctgaggtaactaaaaaggcactcgagcagtcgcttaaaaatcttcttctgaaaaaaccgcttaccaagattactataaacgatattaccgaggattgcggcataaaccggatgaccttctattatcattttaaggatatttacgaccttgtggaatggtcgtgccttgaagacgcaagaaaagcgcttgaagaaaagaagacccacgatacctggcaggagggttttctgaatatatttgaggctgtgcttgcaaataaaccgtttgttatgaatgtctaccgctgtgtcgatcgtgagcaggtggaaaaatatctgaaaccgctgacagacggtctgataatgggagtaatagatgagcagtcaacaggaataaccgtgcgtgatgaggataaggagtttatcgcacggatatattcgtatgtgttcatagggataatgcttgactggataaaaggcgatatgaaggaagacccgaggctgataatagataagctcgcattgcttataaaagattccgtttccgatgcgttgaatcgtttcaaggaaatccatgaagatgatagatgaagccctgcgatacgcaaaagcaggcattcccgttttcccgctccactggctcaagcaggatggcacatgctcctgcaggcttggcgatatgtgtcaggccaagggcaaacacccccgcattaagaattggagtgacgaagcgacaacggatgtcgctaagatcactggatggtggaatcagacgccccttgccaacattggtattcccatgggtgaaaagagcggtctggtggcgctggacgttgacactcgacatgatggagataagagcctcacggatctggtcacagagtacggtgcattgccgaagacgatcacggcaacgaccggtagtggcggtaaacactacattttcaaatacacagaagaactggcactcaaaaatgtggttggattccgtgacggccttgatgtacgcacacaaggtggactgatcgttgcagcacccagcatgcatcagagcggtaaccgatatgcgtgggatactggactctctccttttgagtgtgaagcggcggaaatgccgagctggctggtagatgagattcgcaaggttggcactaagcttacccaaaagaaaaaggctgcggacaagcagccccgcaagaagatcaaagaaggtggcagaaacaatcacttggcctctcttgccggagcacttcgccgtaaaggcatcggtgaggatggcatcattgctacacttcgtgccgaaaacaaagaacgtctcgatccgccccttgacgatgagacggtcgtggcaatcgccaagagtatcacccgctatgagccggacgaacctgacccgcagtacaaactgaccgacgtcggaaacgctgagcgctttgtggcgatgttcaaggacgaggtcaaatactgctctgtatataagaaatggtttatctggaacggaaagttctgggagcaggacgaaggcacgatcgtagaatatgcgattcagtgtgtccgcagcatttacacttacgcggatatgcttcccgcaggcgatcaacgaaaagcattgatccagcatgccatgcgtagcgaaagcggcaataagatcaaacttctcattacgcttgcggcaggcatgaaggatctggcgattgcgcctgacgactgggatgcaaacccgtggctgctcaactgccagaacggcacgatcaacctgaagaccggaaaactgcagccgtttaataaggcggactacattacccgcatctgcaacgcctccttcgatgagaattgcgctacgccgttatgggatacgctgttggagacaatcacaaagggcgataccgacacaatccggtacatgcagaaggcactcggctatgcgctgaccggcgatacatccgagcaggcgatgttcatgctttacggaaccggcagcaatggcaaaagcacgtttctcaatatcttctcggccgtgatgaatacctacgcccagagtgcgtcgagcgatgcgttcatgcagaaaaagagcgaaagcgtaaacaacgatatagctcgcctcaagggtgcgcggtttgttacggctattgagatggaagagaataagcgacttgccgaatccttgatcaaatccatgaccggtggagacaagctggtgacgcgcttcctctacggcgaatacttcgagtacgtcccgcagttcaaggtgtttctggcggcgaaccataagccgatcatccgtgatacgacccattcgatctggcgcaggatcaagctcatgcccttcgagaacacgttcacggaggcaaaccgcgacaaacactttgccgataagattatggcaaaggagatgcccggtattcttgcttgggcggttaaagggtgcctcctctggcaacgcgaaggtatacaggatccgcccagtgtcaaaagggcgacaacggagtaccggacggaaatggactcattcgcaacgttctttgaggaatgctgtgaggcacgggaaggtgtccgtgtatcgaacaaaatgctgcgttcttcctatgacgagtggtgcaaagacaacggcgaatatgcactttcccagcgcccgttcagccagaagcttctggaaatgggatttgaaaagaagcgttccgcaagcacaggagccgtggaatggatcgggctatccattcgcggtgtcgcatcgaggctatgactgaggtacgattcttcctgattctttttcctataaagccgtatgtgagaagaaatatagaaaaagaacagaaaaagcagtcagtatggttcatacctcagcggctggaggaacgcagatgaatgaagcagcattgattcagaaaatacgcaaataccttgccacggtaccggagtgcttcttttggaaggagcacggtgggcaatatggtactgctggcattcccgatatcatcgtctgtcacaagggacgcttcattgcactggaagccaaggtcggcagaaataccccgacaaagctacaagcggctaccattgaccagatccgaaaagctggtggaacagcagtagtcgtttatagcgttgaggatgtgcaggcggtcatatcaaagaaggaggcactgtatgatggatgatccctatagaactctggcaaacgccattatcgtacaggccgctaaggattaccggaaagcgctgcggcagcttcgacgtaatccgagatacgaaacggccagaaacgagaaaaatgatgtcgagcggttctttcactccgaatggtttcacttcctgacggatgcagacccggattacctgctcgactatcttgcgagggctgagatatgacggcgaaggctcttttggaacgcattatcaaaatccgaaaagcgatcgattatcgaaggacgaaaatcgacgcactgaccgagcaggcggagaacacctccgcccgcttgaccggcatgccgcataatccacgctctgactcttcgcctatggcaagcgccatctgcaggaaggtcgatttggagatggagatcacaaagctcgctgaagagcgcaaagccctgattgctaaaatcgacctcttagaaaatgatgacttatcgaggctcctaattctgcggtatgtgcaggaaacgccgtgggacgatatcgcggcagagatgggcttttgcgaaagacacatttaccggctgcacaaagcagcggtcgaggaactcgataatcgattgaaagatgtcatgtgatgtcagtcgatgtcagttaaagtcagtcaggaaatgcggtatcattataataggcgaagaacatagagagctcacacgggacacctcgcgtgggcttttcttatatacgccaatacagacggaagaagcagatcaatgtcatataggaaagtcggcactttagagcagtgttggtatgtcctcaaatactggctgcgagagcacttccgcaagaggaagtgagactatgccgcgcaaacctaagaggccgtgcgcttaccccggatgccctaacctgacaggcgggcaatattgtgagcagcacaggaaatacgcaaggcagcagtatgatcgatatgagcggtcaccacataccgcgagtaaatacggaagagcgtggcaccggatccgcgccagatatgtagcatcccatccgctgtgtgaacagtgccttaaagaaggtcggatcacaccggtagaagaagttcaccatatcgtgccgatcagccgtggcggaactcacgcagcggacaacctaatgtcgctatgccaaagctgtcataacaagattcaccacgacctaggcgaccggtagggggatcaaaatcttgaaaacttgattacgcggacaacggcgcggggtcacgcgcgaaaaatcgggaaatcaagatgggtatagaccccgcgatttcaagaaatcaaacgaaatggaggtagcgcacatggcaaatggacatggcggtgctcgccccggcgcaggacgcaagaaaaaagcgctatctgagaaaatcatggatggaaacccaggcaaggcaccgctgacgaaactgcagtttgaaattcagaagacggatatgcatggtgaggacatgccgccggtcgccgaatacctgaagcaggtcacaaaaaactcgcagcaaaaccttgcaccgcagatttacgaagacacgtggcgctggctcaatgagcgcgggtgcgccatctacgtcaagaaagaactgattgagcagtatgcgctgtacatgcagcgttggattcagtgtgaggaaggcatcaaccaatatggattgcttgccaagcacccgaccacacaactgccaatcgccagcccgtatgtgaatatgggcatttcgtttttaaagcaggcaaacgtattatggctgcagatctaccagatcgtgaaggacaactgcgaaacgcccatcggtagcagcaacccgaacgacgatctgatggagcggctgctcggataaggagatacacatgcagatagaaaaaatccccgtggcaaagctgaaggctgcggaatacaacccgcgtcgggcgctcaaacccggtgacgcggaatacgaaaagctcaagcgcagcattacggaattcggttatgtggagccggtcatctggaataaacagaccggcaacgtggtcggcggccaccagcggctgacggtcatgcgtgatcttgggatcacagagattgattgcgtcgtagtggagctcgacccgatgcgcgaaaaggcgctgaatgtggcgctcaataagattcagggtgaatgggacaaagataagctggccgctttgctcacggagttcgacggcagcgagttcgacgtcaccctcacaggtttcgatgccgccgaggtcgatgagctcctgaatgctttctactccaaggaagcggtgcaggatgatttcgacgttgacggagaagccgaaaaaatcaaggcaaagggtgcggtcactaagaccggcgatgtctggaagctgggggtacatcgactcatgtgcggcgattccacttcggaggtggatttcgccaagctcatgaacggcaacaaagcgcagatgacggtcacgtccccgccgtatggcgtcggcaaggattacgaaagcaaaggcatcgagccgtggtttgaaaccatgcgcccggtggtcaagaacctgactcgctacgccggaatcgtctgctggaacctcggcgacctctacgccaccggcactcagttcatcgagccgacgaacttctactcctcccagcttttcgcggagcagggcttccgcccaatctggattcgcatctggaaaaagcagggacagaacttcggcgtcggcccctaccatctggtgacgaacaagccggtgcagcagtacgaatacatctccgcgttcagcaaaaatggcgacgtcgagtacaacgatcaggaatacatgtggctgtctgcatacgccggtcacgcataccgcttcgtcaagcgcctcaccaaagaggaacgcaaaaactggggttacgcaggcatctgggagatgaacacggtacgcgcgaacaaggatcaccctgcaatgtacccggtggaactcccgtggcgctgcatcaaaatgcactccgatcgcggcgacattgtgctcgagccgttcagcggcagcggtacaacgattatcgcctgtgagcagctggagcgcgtgtgctacgcaatggagaaaagcccggaatactgcgacctcgccgtcaagcgctgggagcagttcaccggccagaaggcagagaggataaccagccatgccgacgcagaatgaccgccacaccatatcagacctgtatcagatgcaatcccttccgctggagatcaaggtgcggatgacgcagcgccggatacgcgactgggtggaatactggggcgaagacggcgtgtacgtttcattcagcggcggcaaggacagcacagtactgctggatatctgccgcaggatgtacccgaacatcgtcgccgtgtacagcgatacgggcttggagttcccggagatccgcgaattcgtgaagaccaaggataacgtggtctgggtaaggccggagctcacgttccgtaaggtcatcgagaaatgcggatatccctgtatctcgaaagagcaggcggaatggatacaccggatccgcctcggccagaagaacacacgcgatatccagaaatacttttacggcatacgcaccaacggccagccctcccgcttcaagatttcggagcggtggaaattcatgctgaacgcgcccttcgacattggcgcgggctgctgcaatgagatgaaaaagaagccgatcgccaagtacgcgaaagagaccggccgcgttccgatcgtgggcacaatggcgtgcgagtcatcgctgcggacaagcaactggctccgatacggctgcaacgcctacgataacaagaaggcgacgtcggcacctctctcgttctggactgacgcagacatctgggaatacatccgcacctacgatattccatactgcaagatttacgatatgggctacgttcggacgggctgcatcttctgcatgttcggcgttcacctcgacagcgagccgaaccgcttccagcggctgcagcggacgcacccacagttgtggcgctactgcatgaagccgtgggacaagggcgggctcggcatgcgcgaggtactggaatacatgggcgtgccctacgaaaacttcatgctggaggaggaagacaatgtttgaaaaagtgaatccggcgcacccggacaaaatcgccgatcggatcgcaggtgcgatcgtggatctggcatataacgaaaacgcgaacccgaagatcgccgtggaggtgctgatcgggcatggcatgtgcaatatcgcggcggagtcctccgtgcatatctcagcaacggatattctggaagcagtctcgcggatcgcgggcgacgtggtcgtaaactaccatgaggttgcgcaggatcccattctcgcaagaaatcaggcgaatgccgtgcgctgcggcgacaacggcatcttccgaggcgtccccgtcacggacgaacagcgtgcgctggcagagatcgcaagagaaatcttcgcacgatacccctcggatggtaaatacattctcgacagtgaccggctcatcatctgccaaagctgcgcggacaccgaatacctgcaagatcagttccccggcgcggagatcaacccgctcggcgactggacaggcggcatcgatgtggacaccggcgcgaccaaccgaaagctcggcagcgatatggcagacagtattacgggcggaggccttcatgggaaagacctctcgaaggcagatgtcagcgtgaacatctacgcatggctcaaagcccagcgggacgacgtgccggttgagctctgctgtgcgatcggcgacgataccgtggacggcagaccctatgccgagattgtccgcatcgcccgcgactacatccgcaggatcggcggatttgagaagttcgcagaatggggtttggtatgaacattgaaaagatcagcgtggagaaactgctccccgcgaagtacaatcccagaaaagacctgcagcccggtgaccctgagttcgagaagctgaagcgcagcataaccgagttcggttacgtcgagccgatcatctggaacaagcgaactggtgtggtcatcggcgggcaccagcggctcaaggtgctgcagcacctcggctacaccgaggtggactgcgtcgtgctcgacatcgacgaacagaaggaaaaagccctgaacgtggcgctgaataaaatcagcggcgcgtgggacgttccgctcctgactgcattgctgcgtgatctggatgagagcggcttcgatgccaccctcaccggcttcgacgtcagcgagatgagcggactgttcgacgatcagagcgagatcgtggaagacgatcccccggaggcagcgccggaaggcacggagccattctcacaactcggcgaccgctggctactcggcaggcatgtcctctactgtggggatagcaccgagaaaaaggacatcgcagcacttatggacggcaagcaggcctacctcgtggtaacggatccgccatacaatgtggcatatgaaggcagcaacggactaacgatccagaacgacgatatgccggaggaacagtttcttgcgttcctgatcgcagcattcagccgaatgcatgaggtcatgaaacccggcactccgttctatatctggcacgccgagacggtcggcggcgcattccgcagagcgacgaacgaggcactcggcaaggtgcgccagatgctggtgtggaataagaacgcattcacgatgggacaccaagattaccagtggaagcacgaagcttgcatttacggctggacagaaggcggctcccactacttcgtggatgaccggacgcaggcaacggtgatcgaggacaagcgcattgatatcaacaagctgaagaaggaagaaatgcgcgatctgctgcgggaaatcttctcggacaaggtctcgacgaccgtgatcgacgaaaacaaacccgcccgaaacgcggatcacccgacgatgaagccactgaagctcttggcgcggctgatcaaaaacagctcgcggcagggcgacatcgtgctcgacaccttcggcggcagcggtagcacactcatcgcctgcgaacagcttggcagatcatgttacacgatggagctcgacccgaagtacgcggacgtgattgtcaaacgctggctgaaattcaccggtgtggatcacgccgagctcgtgcgcggaggcaaaaagcagccggtcacggcgaatatgttataactgctaattcttctgcttttcggttttgcatctggacttcctcgttcctttctggcttaatacccttaccataaacaagggaggtacccaccatgacactggaaaaggcaacgaaagacatgcaagcgctggtcgcgcagcacggcttcaactacgaaggcgagctcacctacgacggacggcagatcttcactcggcgctggacgaagaaaacgcaggtcgtgtggtacggcgaatgcgaaagcacgctggagatcaagatcagcatgagttacggcatcccgctggtcaggatcgtccgcgacggcagacgcgaagacaagccccgtgactactcaagcccgaagcgggcattcaacgccattggcgagatcgttcgatgcgccggattcgagatgtaaggaggcggacatgatgtacgaaaccagaaaagaagcagcggacgcctgcaaatacgaagcagcggcagccgagcgattcagcacggcggccatccggaaagcgagcgaaggccaatgcagcgcagcatggcggctcgcggatcaggccagaatggcagcacggtgcgcgatgcaggcgcacgaagcgctgtgggcactggtgggcgaagacatgaccgaagcagagttcgacgccttcgagaaagcagagatcgcacaggtctccgcaggtagagccgaacgcgcggcggctgcagcggtcgaaaagctgaacgcaacgcagcacggcctgcccccgaagctcgacgctctctgcgaacagacaggtacccgccccgaagggatcaaggcgctcatggcctactacacagagaacagcggatggacagaacagcaggcggtcgagcacatcgaaaaactcttcgaggacgggacggtcgaggcgcttcagatgctcaaataaggacagcagcagcgtcgcagaacacagttctgcggtcgcttttttagttgttttctttctgctaattccgcgtttttggtctggactttcccgctcttctctggcttaattgtcctaccaaaaacaaaggagacaaccccaccatgacagagaaacagatcaagcaggtcaaagcccagctccccgaaggcgaaacgctcaacaggatgtaccgctcctacgaaggcgacatccgcgtgatcagccgagacaggaaaggcaacgaacaccggtacacaacccgcctcaacgcagacatgagcgtaacgctcataagcatgtaaggaggtggacgcagtgatcacacttgaaagcttctacgacctgatcagccggaacgcacaggtcacgctgctgaacacccggtgccgcacgaacatctttaccggcagcgcacgggacatcccagacgaatacagcgcctgcccggtcgaggacttcagcatgaacgacagcggccacctgaccttcaagatcaaggtcaaggaaacccggccagcgggcagcaactggcaggaaggcacgattcgagtccatgaccggatctaccactactgggtaaagcagtacccggagagctccaagtacgggatcggcggcgggcgcgtctcgaagctgatgctgaagcgcaagggcgaaatcgtctgcaactacgatcgcggctgggacgtaaagcccatcgacgaagacaccgagctggcgaaggacatcatcctccaccagtacacgctgtaaggagagattgacgatgttcggaatcagaagagagacggtcgagcgcctgcgccgtgaataccccgtcggctgcagagtcgagctcgtacagatggacgacgtgcaggctcctccgatcgggacgaagggaacggtcagaggtgtcgacgatatcggcagcatcatggtcagatgggacaacggctgtaggctctcggtggcatacggcgaagacatgtgcaggagaattgacgaatgaagaagccggtactgaaatatgacagtcgcggccccgaaggcaacgtgttctggatactcggacatgtgcagcgggtgatgcaacgcgacggcaggagcgccgaatgggagaaactgtgggagcgagtgcagagcgcagacagctacaacgatgcgctgcagctgatcggtgaagaggtcacgctcatagatacagcaaaataaggaggaatgcggcagcgtcggacgctgtcgttttttgtcgaattataaataggaggggcagagcgattggcggacaacaagatcattgtcccggaaaagaaaatcattacgaacgccactctcgccgatcgcgccgttgcctttatatccgccttgaaacatacaaaaggcgaatggcatggtaagaactttgagctgctgccgtggcaggagaaagttgtgcgagatgttttcgggacagttaaagaaaacggatataggcaatacaacacggcgtacattgaaataccgaagaaacaaggcaagagcgaactcgcagcagcggtcgctctttatttgttggccggtgacggcgaatggggcgcggaggtctacggctgcgcagcagaccggcagcaggcatccatcgtctttgacgtcgcctgccagatggtggagcaatgccctgcgctgaagaaacgcatcaagccagtgctttcccagaagcgactggtttacacacccctcaacagcttttatcaggtgctgtcggcagaatcctatacgaagcacgggctgaacgtccatggtgtcgttttcgatgagctccacgcccagccaaaccggctgctgtatgacgttatgacccacggctccggcgacgcgcgaaaacagccgctgttcttcctgatcacaactgcaggcaccgataggaacagtatctgctgggaggtgcatcagaaggcagaggacattctcgccggacgcaaaaacgatccgactttctaccctgtgatatatggcatcgacgatgatgcggattggtcggatgaacgcaattggtacaaggcgaatccctctctggatgtgaccgtagatgttgagaagctccgcgctgcctaccagagtgcgaaggacaatccagcggaagagaatcttttcaggcagctgcgactcaatcaatgggtgaagcagtcggtgcgctggatgcccatggacgcttgggataaatgtgataccctcgtaaatccggaaacactcattggccgagagtgctacggcgggcttgacctttcaagtagtacggacataacggcatttgtacttgtgtttccgccgcgcgaagagaacgagccgtattatattctcccgtacttttgggtgccggaggacacgattgacttccgagtgcggcgcgaccatgtaccgtatgatgtgtggaaggcgcaaggctcggccatggcaaccgaaggcaacgttattcattatggattcatcgagcaattcattgcagatcttggcaccaagtataacatcaaagagatcgcatacgaccgatggggcgcagtgcaaatgagccaagaccttgcggacgcaggtttcacgatcgtaccattcgggcagggattcaaagatatgagtccgccgacgaaagagctcatgaagctggtactcgaaggtaggatcgcccacggcggcaacgccccgctgcgatggatgatggataacatctatgtgcggacagatcctgcaggcaatatcaaaccggataaggaaaagagcacagagcgcattgacggtgcagtagcaacgatcatggcgctcgaccgtgcaattcgccaccaaggctccgatgagtcagtatatgactcgcgcgggcttttgtttgtataaatatgtagtacaggaggatacaaatgggaattttcagtggactgttcaaatcaagggacaagcctcaagacagaacagcaggcagcaattatgctttcttcttcggcggcacgacatccggcaaggcggtaacagaacgctccgctatgcagatgaccgccgtgtattcctgcgtccgcattctgtcggaagctgtcgcaggactcccgctgcacctatataaatacacggacagcggcggcaaggctatggctcacgaccatccgttgtatcggctactccacgatgagccgaatccggaaatgagttctttcgtgttcagagaaaccctcatgacgcatctgctcctctggggcaacgcctatgcacaaatcatccgcaacggcaaaaacgagatcgttgctctgtatcccttgatgccgaacaagatgtcggtggacagagacgagaacgggcggttgtactacacctattaccgtggctcggatgaagccattaaggataaggagtttgccgtaacgcttcagccatcggatgtgcttcacatccccggcctgggctttgacggtctggtgggctacagccccattgctatggcaaagaacgctattggcatggctatcgcctgtgaggaatacggcgcaaaattcttcgccaacggtgccgctccgggcggtgtgctggaacaccccggtacgatcaaagacccgcagcgtgtgcgagagagctggcagtccaccttcggcggcagcggcaacgcgaacaaaatcgccgtgctggaagaaggcatgaagtacacgcccatcggcatctcgccggagcaggcgcagttcctcgaaacacgcaaattccaaatcaatgagattgctcgaattttccgagtcccaccccacatggtcggtgatctggagaagtcgagcttttctaatatcgagcagcagtcccttgagtttgtgaagtacacccttgacccgtgggtcatccgctgggagcagtccattcagcggtcactcctctcgcgggacgaaaaagcggtgtatttcgtgaagttcaatctggaaggcttgctccgtggcgattaccaaagccgcatgaacgggtacgccattggtcgtcagaacggctggatgtccgcaaacgacatccgggagctggaaaacctcgaccgcatcccggcagaggaaggcggcgacttgtacctcattaacggcaatatgctcccgctgaagaatgcgggtgcttttgcagatacacctaccgacaaaggagaggaggaaaaatcagaaaatgaagaaattctggaattggaagaaccagacggagacagcggaacggacgctgttcctgaacggaaccatcgccgaggaaagctggtttgacgatgatgtcacgccgcagcttttcaaggacgagctcatgtcaggcagcggaaacatcaccgtatggatcaatagtcccggcggcgactgcgtggcggcggctcaaatctacaatatgctcatggactacaagggtgatgtgaccgtgaaaatcgacggtattgccgcatccgcagcatccgtcattgcgatggccggtacgaaggtactggtgtctcccgtgtccatgctcatgatccacaaccccatgactgtggcattcggcaattcggaggaaatgcagaaagccatcgagatgctctcaagcgttaaggattccatcatcaacgcctatgagatcaagacggggctttcccgtgccaagctctcgcacctcatggatgctgaaacttggatggatgccaacaaggctgtggaacttggatttgcggacggaatcatgagccgtgccgatgaggccgaggatatgtgtatagtgtgataacatagtttacagaatgtgcaaggacatagtttacatatttatgataaaatagaggcataaaaattattctccatatttttgtcctttccgtttttctgtaatgactatatcaacgcatctgtcgtaatcatcgacaggtatatcctccgtcagaaattcttcatagcatactccgacagtatagcccttataaccgtttataaatctgtcataatagcctttgccgtaaccgagtctgaagcctttcgcattaaagcagagtgcaggaactatcagcacgctgttttccgcaccggcggcatcaatcacagcacagctctttttcggctcgtcgattccgtacatacctttttcgaggtcgccaaacgtatgtatcacgcaaaactccatattactgccgtctatacatctcggtacagcgacattctttcctgccttaaggcactgcgttatgaattctctcgtatccacctcgccgtctgtcgaaacaaacggcagtataatatccgccgtacgcactttttcaaggcttaaaagattcactgttatagcggcatttttaacagccgtttcactgtcacaaagcagttttcgcttttgcagcaaggcttttctcagttgttttttctgctcgtttacgctcatctgcactgtaaagacttagctgtcttttctgcttttccttcaccgcagagcaatgctccgagcgcaagtccgaattctacagccgcacctgcgccctttgcggtaactatgttatcatcaatatttacaaggtcgcccgtgaacattgcaccctcaaggaattgttcaaaaccggggaagcaagttgcctttttgcctttcagaagtcccagctttccgattatagacggagcggcacagatagcgcctatcgctttcttattatcgacgcagaattttatagccgcctgtacaacggggcttttctcaaggttgagtgttccgggcataccgccgggaagaactatcatctcgaccttatctgtcataataacatcgctgtcggtaatatcggcaataaccgtaactgcgtgtgcgcctgtaatcttaccgccgcctattccgacggtgactacctcttttccgaatctctttaaaatgtcaatcggggcaattgcctcggtttcttcaaatccgtccgctaaaaatacatatatcattctgattgtcctttcccggcattataaaccgcactgaacttctcaaccataaaacacgggtgataagacttcttcgccttgcggagattctcctctcccatatcctcttccctgtttatatattcaagtcctttacagaacctgtttgccatcatatagtttatcatcggatatgctccgtcataatcggtaaacgctttttcaacgtgggtcacaaacgtatcactgcattgctgttcgccgtacgaaaacgcctgtatcctgccatcgactctcagtataccgccgacaagacctaagtcgaagaaatgctcaagtcctattccgacagcgcacatttcctccgatttatcctcgcttttatcgcaatcgttgcgtatgcaccattcaaggctcatctgcttacattcgtcaatattgtccggcgtaatatcctcaaagctccagttaagctgtttgaaacggtttatataattacgctttgaatgcagcttctttccgccgagcgttgcaagcgactgcgactgatacacatagtcatacagatcttcgcttgtatcgaaggtgaacataccgggataacgctgttcgagcatctgcttatcctttatatccatactgcagaattcaaacggtattcccgtactgtcacagtaatttttcagttctgaaagcagtgcgtccgtatcgccttttcctgcgggaaacacgaaacagtttccgtgctttgatacataaaaatcctgaaaacgtcctacagtaatgttgtaaatgccactccacacaaagttatttgtgaagttatactcacaacctctgaaatcagacagcttcagaagcggatctatccactgcttgtcgctgagttcaattttctttaattccaacactttatattaccttgcttttgcctgttatcagccgtaaatcagcgccgataattccttgtttatcttttcgggagtgtaaggattttcaccgtccgagcacggcagtatataccagcccttcttgtcggctgtgtatagcgccgtttcccgacaggccttcagaaaagcaacgttgctttcgtgaatatccttcttcgcctcatctccgccgtaacgtgcggaaaggagcttttgcgacacctctacgggcatatccagaaatacgattctttcgggacgtggaattgcaaatttatcgtactcgtagtcctcaagccactcaaggtactcgtcccattgggatttttccagctttgccatctgatatatcgcatttgaggaggtgtatcttgcggctattatggtcttgcccgctttataatccttttcccagtcggtcttgtagctgatataacggtctatcgcatagaaactgccggccgtatatgcgcccgttctgccgttttcctcacagaatttaccgctgagatagtccttgattatctcgccgcttgcactgttgtaatttggaaagctgatgaaacggatattgctgtctgcgcttgctttcagcatctcaagctgtgtgcttttaccgcaaccgtcaagcccttctataacaaacagttttccgcattttccgttattgccgttcatacatacactctctcataatatagtatagttttattttatcacaaaatccgtgtcaagtcaacttaaaataaacgcacaaagtcttttgtgactttgtgcgttaaaaagcattattcagcacattgaacgttcaacggtgattacggcattgagcctgccgtccttttccgcaattgcgttctttatcataagagcaagctccccgtccttatatctgaagccgaaaggcgttaccagatcgaaaattacatttatccttgaaacaccgtcggtaatgcggaaatcgtggatagtaaggctgctgtcgatattttttattatatcaagaaccacctttttcacctcgtccgccttctgatcatccacaacgacaggatccatatgtatcgtaacactgcatctgtacttttccctgagatcgtcctctataagatctataagctcgtgtgcaagcattatatctgttttactgcttatttcggcgtggagcgatattaccattctgcctacaccgtaatcatgcaccataagatcgtgtacgccgactattccgtcatagttcattacagtgttttcaatttcctccaccaattcctttttaggcttagcgccaagcagcggagtaagactttccttgaatgtattgaagcctgtgtagaggataaaaagcgcaacaatgatacctgcgtatgaatcaagttcaaagccgctgaacagctgtatgaacatacagatgattactaccgatgtagaaatgcagtcggacagcgaatctgccgctgcggccttcattgtggcgctgtctatttttcgaccgagctttgtgttgaacagtgccatccacagtttcacaagaagcgacgctccaagcaccgatacggcaagtatgctgaactccgacttttcgggcgagaagattttttcgaccgagcttttaccaagttcaaagcccatcatcattatgataaaagaaattattatgcccgaaacatactccattctgccgtgaccgtagggatgttcgctgtctgcaggcattcccgccattttaaagccgacaaaggtcattattgatgaacctgcgtctgaaaggttattgaatgcgtctgcgattacggagataccgccggataatatacctgcaatcagctttccgagaaacaaaagtatgttaagcacgataccggtaaatgctccgagatacccgtagcgctttctgacagcgggatcggatgtgtttttgctgtcctttacgaacagttttataagcagattagtcatgactattcctccatattacacgaatacggagcaacataatgcgttgctccgtatcggatatttaagttttatccggattaatccttattgcccataagcagtaccattactgccttctgtgcgtggagtctgttttcagcctcgtcaaagatttcgtttgcgtgttcttcgaataccttggctgtaatttcttcttctctgtgtgcgggcaggcagtgctgtaccatagcgtcgggcttagcgacagccataacctcatcgtttatctggaagcccttgaatgctttctttctgatttcggcttcgccttcctgacccatagatgcccatacgtctgtgaagataacgtctgcgtcctttgcggcctttatcggatcgtctgtcagctcgaagcagtcatacttcttagcgaacgcaagtgttgtagcggcagggtggtagttctcagggcaggcaacagatacgctcatacccgtctttaagccgcctacaataagtgagtttgccatattgttaccgtcacctatgtagcacatcttaagaccgtcaagcttacccttgtactcacggattgtcataaggtcagcaagcacctggcaaggatgagaaaggtccgtaagaccgttgattatcgggatattgccgtattcagcaagattttcaacctcagcctgatcgaatgttcttatcataataccgtcaatgtagcgtgataaaactcttgcagtatcctgtataggctcacctctgccaatctgcatatcgcttgctgaaaggtaaagaggattgccgccaagctgatacatacctgtttcaaaagaaactcttgttcttgtagaagccttgcggaagatcataccgagcgtcttaccctttaaatgatcgtgagggatgccgtgcttaagctcatacttgagctgatctgcgagattgagaatctcaatgatttcctctgtgctgagatccatcatcttaagtaaatgtttcataattttttcctttcggttttagtttttattttattttaaaagttctgcgagtatttcaagacctctgtcaatatcctcataagagatagtgagcggaggaagaagtcttaacttttcctttgcggtaaggataagaagtccgtgttcaagagcggcattcagtatatcctttgcattctttgtctttagctttatgccaatcataagacccatacccgtaaccgattcgacctcgggtatctctttcagcttttcagctatatatcttcccttatctgcaacctgtgacaagaaaatcggatctgccgctttcttcagcacctcaattgcacctgcacaagcgataggatttccgccgaatgtcgacccgtgtgttcccggagtaagtacacctgcgcacttgtcgccgctgaggcacgcacccatcgggataccgcctgctatgccctttgcaagcgttattatatcggctttctttccgaaattatcgcctgcaaggaatttacccgttctgccgacacccgtctgtacttcgtccgaaattgtcagcacatcacgctcggcgcaaagctcaaatattgcgtcaacgaacttctgctcaagcggcacaacaccgccctcgccctgtatatattcgaacattacggcgcataccgtatcatcgagcttcgccttaagatcctctatattgttcgcttcaacgtttataaatccgtcaacaaacgggaagaagtagttgtggaacacgtcctgtcccgtagccgacagcgtacagagcgttctgccgtggaatgaatttacaagggttattatattgtgtctgcccttgccgtatttgtcgaagctgtactttcttgctatcttgatagcacattcgtttgcctcagcaccgctgttgcaaaggaacatattcttcattcctgccgcttccgataatctctcggcaaactcagcctgtacctttgtgtaataataatttgaggtatgctgtatactgcgtacctgttcacacacagcatcagcccattccttgttgcagtaaccgagcgagtttgtgccgataccgcttccgaaatctatatacgtcttgccgttttcgtcaactgccttgtcatcctcgcccttgtcaagaacaacattcagcctgccgtatgatcccattatatgagaattgaatttgtctatagtattcatatctgtcctttccgcctgcatcgtttgccgtcagataatcatagtacctgcgccctcgtttgtaagcagctctataagtattgaatgaggtattctgccgtcaatgatattcgctttctttacacctctgcggacagcctcgacacagcaatctatcttaggtatcatacctcctgagattatgccctgctttttgagataaggcacttctgaaactccgacagtatgtattagagtgctgtcatcgtccttatcctcaagaagtccctttatatctgtcataagaataaggttttcggatttcatctcagccgcaattcttgccgctgccgtatctgcgtttatattgtaaacagtaccgtccttgcctgccgcaacggtcgaaattacagggatatagcccttttcgagaacatcgtttataaggcttacgtttacctgagtaatctcgcctacaagacctaaatccgggtcaagctgttctgcctctatcatatggtcgtcaagaccgcaaagacctactgctctgcccttgtggctgtaaagcagatcgacaagatccttgtttaccttaccgcaaagcaccatctgaacgatgtttatcgtttcttcatcggtgtaacgaaggccgtttacaaacttgctctccttgccgacttttttcagcattgcgtttatttcgggtcctccgccgtgtacaagcactatcttgataccgcagagcgacagaagaacaaggtcggacataaccgcctgcttcagtctgtcgtttgtcattgcgttaccgccgtacttgactactactaccttgtttgaatactgctgtatataaggaagtgcgtcgctgagtatacttgctctcttttcgttttcaagttccatcttcttttgtcctttcggtgtcagcttctgtattctgcgtttatctttacatattcataagtcagatcgcagccccacgctaccgatttatcggcaccgtcgtgcatatcaattctgataacaatttcatcttcggacagtatcttgaatgcttcgtcttctgagaagtcaacacctgtgccgttctcgcagacctttacactaccctttgaagatgacagaacgacctcgaccttcgaaatatcaaaatcgccctcggcataacctatcgcacagagaatacgtccccagttggcgtctgccgcaaatatagccgcctttaaaagactgctgtttataacagacagtgcaacgctctttgcaacagcttctgtaggtgcgtggtcaacaacgcattccatcagcttcgttgcaccctcgccgtcacgggcggtttctcttgcaaggttcatcattacagcgtaaagaccgtttatgaacacttcataatccttgtcctctgccgttatttccttgtttcctgcaagtcccgacgccattatgcacagcgtatcatttgtggatgtatcaccgtccacgcttaccatattgtaagttatatcggctgtccttttcagcgccttatgcagaagctccgcatttatctttacatcggtcgtgataaaagcaagcattgtagccatattgggatttatcataccactgcccttgctgataccgccgatatgacaggtcttgccgtcaagcgtaaactctaccgcaagctcctttttgcgtgtatcggtcgtcattatcgcctcgcacgcaagcgagcttccgtcctcgcttatgctgtctacaagcgtcttgatattgttcttcacagggtcgattgacagcttctgtccgataacgcctgtagagcctactatcatatcgttcttatcaatacccagttcgtttgcgcaaagctcgcacatctgctctgcaatctcaataccgtttgagttacaggtgtttgcgttgccgctgtttacgataacagcctgagcaatgccgttcttgaggtgttcctttgtaacgattatcggtgcgccctttaccttgttctgcgtgtagattgccgccgcagtacactttgtgtcacagcttatcacagcaaggtcacgctttttcgagccgggctttatgccgacattgataccgcccgccttaaagccttttgcggcgcatacacccttatccactaatttataattatcaaattcaaccattgttattacctcacttattatacaagtccggtcgtttcgtcaatgcccatcattatgttaaggcactgaacagccgcaccgcttgcgcccttgcctaagttatcaagtcttgagcaaagcactatacggtcatcgtttccgcaaacgaatatctccatattgttcttacccgataatgtgtttgcggcaaggaaaccgttttcaagcacgccctcgcccataacaggcatcacctttacaagatttgcgtctgcataatgctccgtgaaagccttatgaatatcggcaagcgtatatttcttcggcagaagtcttgtgagaacgggaacagttacgaccataccgctgaaataatcgcatatcagaggattgaacacaggcttgtaatcaagtccgcttatcttcatcatttcaggtaaatgcttatgctcctgaggaagcgcatactgtctggggctgtaaaattcttcaggcttttcatcgctttcgtacactgcgatagccttctttccagctccgctgtaaccggataccgcatgagcgacaaaaggataatcgctcggcattatgcctgcctttacaagaggatatacaagcgaaataaaaccgcttgcataacagccgggaacagccactctcgatgaagccgctatcttttctctgtgctgctttgaaagctcgggaaaaccgtatgcccagtcgggatttgtccgatgtgccgtagaagcatctataatacggacgttactgcccttcgcaagctctaccgcctctcttgcggcggcatcgggcagacaaaggaacgtgaagtcggacgagcatataaacttcttacgctcatcgttatcctttctcttgtcctcatcgatcttcattatttcaatatcgtttctgtccttgaaacgttcgagaattttaagtccggtcgttccttcctgaccgtcaatatacacctttacgctcatataagcacctcttattttttaagaaatcttgtcattccgcagccacgttcatcattaggtctgcgcataaatccgagcttttcgtagaacggctctttatcctttgccgccataagatttatcattatcgtttcgccctcgtcagcgaccgacaacgctttatccataagccttgaaagcatctctctgcctattccctgtccctgatattcgggacgtacaataacgtcactgataaagaactgatagcctccgtcaccgactacccttgccgagccgacttccttttctccgtcaagcgccgttatcgcaaacacagagcttttaagcgcacagttaagctgtcttggcgaaagctcataccagcctacgcttcgtctgaacgaatttatatcgtgcggcaatctgtattcataagttatcatcagatgttgataccgcccagtctgtcttcaagctcagctatctgacgctttaccgcatccggagcgggtccgccgtcaacgcctctttgcataacgcaggtatcaaggctgatagcgtcatatacgtcattatcaaacgtttcgcacagcttcttgtattcttctatcggtagctgttcaagcgttgtattcttctctatgcaaagtgcaacgagtgtaccggttatcttatatgccgttctgaaaggaagccccttctttacaagatagtctgcacagtctgtagcgttgataaagccctttgcggcggcagtacgcatattgtctttaagtaccgtcatagtcgcaagcataggagtaaatgtcgagatacacagctttactgtgtccactgcgtcaaatattgcctccttgtcctcctgcatatccttgttatatgcaagcggaagtcccttcatcattgtgagaagcgtctgcagatcgccgtatactcttgccgtcttgcctcttataagctccgtaacatcggggttcttcttctgcggcattatcgaactgcctgtagaatatgcgtcgtcaagctcgataaacttgaactcccacgagcaccacatgattatttcttccgaaaatctcgaaaggtgcatcataagcatcgaaatatcagagcataactcaacgcagaaatccctgtcggatacgccgtcaaggctgttcatcgtaatatccttgaagccgagaagctcggctgttctctttctgttaagagggtatgtagtgcctgcaagcgcacacgaaccgagcggcattacatccattctttccttgcagtctgcaagtcttgtcagatctcttgtcagcatctgagcatatgccataagatgatgtgcgaatgtaacaggctgtgcacgctgtaaatgagtgtagcccggcattaccgtttccgtatgctgctttgcaatatctataacagtgtttataagctcacggacaagctttgcaatttcatcgacttcatccttgagatagagctttatatcaagagccacctgatcgtttctgctccttgcggtgtgcagacgctttcccgcatcgcctattcgtgcggtaagctcagcctcaacgaacatatgaatatcttccgcattgggatcgaaatgcagtgttccgttttcaatatcgcttaaaattccgttaagaccttctattatcaccttgctgtccgcagggtcgataatgccgcactcaccgagcatggttgcgtgtgctatagagccttttatatcatgcttgtacattcttgcatcaaatgagatggaagaattaaaatcgttgacctttgagtcaacctcctttgaaaatcttcccgcccacatcattttagacatactgttatttcctttcagatttatgttcataacgcaaaaagcgttttgttttttccgttataaatataaaagtaattaaaacgctttttaaaacacagccgtaccgactgtgttttaaatcgcatcttaaaaaccgtaaaagccgcaaggcatagttttacaccttgcgggatttaccgtaacgcttttaaagcttacttattgtttctctcagcatcaagcagagccttgacctttatcggcagaccgaacaggttgataaagccctttgcatctgtctgatcgtaaacatcgtcctcaccgaatgaagcaaagtcttcgctgtacagtgtgtagggtgatgtaacgcctgcgttgatgatgttacccttgtagagcttgagcttaacgtcgcctgtaacagtttcctgtgtcttgtcaacgaaagcgtccatagcctctcttaaaggtgtgtaccactgaccgttatatacgatgtctgcatacttctgtgcaagaccgtacttgtagtgctgtgtttccttatcaagacagatagtttcaagaacttcgtgagcgtgataaaggattgttccgccgggagtttcgtaaacgcctctcgacttcataccaacaagtctgttttcaacaacgtcgaacagaccgatgccgttctcgccgccgagcttgttaagagtcttgatgagctttacgccgtccatcttttcaccgttaagtgaagtggggatacccttttcaaagtgtattgtaacatatgtgggcttgtcgggagcctgctcgggtgaaacgccaagttcaaggaagcctttcttattgtactgaggctcgtttgcggggtcttcaaggtcaagaccttcgtgtgataagtgccagaggttcatatcctttgagtagtttgtttcacgggtaatctttatcggaacattgtgtgcctctgcatactcgatttcctgatctcttgacttaatatcccatattctccagggagcgataatctcaagctcgggtgcgagagccttgatagtaagctcaaaacgcacctggtcgttgcccttacctgtgcagccgtggcagatagcgtcagcgccttccttcttagctatctcaacaagtcttttagctataggaggacgagcgaacgaagtaccgagcagataaccctcgtactttgcgcctgccttaagtgtggggaatatgaagtcgtttacgaattcgtcctgtatatcttctatgtagagcttggatgcgcctgtcttcttagctctttcttcaagacctactatttcagagtcctgtcctacgttacctgctacgcagattacttcacagccgggataattctcgtgtaaccacggaatgatgatggacgtatcaagtccgcctgaataagcaagtacgatctttttgatttctttagccattttattatttcctttctatctcacagacgctttcgggcgttctgctttctgatttaacttacattgaatattatacaccttttcacatcaaagtcaagtatttttattcagtaaactgcataatatactgtatataatgaatatttgttgaattttagcgaatttttatgtatttttttgattgacaagccgtaattgtaaggatataataatagtaaaaggaaattcagtcggaggaattatggaacttaaggacaagctggaaatacttattaaaagaaacggctataaaaagacggactttgcgtctgccgtatccataacctacagagcgcttgcaaactacataagcggtgcaagaaccccgagagcgaaaactctttccgatatggctgtacttctcggtgtcagcgaggaactgctgactgacaacactgtggatctgatactgtcgggagatgaaaagctgtatttcaacggcacttctccgacagaaacaagagaaaaggccgatgtgcttctgagcgaagtatcggctatgcttgacgatgaggatttcaccgaaaacgataagacaacattcttttcctgtatcgcagaaaaatattttgcgggaaaagcaaaaaatcataaaaaaactattgacaatgcagtatgacggtgttataatacaaacagttgaacaaccgttcaaatgaaatgaggttaaaatggcggtcagcaaatcagaaaagtcggaaaatatcactgcaaaagacgaaaatgaattctgtaactgcaatgtgatacacgaggacgtagtaaactatgtgcgtgagaggatgcttgaacagatgcagtttgaaaagctgtcaatgttcttcaaggctataagcgatgcgggaaaggggctatattactggggctaccgcccctagaccctgtcgggggctacgcccctgcgaccccatttttatcaacgatagaggtttttcgacagtctgaaatgatgttaccgacaaggtagcgtcatttttaatatacagttttttcggcattcaaagctccgcccgcatatattcacggcaggcaaggtccggtttatttcttcttggctttatttttcggcacaggtgttatccgttcgagaatctcgaccgcctttgccgtaagctccctgtcctctatatcaagtatataatgctcctttgcgctgtcatacggcacaccgcactcagcgcccgacataagttcttcgatttcgggtagctttttaacatataccgtgttgtcgcagacaagcaggacaggcttatcattgacataaaccatatattcgccgaacatctttttataccgcacgttttcaacgccgacaagctgttcacagacaaattctatgtcgccatttctcagcctctgccttcttttctctttacaaaaaatcttattgcaaacagcaccgccagcataagagccgccgagaagccaagcactatgaatacgttatgcacaaagcccgacagcagatagccgacaacgcacaccgccgcaactgtcagcgcatacggaagctgtgtcgaaacgtgattgacgtggtcgcactgtgcgcctgtcgatgccataatggtggtgtccgagataggcgagcagtggtcgccgcataccgcacccgcaaggcaggctgaaatgcagatgatgaccattgacggaatttctcccgtctgcgaaacattcgcaagctccgcatcaaacacgctcgtaacgatagggataagtatgccgaacgttccccacgatgtacccgttgcaaaagcaagcccgatagccaccacgaacagtattacaggcagaagcacgctcagcgccgttgcactctgtaccactcccgaaacaaacgcgcctgcttcaaggtggtttgtcatcgttttaagtgtccacgcaaaagtcagtataagtatcgcaggcaccatctgcttgaatcctgcggcgatagaatccatacattcgttgaacttcagcacacggcggagcatataatatgcgattataactatcagcgccgagatagagccgagcgacagaccgtaagccgcatcgcagtttgcaaatgccgtcacaaaatccgtacccgagaaaaatccgccggtatagatcatacccacaacgcagaacacgataagcacagcaacaggaagtataaggtctataaccctgccacgctcggtcaccggctgtgcgtcctgctcgtaagtattgttttttgtcgtgaaaatatcaccgttctttgcgttatcctcgtgtattttcatcggtccgtaatccgtatcgctcaccgatatgaatattaccataagtatcgttaaaaatgcgtacagattatacgggatagtgtttataaacagtgatattccgtttacgccctcgaccgtaccgcttaccgccgccgcccacgatgagataggtgcgataatgcagattggtgcggctgtcgaatctataagataagcgagctttgaacgtgatatgctgtgcttgtcggttatcggcctcattaccgagcctaccgtcagacagttgaaataatcgtcaacgaatatcagcacaccgaggaaaaacgttgacagtgcagctccccgtctgcccttgatatgagccgccgcccattcaccgtaggcacggctgccgcccgccttgttcatcagtacaacgattattcccagtacaacaaggaacaccagtattccgacattgtatgcgtttgaaagatttgttataagtccgtcctgcacgactgccttgaacgttccctcaaatcccgttcccgatgccgccgcatagattattccgcccgacaatattccgacaaacagcgaggaatacacttccttggtgataagcgcaagccctatcgctataaccggcggaaacagcgaccacagcgtacccttggcttcggttatcggtgcggcaataatacagcataccgtaaaagccacgataagcaatccaaacaccgctttgctcagataagattttttcttcttttccattgttacttccttttcgcccgtaagcctgtcacacgggcggatttacgttttaagatactttaatggtacattatttcggctctgttgtcaagcgtttacagcttaaaaccgccgtaaaaaagcgtattttctgcacttgcaacaaaaaattccgccccgatgatacgggacggaataattctgtatcggtgcgtcacgaatgtgctctgcaataaatctcaattgcctttgcggtgaataccgccgtgcctgttcctccgtacctgtcgatattatcggtaaattcaccgcctgccgcatacatagtgccgagagaggacagtatatccgtattgcagtcataataattatccgttatgaatcggcgcaaggtttcaacctgttgctgtacctctttgctgtcgggccacttgtctttcagtttgccgaactcagcgaatatcatcataaatctcttgttgacgttgcttttttcatcatcggacatactgctcgttttttcttcgtactgttcgtactgtgcggtgtttccccactgctctttcgcttttgcttcgtattctttcatctttttcgtgtcaaatacagaaaaatccattatatcaactcctgttgttcgtattttacgggcaaattctatcagattgtcgatatgttctcttttcattgtcagaagttctatctgttgttcaagtgccttatccctgtcaaaattgtcggcactgattatcctgcttatgtctttcaatgaaaattccagttccctgaacagtaaaatctgctgtagcctttcgagtgccgtatcgtcatacagcctgtatcccgtatcagtacgtccgctcggtttcaaaagcccgatgttatcataatactgaagagtgcgtatactcactccggtcattttgctcacgtcatttactgtcatcatctgatttccctcccgcaaggcacattataaactattacgcagcgtcagagtcaatacttttctgaaaaatttttaaaaattatttcgatggaaaaaacttatctgtcaccgttttcttttattgccgtctttgcttatgatatgatcctcttgcacaaacagctttataagtcgggggtatctgtccgcattgctcattatataagtcgatgcagcaacatacaatatcgcaaaagcaaagaaaactcccgataaaacgaataaggtcttgcggttttcgtcgtttacactgtttacatcgtcaagcgaaacataacaggtgttgccgcaggaaaacaggcgtatatcggtttcttcgtcgttttctttatcaatgtaacctatctcaaactccctgttctttgctatgtttatctcaatatctttatattcctgcgaattatcttctataaatccggttgcaaacgtccgcttctcaccggctctatccgataccgtaattataaatctgccgctgttatcgcttttgtcaaagtgatattccgtaattctgcccgtatatattgttatttcatcgggcattatatctggggttgcaaacaacgcagcaacgagcgaaaatacaggtaccgccataacaataatatcaacaagaataaaccctccggggtggcggatattaccacggaacagctttgatttctcagagcttatgacctcggcattttccgaacgctgtatcagctcctttgcaaagccgtcaatattgaaagcattttcatctatcaatataagccttttgccaacagtgataatcagatttccgccgtaacgtattttcttcacttgtgaatattcatacctgtgtgttatcctcagcatatcccgataagtaaagtccttgtcggtgtaatctaccctctggtttacagtaaggacaagtataacgccaagcacggcaaatacgccgaataagatacaggtagccatacctgcaccgcttattgccgcagctaccgtcgcaacgccggaaaaaagtgtgcatacaagcccgataaccgctatctctctgctgtttattaccatcctgtaatctattttgttttttgatttatatttcatcgtttcctcttatgagtaccattctgcattatcatcgttcattatataatctgttttttcatacgcaatacggggtaaaccgtcagcaaaataaatgataccgcattttgcaaatccgtttttctcaataatatgcctcgtttcttgttatcctcatgcgtatctgtcgcacaagagttattgtcagccgagacatctgttttctccttgccgtttattcttatatgaatttattatactcgatttaacttcttcggtcaaccaaaaattccgccccgataacccgggacggaaaaaatctgtattcaatatgctatccgaacccgtcaatcttccctgtactccatagtatacagatactgaccggatttcagttgctttttagcggtattcttcattccgcacttagtgtatttagctaccttaagctcagtgtcggtatcaagtacgcagggtataccctcccttgccgcttcggaaaaagggtgttcaagtatctttttcatatatccttttccctgatattcacgcagaactaccaccatcgacaccgctacataatccttttcctttttgtagactttggcataaagctcctcacttgaacctgccactattctcacactgcgaaatgacatctccctgagcattctcccgaccatatgtaatgcaggcttcagctttattttagtgcttttgcgccaatacgcaagaaacccctcgtgattgtcggacgtagtgtacaaaacccccgaattgtagaaatactccgtcattatctcaaacgcctttataatatcctcacgaggtgcagttgtggcaataccgtcgccctctgcggcgaaggcttctccgataagcgttccgtaatgcgccagctcttcctttgtcatattgcttactttctgcattttttccgctcctgttctaaagttagttatcactaattatattataaccgatttcagcccggcggtcaaccaaaaatcccgcaatttccaaagcaaaccgctttatatcaaatacagcgttttacctgcataccgcaaaccgtcaataaaatcagccgtatattatgcaaaaaatgttttcgcatttttttcggcattttcctcccttttcgcattttttatttcgacattttccatccttttcgcattttttattttgctcctttactccttttccgcactttttgcaatacccatccccatttttgcatacaaaaccccgcccccgaaatcacggaggcggagtggtatatgtttaatcatttttactaataatcttacttgccaattcacctattattttagtcaattcattttcaaaatctctcgaaacatcatctgcataacttattgcatgagcacactcgtgcaataacgtaccagcatagtcagtaatacagctaagctgatttcgcttaatgagaatttttccttcttcctgtatccaaagtcctaaaggttcatagtaaaatccatgttcgtatattttttctactaaaagtatatcttttacagcctctggttttcctccaattaagctcaatatatccgaagttttattataaatgtttcgttcatctactgtaagttctgaaacatccacaacagttggtgtaaaattgcttttctcatcttctatatattgccttactgttgttaacgtgttaccattttctgcagtatcattatacttattcattttaatgattaagctatcagatacaactatcggattctgtccgtttctctgcatttcatctattattgatggagcttccatcatttcttgtgcagtaacaaaagttgttttagaatcaatttcacttagcttttttgacgcatatatagcaacatcattccatgacaattcatcgtgcttatcgcctgaagtgaagtactgcaaatcatcgactaattcttctatcacatcttccgaatcacaactcagcaatatatctttgattctgctcgtatatgcacttctgccaacattagttcgttctcgattcaaagccttctttatttgactgttaagtaaagtgatgttgtatgaaaacaaaaaattatcttcttgagcaactttgacgccattaatataaataatactgtcagcgccatttttttgaattacttgtccgtatttggttgtttccaatatatcatcatttgtgaaagataagaaaagcgattttgctttctcaatgtcatctgcagcacatccaaacaaacaaaaatcagttccaatcatattctcgttttcaggaggtaaaatttctgcgtgcaaagtaatgatatcttcaaaaccaacttttgatgcagtctttaatgtaatatcaccatattttgatttgatttttacttttatattgtgccgatataatgtagctaaagcatctttcaaaccaacaccaaatctaccaatgagtttatcgttattcaatttttcgtcattttcattctgcgttaaatgatgataattcaaaccacgtccataatctttaatatgccaccaactgctatcatcttggtagatatcgatgtttttgcttcttgtaagtatctgctcatccaatgcatttgcaataatctctcgtatggcatgataaacttcccaattttcaagtattttttcaatgtttaaatcgaattctctgattttctccatagcaatttgctcctcataatattttgtaaggtcaaaaaattactgctaaaaacatattaccatttatttttaattttgtcaacaccattgaaagctatacaaaaaccccgcccccgaaacctcgggagcggggaaatcgcctatatctatcgcttcacttatgcattcttgtcaagacctgtgatttcaagtgtatcacgagcaataagaagctcctcgtttgtaggaattacccatacctcaaccttgctgtcgggagcagagatctttgtgagcttgccctttaagccgtcgtttacagagttgtcgagcttgatgccgagatattccatattctcgcatacgccctttcttacttccggagcgttctcgccgataccgcctgtgaagataacaacgtcaagaccgttcatagcggctgtgtaagaaccgatgtacttctttatctcgtatgtcagcatatctgtaacaagctgtgaacgcttgtcaccctgctgtgcggcacttgtaatatctctgttgtcgctgaactgacccgaaagtccgaggaagcccgacttcttgttgagatagtcgctcatctgtgcgggagtgaagcccagcttgttctgtacgaattcaacagccgaggggtcaacgctgcccgagcgtgtacccatgatgataccatcaagaggagtaaagcccattgatgtatctacagactttccgtccttgatagctgttatggatgaaccgttgccgaggtggcaagatacgatgttaagaccttcaaggctcttgcctgtgacctcgccgtacttcattgatacaaagcggtgtgatgttccgtggaagccgtactttcttacgtggaactgctcatagcactcataaggcataccgaacatataagccttgggaggcattgtctggtggaacgccgtatcgaatactactacctgaggagttgtttcggggataaccttcttgcaggctctcagcgcaagtgcgtgtgcgtggttatgtacgggagcaaggtctgcaagaccgtctatctgatctataacctcgtccgttacgattgttgtctttgtgaatacctcagcgccctgcactattctgtgacctacagcgcctatctcgctcatatccttgataacagcggcgtcgccctttgtcattacctcaaccagcttttcaaaagcctctgtgtgagtggggaacgaacattcctctacatattccctgccgtcaaacgtcttgtgagtgatctttccgtctataccgatacgctcgcaatttccctttgctatgaccgactcatccttcatatctataagctgatacttcagtgatgaactgccggcatttactaccagaattttcatttaaataagatacctttctgaattaatttttgctgaacgcaatatcattattattttaaaccaaaccgcccgaaaaatcaagtgctttgacgaaaattacgactgcttgccgatatttttacaccgtgaggagaaaacaagaaagccgccccgattaaaaggcggttgcagtttgtagaaaaagtatgtttttttcaaaaaagtgcttgtcctcaatccctatccccaaacccctttccccgggaaaggggctatattactggggctaccgcccctagaccccgtcgggggctacgcccctgcgaccccttttttatcaacgatataggtttatcgacagtctgaaaccgccccgattaaaaagcggttgatttttaattcaatcttgggagcggctgtttatgaagttgcattctccccgataatatgctaaaatattcacgaggaaaccttggacgtcaggcggtcaattcatctcccgaaagtgcaaaagcactttgaaaggaggtgaagctgtgtacataactctggacaacttaattcagattggtattttcctaacgggatttaccgttatgatattcagtatcatttcttttgttataaattttacaaataaaaagaaataaccgcccctagctaccaactaaagcggttataactttaacttctattgggagcgaccgtctgtcgtttccctctttttgtatctataatataacataaaatcaagccggtgtcaagtatgcccttgtcggtatctctcagtttcctcagcgcaaaagcaagcctgcggtatctcatataatccctgagcttcattcccgatatttcgccgaatttccttgaaacatagtattccgagtagccgagcgtctgcgacagcctgccgagcgtcagcttttcgtcctcaccgcttctgatacacctgtctatgtcgtcaacgatattctgaatattcatataccattcgtttatcccgttcatctgtttttctcccgtacagctttcttccatcttttcgactgtattcattttatcacaaacgagcaagccgaaacttgatacggcttgctgtttttactgaaggcagcacagtattttcatatcagatcaagataagtcttgagatcgccgacaaactgatttccgcaccgtgcaagctcaccgagcactcgatcggttcctttttcggtcgtataccagttttctttggtgatgttatagcaatgtacggggcagaccgtcatatcaacattcgggaaagccatttgatacagcattaagcatcggcgagcatgaaaggctttacaaacaattataccgctttttatcattatgcccttttcatcaacggctttacgagaaagaaatgcgttatcacgggtatgccccgacttgctttcttcaatgatcgcagtctgcggaacgccgttttttacgagtacatctgtaaaaaactcgcagtctgaccggtaatcgccactataaatttccgcttttgagcggacgccgtgccatttttcctctttaacgcttactcctcctgacgggactatccaatcagtcaaaccttgtcggtataattctgcggcatattcgggctgttcggggtgtgagccgcccggcagaaaaatcgcatcgaccttttgaggttctcctgacacaaagatataatctgaaatatctgtgatgatccggtttggcataggggttctcctcttagtttttttgtaaaagaaaaatgcgtgatcgatacagcttgctgtttttactactcttccggcgtaaagaacacattcccgtcatcgtcggtcgtaaacaccgtgaagccggtatagcacacatttccgtaaatgtcgtttataacaaagctgtatctgtagtcgcctgcaggcagattgacaaactctatcatattgtcgccgctgtaggtgcattcatcaccctcggctttgcctgcaaagttaccctcgctgtcgtaagtattgaatatcggcactatgacatcgccctctttaagcggaacaacgcttcttgccgactcgccgttttcgtttacgccgtcccatgttccaagcgccgttatgtcatacgcattgccgtcctgcgtcatagctatacgcagatttgtttccttgccattgagctttataggtgatgtgtaaaccgagctgtttccgttcttctccactatgaacatagggataagattattctcaatcatataccactgcccgctgaaattatcctcgaccagtcccgatgagaaatcgacctttgtactctggtcaacaccgaattcgataagctcacccgtttcctcgtcaacacggtaaaccgagcagtttacgctcgcaaggttgtttatagtatcgtccgtaacattgaagtagaacgttccctcatcgtcaagcacaggtccgacatctatctgcacactgctcttatcaccgcagaagcccatgttgtcggtcttgttgttgtaatgctcccagttgctctcgtagtcggaataatccccgtcgctccagtacaccgcaccgtccgcaagccatgttttttcaccgctgtacccgtccgtactgccgttttgtgctccgtaggctattctgtcaacaaacgtcatatagtacggacttacgcacaccttgccgaatgttgcaagctcggcagagcctgaaacgccgaacggatagtaggtcgaaagccccgttgagccgtccttgtcctcgccgtagatgttatacactaccgccttttcaagcgccgacataaccttgtccgccttgtcgcccgataccgtagccgctatcatagagccgagatccaccatgttggtatatccctctgtatcgttgttactgccgtatgctcttacggtatagatgcttcttaccgcattcgcaagcagtgcagggtcagaagaaatatcgttcatttcctcggcggcgtcattcaccgcctttacaagttcgtctattcggctgagatccgttatcgaaagcgtagcctcgccgcctgcgccgatagcctcgcacgatgccataaagctgtcagcgaccgtctttccgagttctgctgtatccgctgtcggattactttccataaagcctgctatctcggtataatcccagccgtatcccggttccgtttcctcagacgcaaacatatagtcagcgtgcggaacaagcatattcgccgtttcgaccgttgccataaggcaagcgtcaaagccgatgaacgcaaacttatccgtcatcttatcgtatattgatgtaagcgcagtgtctatctcctcaagcgacagcgaatcgttctcgttaagctcgtcgaagcacacgccgcttatacttcctccgccgtggttccagaagataagccccattttagccgccgcatagttttctataccccagccgagaaaatcgacaagcacatcctccttgcccatattgacagattctttttcttcgacaaggcttatttctccgcccgttacaacataacgctgtgtcttttcggcagagatgccgtatgtatcagcccacgctcccgcaccgcccgtctgaatgacgaacttcacgttctcgctttttgaccctgcgatcatttcctcaatgtcgccgctcgcaagcccgttctcgctttcaaggtcacttccgcacatataaacgaataccgtctgtgtgccgtcctcgcccataggcttttcggcttcacgctgttttctcgtaatgcttatcccgtccgaaccgctgaacgtcagctttgacgcacgactgcccgtaacattcccgtcatatttattatcactgccttcactgccttcactgctttccgcagtgccgccgtcgctcgtctgcctgttgtcgcttgccgtgctgtcggaaatctcctcctcatcgtcaaggcaaccgctcgatagcacagccgttgcaagtaccgataccgcaagcagtgcccgtaatatcttttcacttgtttttctcataagctctccttttctcttagccgtaattataaccatattctcacatattaattataatcgtttttcactgcaattgcaataaaaaggcacaaaaggcatttattcggctgaaaacggtaatccccctcgccgccctaaacttccaaaaccgcactatccctctcacttttcgtaatgctaacatctgtattctccgatatgattctgtatccgcactatcccacccacttttcgtagggcgaggggcttgcccctcccgttgcaccgtagttattgattttctcagcgtttttaatctatcaatcatcaatagcggattgcaatcaaattttcatttttatatattaacttgatttttgataattgcaatgatgtttcgggaggtgcaagcaaggcaaggatgccttaagtgtgtgcccaaagtttcgcacggatgcgaaaccaaaaagcacacacagacactcccctacgaatattcctacaattcatcacaaccgcatataaactgcaaacaccaaacttggcttataaacactttgccggtttcgcaaaatgtagcaaatcgctatcacccttgcctcccctcgaaaaaggggaggtggcttgacggcaaggcacaagcctaattttacagcgtttttatgcgatatatccgacttttataattactaagtcggtctgccgtcaagacggtggggatttcatcgaaaacgattaccttaaaaaagtcgtttttagctaaaagaaaagtaaaagagcaacggaaagaaaagaagaaactatgagagatctaacaaaaggaagcataatccggcttatgctcctgttcagtctgcctattctgcttggcagtctgttccaacaggcgtataacctggtcgacattataattgtcggaaaaaaactcggtgagctatcgctgtccgccgtcggttcgacaacggcggtggtgtcgcttatgttcaacattattaacggtttatgcacaggttttgcaatacctgttgcaaagcactacggtgctaacgatatgaacaaggtgcggcgcacggttgcaggaatgattacatattctgcgataattacagcattaatcatggcgctgtgtatagtgtttgttgagccgctgcttactgcactcaatacgccggctgagatttttgaacaggcgaagctgtatcttacgatagtggcaggcggacttatagttacgcttatatataaccttgaagcgaacattcttcgtgctttgggcgacagcatagtaccgctgataatacttgtaatatcagccgtactgaatgtcggtctggattttctgtttatattcggattcggcatgggggttgacggtgcggcgcttgcaacggttatcgcacagcttatctccgctattgtctgtttcgtttatcttatcagaaaatgcccatttttaaagctcggcaggtctgatttcaggcttcacggcgaggagataaaaagccttcttgcttctggacttggaatggcgcttatgtattcgatagttgacataggctcgatagttctgcaaaacggcatcaacgggcttggaacgggtataatctcggctcataccgccgccagaaagatattcagctttactatcatgccgttctcggcaatcagcgcaacgcttgtgacatttgtaagccagaacctcggcgcaggcaagtttgacaggataaagaaaagcataaaatacggtctgctgataggctacggctggtcaacgcttgcggtgcttattgtgtatctgttcggagaacagcttgtgcttatgatagcgcctgcggacaaccgtgaaattatagatacggcggtcaattatctgaggataaatgtgccgttctactatgctctgaatacgcttttgtcgctgagatgtacactacagggactcggaaagagcgttgttccgataggggcaagcattgtcgagatgatatggaagatagtgactgtagttgcggttatccccgtatgcggttatttcggcgtatgtatatccgaaccgattatatggacggcaagcggacttctcgttgcggttattgctataaagacgctcagagcgtttgagaaagcgtaatattgcgtttagatatttcaattttcggcattttagtttttttgaaaaatatttcaaataaatgcaaaaatcgcttgaaaaattgttaatatagttgtataatagatacattagtagcgttaatgctaagaaaggttaattttatgaacatctggcacgatattgataaagaaagagtaactcccaatgactttttagcggtcattgagatctcaaagggcagtaagtcaaagtacgagcttgacaaaaagacgggagtgcttatactcgacagaatactgtatacatcgacacattatcccgcaaactacggatttatccccaagacgcttgcagacgacggagatccgcttgatgtgcttgttctgtgcaacgagcctcttgttccgcttgtgcttgtacagtgctatcctatcggtgttataaatatgatagataacggaaagatggatcagaagataatagctatcccgtttgaagatcccaattataactcttacagaagcattgagggcttaccctcgcacatctttgacgaaatgctgcacttcttcaaggtatataagcagcttgagggcaaggaaactgcggtcaatgaggtaatgggtcacaaggctgcggttgagatcatcaaggaatgtatagcaaattacgatgaggtttacggtgaaaagtacaacaacattgatactggcaagtaaatctccacgcagaattgaacttatgacgctggcaggcttcgattttttatccgttcctgccgtaaaggaagagaagataacgggcggtacatcaccgtcagacgcagtgcttatgctatcccgacagaaagcagaggagatagccgaaaaatttccctataatacggttatcggagcggatactgttgtggcgctcggtaacgagataatgggcaagcctgagaatgagcaggacgcatttaatatgctgaaaaagctgtcaggcaaaacacatacggtacttacgggagtatgcgtaatttctcccgataagcaaataaatttttatgaaaagaccgaggtggaattctatccgctcggcgacgatgagatacggcagtatatagcaagcggtgagcctatggacaaagcgggtgcttacggcattcaggaaaaaggcgctatgtttgtaaaacgtataaacggcgatttttacaacgttgtaggattgcctgtagcacggcttgcaagagaactgaacgctctcacagaaaataatcttcagtgaaaggacgcaaaggtatgttatttttgaacaacgcatttacaaaagatattacggagtacgacggagaagtgctcaaagaagtaaaaaccgtagacggaaagatatatctttcaaacggcgctatcattaaagagggtgttgtcggaaaattcttcgacattgccactaatgacaaatacggtactgtatttgaggctgacggtccagatgagatcggtcctatcgttggattcgctcctgttacgggcgattccgctcccgattattttgcattctgattatcgaaacttaacaaactgcggcagagcaatacgctttgccgcttttttcttttccgtttttatgactttggttggatttgctgtttttataaactaatactttaattttatgcggaaatatatgttgcgtacaactgctatttgtgttaaacttaatgcaaacaaggaggaattgatatggaaacggttttttcaaagcagttacagatgctcagaaagcaaagcggtatcacgcaggaacagcttgcagacaagctcggtgttaccgcacaggcagtatcaaaatgggaaaacgggagctatcccgacggcgatttactgcctaagatagcggacatcttcgatgtttctatagacaatctttacggcagaggagaggaaaagtgttcgtttgaacaacaggtattgaatcatatgcgggctatagccgacagcaatcaggatttttctgccgagtggctgaaaaattaccttaatataatctgggctatgcagcttactgcgtggcgtgaatgccgctattactatgatattcccgatattaaagattcaaacggcacggttgcttccgagtgcacctgtaatacaggtgtgacgtatatgcggcttaataaggatttccgctattttacatttataaaacagccggagagcttcgcaaaacagttttcggatattgataagctgtcggagttgttcaggttcttaggagataagatgaacttaaaggtggtaatgtatcttctttctcttgataacggcgaggtagccggtgcctcgaccatagcaactcatctcggctatccgaaagaaaagatagaaaaagcgcttcagtatcttttgagcatcaacggctcaaacaaagagataatcgaaataagcgtgctttgcgccgacaacggtaaagaaaaagtatacggagtaagaaactacttgcctgaaatgcttattttgctgacaggtgcgtttgccgtactcaatcagccgcatggttatcagacaagcgtaaacaaccgtgattatcctttctttgaccgaaaggacatgagttttataaaaatgggagagaaaaatgaagaaaaataaagagaaagagaaaaacaccaatccttatcataaggaatacggcgttttcagcaacagcattcacgcattaaaatcaatgctaaactattcacacaggtttatacctgttataataatcagcataatctgtgcgccgataatgcagtatctgtggtcgttcatatcaaagttcgttattgatatgataacttcaggacagagtgttaccgcacttgcactgcttatgggcggatttaccgtaatacagattacggctactatgctgaacctttacggcaactcattctttcacgtttatatcggagcaagattcaggcagatgggacttaagaaccgcaagataatgtcggtggattacggctatcttgaggataaggactttatggactgctatcagaaagcaggaaacgcctgcaacaacaataacaacggcatagaaggtatgatgagaggtattgtgcgtcttctcacgcttataccgataatcgcagtaggtatcgctatcctcggcacaatgaatatttttatcatgcttgctatacttgtctgttctgtacttcaattcgttgtcagcaataagacaaacgcttactgcaagaaaaaggtgtgggatccgcttgcaccgtggtggcgcagacataattatctttcttataccacgagcgactttgaggcggctaaggatataagaatgttcggaatagccgattggcttacagaaaagttcaaagtgctgaacaaagagcgctatgcggcgcagaagaaaaattcaaggatatgggcggtgtcggctgtcataaatgctgtactctgggcaggagtgcaggctgcggtttacgcatggctcttgtacagcgttgtaaccggaagtatgacgataggtaattttactttgtatcttgcatcgtcaatgacattctttgattatacaaatcagcttctgaccgctgtatcggacttacttgcaaggagcagggaatatgacgatttccgcagctttatggacgctgactgcggagataaggacgacagcggaattgatgttccgcagtgtgacagctatgaatttacattccgcaatgtttcgttcaaatatccgaaggcagaaaaatatgcacttaaaaacgtcaatatcactcttaacgcaggagagaggcttgcggtggtagggcttaacggcgcaggaaaatctacctttataaagctgctgttaaggctgtatgaggtgacagagggcgagatactgctgaacggtgtcaatataaagcagtacaacaagcacagctattataagatattctcgcctgcttttcaggaggtggaactgttcgcatttcctctgtatatgaacgtttcaatgagcagtgcggataaatcggataaggagaaggcaaggcagtgcgttattgattcgggacttgaaaataagctctccgaacttgaaaagggtatggataccgagatactaaagatcgtttacgatgacggcgttgatctttcgggcggcgaaaagcagaagctggcgcttgcgagagcgttatataaaaatgcgcctgtggtagtccttgacgagcctacggcggcactggacgcacttgcggaaagcaaactgtacggtgactttgacaagctcatcggtaacaagacagcggtatatatcagccacagattaagctctacacagttttgcgacaaggtcgctatgttcaaggacggcggtatagtcgagtacggaactcacagcgagcttatggacaagggcggagaatacgctgatatgttcaatgtccaggctcagtattatattgacaacaacgaaagcgaggtggctgtcaatgcgtaaagaaaaagagaaaaagatactgcctacgcttaaatttatgctgaaaacggcagtaaagaataagcctcagctgtttattgcttatgcgctgcaggtggtggtttcgttttcgcagacaatggttaatatcatctcgtcaaaatatcttgtagatgagatcgccgcaataatcggcggcggtaaagctgaggagcatatacctacagcgatattctgcattgcgcttatagtcggtgtgaccttgcttgcggcacttatcaactatcttgtaaatgagataaagaatgtttattccgagtggttcaacgagtattttgaagtaagcctgtccgaaaaggtaatgaagatggattttgagcataccgaggatcccgacacgctcgatcagatgaacaaggcgaaagagggtatgtcgtggtacagcggcggagtagtcggaatactgaacggtttcttcaatatcgtttcaaacggggtgaacgtactcggcgttatagcgataatcgcagttacctgtccgcttcttctgccgatacagatcatatcgcttgttcttatcacgatattcacaaataagagcaacaagcttgatatagaatatttcaagaagctgtctaaaatcaatcgccttttcgggtatttcttctatcagctgtccgacccgtcaaacggtaaggaagtcaggctgtttgacagcaaggatatgatgtgcgataaagcggattactacagcaatgaaactatagacacgttcagggagcagtacaaagcgcagtataaatatatgcaatactcaaatctcacaaacggactgcgtgacggactttcatatttctacataggctttaaggcactgacgggagcgattacactcggtgattttacaatgtgtgtttcatcggcgtcaacgctctactggggactgtatagcattgtagacaacattgcggctacggtaaaggcgtgcggttacgcatacgaatatctgaaatttgatgcaatttccgacagaatgacaaagggtgataagcctgtttcggacggcgaacacgttattgagttcagaaatgtcagcttcaaatatccgagaagtgaaaattatgtcctcagaaatatcaatatcactattaaacaaggcgagcatctgtctgtagtcggacttaacggtgcgggaaagacaacgtttataaaactcctttgccgtatgtatgatgtaacagacggtgagatactgatagataatatcaatatcaaggattactcggacagcgagtacagaaagctgttctcggtggtattccaggatttcgagctgttcgctttcagccttaaggagaacataatacttgacgagcaggaggacgaggaaaagctgataaagacgctcaaaatggcaggcttatatgaagatgcgatgaagcttgaaaacaagttcgacacgacaatattcaaaagctatgatgaaaacggcactgaactttctggcggtcagcagcagaaaaccgctatctgccgtgctttataccgtgacagcccgatagtaatacttgacgagcctacagcggcgctcgacccggtagccgaatatgagatatacaagcacttcaacgagcttgtcggcggcaagaccgctatctacatatcccataggctttcaagctgtaaattctgcgatgaaatcgccgtatttgctgatgatacgataaaggagtacggtacgcacgaagaacttgtgaaaatcgaaagcggtatttattccgaaatgtacaacgctcaggcgaagtattatgtggagaacgtgtcgtaaacagcgtaaagaaaatacccatgcagtgataaactctgcgtgggtatttcgttttttacgctattcccgataatgtgcatataccgtttaccgctatgcaaagcactattccgataacggtcggcagggcaaagctcaccgctgtccatttaaggctctttgtttccttatataccgtaatgcaggatgtcgagcaagggaagtggaacagtacaaatatcaccatacatattgctgttacagaagtccagccgttagatataaacaaatccttcagtgcggacaactccgatatttcggtaagcacagtaccttctgagtatgccattattattatcggaacaactatctcatttgcaggaaagccgagtatgaacgcaagcaatataacaccgtcaagtcccataagtctgccaaatgggtcaaggaactccgtgcagtgtgacaacagcgaagcatcgcctgcagtaacattcgccatcagccatataattagccctgcagggatagcgacaattaccgctctgccgagaacgaacagcgtcctgtcgagaaacgctctgacaaggacctttgcaaactgcggtgttctgtatggcggaagctcaagcgtgaacgatgacggcattccttttagtaatgtctttgacaggaaacgtgacgagagcataacagcggcaaccgaggcggctatagcggcactcagcaggagcgccgccaaaaaatccgagcctgcgacagccggcacaccgatagcaaacattgtgataatgcttatgatagtcggaaattttccgttgcagggcataattgatgcagttatgatcgctataagccgttcacgtttactgtcgattatccttgcacctgttattccgcaggcattacagccaagactcatacacagacataaagcctgtttaccgcacgctcccgcctttttgaacgctttgtcaagattgaatgctattctgggtagtattccgtaatcttcaagtatggtgaacagcggaaagaatatcgccataggaggaagcattaccgataccacccacgcaagcactctgaatatcccttcggtgagaacgctgttcagcattacgggagtacctattgacaataaggcgctataaagcagtgattcagcctttccgaaaagctccgaaagcaaggcagacgggtaattcgcacctgttattgttatccataaaatgataaacagcataagcagcattattggtattcccgtcagttttccggtaagtatcctgtcgattttcctgtcacggacttgttttttattggcactacgttttacgcattccgccgcaattccttcagcagttatgaaaatgcaggaaataatctcatcggtaaaattattgtcggtcagtctgtctgcggcggatataagcgttttgaggtaattttcgtctgtaccgtattttttacacaggctgtctaccgtatcgctgtcgccctgaaggagcttaagacatataaaacgctttgtcctgctgtctgtttctattttttcggtaagcggcaaaagctgtgatattgcgttttctatacggcttgtgtaaacaagcgttatatcgttgctttccttgctaagtgcaacgctttctattgcctgcatcagtttatccagcccttttttgctccgtgccgatgttgccgctacaggtatcccaagctgttgtgacagcttagttatatcggtttttatgtttttcttttccgcttcatccatcatattcacgcacagtactgctttagacgtgatttcggttatctgcagtacaagattcagatttcgttcaagacaagatgcatcgcagacgataacagtaacatcgggcttttcaaggcatatatgccggcaggctattatttcctccgcagaatgagcacacagtgaatatgtgccgggaaggtctgttatcagatatttgttattgttgtaagtataactgcctgcggcgttgccgacagtttttccgacccagtttcccgtatgttgcttaagccctgtcagagcgttgaaaaccgtgcttttgccgacattgggattgccggcgagcgcaaccgtaaattctttttcgtatttcatattttccgcctttcagctgtaatattacattatatgaaaatacgtctgatttgttaagaatgaattatacgttttcttcggaaaccgcctgcgtcagcgtgcgggaaagctcatcgctgttgaccggctttgtaagaaagcctgtcattccgcattgttgcgccttgttcacgtcttcgctgaatgcgcttgctgtcattgcgattatcggtactgtttttgcatattcgcttcggatattccttatttctttcgcacattgaaagccgtccattaacggcatccgcagatccataaggataatatcatagtaatagtctggattgcggcagaacatttcaagcgcctttctgccgtttgctgcgacctcgctgtttacgttatatttggcaagcatcgcttttactatctgaacgtttacctctacatcttcggcaagaagaatgtattttccgctaagcgtcattgacgaattgtcaagctcatcacaatgaccgggattattatcgctgaaattgtctgtaaatcctttgcaatgctccgataatatgcgttttaaatcaaaggtgagaagcggtataagacatacgccttttactgcgcccggatactttgaaagcgacaagtccgattgattttctgttgtgactatgtatgttatattgttgtcgtttttgccgatatattctgcgattttatttacccggtctgcatcggaaacgataatatcaaagtgcctgtccgctgtaaagccgtcatcctgtttatcgtatgaacagtaggttatccccagcttttccagcgcttctgctatctgagccgaatgactgcggttgttgtttataataagcgccgacagacatctgttaccggaataacggttttccgttccctttacggcttcaatctgcagctttataataaactccgtgcctgcgccctttttcgtatttaccgttatgcttccgcctgcggcatcgactattctcttagaaataggcataccgagtcccgttccgcctatatttttgtcggtcatctcacgttcatacggctcgaatatctttttggtgaattcctcgctcatacctatgccgttgtccctgacccttatctcatattccggaacaccctttttgccgtcatccgtttcggtaagcgtaagagaaatatcgccgccgttgtgcgtgaattttatcgcatttgaaaggaagttcattataagctgttcaaatctgtgcttatcgcaacgcacaatctcgtgggtcacattgtgcatacttatcgtcagattatgttgcttttcagccgcaatgctgcttattaccgttcttatctcataaaacaggcgggataaatccacgttggtgatattgaatgtcagtctgccgctttctattacgcttatatcgagaatatcgcttataaggccgagaagctgatttcccgatgtgataatcttattgatatattcctttgtcgccgcagaatttccttcctcatttgcggcaagggaggcaaaaccgattatcgcactgagaggagtgcgtatatcgtgagaaatgcctgagatgaacgagcttttggcattgtttgcttttttggcttcgttgactgcactatgcagtgcaaggtttgtcttgcgttctttggtgcggtcagacagtacaaggatatatctatcctctccgtcaatcttgtttctgagtgcggttatatgaaacaggcaggcatttccgctgtttctgcgcacatattttctttcccactctttacgctcaccgacagacatacggatgagattttctctgatattctcgtctttatccgtcactgccgagttttctattatgctttcgtccgacatagcctcgctttgagaaatgccgagtattctttctatgttggggctgacatatcctactgagaaatcctctgtgttcagcataagaaatatatcgtcaacgttatttgaaagcacggaaaataattcttccctgtattttatctcgctgtcctttttcctgaggttgagatagtttttacggatgagatataaaacggacagagtacagataagcgctatcacactgacgcttgcagacattgttatcgtctgcaggcggttgatgttttcgtttactacagaacacggaacaataccgataagtatccagtccttgaagcctatgctgtgatatgccagataatatgctttaccgccgagcgtaagcctgtttacccctgattcgttatagcatatttcggcaatataagggtgaatgttatcctgcgacagattatccgagctgtctgcaagcatccgccagaagttgcttaattcatcgccgtgttcgcccctattgtttactacaacccttccgtcaggataaactatgtaatttgtagccatattattgaatgtgtttgagcttagcaaggatatgatgtcatcgttgttaaagctgattgctatagcggaatacgaaaagtcgccgtacttgttttcggggcagggaacagcgaacacgataagctccgacctgtcaatgagagcggtatcggatactacgtttttgccctcctccataagaattctcatatttcttccgagatccatcctgccggtattaccgtcaaccgtacaatagcttccgtccttatcaagaaagtaaaaatccgtgaatgcgccgatacgtctgatattttcaatgtaagtcctaattttcttatcgtcatcggtgtcttcaagataaggtagccacatatccatagcgttccagttttcgcttaacagattgctcagcgagttaccgacctgagaatatatttcgttaaggtgagtggcgctttctttgaagataagcttcgatgaaatggcattgtaagtataagcggacagtataactatcaatgttgccgtgacgattacaaggtaagcaaaattctttcttatcaaaaataacatctccccgaaatttatacctctgatacaaaataattacatttatctcttaaagaatatcatattttatctttaaatgtcaataaattcaagcacgaagattgaaaaatataaaaaaatcctgcgaatcattcagtcccggagggtatcgcaaatttgctgatcccgctggtgatttatgttgctatgttttgtgcggactggaaactggctcttatgtctttggcctctatcccgatcagcctgctctccatggtcattatgtactctgttggaatgaagcgcatgggtccctactatcagtctgcacagaaaatgaacaacacgatcattgagtacatcaatggtatggaggttgtcaaggttttcaaccgggagagtgaatcttacgagaacttccgcaaggatgtaacggactatcgggattataccttggcatggtataaggccgcctggccctggatggcgatatacggaagtctgctgccctgcactgttattctgactttgcctcttggggcatggtttgttctctgtggcataagcactttacctgatttgattttagtcctctgcctttccctcagcattgggattcctctcctgaaagcactgggctttatggagacgattccgaatctgaattataagatcacggcacttgaacagatgttaaatgcggcaccgctgcaagctgctgaggatgatttccacggacaggattttaacatttcttacgatcatgtttcctttgcgtatcaaacgacacagcctggcccagatgggaaaccgataatagcggaaaacgaagtcctccacgatattacccttgtggcaaaagcaggacaaaaaactgccctggttggtgaatccggttctggcaagagcacccttgcaaaactgttgatccactactatgacccgcagaaagggagcatttccattggcgggcagaaactttgtgatatgagcctggaggcattgaacagccgcatttcctatgtggctcaggatcagtacctgtttaacacctccctgctggaaaatatccgtcttggacgtttggatgctaccgatgaggaagtaatggaggcggcgaagaaagcccagtgtatggagtttctggaaaagctgccgcaaggtattcactccatggcgggcgatgcggggaaaatgctttccggggggcagcgccagcgaatttccctggcgcgagcaatattgaaggatgccccgattgtagtgcttgacgaggccacggcctatgctgatccagaaaatgaggaaaaaatggaggctgctattgcggagctggtgaagggaaaaaccttggtagttatcgctcacaaacttcccgctataatgaacgcagatcaaatatgcgttatggatcacggaaagatggtggcaaccggaaaacatcaggagctgattcaagcttgcccagaataccaaaagttgtggaaagcggctcaggacagcgccgagtggaaagtatctactgcaaaggagggaagataaatgtttgcattgatttcaagaatcctgaacctctccgggaggtataaaagccgtattcaggctgcatttctatgtgcatttgtcgagtccattctctccaaaatgccgatcttcatggcgtttattgtctttgccgggtttgctgataatacgctgactggaaagacctgtctgtttgtcggacttggattattagctgttgtagtggttcagacagtggttcactatttgagcgaccgtctgcaaagtgccgctggatttatgatctttgctgataaacggatggagttgggaaatcatttaagaaaaatgccgatgggttactttacatcggggaatattggcaaaatcagctctgttctcagtacggatatggttttcattgaggaagtttctatgagtaccattggcaacatgatgagctatatgctgtctactttggttttagctgtttttatgttcgtactggattggagacttgggctgattgcggtaatcattaccttgctggcatcgctggttgcaaaatatatgaataaggtttccttcaaggaggctgtcgggcgtcaaaaccaaagcgagaatttgacggatgcggtcttgtcttttgctgaaggaattggggttatcaaaagttacaatctgctcggagaaaaatctgacgaattaacggaaaacttcaaaaaatcaagggatgtcaatacgaagtttgagcagaaaatgacaccgtggaccactggcttaaacattctctatggcgtgggtattgccgctatcttcggtttatccgtttttttacatcaggaaggcgtactctccctggcttatcttttgggcgtgctgctgtttgtctttgatctctttggacctctgaaagctctttatggagaagcaacccgactgaccgtgatgaatgccgcattagaccgcattgaagctgttttggacgagcccgaacttcccgataacggaaatcaacatattctgtcacaggcacagccggatcagccagaagtacaatttagcgatgtggccttcgcctatcaggacaaggaagtcctgcacaacatcagcttctctatgcagaagaataccatgaccgcacttgtgggaccgtctggcggtggcaaatccacgattgcgaaccttctggcgcggctgtgggatgtgaaatccggcaaagtgacaatccgtggtacagatattcgggatgtacctctcgccgaactgatggaacagatcagcatggttttccagagggtgtacttgttccaggataccatttacaacaatatcagcatgggtaaaccggacgctaccgaggaagaagtctatgaggctgcaaaaaaagcccgctgctatgattttatcatggcgctgccagatggattccagacagtcatcggtgaaggcggcgctactctgtccggcggcgaaaagcaaagaatctctatcgcccgctgcattttgaaggacgcaccgattgtcattttggatgaagcgactgcaagtgttgataccgataatgaaagctatatccaggaggcaatcaatgaactggtaaagggtaaaacattgcttgtgattgcacaccgcctgaataccatccgtcaggcagatcagattttggtgatctccgatggacggatcagcgaacagggaacccatgacgagcttatggcaaaagccgggatttatcaggattttgtaaatatccgtaaaaagtcctccggctggagccttgcataaaggagacaatagtgatgattcatgcgtccggagaggattatctggaggctgtgctggttcttcaaaagaatcacggtgctgtccgctctattgatgttgcacggcgtgttggagtttcaaaagccagtgtaagctatgcggtgtcggctttgcgtgaagggggctttttaacggtagatagtgattacgttttgcatttgaccgaaacaggccggaatgttgccgaaaaaatttatgagcggcatcagttctttacagagcaatttatcgcagctggcgttgaccctgaaattgcagagcgagatgcttgccggattgaacacgccatcagtcaggacacctttgaaaagatccgggatgcacacaaacaggaaaaataggatactaatgcccgtcgttccaactgtgcggacaagagcagccagtggggaaaatataagcccactggctgctctacatgaaagacaatcatcggcccttttgttttcccctgtacatcacttcagcttatctgcgctcatgcacaggtctatgtaccgttgcgactcttcttcaccctttcctgcaaagtaatcaagaacgcacttggcaacggtctgcggcgctctatcgtggaacacgattccatccagactgatgtccatttcttctgagatcagcgcaaccgtttcaaatttcggattgctcttgcacttttcaatctcaatgacagttcgggtacacatattaagccgttccgctaattcgcgctgcgtgatctttttctgctcccgcttttcgcgaagcttttgggcgaacaggtcaagaaagttcattgtaaatcacctctactacattgtagagtgagcctcaattcacttaaatacacatgaagctcacattgaatgagccgcaaatcacattcagcgagttggaggtaattttatgatgtcacggatgaacaggagatactgctaaggccgctcgcggtcatgtaaaaaagcataagcaccgattagccgtccacttcaaaaagcacgcggctatcccccagacgagctgcactcacgaaagcgagttgcagctctctttttatgcggtttggttcatccgtgatttagcccctcccggtacagtattcgttactcatgttttcactcgcacgcaaggcgctcgttcaggtcatcatgcctgttcgagcgcctttttacgttttcctgtcggctgtcgttctccgccggtgttggtctggttcaccacccacccaacaccgaaacggaggacatattatgtttaacagaaagagcagctatgcgctgaacaagaaagaccccaacgctatcgtttacatggatgccaacgaagccatcatccgcctgacccgcgaggactttgccagcgaggaagaatttctgaaatggaagtccctgtcggatgcagactatcatgcttccgagaaagaggatcatgtctacgctaatcatacccttgcactggacgagctttccgaggaagcagcatctattcccgctgcggatatctgcatggagcaggcgcatgaccgggtggcggaaatccgccgtagcacccaaaaggttacgcaaatcaggaagcacctgacggacactcagttccgcaggatgtggatgtatttcgtggatggaatgacgattgacgagattggaaaagtcgaaggcgtgtcgcatcaggctatttctctcaacattacagcagcaatcagaaaaatcaaaaaatatttctgaggtttttcaaaaacaccttgcaaaagtggcccaaaatcggcgataggtgaagggacattctccacgaagcctttcgttgaacgttgaaaactgaatagaccatgatgcaggcacaaaacccgcgtgatagcggcataaggtgcgccgccacgacgatggcttcaaggaggtgattccggaaaagccatccgagcgatctacgcagccttagacccgattcggcaaatcgggcgcgatgacagcgcggcggataatgaaacttgctcacgccctcccacagacttgagggggaaccctgcggtatgcgccagctctttgaggcagcggtatcgtggagttatgacagccctgccaagggcggcctgcatcatgcccactatccggggcgcgtggcaaataggatggatcttctcaaatggacaagcagagcggctgcgccggtattcgccattatgttatgtggctccaattctacccgcgcagccgcctctcaaagtcagataccatgcgctgacggcctttccgtcagcgcattcatgtgaccttgaggaaacccaccaaaccgagaaaggagatcgccatgatgcagccgacgccaaacgaaacccaaatccacacggatgaactggtggacatccgggaagtatccgtagacaaaaatcttcccaaggaagaacgcattgtcgcctttatccgccagatcaaaaatccttaccgcttccgctgcggcgattttgtggtaaacgcctgctttgccgggaacggcgttacgttggaggaatgtctgcaaggcattttgcgctgagcgacatcctcgcttttttccgcagagagtgctatgatcggtgtggaaaaggatgaaaacctaatagccagataaccactcttttcatgcgggagcagtccgggagaaaggagtgctttttcatgcctaaatacaaagctaccgcttacatccgcctgtcctacaccgacgatcattccagcgaaagcgacagcgtttccaatcagcgcaagctcattgaaaactttgtagagcgtaacccggatattgaggtcgtttccgaaaagatcgacgatggatacagcggcatcatctttgaccgccccgcgttcaaggaaatgatgcaggatgtcaccgatggcaacatcaactgcgtcattgtaaaagacctctcccgcttagggcgcgagtacatcgaaacaggccggtatctgcgccgggtattcccggcctacggggtgcgtttcatcgctatcaccgacagcatcgacaccgcccacgacagcggcgatgatctgaccgtatcggtcaagaacattatgaatgaagcctactgccgggacatttccatcaagacccgttcttctctggacgtgaagcggcgcaatggcgatttcgtcggcgcgttcccggtgtacggctacatgaaagccgaggacaacaagaatttgctcgtccctgacccctacgctgcctgcgttgtctgcgacattttccgtatgcggctggagggcgcaagcgcctccaagatcgcatctgagctgaaccggctgggtattctctccccgctggcgtacaagaagaacaacggtctgccctacgcgaaaaagggctacgcggacaaagccgactgcaagtggtcagcaaccaccatcatccgcatcttgcaggacgaaacctataccggaacgctggtgcagggcaaacagggtacgccgcattacaagatcaagcagatggagcagcgccccgcctccgagtgggtgcgcgtcccggatgcccataaagcgctgattgcccgtcaggattttgagctggtgcagcgcattaagggactggatacccggacttctcccaacgaggatacggtttacctgttctccggtattctgatctgcgggtgctgcggaagccgcatgacccgcaagaccaaccgtgcgaacggcaaggagtaccactactattattgtccaaccggcaagaaaaagggctgcgcccatccggtcatgctgaaagaaagcagcctgatcgactgtgtgcgggacagcctgaaagcctatatcggcaatattgcttctctggaggcgctgctgaccggcattgaccagaccagcatcaatcaggcgcttgccaaggaatacagcgaccacatcaccgacaacgagcgccggttggagcaggtgctggagttcaaggcacggctttatgagagccttgtggggggtatgcttaccaaggaagaatacgcttcctataaggcaaagtacaccaagcaggccgaggacatccgagaaagcgtccgcgttctcaaggaaaaactcacggaggtgctggaaaaccggagtgagcgcaaccgctggatttcacagtttacgcagttctccacgctggaaaccttagaccgcagggcgctcattcacatggtacagagcatccgcgtccgtgggaagaaggagctggatattacctttacccatgaggacgaatacaaaaaggcgttgcagcttctggcgctggcagcgcagcagaaagattacgaacagagaaaggtgggctgagcatggcaaggaaaagcagaaaagaaacggctgcggtggccgtgcaggaggctgacgccgcttgccgcgccgcgatctatgtccgcctttcggtggaggatacccacacgcacagcgtatccattgaaacccagcagatgattattgcccgctatctggagcagtacccggagatcagcgtgtacgatacctacattgacaacggcgcgaccgggacaaacttccaccgtccgggctttcagcagatgctctcagatattgaggctggtcacgtcaactgcgtcattgtgaaagacctctcccgtttggggcggaacaccatcgacaccggctactacattgagcagtatttccgcatccgcaacatccgctttattgcggtcaatgaaaacttcgataccgtcgccccggaggacgcccattccggtatcatcattccgctgcggaacatgataaacgaagcctacgctttggacattgggcgaaagatcagagcgcagcagcggcaggccatgaaggacggcaagttcatcggggcgcgtactccctacggctatctgaaagccgaggacgattgccaccagcttatcatcgaccctgttgccgccgttgtggtgcagcggatgttccgctgggcttccgagggcgctggcctcaataccatcgccgtgcggctgaatgaagcgggcgttctcactcccagccactataagaagatgcagggcaagatcacccacgaaaatttgctcggcagcggcaagtggcaaacccgaacagtcggcgttattctccgctccgaggtctacaccggagatctcgttcaggggcagaccaaaaccgtggatcaccggcaggtcaaggccgatgccgaggaatggacggtggtacgggacacccacgaggccatcatcagccgggaacagttcgcggcggtgcaggaaatactcaatcagaccgccagccgcgccaaggcacgggaggtcaaagcctacacgccgaatcttctcaaaggcaaggtgttctgcgcccattgcggcggcagcctgcaccggcagagaaacatccgcaagaagtccgacgatgtgtacttctaccattgtctgagccagagccgaatcagcaaggatgcctgccccggcgtgaccatccgcgaggatgcgttgctggatatgttggcagatatgcttcaggactcgcttgatacggcgctggggcaatacaccctctctcttgcggagctgccccggcaggccgctgaccgcgctgagctgcgggagaagatcaccagccgcaaacaggaaatccagcggcttcgcagtatcgtgcggagtttatatgaaaacctcgtccaaggcgttctcaccaaggatgaatactttgactacaaggagaagtacgaaagccgcattgccgacctcgccgtggaaatggaacagttggaggacggcctgcgaacgatggatgctcaagcagagcagcaccgggtgctggaacaggatgccgcacaaatcaagaccgaccgggcgctgaccggcgcactcatcgagcggctgatcgaccgcatcgaggtgtcccatgataagcaaatcacggtgcgctatcgtttccagagcgagtttgaaacctatgcggaggtgctggaacaatgcagaaatatgtgattgctctctatatccgcctctccattgaggactacaagtatgacagtctgagtatcgaaaaccagagtcttgtcctccacgaatatgcggcctccatgccggaagccctgaacgcggagatcatggagttcatcgacaacgggtacagcggcacgaattttgagcgtccgcaggtacagaagctcattgagctggtgcgggccaatcaaatcgactgcatcatcgtcaaggatttttcccgcttcgggcgaaacagcattgaaaccggctactttatcgagcgcgtgttcccgctgttccatacccgcttcatttccatcagcgacgattttgacagcagcaaattcaagggtgacaccggcggcatggacgtagcattcaagtatctcatcagcgaatattacagccgcgatatgtccatcaagaccaagagcgccaagtacgccaagatgcagcgcggcgagtatcagagcaaaatctgtccctatggctaccgcaaaagcgccgatggcagaatggagcctgacccggaggccgctgccgttgtgcagctcatcttccagcttgccgccgagggcatcaacgccaccgccatcacgcgagagctgttccgcagaaacatccccacccccggccagtacaaagcggcgcgaggcaatcacacacacgatatttcccgctgtcacgggatttggagtacatccaccattctccgcattttggaggacgaacgctacaccggcgtgtatgtgattggcaagcgggcagttctcgaagtaggcggcaacagaagccgcctgaaggacagagaatcatggtacatcatccccgaccatcacccggccatcattgagaaagccgtgtttgataccgcgcaggccagtcagctccgcttttcacagcccaacaaaaagaagcgggactacccgctgaagggcaaagccttctgcggctgctgcggccatgcactgtcccgcaccatgcagaaaacctcgtattattactgccgccattccgaagcagacgaagaaagccgctgccacaagatgcgcctgaacgccgcagagctggagcaggcggtattcctgacgctgaaaaagcagatggaagccgccgcgccacttgcccctgacggtacgctccgggtggatgcttccgtaccggaacgcaccgaatatgagcagcagatcgaggcactgcaagacggtaagcgcgccttgtatgaacgctatctcatgggcgagattgacctgaacacctacaaggcggaaaagactgcgtgtgacgagctgcttttgaaaacgaaaaacgcctatgccgcagtattggcacaggcgaagcagaaacgggacgaacaggcacggcaggacagccgcatggaagcgtccaaggcaattttcgatgcggacacgctgaccaccgagctggccgagctgctgatcgacagggtgctggtgtaccccgacaagcgcattgagatcgcatacaaaatccaggacatttttgattgaggtggcagtcatgaaaattgctttctattgcagagtggacggacagggctttggctttgtcctccccgatgaagctgacaagctccgcgagtttttcgccgagcatcaggataagcctgcgcttgaaaatccatcaagcgcaagctaaaaatttttgtcgtgtgcttgacatacgggtggcgcagatcatggaaccgaatcagcggaagctccgcctgttttaacagtgtttttaatcggtggtaagcatagtcggggtgcatcgggttttcgggctcatagatattcgggaatatccattcgctgactgccgtttcttttcgcttccgcagaagttccgcagtgctcggcggcaggacaatcgtgcgcgttcccgtctcggttttggtttcgccgatattcaatccgccgcctttccttttagcaaccgagcgcctcactttcagctttccgttttccgcatcgaagtcctcccacttcagtccgcagatttcaccccgccgcagtcctgtggtcagctcggtgtagaagaaatcgtaccaccgcttatcctgccgaatgcgtttcataaatctctcaagctgttcgtcattgagtatctgcttcggcggataattgtttttgggaatcgttgtgccgaccgttggatttttaacaatcagccgtaggcgcaccgccatatcgagtgcttcgtgcagcatcatatgaataccgcgcaccatactgtcggcaagctctgtaccgtgcagcttgtcaggtttcacccgacctttctttttgacggtgttatagaatttttgaagctcctgcgtggtcagcgccgacaaaggtctgtcgccgagatacggtttgatttgatttttaatcatcgctttgtatgaatcaagcgtgctctcgcgaatcgtgaagatcatatattcattaatccatcggtcgagccattccccgagcgtcatattcgaatcctcggtgaggtcggcgtcgcggtacatctcgatgcagtcgtggagctttacgattaactccttttgtgttcgggcaagcacatagcggtgaatcggatcgccgttctttttgtgaccgacaacgatgcggccttcccatcttccgtcttcgcgcttgcgcaccataccgtctcccgacggtcttcgttttgccatagtaccacttcctttcgcagtacaacacaataccacatacatggcggaatatccagctaagtttgcggtaaaattcgcaacccctaaatcagcgaggttaaaattcgagcaacccctaaattgcggtttcgtaaccggattgcaaaagccgtacaaacccttatgcggtcggcgttgccgtccgctgtgagccgagttgcgggtcgcttgcgaccccacctctttctcctgcttattttcggacgagccgtaaaactgccgttaaaccgccgatcccccgtatttgcggtcaaattcggcgagctttttcaaaactgcctgatgccttgtttcctcgtgtagccgtatcagttgttgctcgtaataccgctctaccgcttccgcaatcgggcgtattgtatagcgcaaattgccgttgcgcttttctcccttttgggtgataacggaggtcggctctgcagtaatcagctgcttttcaatcagactgtctacatatttcttgacggtgtttttgctcatgccgacagcgttgccaatcgttttgtagctcggatggcactgaaatgttttcctgtcctcgcagtacatcagatacgcatacactgcgatctcaccggtactgagacccaagatgaaaatttcattcggcacggggaaataatcccggatcgcatcacgctttggatatcgggtgaatctcaaatgctgcctcccgtcttttcttcgacccatgcgcggaatttttctttcggtacgatgagccgtgagccgatacgcaacgacggaaaccctttatcgtgcatcagctcgtagctgcttgagatggagatgccgaggagcttggctaccgtttcagcattaaggaacaacggcagatcctcataagcggtgtaaacagattctttcattggtttttcctcctgttaaattcacacggtttttcgccgtgttatgtagagaactgctgttttgcaaaacaaaaagacccgcactcaatcccgatgctaatctgcatcggtgattatgtaagtgcgagtctgaaactcaaaataaaaatatgtgtattcaattgtcggttgctttctttacttgcagtataacatcaacttatataaaactcattgccgtatctctgatactctcctgcacagcggcgctcaccgcctgcagttcgtcctcgacctcatctgatgcatcaacgggtaatgtcggcgacacaacacctgtttcggaaacctcctccacatcatcggaagctgtcaacagcgaaagtaaaaccgacagcagttcagaggataccaagagcagtgacgagaacaaaagcagcgaaaacagcaccgaatcgaccgtcacttacgaatatgtaaaggacggcaaattctcccttgcaaacggcaacctttcattcaaaatgcctaaggactggaagctcgcaagtgcctctatagcttatcagtttgcgtcaacagacgaatacaacgagaataaattcaatcttgtagtcagcaagaccaacagccctatcgaagatgtgacctcagagcagatgaccgccacatataaggctactatggaggacttcaagctggttgatttccagcacaccgaaatagcaggcaaaaaggcaatctatatgcagctgacaggcatggtgtcacaggtaacaaagcagaccaccataacacagtatatgatccagtcgggcgaagatgcttattgtttctcattcacacagtcaactgaagatgaaactttccccgaccttatagcaggcgttatagattcgcttgaaattaagtaaattaaaagagaaacagccgtacaagctgtttcttttcctttttaccgttgcatttccacatcggatatgctacaataaatctgaaaataacagccgtaaggcaaacaggagttactatgaacaagaataaattaaaccgccttgatgaaatgatgcagtcgcaggtagacagcggaatgattcccggcggacatttaagaataatcaaggacggagagcgagtatacgataaatgcttcggaatggctgacgttgcccgtagccttaagatatcggacaatacgatataccgtctttacagtatgacaaagcccgttaccgcagttgcgacaatgatactctatgacagagggcttattgacctttccgacagcgtaagctggtttcttgagggctttaaagatcagaaggtcgtaaccgcagacggcattgttccggcaaaccgtgaagtcaaaatcatcgacctgcttacaatgaccgcaggacttatgtaccccgacagaaacgtaaatccctccggcgataaaatggctgatttattcgataaattctacgaaagagcattttccggcaacggcacatattcaaccgttgagatgtgcaacgaaatgggtaaaataccgctgttcgcacagccaggcacctgctggaactacagcgtctgtgcagatgttctcggtgcgatagttgaagttgtaagcaaaaagcgtttaggcgacttccttaaagatgagatattcacgcctctcggtatgaacgataccgatttctatgtgcctgccgaaaagcgtgaccgctttgcagaaatctatatcagaggcgaggacggtaagctcgctccgtgcgactggcagcacttaggacttgtctataaatatacaaagcgtcccgaatttgagataggcggtgcaggactggtttccaccgtaaacgactatgaaaaattcgctcagatgctgttaaacggcggaaaatacggcgatacccgcatactcagccgcaaggcagttgaccttatatctcacaatatcatcaccgccgagcaggcaaagacattcaactgggattcgtgtatcggttatggctacggaggacttatgagaacgctcataaaccccgaaataactactgtcggcagtacaggagaatacggctgggacggctggacaggaaactacttctgcaacgatcccgaaaacaatcttacatttatgtactttatacaggtctgtggcggtaacggcatacgtccgctcagaacattaaagcaggttatgtactcggctcttgacgattgagcataatttacacagaatacagcactgccccgtgagaaagctcacggggcagttttatattaaattctttttctataccgttttacagcttgtcaaaatacttctgcacagggctgtactgcacgatataatccacatactctgccgtagccgagtagaaatcagcctcgaaccttgctatacccgcaccgcccgatgcaaaattctcatcagaaacatagttcttcgagttatcaagtatatagcaatccgtattctcgacaaatctttcctcgcacagctttagcagggcctttgcgtttgcaaatttcttcttgtctgtcacaagcggctttatttttccgtcataatctcttaccttgtcattgagcgacaccttgcacagaattatattactgccgtatttctgcttcacaaaatgcgacagcttatcacaggcggcaaggatacgctccttgtccttttgagcgtcaagcgtgaacggctgccctgcttttccgagaataaccgaaaggtcggaatttgcatactgcttgtccacagtaaatccctcgccgttatattttgcattatccgcaataacgtccgccatgtctatcgctatccaccgtgaccgacttaccgtgagcctttgcacagttgtcctcataagctgttccaaagccttagcgcccgacttatctgcagtggcaaacctcttttcctctacggaatgcggcttatcaaacgcccatacaaacgactctccgctcaccgccacattcattctgatagttgtagcctttgcaagcgctctctttataacacccgtaccccacatatctatcaatgtgaagttgtgtatcttttcatattcatctatcttctgaggcaccgccttaggatcgccgccgttccacagctcgtatgcgacccttgtcataaaccgcaggttctgatcgtttacatcaacatcttttcccaatgcaccgccaagcgtagccctaacaaagtttgcgataggacgctttatcctgtactgcctgtcaagaagtcttataagctcgccgtgtgtcacattctgcaacgtattgctttccagtgccgcaataaccttcaccgcattcttcatctcaatattgtcaccgaaatcataatatctgtaaatatcggttatgcttgagtaatgctgttcgattatgtcctttatttctgccctgttctccgcaataaattctcttgaagtatggaacataagtgcgtctgccggctcttttctgtcaagcagaacggtaagcagtccccttgcacacgcattgtcataatagcacaggatctgttccagccttgaatcaatatcctgctccttgtacactctgccgggttctcccgatgtaatctcatcaagcgccttttcgcagtccgcaaaatagaaacggttgaacaccgcctcttttccgtcaccggtcaacgacaaatcaccgaaataccttcccgaaaggtctattataacagggtgtacctttttgataaaataattctcaatatcctcaaggaatgcattcagcttgttcttcggcgtgctttttctgacctgtctgcctattgcgtagaattcgggagaaatcgtccttacaagaatgattttatccgcaggatacagctttagtatctcttttgcaaaaatatcgacaagcggcttataaacgtcttcgggcaatatgttcggcaatttttcgccgtgcttttcattgccgtcaataccgcccgtcagaaatgaattttcagtcttgacaagtccgtgtgccgcagtaccgtaaaagtcaaaaataaaatagtccgagcggttttcctttatatattcaaatgtcctgctctcccactgagcatcgctgttgtcgattttttccgggaagaacgccgcaagcggagatatttttcttacagtgttatcggctgtgaacttagggcttctttcgactatcttctgtacattgtaagagcccatagtaataaagccggtacgcttcataagcgaagaagtatccacagtaccgatattcaccgttcttccgccgcttgtctgtcctgtcaccatgaaatagcacagcccttcgacagcgttcactctgacagccgttttctctgtagttataagaaatttgaatctgccgttctcccgtctgaaataaaccgtgtacctttcgcagtcctcacgcttttcaaaacgcagaataacagcgccgttctcgtctttggttatgcggattttatccatattaacacctcgctataggctatatagtttattttatcatatttaaaaggaaatttcaagattctttgcgttgccgcttgacattcacggctcaggagtgtataatatctaaggatttgaaaatgaatttcattttcaatttaacattcgtaattactgcggagggataaatatgtcatacaatacccgtcagcgtgagctgatacttgattatattaaaaagaacgcaaaaaagcatcttaccgcagacgatatagccgatgcgctgaaagcggagcaggtcggcaaaaccaccgtataccgttatcttgaaaagctatgcgaacagaatatcgtcaggaaattcattctcagcgagggaaaaagcgcctgctatcaatataacgatgaacagcaatgtcacgatcactttcatatgaaatgtcttaaatgcggaaagctgtttcatcttgaatgcgaccacctgaaagatattgcggcgcatatttcgaaaatgcacgattttacaatagacagctcacgcaccgttttctacggtatttgcggagaatgtgccaaaaagaccccgacaacaaaagaaaagagtgatatataatgaagttaaaaagaaaactgcttgccgtgattactgcggcagcaacggttttcagcctgtgcgcctgctcgtcagaaagcggttattcaaacagcgacagcggcaagctgaaaatcatctcgaccgtatttccgccgtatgaccttgcaaggcagatagccggcgacaatgccgaaatcagcattcttctccctccgggaagcgagattcataattatgagccgtccgccaaggatatgattgcaatacgcaactgcgacatatttctctacatcggcggcgaaaacgaacagtgggctgaaaagctgataaattcaaacgatacggaaaatgtcacagcagtaaagctgattgattatgttcctaccctttcggaagacgaagacgagcatgaccacgaccacgaccacgaccacgaccatgaccacgagcatgaacacgaaaccgatgagcatatatggacatcgcccaaaaacgctcagcttatgctttcggcggtatatgacgcaatctgcaaggttgacccgtcgaacaaacagacctacacaaaaaacaaggacgcttacgcaaaacagctttccgaccttgataatgcttacaggtcggcagttgacaacgcaaagaacaagacgatagttttagctgacaaattcccgttcaggtatcttgcgcacgaatacggtcttgaattcagttccgcatttgccgcctgctccgatgaatccgagcctggcgtttctacgatgataaagctgacaaaaacgataaaggaaaacaacattcccgcagtttactatcttgaattcagcagtaccaaaatagcggatactctgtgcgatgaaacaggagcaacaaagctgatgcttcactcctgccacaacgtttcaaagcaggatattgaaaacaacataagctatgttgatcttatgaaacagaatctcgaaaatcttaaattgacccttaacggctgacaggaggattaataatgtcatatcttatagaatgtaaaaatcttaccgcaggctacgagggaatgcctgttgtaaagaatctcagcttcaatgtttccgcaggcgactatctgtgcatagtcggcgagaacggaagcggaaaatccacccttatgaaaaccattctcggactgcgctccgctttatcgggagagataatcttcggtgacggtcttaaacagaccgagataggctatcttccccagcagaccgccgcacagaaggacttccccgctaccgtgcgtgaggttgtgctttcgggctgtcttggcagaaaagggttttcccccttttattcaaaagccgacaagaagctctgcgatgataacatagagcttctcggcataaccggcattgcccaccgcagctaccgcaatctgtcgggcggtcagcaacagcgtgtactgcttgcccgtgcgctttgtgcgacaggaaaacttcttctcctcgatgaacccgtttccggacttgaccctatggttactgccgaaatgtatgagataataagcaggctgaatcgtgagcagagcataacgattataatgatctcccacgatctgcagggcgcactgaaatacggtacaaagatactccatatggagagcggcgcatacttcttcggaactaccgccgagtaccgcagtaccgatatattccacgcaatgagtacctgtgactgtcattgcacctgcgaccatcacacaggctcaaaggaggctcgttaaaatgcttgagatttttcaatacggatttcttctgcgtgcgcttgtagtcggacttcttgtttcgctgtgcgccgcacttcttggtgtaagccttgtattaaaacgtttttctatgataggcgacggattatcccacgtcggcttcggtgcgctcgcaatagcctccgcactgaatttagcgcctttgcaggtatctatcccagttgtgatcgtagctgcatttattctgctcagaataagctctgacggcaagataaaaggagatgccgcaatagcacttctttcgagcagtgcgcttgcgataggtgcaatagtcatatcgcagactaacagtgcaacggatatgaacagctatatgttcggcagtattatggctataagcaacgacgatcttgtgctcagcataatctgctcggttattgtcatcgtaatgttcgtcttattctacaacaagattttcgctgtgacctttgacgagaatttttccaaggcgacaggcgtaaagtcgggtgtatacaacacgataattgcgctcctcactgctcttactattgtagtgggaatgagaattatgggtgcgctccttatttcaagccttataatattccctgcactgacctcaatgagagtattcaggagcttccgcagtgtaacgatctgctctgcggttgtttcctgcgtcagctacattatcggtatagcgataacctactatgccgacaatttccctgcaggcgcaagcgtagtagttgcaaacctcggaatgttcctcatcttctcgcttctcggcttcctcctccgcaaaaagacccaatagtgcgagcgaatgtaaggcgcacaaatctgttcttaataaacgcttacaaaaaagccgcccacacggacggcttttttgtaataccctgtgacatttacggaaaaatatcgtcttaatatataaagagagaaaaaggagagtgaatatgaatatatccgacaagaatatcaccaccctgcttgaaagccgcaatgaacaggcactaaaactcctgtccgaaaaatacggcggactgtgttcatcaatttcatacaatgtcctcggcaacagaagcgacagcgaagaagtcacaaacgatacatatatgaaagtatggaacacaataccgcccgaaaagccacgcagtctttgtgcttatgtggctaaaatcgttcgcaatctttcccttgacaagctaagatacaacaaccgttcaaaacgatgcggtgaaaccgatgcactgctgtcagaacttgaagaatgtattccggcaacggacaacacagaaaaatcggcagaaaacaatgagcttaaatccgttctcaacacatttttagcttagcttgacgagcgtacacgcaaaattttcgtcttacgttattttgcctgctacagtatagccgatatttcagaaagattagcaattaccgaaaccaatacaacatctattttaaaccgcacacgaaccaaactccgaaaatatctttcggataaagatgtatacattcagaaaggagaataatcatgaacgagcataaagcattcccgctttttactgcattcagcgacataaatgaaaaatatatttccgacgcacttgacgaaacgcagcacaaaagcaagtggtatctgaattccgcttttcttggcatttcagccgcctgcttctgtcttgtcgcagtatgtaccgcaattataataggaatcaataacaacgcaataaatcctgcaggctcgtcagatatatcatcagatatatcctacacagcgttttcggacgaacgttatgataccgtaatttacaacgacactgtatacaaacgtataaattacatttcacccgatgatgaaatgcgcagaggatatataggtacggcagaagtcaccgacgctgacggcaaaacagaaaatcattatgttttttcactgaaaggaatcagaccgcacatagccatagccgtaagaatggactataacacctactgccgttatattacagcttccactgtgaatgaaacgcttctctcacttatttgcaacaatgatacatcggatttggatgatccctattcggtaaattactttgcctcgtctttttccgaacacagcgaaaagcgcttcacgagcgattcggtcggctggatgaatcaaatattatggttgacttttagcgagtccccatcttcatcaaaagcagaccgggaagacttaatcgaaagcacagataattatatatcggttgatttatcatgtatcccactcggaattgaaaatgcaaaaataaatataaaagcaaacggcactgttaccgttgtatgcaacggtaccgagtttacaatggaaaatcgtctctctgaatacaaaatgacacgtttattgcatcttttggataatgaacgtatcgactgcaacgaatatatatataacgataccgattcctaagaagcatcgctttccgagtattaattattgtctttcaggctgtacgataagtgtaggataatacagcgggtcatttttcgttttaacaattatccgcaccgataaacaacagccgcccacaagggcggctgttcaatttatctgtcaacataatacctgtacgaattaatcgtaacgacctgcggcttcatttccgacagcctatccgctctctttccaacaagctgaaatccgtttttctcgataactctgttgcttgcaatattttcttcaactgcttcgataacaaatgttctgtatccgtcctccgcaagctctttcataacaacacccagcgcctcggtcatatatccgttgccccagtatctgcggcaggagcaatatcctatcacgggattttcgtgatgataaccgactacatctatcattcctataagctcaccgtcagccttattttcaatgccgtaacggtaacaattgtcattatcatattccgccagccacatatcaagaatcgccttagtttcgtttatatccttatgcgcactccatgtgacatattttgcaacctcgctgtcactcgcccaatttctgaaaatactctctgcgtcatcttttcgcagttttctgagaaacagcctttttgtttcaatctctctcatattatcctcctttgcattgttgcagttgctgcaataaaatccggtaatttatttccgattaacaaaatcccacaaccgccttaaaacgtttgtgggatttgattgtaattcacttatcaagcaggaacataacctttttaagctgtgctgtcattgccgaataataaagcggaaacatagcctcaacacagccgaggaaataaaggttacggttatttatctcaccgaacttcggcatatatgtgtaaacataacgtctgaaccactccgatgaatatgacggcaaaggatttttctgctttctgactttaaaattgccctcatagctttcatagataatctctccaaaattatccgcaccgttctttatcatcagctcatacacctgtttaagctgtttatccgacagcggaaaatcttctgtcggacgtgcgataaacggcagccttaccgcaaggctgtacataataagatgctgtaccctgccgaactcagccgtttcgaacattgcctcgttttcgggtgtttttatccttattccgagattttcaagccgtgatgtttcggtaacgtccatcagtgcgatacgaaagacatcttttatattgatattgtaaaaatcactgtcggacacagtatagatatactgcattaccgtagtcattgaccttgccgtattagtgataattcccgctattatcggcagtgactcatttgaaatgctcatttatcctcctcgggattattactcggaatattgatagtcttactgttgcctctaagaatttcttcaaaggaatcactcggcataggttttgcaaagtagaaaccttgtgccatctcacagccaagaccgccgagcagctttgcctgatcatcggtttcaataccctcgcatattgtatgcataccaagtgagcctgccattctgataacataacccagtatatcgttggctctcttgttgctgtttgattccgcaaggaacgccctgtctatcttcagcacatcagcaggaagatctttcagcatattgagcgaagaatatcccgagccgaaatcatcgattgaaatatggaatccgtaatccttgagttgcttgaacacagccgtaagcacatcgagcgacccataagccgcactctctgtgatctcaatctcaatgcttgacgttgaaacgccatgagataaacatatatcgttcagcttttcgacaaactgcggatctctcagatgtgctcttgacatattgaccgatataagcagatgcggataatagctctcccactgcttgatcttctggcatacctgatccataatgtaataatccagcttgataataaatctgttcttttcaaagagcggtatgaattttccgggagaaatgaccgtgccgtcctttatccaccttacaagagcctccgcacccgtaagattaaccttgccgtcaagagaaaccttaggctgatagaaaacgcagaattcatgcatatcaagcgctgtctgcatctcgttttcaatgcgcttttcctcacgcatcttttcaagcatactctcgctgtagaacgtatatgcactgtcatcgccgtactttacggtacgctttgctatatccgcaaggtcgcccatacgtcttatggacacgctcttgtcggttatcctgtaaataccgaatgaaagcacaggcacaaactcggttatttcgtattcgatagcctgtatcagactgcctatacgtcttgcagtatcactgtcactgctataaagcataagtatataataattgtccgaatttattctggagaaggtctcgccgtcctgaagatttctgtttaccgtatcggcaatcagcttaagcaccctgttgccctcatcgtgaccgtacatatcgttgatagccttgaacttgtcaatatcgaagctgacaagcgcatatctgcggtattcgtgcctcagcagactttttgcgtcaagcacaaacttatcccatgtaccgtaaccggttatgctatcagtataggctatcctgctgacctcctcgttggccttggcgagccttcggaacgatactctgactatcactatatatgctgtaattacaataatcagtatcagcacaaagaatgcgtacatcaatatgtttatcattgcgtaatgattctgctctgccgctacaacattctctttgaatatcagcagatagtgcagatcatcaaagcccgacataccgctgtaatacgctacatacttttcgcccttgcagacgctttttacaataccgcttcctccgacctttgcaaagttatccttgacggcatttcttacgctttcttccacccctgcaagaatatcggacgagaagaacaaatctcccataggaacatagtcaccgagcgcattttcaccggacattatcacttcaccgtcagaattaagcacatatccgttgctgtcgttttctttaccgccgaatgacatatcaatcagattgttataactccttgtgtcgcatattcccgcaaccatgcccacaatacgcttgtaatcgccatagatcggtgcagcaattgcatttaccattttttcgtcaggctcgctgtatatcgcctttgaaatatacacctcgccgttcatagcccgtttataatattcacgggcggatatgttcttgcttatgtttttgcttgttataacatcgccgttctcatcggcgattataaatgcgtctatcgttgaacagctgttctcaaggtcctttatcatcttgataacaagattctcatcggtattcttataattacttgcgcaggcggcaaaattctttaccgtattgacatcgttccttattgcgctttccactatgtcacatttctgagaagccgctctgtctatataattgttgacctctccgtcaagtgcagatatggtatttgccataaacaaagacgccattaccacgaagatcgctatgcataaagccgctatcactgaaattatctctgttctgtgctttatattcaacatagtaatctccctcctttatatccgcagactttttgttttctgacctccggatatacttatttaaataaaagtataccacatttcgtttctgaaatcaaccgtttaaatcaatttatattatgtttgttataaagcctatccctgtcccttaggttttctccctcttggctccctctttccttacccatacccttaccccgctggggtgttggatgaactagtaaaactacccgaacattgtatatcctgttaatgcagggacgcttaacgctacacgtccgcaggttagtacatatatcttaggttagtagcgtttttttgaaaggttaatgtcagtgcagttgcactgatacactcacgaaattattaattccctgtgggtactgaaaatgttttctgcggtgttggcgatatatttcactgcgtgagcattgataataatcagtttatcaacagcctgtgcgtttgtgcttttaaaacgtgttattatgcttatctgtaggtcgtgaattcctgtacccagtaatacttataagcatcgttatatgtgccgaatgctacggcgagattttcaaaatcgggattgagtatattttcacggtgacccttggtagaagccatccagctgtcgactactctctgtgcggtgggctggcccgagccgagattttctccgacggagcagaacttataccataactcatcatcactgtagccgtatatggtcttgaagtttgaaccgtccggccgcagatggctgaactgctgttcaatttcagtgcaacgtgcctttgccgccttgtatgcgtttgtatcccatttataaggcttaaggccgtaggaaacacggatctcatttacgatacggaaaacctctgcctcctctgcggtgcagtttacggggctgtcggttatagccgatgtgggtgttgtgttgtcctgcacggcgggttttgccgctttgggaacggtagttgcgacaggcttgctttcggaaagatagtcgctgtggatatatgtgccgtcatcgagcttatagtagccggtgtctgtcagtgcggcgatatttaccgcatctccgtaatatttataggaaacgacctcagagccttgtaagccctcttttcttgcacaacagcttgaaatgtttatgtaccttgtgccgctgcacttcttttctgtccatgcgggctttggtgcggcggttgtcgcaggtgttgtagctttggttgtcgccgctgtggtctgagtggtctttgctgttgtggttgccgatgtagccttggctgctgtggttgccgatgtagttaccgatgttgctgccgatgttgctgccgatgttgcagcggtggtttcctgtgtctcgttatgcttgatggctttggtgggaaccttttgttcctcgacaggcgaagcggcggaatatgatgactctgaaccgttgctgtagctgataccctcgtcatcggctttgactccgaaccatgagtaacggcttgaaagaacgcaaagagcgactacgacaacaaaaccgcatgacgcacagccgattttcagaaaattgccgtgtgacttctttttcctgtcgtatgtctgaatcccgctttccgggttttcggttttgttttcttcgttcatgttcatgggtatcacctgccttttgcctgaacttaacggtaagcataatttaacacctatattctatcacaaatgcgtttagcgtgtcaacagatactgaaattgccagaaaatatttgtaaggattgcacaaattaacgtgtggcgtttatgtaaaatcacaataaaataagtctgttaaaaatgcactattataaaagcgaaagtagatttatttttgtacaaaaggtcgaaaaggttacaaaacggtaacaaaatggttacaaattgttgcgggtttgtaatcttttatgttataatggcggtgacggaaaagatttgctgtctttcatgacggaaggaaaagcaaccttaaaggtgtggagcgggcgttatgcccgttcctgcttttaacggaaaaagcgttgatttatcacctgtcgttcacaacggcgggttattatataaatatattgattgtttggggcgtatgcccgtttgatttggcttatacggaaaaggattgataatgggaaaactgatgatacccgattatcgtgacgatattgaggaaactatacttcctgacagcgacagtgaaaaggaagcgcaggaggctgatgtaaagcctgcggttgccgatacgtcggagaatcggaatgaagaaaacaacgaagaaaaagacaaaggcaaaaacggtatatcggctgttgctgacagaatctttgattttctggttatggcagggcagtatttctgccatatcatagccgatgtattttcaaagcctgctgtatatgtggcttatgccgccgtgtttatatggaagcatacggcgctgttcagggacgcagtaaagaggacgttctgcgaaataggcagcttcttctttgcacctttgttaaagtcaaagcgtgtgcttcagcgcacaaacaggcagataaggactgcaaaggagcagggcgacaacaagaaggcggcaaagctgtacggaagtatagcgaaggacgcagtattcggcaagcagggtcttgcggtaacgctgttcaactatgccgcaccgatcatcgcaatagtatttcttatgagcgttgtcggatatgcgacgggtacagactatgcgataaagctgacggttgacggaaagtttgtaggatatgtcgaaagcgagcaggtgttcaatgacgcagagcgtataatgcaggagcgtatcacatatatcggcaacgagaagaagataagcatggagccggaatattcgctcgaaatgctcggcgaccaggaatatctgacgaaatatcagcttgcaaacaagctgcttgagctgagcgatactcctatcgagtatgcatacggaatgtacataggcgggaagttctatggcgcacttgttgacaacaccgcagttgaggctgagcttgagaagatacttgacggctaccgcacaaatgcaaaggacgaggacgttgcctttgagaaggatatagagtatgttcccggtctttatctgtcagacagtattgtgtcgagtgatgagatcatcaagctgataaattccaaaaaggaagaagcgtcctattacactgtggttgacggcgacagccattcgggaatatgctcaaagctcggaataagcatggaggagcttgaggcattgaatcccggcattatggatgaggactatgtgctgagagccggcgaaaagctccttaaaacgcaggaggtgcctttcctgtcggtaagtatttcaagaacggaaacatacaacgttgaagttccgtatgaaacgaaatatgaggacgacgatacacgctatgagggtgttgaaacggtttaccaggagggcgagaccggtacgaacaaaatcacggcaaaggtgtattatgtaaacggcgaagaggtcaagcgtaccataaagaaaaccgaaagagtgaaagagcctgtaacggagattatccttcagggcacactgcctccgcagtcatcacattattcaaacgcttctgccgatacgggcaagaagtatatatggcctgttgacggcggcacattctgggagtggggctggtgggacggcggttatgccggacacagaggcgttgatataggcgcaccttacggtacggatgtatatgccggagcaagcggtactgtaatatttgcaggctgggacaacggcggactcggtaatgccgtgatgatacttcatcccgacggatacacaacggtatatgcccacaacagtgagatattcgtcagtgcgggtcaggaggtaaatcagggcgactgcatagccgcagtaggcgaaaccggccttgcgtacggctgtcactgccacttcgaagtaagatacggttcggaaagactgaacccgagatattatctcagcggtctgccggatcccggatattattaatatgaaatttaacggataacaggaaacaaccgctgtgctgaggcatggcggttgtttgactatcggaatgcaccttgacaatttatcgaaagtgtgatagaatacaaataaagagggaacgacagacgaccgctcccgtgttggctaagaaataaccgtcgtagttggaagctgtgggcggttatttctttttattcgaagaactgatagtaaatatcataactgtgaacgcagtaaggaaaatacctatctgtgttaaatcgctcaaggttatgtacatcagctacaccccctttcagatgttttcgcatcttgggagatgtattgaccgcctgtcgtccgaggaaccctcttcgctattatatcatatatttcatctgaaatcaaccgctgtgctgaggcatggcggttgtgttttattgcaaaacggtcataaattttcttctcgtttcatagatttactgtagagtacccgaaaggaaaggacgtgcagtatgaacgaaattatgacaagggaagaatttttaaaggaacgaaatgcggtgtgcgagtctgacgctgtggcgggcggggacgatgtttgcaagggacaggatgcggatacggcggttatgacggaggaaaacgggaagctgagtgccgacggtataaccgtatcggaagtagtggttaaaggcaggcgcaacaggcagtatgcagggctgatactctttataacggcggttgccggggctgttgtcggggcggtgttttacgggaaggcaacggtgaccgtgcctgatgagatgttggagggctttctcgaaggaaggatacacggcggatttttcgggaatgccgccgcttcgttcatatcggcgctgatatggtgcattgtaccgtttttagcagggctttgcgcagtgggacagcctgtgggtgcgcttataccggcattcaagggtataggtgtgggaatgacgtttgcggcgcttgtgaatacatacggggcaaacgggataccggcttttgcggtgtttgttcttccgtccgcatttataggaacggtaatctgctgttatcagtgccgcctgtccgtgttatgctcaaacagtgtgctggctgtgcttaaaggcaggcgtgacgaggctccgcactattataagatatatcttgagcggtttgcggtatgctgtatcgggtgctttctgctggggatagcggacgctgttataacttttttgttccgcccgatattcgttatatgaaacacttgaaattttcgtttcacgggtgtataatgttaacagtaaaaattgcctttggcatgaaagaaggataacattatggaaaaaatggaagtattactggaaacctccgcacgtcacatccacgttacgcaggaggcactcgaaacactgttcggcaagggtcacgagcttacaaagaagaaggatctttctcagcccggtcagttcgcttgcgaggaaagagttactataacaggccccaagagatcgcttgcaaacgtatctattttaggccctgttcgtcctgctacacaggttgaactttcggctacggacgcacgttctatcggatgtcctatattcgtaagagaatcgggcgatattgcaggcacacccggttgcaagataacaggtcctgagggcgagatcgaaatcagcgagggcgttatcgttgctaagcgtcatatccaccttgttcccgaaaccgctgaaaagtggggcgtgaagaacaaggacgttgtaagcgtaaaggttgattctgacggaagaaaggcaattctcggagatgttgttatcagagtaagcgagaattttgcagacgctatgcacattgatacagacgaatcaaacgctgtaatggccgctcccggcatgatggtcgaagttatcaagtaatacggcgttacatatgacggttttatctccgtggctttgggctgcggagatttttttgtgaattaatgatagcgtaaaaaagggaaaaatgttttctatagaagggtctgctgtaacggaaggagtttacacaatagctgaaaatcagaacaaagaatcagtaaaggaagtagcctctgcaagctgtgagaaacgtaaaaagtaaatattacgggaaaagtcaggtgtaacgcttggctttttcttttgtttgtggtaaaatataagtggtaagtctaaactaacttatattgaggtgacgcaattggagatatttctgatactgatgataccgcttatgggaacaacgctcgggtcgcttatggtgttccttatgcgtgacaaggtgagggcccagacggagaagctgctgcttggttttgcatcgggagtaatgatagcggcttcggtatggtcgcttctgataccgtcaatggaactgtccgaacggggctacgggaaaatgaactgggtgcctgctgtggtcggctttgcggcggggatactgtttctgcttggaatagacagctttgtgccgcatctgcatcttgacagcgataagcctgagggcatgcgctcggggctttcgaaaactactatgatgctgcttgcggtgaccatccataacgtgccggagggaatggctgtcggtgcggctgtagccgggtcaaccggcacgaacggtgacagcgttactcttgcaagcacatttgcactggcgctgggtatcgcaatacagaacttccccgaaggagcggtggtttcaatgccgcttaaaagcgagggaatgaaaaagggaaaagcgtttgtgatgggagtgctgtcgggcgttgtcgagccgataggtgcggcggtgatgatactgctcgcttcattcatcgctccgcttttgccgtatatgctgtcgtttgcggcaggggctatgatgtatgttgtgatagaagagcttatacctgaggcgcagggcggagagcatagcaacataggaacgataggtgcggcggcagggtttgttgttatgatggtgcttgattgtacgttggggtgagaaaatgttttttgtttaatgtgcttcgattatatcgttcagctttgaccatgatagcaagctaccgatagttctttttgtcggacaacacttctcgggttcgctattcgagtgaatgcacctgtcaatatgaaagagggagacaaccaaagggatcaggaaaacaacttctaagcaactacaatccccaccgtcacggctcggaaatattagtaatttataaaagctggatttctaactaatatactgataaatgcagaacttgttgtgccagccgtgccacctcccctttttcgaggggaggcaagtgtgatagtactttggcaataaatggttgcacttctaaataatgtataagcagggacgcttaacgctacacgtccgcaggttagtacatatatctcagattagtggcgttttttgaagagtcaatgttagagcagttgcattgataaggtcacgaaattattaacgccttgtcggtacggaaagtgtttcaggtggtgttggtgatatatttcactgtgtggcttcattaataatcagtttgtcgatagcctgaatgcccgtccgttgagggcgggcattggttataaacctcttattttcttcctataatcttcaggtaaattcccgaggttattttataggcgaaaatgtagaacagggcaaatacggcaaagcatatcacgtttgcaataagaagaagtgtgctgtcggcaaagccgaacattttaacagctttaagtattatcggaaaagcgaatgcaaggtgtatgcccgcaaagataagaggagcaaagaacacggtcagcacctgcgagtttatgctcttctttatttccttttccgtcattccgacacttctcatcgttgcaaagcgttctctgtcctcgtagccttccgaaacctgcttatagtagattataagcactgtggcaaagacaaagacaagtcctaagaatattccgagaaagagaagtccgccgtaggttgctatcatcacatcaaggttttcggttctgctttcggcaatggggaagatattctccatattccgtgagctttttgccagaatatccgtgaggctgtcgcacagggcttgcttgtcggcgttgcttccgtcaatgtcaaagccgaaataatgctttaaccacgatgcgttttcgccgtaagccttacggttcagcaggaatatatcgtaaagggtgttattatcggggagaataacgaaaaatacgctgtaaaccgtttcgccgtaggaaatatttttcggcataggaactgcccttgacttatatttcttgccgtttaatattatttcgccgtcggtgctgtcggagcttgccgtcagtatttcgccctcggagagcgtttcgttcctgccgctcgttttgttatagtcttcaagcgtgatgaagaaaaaatcctttatttcagattggcttacatctgcggaatctgtcgcaggggctaagtggacggtattatcggaaaaataaccgccgacttcaagataatcatacgaaagagtgtttacggggttatgatcattgcttttcgccgtgtcaagcgctgtgccacacaagtcggaaatattgcgtatcgtcttatcttcaaagctgttgtaagtgagcgttaccgagatgtcacggctgcggataaacgtgcttgtctgtatccctgaaaaaagacttatcgtggacgaaagcattacaagcaccatagttgacagtatgcagacagaagccagtcctgcaccgtttcttttcatacggtatgtcatgccggaaacggatacaaagtgattcgctttgtagtaatatcttttgtttttcataagaagccggcaaagtgcgacagagccgctgacaaagagcatataagtgccgattattacaagaagcaccgcaaggaagaaatttccgacaatttcaatgcccgcctgtgtcgtgacggcaatataataagcgatagcaagcagtatcaagccgactaaggcaaatacgaaatttgcccgtggcggtttttcgccctgcttttcgctttgaagcagattaattgcgcttagtctgcctatgcggacaaaggcactcagcagaagaattatcgttatggctgtgaatactgcggcggtaatggctattgcgcctgcatcgacagacagattgccgacagggtcaatgccgagaagtctgaacatacacagctcagcgaggcgtgacaggagtatccctgcggcaagtccgcaaagaagcgatataataagcgtgaaaaggctttcgcaaaggagtatgcgtgctatgttgcgtttgttcattccgagaatattgtataagccgaactctttgccacggtttttgataagcacaaagtagctgtagaaaagaaaaatcaaggagaaaatgccgattacgattattccgagccaaagacaccactgtgcgtaaacgcctctgtttgtgtttgcgatgttttcgctccttgcaaggtatgccgtgatgtacatcatcatcaccattgcaactaaggtgaggatatacggcagataaagccgtttgtttttcttcatgccgttcacggcgagcttcgggtagaacagtgttttcatctgcggtcaccgcctgccacaagcaccgtcagcgtatcgtttatctttgcatagaattcttccgttgcggaaatgcctttatatatctggtggtaaacctcgccgtcctttatgaagagcacccgtgaggcactgcttgccgcctttaccgaatgtgttaccataaggatagtctgaccgtcacggtttatttcaccgaacaggttgagaagctcctccgacgcttttgaatcgagtgcgcctgtaggctcgtccgcaagcagaatatcggggtttgttataagcgcacgggcgacagcggtacgttgcttctgaccgcccgatatttcataagggtatctgtcgagcaggtcgcttatgccgagctttgcggcaagagggagaagccttgagttcatctcatcgtagcttttgcccataagcacgagcggcagaaaaatattgtcacgcacggagaatgtatcgagcaggttgaagtcctgaaacacaaatccgagatgctcacgtctgaaaagtgcagagtcgctgtcctttatctttgttatgtcaactcccgagagcattacaacacctgcggtcgccttgtcaagcgttgcgaggatgttgagcagggtagtcttgcctgagccgctttcgcccataatagcgatatattcgccctttgcggcagagaagctgacgtttcgcagtgcgacattcggctttgcaccgagccgctgtgtgtagacctttttaagtcccgttacttcaagtaaattcatattgtacctcctttaagctatgacaatattatagctgaaataacggaagtgtgccatttatccgtcttacgataagagcgtccgtcttacatttttgtaatattgcgattactcgtgccttattttgctttctgtaaggtcaagcataaagacagagccttttccaagctcggacacggcggtaagagtaatgccgagcatatcggcaatacagcggcaaagatacagtcctataccgcttgccttcatatcatatctgccgttaagtcctgtgtatccgttgtcgaaaattctcggcaggtcggcagggtctatgccaattcccgtgtcggcaatgcagagaatctttctgtcggtgtcgggcttcatataaattgataccgagcctttagcggtgtattttatcgcatttgagagcagttgttcaataataaaggacagccatttttcatcggtgagaacatcggtgtcaagctccttgtaatcaaggctcagcttcttcccgataaactgcgtggagaatttacgaaccgatttttttactatatcgtcaaggctgtaatgctttatcacaaggtcattgccggagctttcaagccggacatagcacagcgccatatcgacatactgctcaatcttcataagttcgtctgacaacctgcggttgctttcgctgtcttctgactggagcataagccgcattgcggagataggcgtttttatctgatgtacccacatagtgtaatattcgtttgtcgcctgcaggctgtttgcggatttttccttaagggaaatgcagtaatcgctgagtgtccgtatcagcctgtcgtaatccttgtcatctgccgataccgctttcggaagattgtcggcacttacggttatctcgtttgcaagacgggtgaggatattatgctttttgtacgcctttataaaagttaccgcaccgatagccgtaacagcggcaagcgacagcaaaagcgcatacagcacaggctctgaggggaggttataaagcgacagcaccacagcgaaaattacagctgcaataataatgcagacaagcgttattatgcggctcctgataaagtcaagaaagaatttcatactatcatataccccattccgaccttggttgcgatgtagttttcaagtcctatgttttcgagctttttgcgaagcctgctgacatttaccgtaagggtgttctcgtcaacaaagcaatcggtttcccataatctctgcataagcgtatcacgggaaattatcctgcctgcgttttccataagagtgcggagtatgcgaagctcgttctttgtaagctctgcctttttatcgccgtttgtcacgaccgccgatgaaatatcaagtataacactgccgtgggatataaggtcgctgttgcccgaaaaggagtaggcacggcgaagcactgcgtttatctttgcggtcagcaccgaaagatcgaacggctttgctataaaatcatctccgcccatattcatagccataactacattcatattatcggaggcagaggagagaaagatgacaggcacttttgacagctttcttatctcgccgcaccagtagtagccgtcatagaacggtagctttatatcaagcagtacaagctgagggtcgaaagcggcaaactccgcagtgatattgtgaaaatcctttgcacactctactttataatcccagccctcgaggtgctttttcagcgtttgcgctatcgtggggtcgtcttcaatgatgaaaattctgtacatagtcaaatttctgccattcttataataagttcgttgaattgcttggaaaacacgggaggaatgttatgggcggctttgtcccatatctcgtatctgcaatttttattcatagcggcaagtccttttacgctgtcgtgtacttctgtctgttccttactgcctgcaagggcaatcatcgggaagtatgcgttttcaaagccgtttattgtttcaagcgttattccgttgtcaacggagcttcttacggtttcgatacgcacgttctgcatctgtgcgacaaattcttttctttgctctttgggcagtccgttcataaatccgatgaaaccgcataatcgtttgttcttgaatgatgcaaactgcttttcgttcatagccatgacctttgagagcataggctctttcttgataagccacggacttactattatcgcagaagtaaaatactgcggatattccgcacacagcttaacgctaagctgagcgccgagcgaaaagccgacaagcgttacctttttgccgatgtcggctatgaaatccgcaagctgttttactgctgtttcggtatcgaaaatctcatctgcggcatctccgtagcctatgatatgcggaagaagtattattgcggatattctcgaaaagctgggcgactttgacagtatatccgctcctatctgcggatgctgtttcatcagcgcccattcttcatcgtcaagtctgcccggcttcagcaatatggaatcgggtattccgatttttcctatatcgtgcaggtgagcggctatatgtatttcctgtatttcgtcatccgcaagtcccagcatttttgcaaggaccgtagccgtatcgctgaccctcctcgaatgatctcccgtatacggatctctcgcatcaagcgcagacgatatacactccacaaactcgtggtataatttattgtcctgtgtaattatactgttggcgtcgataattttcggttgttcctgctccactctgacattcctcttttctttcccgtaaccgccgaccgccgtatgtaagttagtttaagacaaccgtgatataaaactaaatcgttacacattttctgcggcaacgtgcttttcttttatatgctttttcagcttgtcaaatgattcggagcttatatcgtgttccagcttgcacgcatcctctgcagccgttttttcgtctacgcctataccgataagccagtcggtaagcactctgtgacgttcatatatacgctgtgctatcgcctcgccgggttctgtaagcgttatatagccgtccctgtccacctcgataaaaccgccgcttctgagtatactcatagcacggcttacactcggctttgaaagctccatttcgtgtactatatcaatagaacgtacatctacccctctttctctgagaacaaggatagtttcaagatagttctcacccgattcgtgaatacctggcattaatgtaccgcctttcagtttggttaattctgtcggttagtcaccgcttattcgttgttattatagcattaaattaagtggctgtcaagccacagtggcggtacgccaccgttttgcacagcgaaactatttaatgctaaaacgttctcagctattgcgtagcaagccgcatattatgcggcgaaatcgttgcaaaacgatttcaggttgaggttgttataacattaaattaagtggctgtcaagccacagtggcggtacgccactgtttggcacagcaaaactatttaatgctaaaacgttctcagccattgcgtagcaagccgcatttctatgcggcgaaatcgtcttttgacgatttcaggctgaggttgttataacacgattttaatgtgccgtcaaggcacagcggcaatttgccgcaagttttgcctttggcaaaacaaaatcgtgtttcaacgttctcggacaggtgagtatgcacctccgcatttttatgcggtaaatcatcgtcagatgatttcagtctgaggttgttattgcgtaagcaaaaacgttctcagccattgcgtagcaagccgcatttctatgcggcgaaatcgtcttttgacgatttcaggctgaggttgttatagcattaaattaagtggctgtcaagccacagcggcggtacgccactgttttgcacagcgaaacaaaaccgcactgacaaaagccgatgcggtaagcgtaactatgctattatcagaccttagcgataacctcgacttcggcaagaacacccttaggcagtgcctttactgcaacgcaagaacgggcaggctttgatgtgaaatactgaccgtatacctcgttaaactttgcaaagtcgcccatatcggctaagaagcaggtcgtcttgataacattttcaaagctcgttcctgcctgctttaaaacttcgcctaaatttctgcatatctgatgtgtctgaccctcgatgtcctttgcctcaacctcagatgtttcgggattgattgcgatctgacccgatgtgtaaagcacacctgcgtgaactattgcctgtgaataaggaccgattgcagcaggcgccttgtctgtatgaatcttttccattgtcattgccttcctttaatttattactcgatgctgtatccagcatcggtaagtgcttttcttatctgagcgatatgctcatagtttcttgtttcaagctcaacacgcagataacagccgttgacatcctcgccctcgtttgcacgctcgtggtgaacggatataacgttaccgccgagatctgcgattatctgcgatacgcccttgagctgaccgggcttgtcgataagtgcaatattaagctggcaggtacgtcctgactttataagacctctcttgattactcttgaaagaatcgttacatcaatattaccgcctgatacaaggcatacgaccttcttgccctttacgggaaccttgttgaacataacagccgcaacgggaactgcgcctgcaccctcggctatcagcttgtgcttttcaataagcgtaagtatagcggtcgaaatttcatcatccgtaacagttacaatatcatctacatactttctgcaaagctcgaatgtatttgagccgggctcctttactgcgataccgtctgctatagtggaaacgtggtcaaggcactctatcttgccgtccttgacagatgtctgcatactgggtgcgcctgccgcctgaacaccgtatacctttatatcgggctttaatgacttcatcgtgaaagcaacgcccgaaataagtccgccgccgccgataggcactacaacagcgtctatatcgtcaagctgttcaagcagttcaagacctatcgttccctgtcctgcgattacatcttcatcgttgaacgggtgaataaatgtatagccgtgttcgtcacgaagctgtaaagccttgttgtatgcatcatcatatacgccctcaacaagacatatctccgcaccgtagcttcttgtagcctcgacctttgaaatcggagcgccgtccggcagacatattatcgacttgataccgcttctctgcgccgcaagagcaacgccctgagcgtgatttcccgcactgcaggcgataacgccgtgcttcttttcctcatctgtaagggtagaaatcttgtagtatgcgcctcttaccttgaacgagcctgtcacctgtaaattttccgtcttgagataaacatccgcatcgggatttatctggggagcgtgaataaggtcggtaggtcttattacctctttcagtttaaaagccgcatgataaaccttgtctaatgtcaacatctttcttctttcctttcctgtctttgctttataaatgattctgcgatttcaatgatacaaagcacttttcggtagctgataaaataaaaaagccccgccttatgaaacttatcgtttcaagaggcgaaggcttgaagtctccgtgttaccactcttattgcccgtgaataacgagccgctctgtacatatccgtcaatatgctactctgtaacgggagtacccgtacaggcttactgctgtttctgcctgtctgctcagaggtgattatcttttgcggtattacctgccgtttcgcacctccaacggctctctgtgaggcttttcccgccgacttcctcgtcaacgcattcttgttatcgttttagagtatatcactgtttttgcgatttgtcaacactaattttcaaaaaaatcgcttacacgtttacgcaaaataattatcaaacgctttaacgccgatgtcaatctgcttttccgcaaactttgccgcatcattgtcattttcgcttgtatcgtctgtttggccaagaatcataaagcagtaataaccgtctttttcaagcaccttgccggcgtttacctttgcaacatttacaggatactgaatctgctgttccttcataacagtcagtgcgtcctcaagcgcacgcttgacttcggattccttgccctttttagcctttaccgcaaccaacctgtccgggtggaagctgataatgggtgcttcagcaacgatctcatcatacatatcctttgtaagtccgaattcgctctcgatcatttctgcgtccatagcctgatcgggcagatagttgtcgccgtatgcctttgcgatagcgtccctcagaccctttgctgataatgtgctgtttttatcattgctttccgagccgcttatatctcccgacgagcttccggtgctttcctgagccgaagtcgaaagacccggtgcggcagacgatgcattgctctccttgcctgatgcgcaggcggatagaatgacggatacagcggcaaccgccgcaaccgcagatatgatatacctgtactttttcattttcctgttcattgaaaccctccttttacggtttatatccggattatattattgctgtgtgaaatcgacattagacctatgtagaatttatatgaaaatttcggaaaaatctatagacatttccggatgcagatgttataattgaatcatcaaaataaccaattttcgcacagaaaggaatagtaaaatgcacgatattgataaacttatttctgaaatgacacttgaagaaaaagcaggtctttgctcgggtgcggatttctggcacacgaaaaaagttgaccgtcttggaattcccgatgttatggtaagcgacggccctcacggacttcgcaaacaggatattgataccgttgaccctaacgaaagcattaaagccgtatgcttccctgccgcttgtgctactgcctgcagctttgaccgtgagcttatgctgtcgatgggcgaaacgctcggtgaagaatgccgtgcagaagacgtatccgtactgctcggtcctgccgtaaacataaagcgttcgcctctttgcggaagaaacttcgaatatatttcggaagacccttatcttgcaggcgagctttctgcggcatatataaacggcgtgcagagcaagaatgtcggcacatctataaagcactttgccgcaaacagccaggaaactcgccgtatgacatgctcatcggatatgagtgaacgtactctgcgtgaaatctacttccctgcttttgaaactgccgttaaaaaggctcagccttggacggtaatgtgttcatacaatctgataaacggtgaatattcatcggaaaacgacaatctgctgaacaaggttcttcgtgacgaatggggtttcaagggctatgtaatgtccgactggggagcggtaaacgaccgtgtcaaaggtcttgccgcaggacttgatcttgaaatgccttcaagcggcggtcttaatgacgcaaagattgtcgaggcggtaaagaacggcacacttgacgaaaaggtgcttgacaccgcagtaaagcgtatacttgagcaggtttaccgctaccgtgacgtaaagggcggagagcatattttcgaccgcagcgccgaccataagaaagcggctgatattgcaaaggaatgtatggttcttcttaaaaacgacggcgctttacccctgccccacagcaacgccaagatagcgtttatcggtgcttttgcgaaagctcccagaatacagggcggcggcagttcgcacataaatacggggaacatttcaaacgcacttgacagcgccgcaaaatattccgacgtttcctatgccgaaggatatgagcgtgagtcaaacgatacaaaccctgcacttcttgaggaggctgtacagcttgccgcagacagtgatgttgcggtaattttcgcaggacttcccgacagctttgaatcggaaggctatgacagacagcatatgcgtatgcccgactgccagaacgaattgattgacgaaatctgcaaggtgcaggaaaacgtaatagttgtactgcacaacggctctcccgttgaaatgccgtggaacgataaggtaagcgcagttcttgaggtttatctctgcggcgaggctacaggcgaagctactgcggatatacttttcggcaaggcaaacccctgcggaaagctcgcagaaacaataccgatgaaattatccgatactcccagctacctcacattccccggcgaccgccacgcagaatataacgagggtgtattcgtaggctacagatactacgataaaaaggaaatggcagtacgctatcctttcggtcacggcttatcctataccacatttgaatattccgatataaagctctccgacaccgcagtaggcgatgacgatattctcacagtaaatgtggttatcacgaataccggcaactgtgcaggcaaggaaatcgtacagctttatgtagcggataaatcgggctttgctgttcgtccggaaaaggagcttaaagatttcatcaagatcgagcttcagcccggtgaaagaaagacagtcacattcaggctcgacaagagggcgttcagctactataacgaggaacttggcgattggtacgcacctaacggcaagtatgatataatgatagcaagctcatcccgtgatataagacttacggctgaggttacgcacaaaacagcggtaaaactcccgtttgtcgcaactgaaaacacggtattcggcgagtttatggactatgccgagggcaaggctactatcgacctgctcttcagcaaggttgcaaagggtctgctcggcggcgatcactttgagcctgaggctgtacgcagtatgattggcagtatgccgctccgtcagatacgctcattcggcggtatcagcgatgaactgctgcatcaggctgtcgatatgctgaataaggacttcggcggatttaaggcgcagatgtaatataacagaatataataaaccggtgcagtctgtgtgacctgcaccggtttttattataaaggaaaataagaagcatcattcagcgtaaacccgctatacagcacgtcatatattctgccgtcctgtgcggtataatgcgtaaatacaccgttttcgtccaatgagaaaacatagtcatccgaataaatatcacgcatatcaaacatatcagacatatcaagcatatcaagcaatctggtttcatttatccattgcaaatgttttgatgtaaattctttatcgctgttattaaaatatgtatatcttctgaaagcaactttatcgtcttgataaaagtaacaatccttttctaccatcgatattccgataccgtgcaatatattgaaatatgtacattcctttgcttttccgccgtcaaaacggtattttgtaaacatatctatcaaaaaaaatgctcatcatcatttctgtaaaagcaatcaaccctatacacatcttcactgttataaaaatataatccgtaattattactgccacacatatagtcgtaaatcagacgaccgttttcatcaaagccatattcatagccgtatttccgaggcttgcttttacattttttaatttttcccctatggtaacctccaacagcaaggaacagatagtaatcgggattataccaacctcctgtaccgttgcactccacggtagtatattcatatcttactgcacttttcaaagcgttattgagtatatccgggaaattgtccttgtgcgaatttacaaacgcttttacctcacttatttcgctgtcaaaatcttcttttgctatatctgcgatactcatattttacctcatataaaagaaatcgactgatataggactaccaatcggtttattctgacattacgtttcttcctgctttgccttttcccttgcaagcaaatttgccttatagtcaagataattctggagaataactgcggcggcaactgcgtcaatcacttttttacgctcctttccacgcttgtttacgtcattcatcatattgtgtgcagtgaccgtagtcgaacgttcgtcccacataacaacgggtatttcgagaaaattctgaagcatatctgcaaacattctgcacttctcacttctcggtccgtatgttccgttcatatttatcggatttccaaccacaacctcgccgacctcatattcgacagcggcggcggctaccttttcaacacacgtctgaaaatttctctcgtctataacgcctataggtgacgcaagcgtctgcgttctgtcacagcaggcaagacctgtgtgtgcatcgccgtaatcaacagccattatcttcattatttcttatttcctttcggacaagtagtttttcctgtaacaaagctgaattcaagctctgtcataaaatcgaacaatccgggtatgagctttttctctttctgcattttctcaaattccgcaagcgtgacaaacttcgcaccggacacttcctctgtctgaagcgtcagatcgtcaagcgacagatctctgtgcaactcgtagcaatctataaagaaagccgcaccgtgctttgtacctttgaatgtaagctcctcatcggcaacatctatgccgatttcttcctttatttcacgcttgatacagtcaatgcttgattctcccgctttgaccgcaccgcccgtgcattcccacagaccgccgaaattcttatacttacagcgctgtgtaacgagcagcctgttaccgcttactatccacgcctcacagacgatattgtattcgcccggctgcatacggatacctcttttatgaagttttccggtacgctttctgttcttgtcgtacacgtcccagtattccgccacccgtttcacctccctgcgattatccgtttaatcagttgttggctttatactctttcagtgcctcggcaagctgagcaggacatgaactgctctttgagccgcactttataccgtcaagacgctcgataacctcatcaacaggcataccctgtacaagatgggctataccctgcagatttccgttgcagccgcctattacctgaagaccttctaccttgccgttttcaacatctattatcattttacgggaacatactcccttgggtgtgtattcaaatgtcatttttgtctgcctttcttgttttcttatttctgcgccgctttctcaaccgctgtagctaccgcttctgctaccgacttgtcaagcgggcttgggattatgtattctcttgataatttgtcgggggttacgatatcggctatagcgtaagctgcggccttcttcatttcttccgttattgcctttgctccgcactgtaaagcacccttgaatattccggggaatacaagaacgttgtttatctggttggggaagtcgcttctgcctgtacctacgatataagcgcctgcggcaagagccttgtcgggcattatctcaggctcgggattagccatagcgaatactatcggcttttctgccatcgactttatcatatcctcgctcacaagacccggctttgatacgcctatgaatacgtctgcgcccttcatagcctcagaaagtccgccctttatattattgttgtttgtctttgttgcaatctctgcgtgagcgggattttcatacttatcatccctgttgatgataccgtttatatcgaccatgataagattgcctattcccatattaagcaggaatgtgcctatcgcgatacctgccgcacctgcaccgtttattacaaccgtaatatccttcatctgcttgcctgcacagcgtaccgcattgataagcgccgcacccactacaacggctgttccgtgctgatcgtcgtggaatacgggaatatcgagcttttccttaagtctgcgttcaatctcaaagcatctcggagcggatatatcctctatatttataccgccgaagctatcggatataagctctatcgttctaactatctcgtcaacatccttagactttatgcagatagggaatgcgtcaacgcctgcgaactccttgaacagacagcatttgccttccattacgggcatacctgcaagtccgcctatatcgccaagaccaagcacggctgtaccgtccgtgataactgcaactaaattcttacggcgtgtcagcctgtatgacagcgaagggtccttttctatttcaagacaggcctgtgcaacacctggcgtatagcaaagcgaaagatcctcccttgtgttaacgggtgctcttgaaataacttctatcttgccttgccattcatagtgcttttccagtgcctgctgtttgatatcggttgccatttttcttttccttccttttgggacaattattttattttccgtttcagaatacgctgaagcgaatcatcgggagtgtagttcgtgccgatagctatcggatagtggttatagaatccgtgaaaatccgaaccgcccgttgtgataagattatgctctcctgctgttttgagcagcctttcacgctgttcttcggtcgcactctggtgccatacctccacaccgtctatctttcctgctgcggcaagctcctcgagcagttcgaaattgtcgaataccgcagggtgagcaagtacagctacaccgcctgcagaatgtataagctccagtacgaaatgtacttcgggataatcctgcatatccgtgctgacttcctctgcgcaaagtcccgttgcaggattgaacagctcgtcatacaccttgccgtaaaggtttgtcgtatatccgtaatccataagggcgtgcatgatatgacacttgaatatgactttactgcctgtcgcataacgcaatatgctctcaagcgttataggatacttttcaatcaccttcatagccatctgcttgccacgcttcttacgaagctcacaggtacgcagacataagccctcaagcctgttcggcttttcggggttgtagcatattatgtgcgccttagttccgtgtttgctgtcgtatgtggaaaactcgacagcaggaattacgttaacgccgtaacgttctccgagaactaccgcccttgacgaagaagacagcgtgtcgtggtcggttattgcaaaataatcaataccgtaacgcttagcctgtgcaatggtttcctcaagtcccagtgagccgtcagacattgtggtatggcaatgtaaatcagccttcatatcaatacccttctttctttgtgttctgcttgtaacgctacagccgcaaactgcacgatactaaataattataccacttttaaaggtataatgcaacagtttttgtaaattcggagcaaacgctcttttttatgcgaaacggcactcccgcaattaatgcgggaatgccatcgaacttaactatttgataacttttccgtgagcctttggagcagccttgatctctttttcactgccgcctctgtcaacaaacacggcattttcggcaatatcctcctcggttatcgagccaagctcggggttgcgttcgccacgctcctcgtaatacggattgacaatatatttctgtatcacgggatagcagatgaatgtagtggtaaagcacataagcgacagcggtaagaatataaccgcaaataccgaaaaaggtaaaaaaagcacaataagacttattataacgagattgatgataagcgcaatgaaattacgctttactccgaggaaaacaaggaaaacagcgttcttgagtatcgagccgattgaaaggttgagtgcaacgatctcaagataaatatagaagtgcattataaacacaagagtagcacagcatatcataatgcagataaacacaagcgagccgtcggggagcgattcgttcataaggaactggaagcaggcaatccagacggatactatcattataacgtcaactataccaataaaaaacgactgtttgaaattcttcttgaaagcagtaaagaattcatcgaaaacaaagcacggctgttcgagaatgaactttctcataacgtgagtaagagccgccgtagcaggtccgaaggtaattatgggtatgcagaaaagaacatacagcatattaagctctatcagcttccagaactttctgccgaatatttcccaatatttgaaaaacggctttttctgcggtgccgattttgatacgcccttgcccgagctctgataatcgaataacttgaatgccaagataacaactccttaacgtgaaaacgtgaacatttctgccttaacggcattatgtcaatgataacaccgtaatgttaacagcgtttaaataatcagttacactcatacggtaaaaataccgtgtaatattatacaatattttttgacggatttcaagttaaaaataggaatattgtataaaaagattcagattagcggcaacttccgtattcacagcctaataaactattgaacaggcggtaaaaaagtgctataataaattaaatatattccgaaaggagtcaacttaaaccgacagtggaatacattacaatcggaaatgtcaaaatagaaaaaactgcttcactggctccgatggcttctgttgccgataaggcaatgcgtactatgtgcaagaaatacggagcggcattgctcacaggagaaatggcaagtgcaaaagggctgtgttattccgacaggaaaactgcggctctgcttaccgtcacagattatgagcgtcctatggcgatacagcttttcggtagtgagcctgaatttatggcaaaggcggctgttattgcggcgcagtacaagcccgacttcatagatatatttccagttctgaaccaaccagtaagcaaagtgttcaagattttccgcagactgaaagttatatcaagattgattttcagtttgaaacaggaacaagtaccatttttgcctatgaggaaaacggaaaacactatatcgaacagccttatcagggaatttataaaattgacagtcagctgtacgaacggctgcaagaaacaaactaaaatttaacttatccattcagcggtcatgtttccgggcatgaccgcttttccatgccctcattttgtagcagcttccgcttccagcaccttagccattttgtcggcggcggtttcctttgcgccctgcttgaaaaagccggacacgacaagaacagagttccctatacggatttccgtcacgcaatcggcgggtgcggtgcttttcatgctgtgtctgatatgctcttttttatcggtcataggcgaactcctttcaatcgttcatcagttgctttaagcggttcagcttgttttgtgcgctctccctgcggaagttctcgccggagaagcagacaggggcgcacatttcaagcagtcggtcataaatccgggcgtggggcgtgtcctgcgggttctgcaactcggtaagcgtgaggttggtcgtgacgatcagcggcttgccgcttcggtatcggctgtcaatcacattgtagacctgctctaagccatactctgtgccacgctccattccaaaatcatcaaggataagcagcggatagcggcagaggttggaaatatattcgttcttgccctcaaaagtggctgcaaggtcattaagaataagggcaaagttcgtcatgcggacggagatttctttctccatgagggcgtttgcgatacatccggcaaggtagcttttgcctgtgccgacgctgccccaaagcagatagccgatgttcccggctttcatgtcctcccaatgttccacatagaaatgggcggttttcatctgcgggtttctgccgttgtcattggcaaaagtccattcccgcatagccgggtcggtaaagccccggcgtttcagttcttccaccttgtcccggtgctttcgctgctgttcggcggcttcacgctccatgcgctgcgcccgctggcagtcacattcagccggatgtcggtcacgcccaaacagggtagccttatcagccgggaaataggcttctttcggtgtccggcacttgccgcagtagagcagaccgtcctcacctgtgtagtcctccggctcggcggtgactgctggtatctgtaaattcatatcttcaaaagctggtttcatagactttctccctccttgtagctgtaatcgggtatgccccttttcggggcagctttagcggtatcgtcagccacccatctgcggatagtggctgcatggttcttgtatttcctcccagtggaagcgatatagccggatagccggtcaatgtaatactcccacttgtcgggcagttctgcttgcagttcggaaagctccgtatctgtcaaaatcacatttttgtatctgccgtaagcagcgggagcggctcgtcctggttctgactctctctctttttctatctctatatctatctctttctttatctctatctctggtggacaaatgtccgcttttgcttcggacacttgtccactaagccgtttttgctctgaaatcttcattcttgccctgcgcttgcgctccccctcggtagaggactgaccgatgaaaagctcgatattgctcatatacaaagccccgttgtccagcggttcgacaagccccagcttcataaagatttgcaaagcccgttcaactgtgccgacctgctggcgggtaatggtggctatcatttgggcggtgtaggggatattctcgtcaagctgcaaagtgccgccgtatttcagcgattttaagtacagcttcaagaggatattggaatacagcataccgtcctgcatactttccagcagcacgatagcgtcatcgtcaaaatagctttctttcagtttgaggtaataatatttgcggttatctgacataatcttggttctccttatctgcggggcgggctttccatctctttgagtaataccgggggcagagtaccacgatagccctaaaactctgcttgcagtcatgggtacagccccggcaaagggcattgaaagtaatgcggtttcgctcattgaggaagaacgcccattccagccgccgcttcttgctcattctcggcatgaaaaaacgctcctttcttcggtttggtcgggtatgaggggacaggggcaaaatctgtatgttcccggtgtcattttcgggaaaaatctgccctgtaagccccgtttgcaagggtgggtgtgttgcgggtagggtaagctatacccccagccttttgtatggtttcggtatcatttcgggtcggtttttaacgctcctgttcgtgctttttctgacggctcggtgtgccgtgtagtatctgctcggcgttccgcttggctgtggcaagctgctcatgctcggctttggcggtgcggtaggtgttgtaagctgcgtttttctcggaaatgagggtttcaatctctgtattcagctttgaaatggctggcagcttcttccccggtgcaagcacctttagctggcgcagggtggcttcatagatgataaaatccgcttcgttggcttggtaatagcggtctgcctttttcccggacagctttttatgaacgtcaatgacggggcgggtgcggcggtaatcgctgacaacctttcgcagatttttcttatcggaaatgctctgttcaatgccccgcagactttccctcgcttcggacagggctttccggctgctctccacggctgcgtccagcttgtcaaggtcaagcagttcgttttccatgagaaagttgtgggtagccgccatctgtttgagattgtgcagggaagcccagcggtcatagcctgcgcccttgccctcggctcgcttggcttcccggtcaaccatacgctgtaatccgtcctgtttcggggcggttttggcggcttttttccgctgtaaatgctccataatgctgtcggggtattcgggtatggctgcggtctgttcggcggctctgtgggcgttctgctccaaaagggcaaggacggcggtacggtcaaaatcatcccccagcttccgggcggtaatgggcttggttctgtccggcgtgagataggacagccgcccccggctctccttgacggagattcccgactgcaaaagcaaagctgaaaattcgtcaaaggtgcttgcccggtcaagggtgttgcgtatggtctgccgcagcttcgccttgtcggtttcaaacttggtttgccggggcgtgataccgtccgctatcatcggggcattggctttatcaagggcaagctgccctttcttctgcgcccagtattcacgctcggtcactcggttcttactgccatgcaagaggtcaatctgatacagattttcccggtggcacatctccatgacttcggacttgaaatattccatagctgcgtctgtgcagcggtgcttcatgccgcatttcgtgtccgctggtctgtccatgtagggcagaagcgggacagcttcaatccgcaagctgtttatgacgatatgcacatgaatgttgccagagtgattgtgtccgtccgggtgggtgcagacaatggcttggtgtccggggaaatgctctttgcaaaattcctcgcccagcgattgtgccttatcaacggtcaagccgttgtccgttccgtcccgtgggtcgaagctgatgatatagtggtgggacttcacatcttcccgtttttggtttttgccatagcggagattggagcgcatacaggctacggcaaaatcttcatcgccgcagttcagcgtggcaaggcggtagtcctcacgggggacaagccgcccgttttcatcaagggtaggcttcatggtaaactcgtcatgctcaaaggtaaggtactgctcggctgccccgtagtcggcatttttagagctgatatgtttgaatgttgccaacggcttcacctactttctgcaagacttcaaacttcaaggctgcaaggtcggaaatggcgactcggacttcgccggacagggcgttgtacggcacaccgtattcgttcagataccgggcaatctgattgaggttgccgccgatcctgccgtattcggcggtcagcttcccgacagcggcaagcaattcatcattgaccggggaaacggtaacaatggggcgtatggttgcccgtgtaatggcttgccggataaattcggactggctcataccataaggggcaagccgggcggtaaagtcggcgtattcttcatcggtcagccgggtcttgactaccctgctgcggtggggcgtgttatatcgtttcataggtggttgacctcctttctgtgcgtggtgtcctctcactaataggagaaaaacggggtgtgtagcggaactgtttttgaaataatccgaaaagaatttgcgggaatttttcaagcggctttagccgccatagcagggtttggggaaggcactccccaacaagattcccgcaaggacaaaatgagcgataagcgaaatttggtactgcggtagaatcttgctctccgtgactgcaaactttctctcacttccgtccgccacttttttggaaaactgcaaccacaaaagtttgtttctctttttctgctactactaatcctgtaaagggcattcctgcccgctttcgctaaaatgacaccggacgcagtggtttctacccggtgttggagaaatcctttctctttgccctctactacgggtaaatgctccaaatgccaaacaccagggcagaaaaattccctcctcgcttactactacaaccggcagggggcaaaatggccgggagcggagccggacaacaaaaaaagcagtaaatctttttcaagacttactgctttcgctggccgcgtcggtggcggctggtattcagtttttatgacttgtccggtggttcgtcaagccggaacttgaattgacagtcaattaaccgctgctttacatagtcctccacctcggcgttgacctgcccgttcacttttgagaaatagcggatatatccggcgtagtggagcaggacagcgttcacggcttctgggtcgccctcacgggctttgaggattgtttcataggggagaagtctactcataccggctcacccccatttcttcgcgtagccgctgcaaggcaagctggatatgccgccccgctgtgctgcgtgaccggccaatacacgcgccgatcacgcgctgcggctggcgcagaaagtaatagcgcaggatttcttcccgcgtctgctccggcaaaacagagatcgcgtcggcaagggcggcgttgcagagcaggacggtctgaccgcagacggtaaatgggtattcctcgtccggctccgacgcggcaaactggacaaacttctcgttcatcagatagtcaagggaaacttgccgttcccattgccgtttaagcttcaaaatcttgtccaaggcggcacagcggataacagtcttgcaaaaggcgttgtacctgcgctggatatattcttgataggctatctggtcggtcatggaaattcccctttctgaataatagtgcggggcggtggcacttcttgctgtcgccccttgattgcctaccagcaaaggcgggcggggctgtcaacggctgcgcatatgcgccgttcatcttgaccgttgactggctcggctgggtttgctatttacccgacaaacttgaatttattttaagctatcacgttttaccttcttaagccttactatcattaccataggaatttctttgttggttttaaaacattcttcataaaatccatcaatgacaaatccagctctaaaacaaaggttaaaaatatcttgtatggaacgatgataataaatctgctctttcggttgcccttcaatcgctatatcatagtaactgtgcggtgtcatatatttttcagtcaacgtgacaaaacaagggtgttgcgttgcaaagacaaaaattccgctttcctgcaacagttcataaacagccataagaagtggttcaatatccgtaatatccataattgccatattagaaactgctttcgtaaaggctcgatttctttttaattctaatatactttttctatcggtcgcatccgccacacaaaattcaatttgttttgcatattgtgattgccgtcttttagccaattctatcatttttttgctgtaatcaaaagcgacaaccgaagcgcctctttgtgcaagatacgaagaataatttccattgccacacgcaatatccaaaatgtaatccgcaggattaggagatagaagttccgttactttgggacgcactacctctctgtgaaattcattagattcgtcacccattgcattatcccaaaattgtgcgttctcctcccagatttttttactttcctctgttcccatgttctctcccactccccaaatttgcttttttgcttccattaaatcttccttactatattccattgttaccctccataacttctgattgttgccgtcttgacgattatgtatctttacattaccttctgaaacatatggcgcaccttgtccaggcggctgtttggacggcggggctggatgaccggctgaccgacagcggcctgatatcctttcagctctgtaaggcatacgctccgcccgttggtgtaaaaggccagatcagtacggtatgcctgtatacagcgggcgggaatctcgccagtaaagacaacttcatccttttttacctggccgtttcgatggtggcacagtatttcggtgcatcatgataagccctggaaaggtattcctggggcgcatagaggatgaaggagagataaggttccagcagctgcgtccccgattccttcaatgcctgttccaatacaatcggggccaatgagcggaagtccgccggcgtgctgaccggactgtaataaagcccgtattcaaagcaaatcttacagtccgttacgttccagccgaacaagccctgctccagcccgtaacggataccatccctgacagcgttttgaaaactctggttcaagtatcccagcgaaacccggctctcgtattgtacaccggagccaagcgagagtggtgtaacagacagtcctatggatgcccaaaacgggttgggcggcacctcgatatggatggtgtggctggctgctttgagcggccgctccatataaatgacggagggttcctttaccactgtttcaagcttgtatttttccgacagcaaagcggaaacaacctccaactgcacccggcccaaaaaagaaagaatgatctcatgggtgatggaatccacttcgcaacgcaaaagcgggtcagtatccgcaagttgcgtaagagcgtccagcagccgttctctttgcgctgccgttttcggcgcaatcgtcgtccgcagcatggggagggggtcctcgcgccaccttttacgagggagccgggtttggtcccctaatacatcgtttaacctcacgctgtcgctgggaaggataacaatttcaccctgataagcggtgtctgtccgaacaatttcccctttggatggaatacgcatctctgtgattttcagcttttctctcccggccagggccaccgtatcccgcaggcgcagcgttccgctgtataaccgtagatagacacgccgctggccgcaatcggtgtactcaaccttgaaaacgctgccgcatagggcggcgcccccctgttccccaatcggttggaacagccctgtcaccgcatccatcaacggttgaatgccaaggccatttttggcgctgccatgatagactgggaacagggaggcgtcttgaacccgctgctgttcctcccgcgcaagtttttcccggctgattggttctcctgcgatatacttttccaataattcatcgttattttcgatgaccgcatcccatgcttctatgtcggtattttcctccaggactatttccggggacagcgacaccgtctgcttgatgataatatcggcggagagcttatcccgaacagactgaaccacgctctgcaaatcaacgccagcctggtcgatcttgttgataaagataacggtgggaatgttcattttccgcagggcatggaacagaatacgggtctgggcctgcacgccatctttagcggagatcaccaagatggccccatctaaaacagccaaagagcggtacacctccgccaaaaaatccatgtggccgggcgtatccacaatgttaactttacatctgtgccactggaaggaagtgactgccgcttgaatggtaatcccacgctgccgctccaaaaacatggtgtccgtcctcgttgtccctttttcgacgctccccggttctgaaatggctccgctggcatatagcaggctctccgtcaaggtcgtctttccagcgtctacatgggcaagaattccaatattgattattttcatgtgattgtcctccctttacagccccaaagggcataaaaatccccagcagtaaaatacttttaccactggggattataagttgcggacatacacatatacagcatacacctgtttgtgattgctgtttttggggatatgtcaaaattgataaggcaaaagtattcttaaattgggtacaaaaaactaagcccctacaaaaggagctatcataatcctttgttcccactatttgattatagttttatttaagaataccttgccgcatattttttactccttttctggattaaatcattgtatcacatcagttttaggaaagcaagtacctaaaagaaatttttcttccccttatatgtaacaatcataccggcttcctagcgttcagaatgttttctgctgtctgctgtggtgtttggttggaattgtccaaccaaaagccgatccgtggtgttgtctgcattttactaaatacaaattcaatgtatacagaaagatataaggagtgggagggattccgccgtagttggcattgtaggaaaatccaaaagtttagattttcccacaatgcttatcttttggtctttggttcggaatagtgtagtgctggcggtctatctcttgttttcggttgcttgcttccttaccgtacatgagcattacagccgggcatcaatgctttggggaaatatatgaaaacgaagatagcaacatttatagggcttttcctcaccctgtatctgtattatattcgacgtttgttaactgaatttaaattctgcggattatttttaatattttcttccccgtcgtctattgacagtgttgcttctttatagtatcatagtcaaagaatgtaaatgttcgcacgaaagggaaacatctatgataaatacgatagacatcagcggaaagtgggagcttttcataagcgaaaataaccgtacctcgcttccggataattacaacgacagcataattcttcccgatacgctgtcagatgccgcaaaggtggctgagaacaagaacagggacgaaggataccttaccgataaatacacattcactggatatgcgtggttcagacgttcgtgtacccttgaaagcgatatgacgggcttggtgtcgatactcacacttgaacgcacaagagtaagcacgctgtatattgacggtgcggaagtaggtacctgcgacagcctttgcagctcgcaccgctatgatatttcttcatatatgaccgcaggcacacacgaaattgttatccgtgtggcaaatgtcggttataagacgggcggaggtcacatgacaagtcctgatacccagacaaactggctgggcattgtcggaaagatgaatatcgaaatatatcccaagagctacatttccgatgtaagagtgattgcgtctgctgacggcagtttatcggtaagaggcttggtcaacggtgcggacaacgccgttgttactgcaactgttaccgctcccggcggaatccgtgtgcttaaagctaatatcatatctgacggagatacatttgaagcagagttcagacttgaaaacgctcagctgtgggatgaatttgaacgcaatatctacagtcttgaattacgttgcggtgaagatatattcaatacctcgttcggctttgtcacattctctggtaatgacaggaaactgctcgtaaacggcagtgaggcatttctcagaggaaagcacgacggaatgatttttcctcttaccgcttatgctccctgtgatgttaacgattggaaagaacgtcttaaaatcgccaaaagctatggcataaaccattaccgtttccacacctgctgtcctcccgatgccgcatttaccgccgcagacgagcttggtatctatatggagccggagcttcctttctggggaacgattgccgctaagggcgaggacggttataacgaggaagaacaggactaccttataaacgagggtatccgtattataaaagatttttcccaccacccttcatttgttatgatgtcgctcggaaacgagctttggggcaaccgtgaaaggctcggagagataatcgacattctccgccgtgaaaatcattcaatcttctttacaagcggctcaaacaacttccagttctggcctgccgaaattccgcaggaggattttttcgcaggagtaagactttcccgtgacagacttttcagaggctcttatgctatgtgtgacgcacctctcggtcatatccagacggacaagccgaatgccgcttacgattatgatgcgataatcagaggcgaaaacggctcggagaacgagggcggagatacgatacagattcagtacggcacaggggtaaagacggtaaagctgagcgccgcagacggcagttatattccgcacaagccggtaatatctcacgaggtcggacagtatgattatttccccgactttgacgagatgaaaatgtacacaggtcctctcgttcctcgctatctcgatattttcagagaaaggcttgaagaaaagggactttacacgcagtggagagatttcttcgaggcggtcggcgcacattgtactcagtgctataaggacgagattgaaacagctctgcgttcttccgaactcagcggattccagcttctcgatctgcaggatttcaacggacagggagtttcgcttgtcggcgtgcttaatgcctttatgcaatcgaagggctttataacacctgagggctggagaggcttctgcgacagtaatgtactgcttgcaaagacggaaaagtatgttttcggtgcggaagaaaaaccgtcagtagagattcttctttcgtcatacggtaaaggtaagataaagagcggagcggtgcagtattcgctcataagcgatgagcttgatataaacggcagtgttgagtttacctcatcggatgcacgccttacctctgtcggcacattcgttcccgacttcagcggtatcacaaaaccgcagaaagcagtccttacacttgctatgggcgaactgcacaacagctatgtattctggctttatccgcagacagatgttgaaattaccgaaaacggaataaagacagccgatgacgagctgatttttacagacagcgttgaaaaggcaaaagtgcttatagcaagcggcaaaaaggctatggtgataaccgacggcagtaatgctatagaaaacgcatactgtgcggatttctggaactatcatatgttccgtgtcatttcggagagtatgaacaagcctgtagcacccggtacgatgggacttcttatagacaagaacgataagctgctgagcgctttcccgtgtgaaaagtttaccacgccgcagtggtatgaggcggtaacgcacagcaaggcggatattcttgacgatacacccgatgttactccgatagttcgggttgtggacaacaccgagcgttgccaccgactcggaatgctctataagaagaacggtattcttcattgcagtataagactttgggaagcggcagacgttcccgaaataaaacagcttgcaaagagcattacggaaaatttctgaatagcaagaccgccctgtgtataaaaacgcagggcggtctcagactgtcgataaacctcttgattatataaaaatggggtcgcaggggcgtagcccccgacagggtctaggggcggtagccccagtaatatagcccctttcccgctttgacgagtgggagcagaacttacagcagggcgaggacggcaagtggcggtacgttgcaggaagtgcgggtaaagtcaaagcgaataaaccgatgaggtttgcagggaatggtgttgacaaatcaaagaaaaatggtataattaacaacagaaagttaagtataagcgatagaatacttgaatggaatgacgaagataaaattctggaatacagtccagacgaagtagaagctgaattgctaaaaagtgaaattggtcgagaagctaatgagtatatagtcgataataatataatcattaattttgattattcacagttttcgcttttcgatgaagaactctgtttaggtgaagttatttcttcaaaagatatagcaatctatcccaataattgcaaaagtgtatcagctttagcaaaaacaataattcacgaagtagagcacttaaaaattaacagtgattataacactcaaaaagaagaagtaaggtgtaagttggctgaaataaaggatactaagaataattatgattattctgatataaggagaaccattacagaagtgaaaaaaataaatggatacaacggaatgtcttggaggtaatttatgaactatagttcttattcagaatttgcaattaaacgtaaagaactgtatgaaggaaaagtaaccaaaatcccatgtcctgaatgtagtggcggctatataagcaaaagtaatgatcctaaaaaaaagagcaataatacattttactgcgataaatgcaacatgaaaattattgttaattgaccgcaagcgtccgaatgaattaaactttaaccgcccacagcagtgagcggttttcttatacccgtgtgcaatcaattgcacttaacttgaacaccaacttcacaaaaacagccgttttttgtgaagttcggtgcaaatacaagcaaacttaataattttaccgctccacgagggcggtatttttatacccaaaatcaaagaaagcgaggaaaagcaatggaacccgaaaagaaaactcccgaagaggagaagaaggccgacgctcccgcagcggagcagaaggacgagccaaagcccgaagaaaagcccgccgaaaacaagcaggcagacgataacggcacggcgagagaagcggcgacttcggcaagtcaaactactgtgacaagtggtttatgctgttgtctgtggcaatccgaggcgggctgttccaccctaactgccgtcatactatggggcagtacatagaggggcttacaaagataccaaagccgattcctgccgagaagatacgggaacagcgagagcttgaagaaaagcaacgggctatggagcgcaagataagagcgctcaaacgcaaggttgagggcacgcaggacgagaagaaggtcaaggagtataagcgtaagctccgagaggaacaaggcaagctcagagagtttatcaaagagcacgacgatgttctccgcagagattattcaagagagaagatctacagcggtaagggtgagccgaagcagacagctccgagaacggaagaagcgcctgttaaagctaccgataccgaaagcaaaaatcctgttccgacaaataaagagcctaatattcctcagccggataataacgtttctgaaccggaaaataacgtttctaagccggataataacgaaaatacaatgaattttgtacggcctgagcctgtaaagaccgtttagagcaacgaagacacagacgatacgccgactgcggttgtgtctgatgaagccgatgaaactgctgaaacgacagaaaacgtacaggaaactgtaaaacagcctgtcgaagcaacggcagacagcgaagaagacgtacagaattttacagatgatactgttgacaattcggatgaaagtgatataatagaagagaaaacagatttcgagccgttgccagcagatactgttgttcctgtactgcgtgaggactcaaatgaatggattgaccgtctgtcctccgaagaaatcagagcaatcaagaagtacacgaagaacagcggagatcccaaagacgataagttctatgcaaggcttaattcaatgcttcgtggggatattcccgaagatgacactttgaaatattattccgatgttatatcgggtgcgatagcgaagtttgagttaaagcacgacattatctgttaccgatctgtcaattacaatcctgtggaatgaatgaaagttggcgatatatatgagcctaagcagtttgttagttcagcagtaactaaatcaggtgcgataagcggtaattataatttaattatatttgctaagaaaggaagcaagggtgcgtatattgaattgttgagcaaatacccaaatcagagagagtttttattcgataaaaatcttaaatatagcattttggatattgatgggacaattataactttagaggtgataatatgaaaggcaatacgaatgtgcgtattcccagagaattaattgaaaaagctaaatccgatttgattaaggctataaattctggagaagatgactgggatgaagaaacccgaaaagactgggaagaaaaaatgaactcataaaaccgcccacagcagtgagcggttttgttatatcccgtgtgcaatcaattgcacttggtttgaacgcaaacttcacaaaaacagccgttttttgcaaagttctgcacaaatcagaaccaaacttaataattttaccgctcttaaaaagggcggtatttttatacccaaaatcaaagaaagcgaggtaaagcaatggaaaccgaaaagaaaactcccgaagaggagaagaagcccactcccgcagcggagcagaaggacgagcccaagcccgaagagaagcccgccgaaaacaagcagacggacgataacggcacgacagagaagacaccggtaataaacaaacaaaccgcataaaaatgcggtttgaaagaaatatggtcgaggtgacaagatttgaacttgcgacctctgcgtcccgaacgcagcgctctaccaaactgagccacacctcgatgttatccctctttttcaagagggaagagtattcaattaatattctacgccgtaagtgctgcggtactgcttcatagcgtcaaggtactgcttgccctcgataacgccgttctcaatggcactgattatgtcattgatattaacaatcgagtaaacctttacgccgaaatccttgtcggcagactgtactgcgcttaaatcactgtcaagtgctttttccatacggtcaactgttattaccattgccgttatatttacatcagccgcacccttgagcttgggaagaacttctctgagagccttgcctgatgtcattacatcttctatgataactaccttatcgccgtcggcaagctgctttcctacaaacataccgccttcgccgtgatccttgacctcttttctgtcaaagcagtagcttacatcaacgccgaacttgttgaacagtgccacacaagcacttaccgaaaggggaatgcccttgtaggcaggtccgaacagtacatcggcttcaatgccgttgtcgtggatgcactctgcatagaactcaccgagcttcgcaagctgtgcgcctgtcttgtagttgcctgtgtttatgaagtaaggagcttttctgccactcttgagtgtgaactcgccgaatgtaagaactccgctgtcaaccatgaatttaataaagctctctttatacgtcatactgttctccttcttggcagttactccaaaacttaacgctatatattatagcatatcaattttgccttgtcaagcctttccggtaaaatcatcaaaagttagttttttaagctcgtcacatactatatcggaaattctggcaaacgctatgcgataattgcatggaagaccgttttcggcacgattgcagttataatgcccgtcaaggcaacggctgaacatatatgtaccctctaccgcctcgaccacgtcatacagcgataattcagacggcgacttgccaagctcatatccgcccttagtgcctttgtacgagtttactataccggcatttcccagcttccgcagaatcttcatagcaaatgtctgcggcacataggtcttttcggaaatcgcttttgcatcgaatctgccgtcattctttaccataaaatcaactatcctgatagcatagtcggtttccagagtaatgtgcatttcttactccttatcagtccagaaagtccttcagcttcttgcttcttgaagggtgtctcagctttcttaaagcctttgcttctatctgtctgatacgctctcttgtaacgtcaaactctttgcctacttcttcaagagttctcggtctgccgtcttcaagaccgaatctcagacgaagaaccttttcttcacggggagtaagcgtaccgagaatttcgctaagctgttccttgagaagcgttcttgatgccgcttctgcgggtgcgggcgcatcctcatcgggaatgaagtcgcctaagtggctgtcttcttcttcaccgataggggtttcaagcgaaacggggtcctgagatattctgagtatttctcttactctgtcaactgtgattccgagtctgtccgcaatttcctgaggtgtaggctcatgaccgttttcgtgcaggagctggctggaaaccttctttacctttgttatggtttcaaccatatgaacggggattctgatagttcttgcctggtctgcaatagaacgtgtgattgcctgtcttatccaccatgtagcgtaggttgagaacttgtatccctttgtataatcaaacttttcaactgccttgataagtccgagatttccttcctggataagatcgaggaactgcatacctctgccgacatatctttttgcgatgcttacaacaagtcgcaggtttgcttcgctcagacgctttcttgcatacttgtcgccctgcgccatacgggtggcaagttcaatttcttcttccgctgtcagcagaggcactctgcctatctccttgagatagattttaacagggtcgtctatagcgatgccttcagatgaaagagaagactcgaaatcgtcgctgtcggtaaagtcaagcgcactgtcaaggtcttcatccgcagagaagtcatcaacgatttcgatattgctgctttcaaaatcgtcatagagcttgttgatttcatcggcatcaaagtcaagctcctcaagcacatcggttatctcctttgttgtgagcttaccgctctgcttaccgtgattaatgagttcgtttattttgctgtctgccatatttatcgttcctttcaaaaccttccggtcatgatttattgtttttaattttgtcagcgaattgccttagttcatcctccgacatatccgcaacactttttgattgcttcttatctctgtattttatcagcacattcagataatcgttcagccgttcaacgctgaatggcaaattattgttttcgtgtatcagcttgtatattgacgcaacttcctccgcagaatatctatcggcaagcattgaaacgtcatttgaaagtccgcaggagatcattgccgtgagatcgataaacagccgtttgttgaactccgtaacaaaatcatcggagcttattctatcggttatttttttcagagcgtcgggcgagtggaacagatatgctatgataccccgttccgcctgagtttcagcaggatagcgtgacgcttccggattaatcttatctctgtttaccgagccgttaagtatcgcacggcgattatccttttcccgtgttttgtttctctttgagataatctgatttacggctatgtctacatttgcacggttgacatcgcattcctgcgctatagtcgaaatgtacacggcacggtcgattgggctgtttatatttgctataaagctgaccgctttttttagatattccgattttccgccgggtgcggagaggtctgtctctgagcgtatttttttaagctcgtaatccattcccgactggctgccgtcaatcagaagctggaacgcctctttgccgaactttttgatatattcatcggggtcttttgcgccctgcattgtcagcacatttgcggaaattcctaccttgtcaagaatattcatcgctcttgcggtagctttctgtcctgcggcatcgctgtcatatgcaagaatgaccttcctgaagccgagattcgcaatgttccttgcgtgagaatccgttatggccgtaccgcaggtcgctacggcgtttttaaagcccgcctgatacattgaaataacgtcaaggtttccctcgcacattatcagaacgctctcgcccgcattttttgcgtggttaaggctgtacaggaatgtacttttattatataccgcagtcgcctttgtattaaggtactttctgttatcgtcgccgccgatgacacggccggaaaaaccgactatattgcctctgacatcaataaacgggaacattaccctgtacttgaaaaagtcaaagtaattacctctttttgatgattttgaaagcagtgacgcttcttccatctcggaatcgctgtatccgagcgaattcatatgttttttcagtgaatcccatgtatcgggagcatagccaagaccgtatgttcttatcgtgtggtctgttagacctcggccgtataagtaatcaaggccttccttgccggcaggggagtacagatatttatgaaagaaccttcctgcctcacggttcatttcataagcccgtgtacgcctttttatgccgttgtcgccttcttcgtcaggcatagctatacctgcacgctgagctaaaaatttcacactttccatatagtcgagatgctcatagagccgtatgaaatttataacatcgcctgccgctccgcagccgaagcagtaaaagctctgcgtggccatgtatatatgacaggacggtgttttttccgagtggaaggggcagttgcagacataatccgtacctgactttttcagtggtacatacgatgaaatcacatcatatatatcgttgctttctttgatatttaaaagaaagtcttccgataaacgcatcgttcttcctttctttgaaaactgttaataagaccagcttttcggaatgcaaagttctttgaagtagtcaaccgcaaagtcgtccgtcattccgcttataaagtcgcataccgcacgttcaagcccgtattcttttgcaaagccgacataaagctcgggcattttctcgggggaaccgatgaaatacttatacagatattcaactatgtggcaggccttgcctttttcggcgttcgtactcggtgcgaaataaaccttgtcgaacatgaatttccgcagctcgtcgtgtgcctgtcttgtagcttcatcatattgtataagatctgtgctgtttgcgattattgattttatcagagtggttattctctcacttttgcttttgccaagcacctctataggtcctttcggcaaatcctcctgtcttagaacaccgcctcttatcgcatcctcaatgtcgtgatttatgtacgctattttgtcgctgaattttacgacctgaccttcaagcgttttagcggtagcgttggtgtgacacaggatgccgtcaatcacttcgcttgtaagattaagtccctgaccgttcttttcaatcacctcgactactcgcttgctctgctcgtaatgcctgaaatggtcgggaacaagctgatccagcgttctctctccgtcatgcccgaagggagtatgtccaagatcgtgaccgagcgctatagcttccgtaagatcctcgttgagtcttaacgctcttgctattgttctggcaatctgcgatacctcaagggtatgcgtaagacgtgttcggtagtggtctgatttcggtatcagaaaaacctgcgtcttgtgcttgagccgtctgaaagaattgcagtggattattctgtcacgatccctttgaaattccgtgcgtatatcacacggaggctcatatacctttctgcccttcgtagctgtgcttttgcaggcgtagggcgaaagcgtcagattttcaatttcttcggttaccgtgcgtggtgatttaccgttatttgagtccaaatatcacacgacctttccgtcaacgacaaatcgaagatgagcaaccgtccggctgttcatcttccgaagtaatatactttaaaatatgaaaaaagtcctttatttttttatttttgtttaaaattcgacatatccgcttttcagcttctcgattttgaccttgccgttgcacctgtcggtcagctttgccgtaagactttcggtaagctcggtttttacgtcggcatagatacatacgctgtctgtaaattctgtgtcacggataattgactcaaattcaggcaacaccgaattgactataccgtacatagtatagtcgcagcttattttaaggctgtccgctacctccatatttacaatttcggcatttgcaagagccattgacgcaccttttgagtaagcgtggaccagccctcccgtaccgagcagaattcctccgaaataacgggtcacaacgcatacgacatctgttataccgtttttggaaagaacgtcataaatgggcatacccgcagtaccgcccggctcgccgtcatcgctgtgtctgcctgtattgttgttgcgaagaatataggcatagcagttgtgggtggcttttctgtgcatcgctcttatttcgtttatgaagcctatcgcttcttcctctgttccggcaggcgaaatgtatccgataaattctgattttttctcggtaaaagacgcttcagttcggtttcttatcgttttgtagctcaatatgcgcctctgttagtttttgctgtctttaagcgacgctcttgtctttcttacatcggtaaggttcgaggtgagaagctcgtcaactctgctgagcatactttcaacatatttgttggtcgcacttttgatctctttggactttgtctgcgctgaggtgagtatctcgtgagccctgttctgcgcctgctttgtgataacttcctcggataccatagctttcgctttttcttcggcttttctgattatgctttcggcttctgccttagcatcgttaataatcactctgcggtcgtttacaagtgcctgtgcctgttttatttcgccgggaaggttcagccttacctgtccgataagatctctgaactgctcaacatcaataagggatttacctcttgtcagaggaacgttctttgatttgtcaagctcaatgtccattgcctcaagaatttcttcaatgctcattttaataccatcctttcaaacatctgatttatttttacgaaatataattcgtcagtatcttttcagtctttcgtttattctgtcgagtatgcactccggaacgaaatcgcttatatctccgccgaacatcgctatctgctttaccatactggacgacagataggtatattcgctctttgaagtcaggaatatcgtttcggctttgtagcacagctttctgttggcttgcgccatctggaattcgtattcgaagtcagaaatagcacgaagcccctttacgataacgtctgcgttatgctcgttgaaatagtcaatgagaagtccttcgttgctgtcgacttcgacatttcctatgccttccgccacaacgctttcacgcaggaactgttttctttcctctattgtaaaactgcacggcttgagcggatttaccgaaacaagcacgattactttatcaaacagctttgacgctcttgaaataatctcaagatgaccgtatgttacagggtcaaagctaccgggatatatagctgttttcatattttattcctcgtcttccgtctgtggttttctgtagaatgtaagtgcggttttgccgtatttttttgattttgtaatgacaaatccgtttatttcttcgggtaatctgcagcccggttcatgctcgcatattattacgcccgtatccttcattttctcggtaagagccggcagtgaacgctgtataaggcttttctcatacggcgggtcgagcagggcaatgtcgaatttctctccggtggttcttaagaatgcggagttgggcatattgacaatctcgcactgactttcaaagccgacgtgggctacattctgctttatgaattttatcgaattctgactgctgtccacaagatacgcttttttagcgcctctgcttacagcctctatcccaagctgaccggagcctgaaaataaatcaagcacaacgcttccttctgtttcaaactgtatagcgctgaatattgcctcttttacgctgtcctttgtgggacgcacgtcaagtccctccggtgcaatcagctttctgcctcttgccgttcctgtgattactctcatcttatttcctttcctttgtcaatcaaaaattctctttaataaaatcgtatatttcttttgctttttcttctttaactttagctacggatgcaatctcatcgggagatgcgtccttgagtgcctgctttgtcttgaaatgctttatcagagcgagtgcctttgcctctcctatgcctttgatttttgtaagctccagttcataagtctttttcttatgcgtctgctgctggaatgaaagcgagaagcggtgaacctcgtcctgaatgtttgtcatcagcgaaaacagcttcctgttggcgtttatctgtatttcttcaccctgcgccgcaatcgctcttgtacggtgcttatcgtcctttacaagtccgtatagcggtattgaaacattcatactgtcaagcacctgctgtacagcgtgtacatgaccctttccgccgtccagaagaattaggtcgggcagcggcgcaaaactctcgtcaccgtcaagataacgctgtatgcgtctttgcaatacctcctgcatacacgcatagtcgttctgacctatcacgttcttgattgtgaatttcctgtagcctgccttatacggtctgccgttgcggtacactatcataccgccgaccctgctgtcctctccgagatttgatatatcatagctttcgataactgtcggtatcttaggtaagcccagcagctttgcaagatcctccagtgcgtttatttcctttaccgtcctgccgaccttcatcgaaaggtattcagaggcgttctgcttagctaaaagcacccttgacaatccttcgccccgctgagccaccgtgacagtaaccttatgtccgcaaagagcggagaagtattcttcgaggattgcactgtcctccatttccttgtctatataaatctgtttcggaatcgcatctttccttgcactgtagtattcgaccagaaaatctgaccgcatctgaccggggtcgtattcgtcaccgatgaagaaattcatcttgtcggttattcttccgccacggtagcacataacagcaatacttgcaagctcaacgttctgagccagtgcgacaacgtcaaaatcgtatgttttgtcggagaatatatcctgaccgtccttcattttctcaattgcgtttatacggtcacggagttttgcggctttttcaaactcaagattctccgatgcttcgtacatctgctcggtaagacgttctacgctcgccttactgccgttttgcatatactctattgcagagtgtataaggctgttgtattcgtcctgctttatcttgccggtacaaacgcccatacatctttttatatgataattaaggcacggacgctcttttctgaaatctctcggaaagaccttgtgacaggacgggaacataaagattctgttgacctcatcgaccgcctgctttgcggtaaatccgctcgtgaacggaccgagatactccgcattcttatcgttgcagttaagcgcataagaaattctcggatatggctcttttgtgatttttatataattatagcccttatcgtcctttagcagtatattatattttggattgtactgctttatcaggctgcattcaagaacaagtgcgtcaagctcgctcggtgtgacgatgaagtcgaaatcatagatattttcgaccagcttccttgtctttgcgttatggctctcaagcgcatgaaaatacgttgttacacggttcttcaaggcttttgccttaccgacgtagattatcctgcccgtcttgtctttcatcagatagacacctggggacagcgacagcttattcgatttatatttctcttaacattcttgatgttgtgcagaattctatcggcgcacgggcttcgcttgtcgaaataaccgtcagcattgacacaacggcagatactcttacggtcatcataagggatgacggccggggaatgagcgaggcggagctgtcaagagccgtcgatccgttctataccacaagaacaacgagaaaatacggattcggagtaccttttttcaaagccgcatcggaaatgaccggcggcagcttcgagataagttcaaaagaaggagaaggtacttatataaaggctgtttttgtactgtcgcacattgacagaatgccgctgggcgatatgacgggtacgcttatatcgcttataaatgcgaactgccgtatagatttcagctataactattcggttgacgaaaagcggttttcgcttgatacaaggcagctcagagccatactcggcagtgttccgttaaatatacccgaggtcacgggatatatcacccgttatcttgaggaaaatacagccgaggtaaacggcggcatcaaatattaacgaccacgaaaggataatttaagatatgaaatctcttgaagaattagctgctatccgtaacaagatgcagaacgttgtgaacctgagaagcgaagcatcggactgcacaagaattgttgtcggaatggcgacctgcggaattgcggcaggggcaagacctgttctcaaagcattttccgacgggatacaggaaaagggcataaaagacgtaatggtaatacaggaaggctgtatcggtctttgccagtatgagcctgttgttgaagtcatcacacccggcaaggaaaaggtgacctacgtcaatatgacatctgaaaaggctgtagaagtaatcgaacagcacattatcggcggcaacgttgtaacgaagtacacgataaactccgctatgtaaaatctgaaaggaaactaatatatgtatcgttcacaagtattgatatgcggtggtaccggttgtacttcttcaggcagtgttaaaattgccaaaagattacaggaagaaatcgacaagaacggtcttaccgacgaagttatggtagtccgcacaggatgtttcggtctgtgtgcgctcggtcctattatgatcgtttatcctgagggtacattctactcgatggtaaaggaagaagatattgctgaaatcgtttcggagcatctgctcaagggacgtatcgttacacgtcttgtatacgatgaaacagtcgcagaaaacgagataaagtcgctcaaggaaaccgacttctataaaaagcagcacagaatcgcactgagaaactgcggtgtaatcaatcccgaatgtatcgacgaatatatcggaagaaacggttatgaggcactcggaaaggtcctcaagacaatgactcccgatgatgtaattcaggtaattcttgattcgggtctgcgtggcagaggcggcggcggattccctacgggcaagaagtggcagcttgcaagaaaccttgtcaaggacgcagatcagaagtatgtatgctgtaacgccgacgagggcgaccccggtgcattcatggatcgttcggttctcgaaggcgatccccacgttgtaatcgaagctatggctattgcaggctatgcgataggcgcaacacagggctatatctacataagagcggaatatcccatcgccgttcagcgtttacagatagcgatagatcaggcaagagaatacggtctgctcggaaagaacatttttgacagcggattcgacttcgaccttgatataagacttggcgcaggcgcattcgtatgcggcgaagaaacagcgcttatgacatctatcgaaggtaacagaggcgagcccagaccccgtcctcccttccctgcggaaagcggtcttttcaagaagcctaccgtactcaacaacgttgaaacatacgctaacattcctcagataatccttaacggtgctgactggtttgcatctatgggtacagaaaagtcaaagggaacaaaggtattcgctctcggcggtaagatacacaacacgggacttgttgaggttcctatgggtactacactgcgtgaggttatttacgaaatcggcggcggtatccccaacggcaaggcattcaaggcggctcagacgggcggtccttcaggcggatgtatccctgcggagcatctcgatataccgatagactacgataaccttatcgctatcggctctatgatgggttcgggcggacttatcgttatggacgaggataactgtatggtagatattgctaagttcttccttcagttcaccgttgacgaatcctgcggtaaatgtacaccctgccgtatcggtacaaagcgtctttacgaaatgctcgaaaagataacatcgggcaacgctactatggaagacctcgacaagatggagaagctgtgctactacatcaagaacaactctctgtgcggtcttggtcagacagctcccaaccccgttttatcaactctgcgttactttaagaacgagtatatcgcacacgttaaggataagaggtgtcctgcaggcgtatgtcaggatcttctcacatacaagatcatcgacctcaggtgtaagggctgtacagcctgcgcaagaggctgtcctgtcggagcaatctcgggtactgtcaagcagccccacagcattgataccacaaaatgtatcaagtgcggtgcttgtatggctaagtgtaagttcggtgcaattattaaggaatgatccggtttgacggataactgaaaggaataaattttactatggttaatataaagattaacggcatagagtacgcagtcgaagaaggtacaaccatccttgaagcctgtcgtcagaacggcatcagaattcctactctctgctggttaaaggatataaacgcaatcggtgcgtgccgtatctgcgtggttgaaatgacaggtgcaagaagccttgttgcatcgtgcgtttacccgttatcgaaatttgatgaaggcaagaacattctgacgcactcccctgctgtattacagagcagaaagatgacgttacagcttttgctttcagatcacaatatggactgccttgcctgctcaagaaacggaagctgtgagcttcaggagctgtgtaaggagcttggtgttgacgatacgacatttttcgagggcgagaagaacgagtacgatattgactacagctcgaagcatatgttccgtgacaacaacaagtgcattcactgccgccgttgtattgccgcctgcgacaagctccagggtattggcgtaatcggtgcaaacaacagaggcttcaagacaagcatagactgtgcgtttgaccttgatcttgccgagaccgcctgcgtatcttgcggtcagtgtataacagcttgtcctacaggtgcgcttgcagaaaaggacgatacggacaaggtatgggacgcacttgcagatcccgaaaaggtagttgttgtacagacagcacccgcagtaagagcatcgctcggagaggcattcggctatcctatgggtacacccgtagagggcaagatggttgcggctcttcgcagactcggcttcaatgccgtatttgacacaaacttcggtgcagaccttactataatggaggaatcgcacgaattccttgacagagttacaaacggcggtgtacttccgatgatcacatcatgttcacccggctggataagattctgcgaggcttacttccccgaatttatccccaacctttcttcctgcaaatctcctcagcagatgaacggcgccatcacaaagacatactgggcaaagaagatgggaattgaccccaagaacattgtaagtgtttctgtgatgccgtgtacagctaagaaattcgagataggcagagaggatcagtctgcggcaggcgttcccgatgttgatatttcaatcacaacaagagagcttgtcaagatgataaaccgtgcgggcttacgcttcagagatctgcccgacgaggttgccgattcacctttaggaaacggcacaggcgcagctgttatcttcggtgctacgggcggcgttatggaagcggctcttcgtacagctgtatggaagctgacaggcgaagctgcagacagccccgttgaattcaaggatgtaagaggcgttgagggtatcaagacggctgaatacaaggtaggcgaccttactgtaaaggtagctgttgtatcgggtcttgcaaacgctaagaagttccttacgcaagtaaagaacggcgaggtagaatgccacttcatcgagattatggcttgtcccggcggatgtgtaaacggcggcggtcaggttatccagcctgcagatgtacgcaactttaccgacatccgtgcagagcgtgcaaaggcactctacagccttgatgacgcaaacaagctcagaaagtcgcacgaaagccccgatgtaaaggaagtatacgaaaacttcctcggagaacccggaagccacattgctcacgagattcttcatacatcgtataaggcaagtcacttaagcaagtaacaaccattatataaccgtgaaccgctctgctgtatggcagggcggtttacatatttccgtacggtttacggataacatgacaggtttttagttaactaatttttaactaataagctaaactatgaaaattgttacatacatttgttttttcgaacgtttttgaaacagaaaaaagcaagttacacgggtttcattagttaaattgcacaataatgttgtatgaattttgactattatgtgaattgaattaagtgtttcaatgtggtacaatcaatgtaacgaatgtgtgtaaacgattgcacgcattacattaaggaggttttttaatatgaattttaaaagaattcttgcaggcgttatggccggtgctaccgctatttctcttgcagcttgttctaacagcggtaacggcggatttgattccgacaccaattctaccgcttccagttcagaaacaacgattgacgatgagattgacaaccccgtcagcgtaggcgacataagcatagacgcaggtgaagatgttgagcccgcagagcttgagtatctcggcaactacgatataacaacagccggtgacgtaaagcctgcatataagtatttctcggaaaactacggctgtaaaatcaaatgtacaatagtaggatcgctccagatacttgaaaagctgacaacggctatttcagccggcgaatcgcccgaccttgttgactactcagacagcacattcccgctcatgatgtcaaagaatatgtacacacctcttgacgactatatggatctttcagctcctcagtggtcgggtcttgatcagtatataaacaagtacaagtggaacggcaagaattactactacccctgggcttataacgtttcatcctacttccttatttacaacagaggagtatttgagcagataggtcttgaagaccccaaggagctttatgatgaaggcaagtggacatgggaagcaatggccgatgtgatccgtaagttcatcgactcggataccgacggcaacagaacaggtctttacggtgctagcgaatattcagcacaggcaataatcgactcaacaggcgtaccgcttatagagatcggtgaggacggtaagttggtaagcaacttcaacaacgcaagcgttgacagagccgctacatttatgcagtcgctcaagagcgaaggtcttgcaaagttccaggaaggcgttataaacgtagacgaagatcctatcgtttcgggtacggcagcattccagggtatgggtgaatggataattacaaactatgcaaagaaaatgaagaaggatgattctcttgatatattctttgttcccttccccagagattcacaggctgatgaatattattattcgatgacgacattcggctatcttgtacccgcaggttcaaaatttgctaaacaggcatcggtatttatcaactgctgccgtctgagcaatacagatgaggatcttaaggctacaacaaaggaaagtattatgaggaacaagaagtatacagatgaacagtacgacttcatgtatagcttcaaggaaatcaacaatttccacgctgtagttgacgagccttacggtcttgacgaaacaacaggtcagataatcaaggatattctcggcaacacgctgttcgatctgcagaacgaaacatacgcaggtcagtcatggacacagatgcgtgaagctaatatcggtacaatcaacaagcagattgaatactacaacggtcttatcacaagcggtaactcctgagtagaataaaacgaataataattataaccgcagttttcggactgcggttatttttatgcgttttttgcatagcaaaagggctttgaaaatcaaagccctcatattattttacggatttactttaccatatcgctgttattgatagcggaaacaagtgcgctgacggagctgttgatgatgtcggtatggatgcctgcgccccagaacgagtttccgttcttgtcgcatatctcaacataagccgccgcctttgactttgagcctacctctatagcgtgttcattatatgttactaagctgtagctaagtccaagaccgttctttatagcgtcgctcactgcatcaagtctgccgttgccgctgccggtatacactgccgtactgcccttgtaatctgctgtaactgtagctgtgattccgccgttttcctgcttatagtgtgcctcggtgattttcagtgcggtttccttattcacgaaattactgcggaatacttcatacacttcatcgggagtaagctccttatgctgatgatcggaaacggatttaaccgtatagccgactttttcacggaacttcttaggcaggtctacaccgtacttctgctgtaacagataaccgataccgccctttccgctctggctgttgatacggataacgtcaccgtcatactgtctgcctatatccataggatctatgggcagataaggaactgtccaatgctcagggtccttttcctcacgccacttcataccctttgcgatagcgtcctgatgtgagcctgagaatgccgcaaacacgagagagccgctgtagggctgtctgtcatagaccttcatacaggtcatcttctcgtaaacctctgttatagagggcaggtcggagaagtcgagcttcgggtctacgccgtgcgagtacatattaagagcaagcgttactatgtcaacgttaccggtacgctcaccgtttccgaacaaagtaccctctattctgtcagcgccggcaagcaagccaagctcgctgtctgcaacggcacagcctctgtcattatggggatgaagcgaaacgataacgttctccctgttcaccatattcttgcacatatactctacctgacttgcgtaaacgtgcggaagcgacatttctacggttacgggcagattgattataaccttatcatcgggagtgggctgccatacgtcaagcaccgcattgcatatctcaagcgcaaattcaggctctgttccggtaaagctctcgggcgaatactcaaacttgaagtcgccgggtgtcttttctctgtattccttgagcagctttgctccttcaacggctatgtcaataatctcgttcttaggctttctgaatacctgttctctttgtgcaacagaggtggaattatacagatgtacaactgcgtgctttgcacctgcaagcgcttcaaacgttttctttatgatgtgttctcttgactgtgtaagtacctgaatagtaacgtcatcggggataaggtcctgttctatcaatgcacggcagaattcatattccgtttcggacgctgcggggaaacctatctcgatctccttgaagcctatcgctacaagcaccttgaagaattcaagcttttcttcaagattcataggaactataagcgcctgatttccgtcacgcagatcgacactgcaccatataggagccttgtctatatactccttttttgtccaatcaagacactgtacgggaggcatgaaatatcctctggagtatttgtttgtgttcattgtacctttcataaattatgtcctttccctatttggttttccgatgcaggcatttaaaaagcaatgtaaatacacaaaaccccgcctctgtaaagagacggggtaaatcctcgtggtaccactctttttgacacagcgtttactgccgtgtccgcttatgccacatctaacaatgtgcttctctgtaacgggagaacccgtcataacttactgcaatgttcagtcatgcgactctcaggcgagctatatccgacctttaatattgccttgcaccaagcggcaactctctgtgaataaacgtgcggcttttttcctgatcaacgtcttttcctattaacaaatattattatatctcagaaaaacacatttgtcaatagttttttacaaattattcacctatcatttcaataagctgttgctgacttatgaccgtaacgccgagctgttgtgctttggtcagcttgcttcctgcttcctcgccggcgagaacgtagcttgttttcttggaaaccgagccgctgcacttgccgccgttctgttctataagcgtttttgcctcatctcttgtcatatcggggagcgttcccgttataacaaatgtcagacctgccagcttgtcgctctttacatcagactgatataccgtgttcacgccgtaagatttcagcctttcgataagctccgtcatatgaggctcgtggagtgcagtgaagatgttatttgcaagaatatcaccgaaattctctacagcggaaatttcttcggacgaagtttccgacagcttttctatactgccgaagtgcttcatcagaagctgtgcgtttttctgacctataccctttattccgagtgcgaataaaagcctgtcaggagaattcgtttttgaattttcgatatttgcaatcagctttgaagccgaaacctttgcaaagcccggcagcatttcaaggtcctgctgttgaagcgagtaaagatcggcaacggtgcttataagtctgttttctacaagctgttttactaccgcttctcccagcccgtcgatattcatagccggtcttgaggcgaaatgctcgatatttttaagaagctgtgcggggcaatcaatgttcacacagcggataaccgcctcgtcctccgccctttccgcctttccgtgacaaacgggacagatatgaggtataacgaacggctcgctgttttcggcgtggcttacgcttcgtacaacctcagggataatatctcctgccttgcggacagcgataatatcgcctattcttatatccttgctgtcgatatagtcctgattatgaagcaccgctcttgatacggtagtacctgcaagccatacaggctcgaacacggcaacgggagtgagtgcgcccgtcctgccgacatttatctctatatcaagcagtttcgtttccttttcttcggggggatatttgaacgctactgcccacttaggcacctttgcggtactgccgagctcgtttctgagttcaaaatcatcgacctttatgaccgcaccgtcaatatcgtaggaataactctgtctgttttcgcctatctccataatgcgtgaaacggcatcttcgatattatcaaaggtcttatagccgtctatcacattgaagccgagcgacttcatatagtcaaggctctcgctgtggcaggtaagctctctgccctcgatacgctgaagattgaatacgaatatatcaagtcctcttgaagctgtcaccctgctgtctttctggcgcagtgagcctgcggcggcgttacggggattcttagccggctgttcatcgttctcaagctgttttctgaccagcttttcaaagtcggcttttggcatatacacctctcccctgacttctataaagggtatcttttcgcgaagtaccataggtattgactttatggttttcagatttttagtgatgtcctcgcccacaaagccgtcgcctcgtgtagagcctcttgtgaatattccgtccttgtattcaagtgaaacagataagccgtctatcttgggttcaacgcagtatacagccttgcctacggcttttttcacacgctcgtcaaattcatacagctcgccttttgagaatacatcctgcaggcttcccatctgcacctcgtgagttaccttctcgaatgtgttgatggcatatccgccgacgtgctgtgtgggagagctttcggaaacaatttcgggattttccgcttctatctcctttattcttctcatcagcctgtcgtactcatcgtcctctatagtaggatcgtcaagaacatagtagttgaaattgtgctgttcggcttgcttgcaaagctgttcgtattcactttttatctgctctttatccattgtaattccttccgttttcggttattcatacggctctgcctcaaagtcatttattgcatcgacaatgtctttatcttcggataccacatgagtgaagctctccggcacatttccgacaatgaccgtttcggcaataagaaaatctccgctgacatctgtttgcacagaatacataggtatgaatgcggtaacgctgacagttgtacgcattatcattctgtgaagcgtctggttaagtcctgcatcggtaaactcgcttataaacactgcgtcggcatagcccttaggctctaccttcattctgacggtaggacctgagccgtgaaaaagcggtattccgctgagtgttccgacagtaaggtcaacgttttcggtttcgcccttcataagcctgtcgtttatctcggtcagcatatcgttcttaatgcggtttatcagcttggtgttgctttcgatagaagaaactctgccgtctgcggtatagctgagctttacaagagcgctgtatccgacatcctctccaagttcattaagacgttcgtttatcgcatcgtctataaggctcacagttaccgccctcgaattgtattcgcacacgttcattatattaggtcttatcataagctgaagcattccggcaaagccgagaagaataaaggccgcaccgataagtttaagcccgagcctgcgtctgaatttcgataaatctcttttcataaaatcacccgttcaaatataatactatattctgagcgggcggattttatgatattgattacttcatcttatagaatgcggtaaatgccttatacgccatataaacgtcattttttgcggtaagctcatacggtgcgtgcattgaaagcacgggaacgccgacatctatcgtatcaatgttaaggtttgcaatataagccgcaacagttccgccgccgccgaaatccaccttgccaagctcgcctgtctgccatacgacatcgttcttgtcaagcatattgtggataagtccgacatactcggcgctagcgtcgcttgtacccgactttcctcttgcgccggtgtactttgtgacaacgatacccttgtttacaaatgagcagttgttacgctcgtagccgtcggggaatgtgggatcgtaagccgcatttacatcggctgaaaggcagcgtgtggcggaaattaccgttcttccgtcactgcccatattctcggctaaatcgtaaaggaagaacttgagatatgccgagcgtaagcctgtgttgccgtcactgcctgtttcttccttgtcggtaagaacgcagacggcggtcttttcgggaacggctttcatatcaataattgcggtaaacgcagtgtatgcgcaaactctgtcgtcctgtccgtatgcgccgacaagacttctgtcaaagccgacatcctttgccttgaaggcaggaacgcattcaagctccgcacttaagaaatccttttctactatgccgtatttctcgaaaaggatattcataagattgagctttaccttttcgcttatcttatcatctctgaaaggtcttgagccaatgaggatattaagctcctcgccctttatcagctttgttgcggggcgcttgtactgctcttccgcaaggtgaggcagaaggtcagtcacaacaaacacggggtcgccctcgtcctcgcctattcttaccgttaccttgcttccatcggcttctcgggaacaacgcccacaccaccgctgtggcggataacgtcacgggatactatcgcaccgttttcaagctccgccttatccgagcatacggtgagaatctttccctcgtactttacttcactgtcgattgtcttttcaaataaatgcatattgtcctcttttctgcggtttattctgctgtatcatcatcggatatatccgcattttcgttgctttcatcactgccgttatctcccttggacagttcattgctttcaagctgttcgtcaaccgttttttctattgttctgatatatgcgttatgatttataacggtatcaagctgctgctgttcgtacagatgaacattggggttcggcttatatctgaatacctttttcagaacgatgtaatatataacgataataaatgccgctccgatcgtgcagacaacgcctgctttaagtccgggtgtaacataattgaattctatattgcattcgcctgcaggtacttttattcccatcacgccacggtttaccttttctatctcggctttctcgccgttgattgttgcgctccagccgctttcccacggtacagtgaacgtaacaaatctgtcctcagtgaacgaagaagtagccttaaagccgtttgccgtaggtgtgaacgtatctacagccgtctttgcaagctcctgtgcgtccttttcaaatgtataatagttgaaatcggaatatctgtcaggttcaagctcaggcagaatatcgctgtatttttcaatctgttcatctgtcagcacgacagcacgggcgagcatattgtcacggttgctcttagcaatcttttcgtactcgtcatcggaaatatagtagctgttcgaatagcctatcgggatatatgccttgttcttgaatatagtaaatccgtcctgctcgtcaatcttctcaaagttcttgagattttcgagcaacgtctttgtatcgctgtactccagcttgtagctttgaataacgagatatttcgtggaatttaccgaacgcatagcgtaatatgatccgtcagggtcggtatttaccgagcgactgaatcccattccgctgtagtactcaaatgcagagccgggaagaatgctgtggaagctgcggaagccgtacattccccacagcatatttgcattattggtaactccgtaggtttctaccctgtagaagctgtcatcgtcaagctctatcgtagcgtttacaatattgttgtaatcgcccaccttcggacctatcgctctgccgtatatcagcgtgtagtacgagaagcagaggcacgcaaccatagtaaagcaataggatttttgcaggaatttatttgttctgagctttgccttgtttctgacaagaatatagcacactataattgcggttattgcaagaacaaccgaaatccagaaaggcagcttctcattaggcaattggaaaagctcggtcacctttgttgttgtcgtatctcccgtgccgatatcgactatgtccttcgatacctcagacggaagtattccgaccatagatataagcactacggcaaatccacaccacttaaggccgtacttcatatctatctcgctgttttcaagggcgtatgccgtcatgaagcaggcgacaagtatcggcatatagaaccagcgtgtgtaataattgttgttgaaaagcacgaagctggaattaagaacggggataagcgcaaacagaaggcatatcggcataagccacttcgcccagtgctttttcttgtacttgatgaacgatatgacacctgccatagagaaaagcggaagatatgccgatacgcttgcccatcttgccgatgaatcggggaagaagttctgccttgcaggaatatccgcagggaagaacaggctctggaaaatcagtccgtatctctgggcgggattatggaatacgagattccatccgtttaaagtattgcttgaacggggcgtatctatacaggtcaatattgcaggaacaaacattgcgcctgcaagcgcaacgccgatgaccgattcaaacgcaagcacaaggaacgttttaaccgtaatcttgaacttggggtcggtgagcctgcacagaaaataaatcacaaggaaaatacattctccgataaagaagaagtagtttacaaatgcgttgagcgcaacagtaagcgcaaagaatactctcctcttgtttactacggtttcttcaagggctataagcataagaggaaatacaaccatagcctcgtggaaatggttgaagaacacattgtacatcgagaagccggagaatgcgtacagcagtccgccgataagcgccgactgcagctttcttacaaatcttctgatatatgcgaaagcaaacagcgaacagcacgatattttaagcaccagcaatggtgccataagatatttggcaaactccgccgggaacggcatactcagccagaagaacgggcttccgagcgtatagaacgaatatgagccgatgaagtttgcaccgatatccgtctgccagctccacataaagctgccgtttttaattgcctgattgcaaagtgtataaaaaggtatctgctgagcgttataatcgccgtaatagatgaaatatccgccgtctattagaacaaacggcaaaaagagtataacgcccattatcattgccataaagaacgcttttcggtagtatagcttttcagatttgtacattccgtgtttccttccgtgatgaagaatatatcggccgtttaatacagcacagcgccgtatttttcagccatagcctccagcttttcaggctctataagtgattttctgtctattattgctctgccctgatacagcataagcgccatcttgagcgaaatctcgtcatccgataaaaacgctacaggcagtgtagccatgtgcatatttctgccgaagtcgatagcgtcgtccggagagtttatgcttactgtcaggacatcatagctttcgccgcacatctgcgcaatgtcgtcctccatataaggaccgcattcaaccgcaggcgagaactccgttgtttcggggtctaagaagaacatctggttttcggtcgccagtgcgagagaggtatcctgcttttcaacgggatttatctcggatgcgtcaagagatgcaaacatttcacgcagtgcggcgatatgctcttttcccgtaccgcagcaaccgcctgcaatctcagcgccgctcagaaccgacttctttacggcgaatgcgaattcttcgggtgatatgctcagcctttctccgtcctgttcatatacggcgctcggctttactataagaggaatcttcgcatacggagcaatctcggaaataatatctgggcaaagatctgccgaggtacagttaaggccgaatgccgatatgcccatagcctgcaatacaagcaaggtgcacagcacatttgtgcctattgcggtttctccgtcctcgtctaccttcattgttgctattatcggcttgttttccttcttgcaggcaagcacggcggctctcatattccacagtgcaggcacagtttcgataacaaacatatcacagtaaggcgataaagcctttacctgctgtctgtagaccgacattatctcggtaaacgtgtagtcgccgtaaggctctatgtaaagtcccgttgacgacagacagcctgcaatgagcgccttttcgtgaaagctgtcataggttatctttgcggcggcggcgttaagctgttctgttttgtcctcgacaccgtatgccttcagattctcacggtttgcaccgtgtgttgcggtgtagagtatctgcgagcctgcgtcaataaagccctgctgaagctgcgtaagggcttcgggatgttcgcagacaaactgagccgtcgaaactgtgtggtcatagccgtatttttcaagtcctgtgccggtaccgccgtcaagcagtatcggcaatcgtataggtatatcctgactgacgggattgctgtccatattgattcctttctgaagttacattttttcgggtgcatcgaccttaagcagatcgagcagattcttgaatactgtctttgtggcaacgcacagagaaagtcttgactgaagaatattctcctcctcgccctttatcttgcaattgtcgtagaacttgtggaaaagctgtgcaaggtcgcacagatactttgttatctttgagggattataatcctttgccgcttcgtttatgcagttcggcagagccgcaatatgacgtataagcgcaagctctgcgggatgattgaagttaagttccgatacgggaatgttgctgtagcctgtgccttcttcttccatacggcgcagaatgctgcatattcttgcgtgagcgtactgaacgtagaacacggggttgtttgagctttcctcaatggcaagctcaaggtcaaattcaaggtgagtgttgggatctcttaaattgaagaagaatcttgccgcatctatcggtacttcgtcaagaagtgtcgaaagcgttatagccttgcccgaacgctttgacagctttaccgtttcaccgtttctgactaacattaccatctgcattataacaatatcaagcttgcttgcgtcaacgccgagcgctgtcagggcggctttcattcttgcgatgtatccgtggtggtccgcaccaagaatgtctatcgccttgtcaaagcctcttgtaacgagcttgttgtagtgatatgcaatatcgggtacaaagtaggtagggataccgtttgcacggacaagaactctgtcctgatcgtcaccgaaatcggacgccttgaaccagattgcaccgtccttttcgtatgtctgacccttttctgtcagcatatcaacaatctgctttaccgcaccgctcttgtgaagcgagctttctctgaaccatgtgtcgtatacgatacggtattttgcaagatctttctcaagtccgtctatgttgagcggcagagcatattctaccagtgcggacttgcggctttcctcatctgcgtttacaaacttgtcgccgtttatcttatagaaattatatgcgtgttcgattatgtcaacacccttgtaaacgtcctcgggcatagggaagttttcttcatcttcaaatatcttgcggcatacgtcatcatcgccgtatgatgcgatgacatcggacttgttgccgtcagctatctgcatatatcttatagacagcgatttgccgaacttttctatctggtttcctgcatcgtttacatagaattcacgctctacctcatagcctgcaaactgaagtacggaagataagctgtcgccgagtgcgccgcctcttgcgttaccgatgtgcatagggcctgtggggtttgccgatacgaattcaacaagcactctcttgcccttgccaagctcggtcttaccgtagtcgctgccgcttgaaataacctcgccgacagtttcgttgaaccataaggggcttataaagaaattcagaaagcccggtcctgcgacctcaatcttttcgaatactgtgccgtcaagcactgcggcatcggctatcatctgacctattgctctcggattgtttctgagcgcctttgcgcttgccattgcggcattgcaggagaaatctccgtgtgatacgtctgcaggacgctcaacattgaaagccggcaggggtaccgcctctatcttgccctcggcaacaagtctgcccagtgcgttcattaccgtttcctttacctgctgtttagcaagctctatcatattgttcatcagttacactccttgacatttataaacatttcattttcagacatatagcttgaattgatgtcgagcatatatttaagatatatttctccgcccgtttctgcaagctcgtttcttatttcatcagtgcatacgcctatcataaagtcgccgaactccgtgccgtaatggcagtggtgcttctttcctttttctatgaacaaagagctgatggctttgccgctccttgtcatagtcaccatttcatcggtcacttcaagcgtcactgagcttccggcaaaaccggtagcctcgctttcatcgtaatacagacggaagccgttctcggtgctttccatagcgccgaatgtaaacaactcggtggaatccttatcctgatctaccgtctgcgtactttttatcgtaatacatacgttctttttcatttattatccgttgttcctttcaaagcctcaatcgaggtcaactacagcgccgatgagcattctcagcatttcctcgtagctgtatgcgctttctgtcacaagccttgtgaatatgctctgtctgtcaaggccgggtattcctcttacacgtcttacatagacctctccgtcattgtcaagcaccatatcgactcttgcaaagcacttgcaggaaagtgcatcataagcggctcttgctgtctgctttatcttgttctgagtaaggccgtccagctttgcaggcactttaagctccgacgtagacgctatatattcggacagcttatcaatgctgtcgtctgttcttacaagctcgcctatcgctacccgctcatcgtgatgctttgcgccgagtacggcacaggtaagctctctgcctttaacggcactctcggctatgatataagggtggtgcgaaaagctcgcctttatcgcttcttcaagctccttttcgttttctgctctgcaggcgccgaccgatgttgaacagcttgtcggtgcggtgtatatcgggaagctcagcttgccggttatcttttttatcgccgccgtcatatcgttcatctcactgcggtgcaatgttacgttctcgataacctttatgttgctgtctgacagcacaagatccattatgcgtctgtcgttgcacagtgccgccgccgcaaaatcgttgccgatgacgggaagacctgccagcttgcacaagccctgtaccctgccgtcctcgccgtattttccgtgaagcacggggaacacggcatctatacggtgaatagtgctttcgccgtcggaaattatctttataacgcccttgttcgtcatatcggggcttatcacgcaagaacagcagtcgctgtcctgctcccagctgccgtcttttatattctcatagctaccgggataaaaaagccatcttcctgctcttgtgatgcctattgcaagcggctcgatctccttgggcaaggagctgagaacactgtatgcggtatgcagtgaagcggcatggtcagcggacgcaccgccgaacagcacggctattcttttctttgccatagctcttcctcttctttcgttctttctgtttatgcaataatacaattaagtatatcacattctgctttcaagttcaagtattaacgtgtaaattataaatagtatcgacctaacggaagaaaaaagtaaaatttcggataaaaatattgaccgtgtgccgcagatatggtaatattaatgtgcatatattttttagcaggctgcagaagaaactgtaccgcctatatcaaaaagaagaggtatattttaacgtatggaaatacaactactcgtaataatcataataatgatcgcctgttcggcgttcttttccgccagcgaaacggcacttaccggtgctaaccgcataaggctcaaaagcatggctgaaaacggctccaagggcgctaaaatggcgcttaaactgcttgacagatacgataaggttatcacaacaatacttatcggaaacaacatagtaaacataaccgcatcttcactgggtacaatacttgcgacagcaatagtaggtcctgacaatgcggctctggtatcgacagtggtactgacgcttgtgatactcgcattcggtgaagtaatgccgaaaagccttgcgaaagaccactcggaagggttgacagtcgcaacgagcggaataatcacattccttacattcatattcactcccctgtcggctttatttatactgcttaaaaagctcgcaaacaagctgttcggcaacaagaaggaggttaccgtaacagaacaggagcttatggctataatagacgaaatcgaggacgagggcgtacttgaagaacaggagcgtgaccttgtgaagtctgctcttgaatttgacgaaacggtagttgatgagataatcactcaccgtgtagacgttattgcagttgatgtaaacgaagatattgaaacggtaaagaaaaccttcatcaacgaggaatattcaagacttcccgtttacgaaggctctatagaccacattatcggctttgtgagtcagaaggactttttcaagaaatatcttactaaaaaagatgacgaaacgttcttactgcgtgatataatgcaggagattcactatgttcctcatctgatgaagataagcgatataatgaagcagatgcagaaggacaaggtacatatggctgtcgtactcgaccagtacggcggaacgctcggtatagttactcttgaagacatactcgaacagcttgtcggtgaaatatgggacgagaacgatgagataatcgcccctgtcacattcgtatcggaaaacgagttcaacgtcaacggcgatgtatcgctgaccgctttcaagcgttactggcataaccgcacgggagatagtccgaaaatcgacggcaacgcaaaaaccgtcggcggctgggtgcttgagcttttcggaaaaatccctgaaacaaacgaaagcgttacaacagacgatttcagaataacggttcttaaagtcagcgaaagaagaatagtaaaggtacgccttaccgtaattcccaaatccgaaaataaggaataatatgcgtgtactgtttatagtctgcgccgtactgggtactgtcggcatatgcggacttcttgtaatgcttctgttcttcaagctgaaaataaacctaggcttcagactgccgaagggcaggactataccgatcgagcagtttattcctcaggggatatacggatatgcggtatttgccgctgtattcggatatttcgggctgatgctgctgcagctttcactgccgtggtacttcatagttcccgccgatattgctatgggctttattgtgaactttatcggtatgcactttctttctcctgccgtaaagagttttgtgaacggcaaagcgccgaagcctgacgatcttatgggatatgaggctgtcgcacttgaaaatatagcaggcagcggctacggaaaggttcgggtgaaatataacgggctgaattaccgttttgacgcaatatccgtatatcacacggatattgaatcaggcgaaaaggtcgatatagttacaggcgaggacgaattgctctttgtccagaaaaaagatgagatatacaaagttcttgacgaggaaaaaacgcctgcaacaaaagcagaaaccgacattacaccggagccgaaaagaaaaaacgacagctttgtaagctcggaagaaatcaataataaccgaaaggaagaataaaacttgttctcaaaggagataacaactactgcggaggactaccgcacattagtaaaattcaccgaatactcgctcaaaaagtcgaataacattctgtttatcactatggcggtacttgcggtggcatcgctcgttatcgggcttgggggaataattccgctgtatatttcggcggctgtatgccttctttgcactgcggtgatccttgccgatgttcttatcatttcaaagaaagcaaaggacggtataaagtacggcaaggtggtgcttaacgcaaagcgtaccttcagctatgatgcggcatcggtaagggtgttcggcggaaggacagctaccgatataaacgcacagtggaatacgattttcaagatatatgagatcgaaaagtgctttataatctatttcagatataaccttgcgttctgcctgccgaaaaatcagcttacaccgcaggaaacactggatgtcagaaactattttataaagaaaatggacggaagattcgtcaaaaaatgcaaataaaacaggaggacggcattatgttgaaaaagctcaaaaagcaggtgcttgaagcaaatctactgcttccgaaatacaaccttataacattcacatggggcaacgtatcggggatagaccgtgaaagaggacttgtagtaataaagccatccggcgttgaatatgacggtatgacggtagacgatcttgttgtagtaactcttgacggcgagcaggtcgagggcgatttaaggccgtcaagcgacacaccgacacatcttgaactgtacaaagcgttccctaacatcggcggtatagttcatacgcattctcagtggagtacgacctttgcacagagcggacttgatattcctgcactcggcacaacgcacggcgactatttctacggggctataccctgcaccgacaagatgacacccgaagctatcggcggcgaatacgaaaaggaaacaggcacgataatcattgacacgtttaaaaagcgtaacatcgatcccgattccgtacctgcagtaaacgtacactctcacggaccttttgcctggggcaaggacgcaatcgacgctgtacacaatgcggtcgtgcttgaaaatgtcgcaaagatggccatgttcaaccttctgcttgacagaaatatcgagcctatgcagcaggagcttcttgataagcactatctgagaaagcacggcgctaacgcatattacggacagaaataacagcttcgggggaataatatgaatatttactgcctatcggaaggcgagctttataacattgaaaacggcaaggaacacctcgttcactgcgagcgtgtggagagctaccgtgacgcagtgcgtaaaatgaaagcccgtgacgaatggaaaaccaccggcaaaggtgcaaagttcatgggcgttgagcagaaggaatacggcgaaaatgaagcattcgatatgctcaagggcatcggttcgtgcggcgacaggctgatatacacgacttttgcggataatgtcggcggtatgtacttcaaggacagcgagggagaaaactatatttttgcaaaccgtgaagaaataatcaatgatattgactgctgtgacgggaagtgcgtagtcagtgcaggaaacgggtattacgaaaatcacattgcccttgtcgatacgaaaaacggcagctttgaacagctcacagaagggtttaccagcgaaactcacccctttatttcacgcaggaacagcgatataatctactatacggctatgggctttgcgacaaacggcggaggagagattgcggaaaaaagcccgtgtacgatatgtcttttcgatacacggagcggaacaatagacgaatttatcgcagaggaaggatttgactgcataaagccgcaggacgatgccgacggaaacatatactacatacgcagaaaatacgttccgacaaagcaaaaaagcaatctggcaatggatatactgatgttccctgtcaggataatcaaggctatcggcggatttttaagcgtgttttcaatggcgtttggcggagaacctttgcgtaccggcggtaaaaatccggcaaagagcaaaactgcagacgagcgtgaagccttcatcgagggaaatctgataaaagccgaaaaacagctgagcggtgacgcagacgacggtataatcccatcggactgggagcttgtaaagcgtgataaaaacggtaacataaccgttttaaaaaagcggataatggattacaaactgctttcagacggagatattctctattcaaacggaagccgcataggaatactgtctggcgataagaacacagttgtgtgcaagatcaaatacgctaactcgataaccgtaaccgaataagacacaaaaagccgccgtgctatctgcacggcggctcagtctgtcgaaaaacctcctgcttatctaaaaatggggtgtcgagtgttgcttgctctgctggttttgcatcgtgcaaaacttttggcaagcaaccaaagcatcaatgtcctttacactggtgcgggaaatgggacttgaacccacacgccaatactgacacaagcacctcaagcttgcctgtctgccgattccagcatccccgcaaatcagcttgtttattatatcagataattttgcatttgtcaagcacaaaaatttacattttcgttttttattttacgctgtcgcttttacggcgatttatttacctgcggtaactgtcgcaatcaatgttacactaccgaaacatctatcttcagctcgccgttttcgtcctcgtaccaggtttcccacgcaaaatacttatcccagcaatcgcactcgctgaagtccatatattccgcattgaactcctccgcttcttccgccggcacaagccagccgctgcaatcactcgcaatcagcccgttcttcacctgttcgtgaccctctttgcaatcaaggaaaaacacgcttcccttttttgcggcagtctgctgaattatctcaatgaatttagtaaatccgagcggctctctcgttcttagtcctgttatcataaatacaccttgcctttatctcttgatagtacaataaattatatcaccataccgccgcaaagtcaaacctaccatcgccctattatttgcttgatgccgaatatatttgtttttaaaagcggcgattataatagtcccgacagataaaagccgtccactgaccaaaacggctcgtgaacggctttttgctgtaagcccgttacatctggagcgattctattaccgcccctacagcttttatcgctttgcctgttgctttcttgacattctgcgtcttgtttgaggtcatagcctttgttgcggcaaaagcgatgccgcctgccaccattgcggtagcggcacatatcatattattggaagttttcttgctcatttttccgtttcctttcataaccgcctttttcggctcgataatataatgtgccgccgttaaaaaattatagcttgataaatctgacatcagaatttgccttattatcctctttgtgtatcaaaaataaagtgagttatataaaatttacatctcgacaatatgataattttgtgctaaaataaatgtatgtgtaaaaaagaaaggtcgttttttaatgtcacagcataaaataatagcggctatccatgacctctccggctatggaagatgttcgctttccgttatattgcccgttatctctgctatggggatacaggtctgtccggtgccgaccgccgttatgtcaactcacaccggcggctttaccgatattgctatggaggatcttacagatcatatttcagcctgctataaccactacgaaaaactgcatctgaagtttgatgcaatctacagcggttttctctcatctccgaaacaggtcgattgctgtcttgaattccttcacggaaaccccgactcacttaaagtagtggatccggtaatgggcgacaacggaaaaccttacagcacttacactcccgagcttatccgcaggatgaaggagcttgttgatgccgcagatgttataacacctaacctcactgaaacgtgtatgcttctcggagaggaatgtcctcccgtaatgtcggtggctcaggcacgctcgtggcttgcccgcctcagcgacaagcccggaatagtagtaataaagggagtacctttgatagacgatgacggtcagaagctctctaacgtaggcttcgacagggaaagcggcagcttctggcgtatcgactgggatcatattcccgtacattaccccggcacaggcgacatcttcacttcagtgcttaccgcatcgttgctgaagggcgaaagcctgcctattgcccttaaccgtgcaaccacgttcacggaaattgccgttaaaaccacctacagctacggcaccgagccacgacttggcgtgctgtttgaggattgtctgagctggcttatgactaatacggtactgtgcgactaccgcaagctatgataatatccgatattgctttttaccgctttgccgcattgcaaagcggttttgcaatttccgttcaaaaaatcaaaaaattgtcgaaaaagggttgacaaacgtttgactttgtgatagaatattatctgttgtcacggcacagcaaaagctaatgaagccgagagtaaaaaaaattaaaaactcttgacaatcggttttcgatatgatataatataacacgtcggttgacaagaaacaaattaacaagctggtgtagctcagttggtagagcagctgatttgtaatcagcaggtcgggggttcgagtccgtccaccagctccaattttttctttaacttaatatgggagtgttcccgagtggccaaagggggcagactgtaaatctgttgcgtttcgcttcggtggtccgaatccacccgctcccaccaaacccgtaagattttcttacgggtttatttttatatataatttaccccttgcctgtcttgagaggcaaggggtattgtcaaaaatcagttttcaagatatttcaggaagtcgtcaaaaatcgctctgtagacctgctcgtttatatgtaagccttgctccaatcagcctaaaaagcggaaaatgtcaaaatatacggtttattatatcctaaacctcataaaagtgcaaatttctccttgacaaatctattcctttgtgctacaataattatccaaacaaacggggccgtaaaggtttcgacggggattgtgaacccggctaagcacgcagagatcgccttatctctttaaacggggcatttttaaaattaaacgcagacaatagatctgaattagtagctgcctgagtgcgctaccgtccttgtagagagcgctgtggctctataaagggcgtcgactaacagccaatgttttcggtgagagtcctgtaaccgtcaacacatcaaaggactaccggacttctatcctgtgagccggagaggagaaagggaatttcaaaagacttcactaagcgtgtagaaaggttggcggatcggttttcggacaggagttcgattctcctcggctccaccattttttccacgctcatatatatgggtgtggaattttttgtttacggtagtacaaaacgcataaaaattatcccacattttccgtacctgacagcactgccctgacaccgtcgtaattataatataatcacctttgacttttaaatcccgatatgctatactgagtttgaaaaccggaattattccggctaaagatttaatggcagataatatgtattttcacgcatcaaggagaaagtaataaatgaaacttttattcaagcaaagattattctcgtggtttgacagctacgacatttatgatgaagccggaaatactgcgttcgttgtaaaaggtgagcttgcatggggacacctgctccgtatttataactcctgcggaaaagaggtcggatacattaaggaaaaggtgtttacctggcttccgaagtttgaaatgtatgtcgactctcgttatgtcggctgcatcagcaaagagtttacattcataagacccagattcaacattgattataacggctggaatatagacggcgactggcttgagtgggattataacatccgtgactgtaccggtcgttacatagcttgcgtatccaaagaaatctggaactggacagatacctatgtgcttgacgtgcaagacccacaggacgcattgtatgtattgatgcttgttcttgccatcgacgcggaaaaatgctcaagaaacgactgaaaacgcataaaaattatcccgcactctgaggtgcgggataattttatttgtcggtacggatcattgcttttatgccggtattacttcttgaacataccgaaaacgcctttcagctttgattgcggtgcagttccgttcagcttgttttcggtatttgtgagatattcatttgcttcggtcgcctgctctgatgttatgccgagttcaggaagaagctctgcaagctcgttccttgcattattgacatcggttactgtgttgtaagtcttgctcttcacgaatttaagagccctttcctttgccgcttcttctcttgttgcggcggttttgataagtgatacctttctgaacttttcgtcaaaatccaccagatgctttttgataatacctatatacttatcctttacgggagtcctgagctgtgacagcttgtcctcgatttcaagcaagtttctttcatagctcagtaaaggctcattttgcggaggtgcgaccttgaacattatattctgtatctcctcaagctcctttttggcgagggcggcattctccctgtcaggcagaaccactccgtcaaccgtattcaacttgtcctcctgtgcctgtatgtaatctgtcgcatcggttgcgagtgtcttgtctataccaagcttcggcaacgtgtcatcaagcgcctttatcgccttgtcaacgtcatcataggtgcaaccggtcggggctatggattttaccagcttcaaagctcttatctgcgccgcctgctgacgtgtttcagcctttgaaaacgctcctgtcgtcttgaaggtcgtatcaaactttgttatataatcgtcaataatcgcaatatacttatcctttactggcgtcttgtagctttcgagttttgcctttacatcgaacagcttctgctcataatcgagaagaagatcgggattcggtttcggtacatcgctcattatagcggtaatctccgcaagctcggctcttgccgcttctgcttcctccttgctgttgaaagcaattccgtcaacggtattgacattgagatagcattgtctgaatagctcactaacctgctctgcttcctcaaaggttattccgaccgttaacaaaaattcatcgaccttctgccttgcgtcaatcagatcctgctcggtgtaacccttgggaatcacgctctttgcaaaattcagtgctctttgtgccgccgcttcttttcttgtttcatacaccgtaaatcctaccgtacggaatgttgtgtcgaactttgccttgtattgctcgataattccgatatacttgttttttacgtctgtttcataagattccagctttgcctttgtttcatcaagcattttctcataaggaagaacgctgttcttgtcaggcttcggcacggcatttactattgccgttatctcgttaagctctgcggtagcctttaatgcctcttccctgtttgcaaactgtattccgtcaattacgcaaaggttcttttcgacctcgtccagataagcgtaagcgttttctgcctgtgcctcggttataccgagatgcgacaaacgttcggtcagcatcttaacagcgttgtcacgctcttcaaaagatgttattctcatgccctttacatattcaaaggctcttattgcccccgcttcttctctcgtcaggctacggtcgaattttccctcttttctgaaaagcctgtcgaaatcggcaagcaatgcgtctatactttcaagatatttatccttaacttttgttttgaacgaatctatctgctttcttttttcgataaggtcgttttcataatcaaggtcagacttgtcggtcggctttgtaaccgtttcaaatatcgccgtaatctgcggaagttcttctcttgcaaggtctgcttccgctcttgagtccataagaacgccgtctacggtgcaataaaggtcgttgaaatatttaagacgttcttccactatattccttgcctgtacaatctgtacggtactgagccctatctttgcggcatactcctccataagtcccttgcacttcacagcatcttcttcggtttcaccgatattatcgtttacaaagcgagcaagaatatcgttcttgatgtcgaatatattcacgccgaaaaattcggagaatttccctatggagtcatcctcatcacccattgtatcaatcagctttgaatagaaactgtcctcgtaaggatcaagctcgaatatctgcacgataaaagcatctctcttttcgggggggagacttatagacatcatattgttgaacatagcctgtgctttctgcgtatcagccgcactcacagtaccgtcaaactttattgcggtgttcttctctactatatcaagcagtaataaatgcagattgaagcaggaatcataaacactgttcaccatatcctgacgaagactcattgtgttaaaaagttcctttatctgtgaacgtgcatagctgcggctcatcatatttccgaccgcattaacaaggctgtacgctataccctcggtgatattcattgccgttgcgtcgagctgatttgaccaggcgtttatggcatttccgccgaatgtagccgactgccagcgaggtctgctctcttttctcagttctcttgcatattcggcatcgttaagatcggtaagtatcttttcatactttttgtcaatgaccttgaacgcttctgtgaattcgtcaaaatacacaccgtcaaaagccatattcacaacagcatctttatctattgtataaatatccacgctgattatatcctgtatcagctcgagcagagccttttcaatgcagtatacaaaagcgctcggagcattgtttataagatcgtcaagatcctcaaactgctcgtttatctctgcaaattttgtctgcgcttcaagagccagttccttgtacttgtttctgataatgttataaatgttcctgtcaggagtaattgtaaacggaacattgcagaactgagttttcagttcatgattttcactttcgataatattttttaaatctctcgcttgcatctgatttcctccgtttgaatattaacagccttgcggcttaactgcatacgaaacgtgtattttgatataaccgatataaaatttgcacattccgtttattatttttcatattatcacacaacaaatatattttccaccgtcaaattccacgcaaaattcctatcaaattgtcatatcgctgtaaatcccattattatgccaaatttcagttaaaatattttccgtcgcttagttgaattttccttcctgctctaagcaaaagattacagccaaagtaaatctgtcggacaagtatatttttctgcgttccacattccccaccgtatatcaaggcgcaaaacagccacgaaaacagcttacatacctcttgacatttacagcctgccgtgctgaatttctgaaccgtgcctgcaactgctatattcagattggaaaacccgatgaaccggcagaaagaaaaagccgtagcactgaacgttcaactttgctttcatagcctcaataacagcatcaacccccacaccgattgtctgaacggtgcaggggttgatgctattattatattttttacgttcttgcaaacaccgcaaaatctatagcggcacataaacagccttcacaattgtttatggttttatacatttcggtcagcgttgctccggtagtcgttacatcgtcaattatgagaatatgctttccgttgagctttgtcggctctgtcacagtaaagcaattgtcgagattgctttcacgctctttcttaccgagcgttttttgctgtgcggtctttcttgttttggcaacggcgttaactgtcggtatgccggttatttcggaaatctcacggcatatcttctcggtatggctgtagccttttttgattttatccgtataataaataggaacaggtacgataacgtcgggcagagtttcatagtaccctgtaatcttctgtacaagcgtatatgccataaaactgattttactgccgtcacggtgcttctttgcgcctataactacaggcgaagtctttttgttataacggcatacgcttaacagcctgccgccgcaaaggctttcctctttttcgttatactcgaattcacaggcgcatttatcgcagatataatccattcttcctatgaccttactgcacaagggacagcggttcggaaagaaacaatcaagcagtatacgcttcagctcgtatttattcatcatcattttcatctaaaaacggattgcgtatctttgtcggctttattatgccgtcaagcagccgtttcgctgtatttctgttcattgtgccgccgttgtcacgtctgcgtctgtccgctcccggaatatcatcggcatcggtaaggctgtctacggaaggagcgtccagctttataacaggcggagtgtgcttttcgctcacagccggcttttcctcagactttgcttttacggacgctttttctccgaccggcacagtaagtgacggcgaggacggcagaatgtcaaaatcatcctgcgtcagacgttctccgctttgctgtacctcagggaaatcttctgccggtgtctgtgttgtttcaacggtatgcctgtacatatttgccgcatagttgctcttaggcgttacagagtgctttatgctgtagtcggcttttgcaaattcgcctgcaaagcccgtatcaacagcaggctctgtatatgctttatcgtctttatcgggcctgttgtcttcgtccgctgtgccttcatttatatatccgccggatgtctgctgtaatttgtcatctgctccgccgaaactgaaaatatcgtcaagcggcttgaaatcataaccgctgaccttttcaagctcggagatctcgctttcgaaagcattgtcgaacggattttcaaacaggctgacatccagcttatctgtttcaccggcctttacaacgtgaacaggtgccttaggagcttcgctttgcggtgcggccgcttcctgctgtacgggtgcggtgctttcctgcatcatatcataaagctcacgttcctgctcctgctttctgcggcggttttcctgctcgtaaagaacactgcggtctacccgttcaaaaacaaaaggctttacctggggctgttttgccttgccggttttttctttgctttcctgtgcggacggctcgctcttgctttcggcttcgtgcttgaccggcgcaaaatgcagatcgtgagaatacttctcaaattccctgaattccgaaacgctgagcgtattgtgaagaatgctctcttttatagccataaagctctgataccactccgcaaaatcacgctgtgtaagatcgacgtttatacgcttcgacatatatgtgtacagctctttggtcatatcctcaagccgtcttatttcatccggtgttctcggaggtaccgccgtgctcatctcaaggcaggtgcggccgcccggctgagccttactgcaatagtcatagtcgtaatccttgtcacgaataaaatactctccgcagcgttcgcagtgctgaagaactcccccgctttcaagcaaaaggtctatttccagatctattatcgccttgaggctgtccgaaacgtacaccttcttcggcagagaacgcatcgttgttattatcgtgttcagcaccgaatccggtttttcgggaacataattctttatcttagcaaagacgtccatcgcctcgctgtccgaatgcagagcggcaaacggtctgtgctcgccctcatattcgatctcgggaagtgccgaagcggctatcgcctttgaaatattgctcgttatgaacggagcagacggcaacctgccgacagtgtacacctttgcggcggtaaagcattctgacggatagcccatctcatttgcggctacgctgaatgtcagatcaaaataatcacgctttgcaaatgcctgctctgccgtaaccttttcaccaaacacaaagtctatcttgcgttttgcgtattcctgaagctgaagaaggctcacccagcggtttaccgccttattgtgacgatattcggtaagccttgtgaatatgagcttttcaaacggagttttggcatttataagctcattccataaggaagatatgccaagccccttttctctgcaaagatattctataaacagatcctgtactgctttttcataaatgccgtggatattcgcctcaacatatttgtgacacgcaccgagtgaattacggagcgcaacaatatcctcaagtctgtactctccgctttccgcacatcttttgcaataatcggtacagcgtctgataaagccggaaaagtcatattcggcaaatttaaggacagactgcggatatgaaagagaatatatctcactcgaatttataccggttaagctgactgttctttttatactcatatccgcttttcctttccgctgctcctttaatagtcttccgatgtgtcatctgtcgatactgcgtcgaagttgaattcacgctttctgccgtcaacataaagcgtatgcttgtctttccacttgacatcggcaggcttgttatagtcggaggttattatatggataccgcccaatgcgttacggcattcaaggaacggcagacttatatctccgtctgtttcttcaagatagaaggataccgaacggctggtgtcgccctcaggatcgacataaagaactattctgtactgcttgtcgggcgaatagcggtagcttgtgcttcttgcggacagatcgacatccataagagtaatgtttccgaacagcatcttgaaagtcaggtaaacaagcactcctactacatacataagcagatatatagtgccgataatgatctttgtggtctcgcccgcaccgctcagcaggaatataagtacgcttacgactatcggaggcactgcggcaaaccagttgccgaagccgaacagaagtatagcgaacgccaaaaaaggcgaaataatcgcaacgattctcgtgactatctgctttcttgtgaaaagcataatcccgaagaagataatattgataaagatataaagcgtaacaagtgcgccctggtgcgtcggctcaagataatatcccataaaaagccacgccacaaagcccagaaacacgggataggctatcgacaggaacgacacaccgaatttgaaccatttatttgttaaaaagctgattactttttccatttattttcctttccgctgtgcaaggcacatacgtttgatttacagcattacttattatattgtatactaaatcgccgcaaatttcaagacttatttcattatcggcagtatttcggtcttttttcatcattgcagagcctgccggttaaataaaaaggagcatcatttatgccccttcgctttattcggttattatcgccttttcgggtacaacagcggttctctttacaagaggctcgccacggacaacgatattcttttcatcgtcaaagccgaatttcttatacatacggcttaccccgtccgacatcggatgttcctgtctgaaagttacggctgacagctcctcaccgacctcaaactgcgccatagccgtaaccataagtcttgacgctataccaatacgcctgtagtcaggcgacacggcgatatgatctatcgttttgttcttcttcgaaaacataataaagcctgcgatattatttttgtgttctataacaaatatctcgccgcttgacattcttttctttataagccttgccattctttcggcattgtagtcagcaaaattctcactgcaaagctcagccagagccgttattttctccgcttcctcagcacaagggatgcgtggcagggtaagtgaaacataatcaaggtcaagtccgaacagaagtgcggtcgttttcatactttccctatccgttccggcaagccgtgattccttgtcacgcaaaaaaagattgcctatcccgtatgtcattattatagcaagctcttccgtgcttatcagcggctttgcaccgtattctatcagcacttcaataatctgctttatatacgggacggatatttcaagcgagcgatcacgaatatctctcagagtgctttcgtgcattttccctacaaattcattgcggaagcgttcagaagatgaaaataaagaaagcgaagaagctgaaacaaatattcccgtaaatgaagaaaaatctgacgaaaacacggataaatccgatactgacgataaacagcaaaattcatcagccggcagcacagacgatgaagcaagcaacgctgaaatcaacagcgataagtctgataattcagccgattccgaaattcccgacaaaaccgaaaatcacactgttgacgaaatactgcgcagctttgaaagcacttttatgagtgaagaggaagcagataaaaagatagaagatttttctaagtctgtttcagactcccgacctgcgcccgatttcaccgcaaagatacataatcataataacaaccaagataaaagcggaaaaacctgcggatgtgagcgatgccgctgtcagaacggcggtcgtatgcaggagaagggcgggcaaaaaccaaattgaaattcagcccgcagtaccgatatggatattataggcaagctgatgaaggacgacgacctgataaaggttgccgctgtagcgtttatcttatggcgtgaccacgccgactacaagctgatcctggtacttttttatgtatttttcatgaaatagcacttgcattttccgccgtcttagtttataataccagtatgtaaacgatgtcaatcaatttacaattccgacaaacaggaggtattttatggctaagtggttggaaaatgcaattttttacgagatatacccgcaatccttcaatgatacaaacggtgacggtatcggagattttcagggtataatcgaaaagctggactatatcaagaaaacaggcttcaacgcaatatggatgaacccctgctttgattcgccattcggtgatgcgggctatgatgtaagggactataaaaaagccgccgcaagatacggaacaaacgatgatttaaagcggcttttcgatgagtgccataagcgtgggatgcacattcttctcgaccttgtacccggtcacacttcggtagagcatgaatggttcaaaaagtcgatgctccccgaaagcaacgagtataccgacagatatatctggacaagcaatatatgggaacaaccggagggccttaactgtataagaggcatatcagaccgtgacggcagtgccgcagtcaacttcttctcatctcagcctgcgctgaactacggctatgccgagcctaagtatgcttaccagcaaaagcctacagatccgggacctatggcgacaagagccgcaatcaaggatgttatgaagttctggcttgatatgggctgtgacggtttcagagtggatatggcaggctcgcttgtaaaatgcgatcccgaatataaagaaacaatcaagctatggcaggatataacgggttatcttaaaagcgaatatcccgaagccgctatggtatctgagtggggcgagccgcaatattcgctgcagggcggctttgatatggacttcttactgcactttggtcctgagggctacaactcgatgttcagaagcgctgagccattcttttcaaagaggggcaaaggtactcccgcaatatttgccgagcagtacaacggctatcacgaaaaggcaacgacaggcggcggacttatctgcattccgtcaggcaatcacgatatggacagacttgcaagaggcagggatgaggacgagctgaaatgctgttttgctttccttctcacaatgcccggcgcaccgtttgtatactacggcgatgagatcggaatgaattttgtagaagggcttgtatcggtagagggcggctataaccgcaccggatcaagaagtcctatgcagtgggacagcaccgcaaatgacggattttcaactgcggacaagtcacagctttatataaagcaagatgacgcacccgacagacctactgtcgaaaagcagatgctcgatgaaaagtcgctctacaatgagataaaaaaactgataaagctaagaaacgaaaattccgcacttcataatctctcagcctttgagtttgtcagcagtgacggttatccgctggtatacaagagaagcagcgacaaacagacggtttatgtgttcatcaatccgtccgataaggtcgtaactgtcaatgcagattatgcaaagggcggaaaggcaatttacacgcttggtgaaaacggctctgttaaagcagatacagttaccgttcccgcaagcggtgcaatttttgttgaggtataattaatcatatataaatgcaaagccgcacagatcggatgtcccttctgtgcggcttttaattattcggtttttgcctgttctttttccttctgcgcctgctctttctttatcttggtactcttgataaccttctgacgtgagaattcctcacgttccttttcttcaagagagtttgagataaatctgacctgtgcctcgtacttcggaataattatattcttcagtgcgttggcacgtttctgcgtcttttttatagcaacggcgagcctgtatatactgttttcaatctcggcgagtacgactgtcagctttttggtttcattgaagcagatataagcgttgtcaagatatgaatttgtcattgcaatatcatactgcggaactataggcttatcgggaagctcaactgtaggaagctcaacgcccataacgcttctgaacgatattttaagatcggtttcttcaggtacaaactgcgtcagcgttgataccgagcccagcgtaatgttagccttctgtagggcggcataagccttttcataggtctgctcgatatttcctcgcaccagctttgatttatcggtcagcgccaccatttctcttatcagaacgttacgctttctgtccataagctcaaagccctgctttgcctgctgtaaggaacgtttagccttgataagattgcctttggtcgggaaaacctgttcagccatacactcacctgcctttcatatagtaactgttatacaaatctcttagcattttcggggtgataatgttcttttatgagctgttcgtttacacggtcaagctcgcttgcaggaagaagcgaaagcagatcccacgcaagatccagcgtttcgtccatagaacgattctcatcgaagccctgattgagaaaatacttttcaaacatcgtgccgaacttcataatcgccttatccgatgcggaaagttcgtcttcaccgataaccgatgcaagcgctcttgcatcctgcactcttgcatagcaagcaaaaagctggtttgaaacatcagcgtgatccgctcttgtgtactgttctcctataccgtccttcataagacgtgacagtgaaagcaatacggaaagtccgggataaattcctgtctggtcaaggtttctgtcaaacactatctgaccctccgtaatatatgccgtaaggtcggggatagggtgcgtaatatcatcgttaggcattgtaagtatcggtatctgcgtaacagagcctgtactgccctctactacacctgctctttcatacatagaggcaaggtcggaataaagataaccgggataaccctttcttccgggaatctctccctttgatgaagagaactcacgcagagcctcacagtatgaggtaaggtcggtcatgataacgagtatgtgcatattcttctcgaacgcaagatattccgccacagtaagcgcacatctgggtgtcaggatacgctctatgataggatcgttcgagagattaaggaacatacaaacacgctgtataacaccggtttcctcaaatgaacgtttgaaatactccgcaacgtcattctgaacgcccattgcggcaaatacaaccgcaaagtcctttccctcgctgtcggcaatcttagcctgctttactatctgcaccgccagcttgttatgcgacagaccggagcctgagaatataggcagtttctgacctctgataagcgtcataagtgcgtctattgaggaaatacccgtgtgtatatagtttctgggataagaacgtgcaacggggttcagtgcacggccgtttatgtcgccgtatttctgcggaaagacttcaccaagtccgtcaatcggcttgcctgcgccgttgaacgttctgccgagcatttcggtagaaagcggaatctcaagcggctttcccgtaaagctgatttttgtatttgtgagcgagatgccgtttgtaccctcaaacacctgcaagacaactttatcgccgtgcatttcaacgacacggcctaaacgctttgtgccatcctccagctttatctctgcaatttcatcataagaaacacctttggcaccctcaaggcagacaagcggtccgtttatttcactcagtcctgcatattgaatcataaaataatctcctatcgggtttaatcatcggcaaacttgctgtttatcatatcaaaatattcgtcaaacatttcgagcttgtcgttaggtatatcgtacttcatctttatcagtttatcgaagaaaccgtatgagataatctccgatatgggcttaccgccgttgatagcgttcagcgagttgtgataaagaagtaagattgctttcatcatcagcttctgcttttcaagcggaacgaatgtatcgtccttatggaaagcgttctgctgtaagaagcctactcttataacacgggcgatttctattatcagcttctggtcgtcaggcagaacatccgcacctatcagctttacaatctccataaggttgttttcctcaaccagtaaggtcgatatttcctgtctgtagcggcagaattcttcaccgacgtgttcgttgtaatactcggctaaatcatcgctgtactctgaatagctcatattccagttgatagccggatagtgtcttgcataggcaagattcttgtcgagtgcccagaagcaacggacgaaacgctttgtattctgcgttacaggctcagagaagtccgatccctgcggagatacggcgccgataatcgtaacactgccctctctgccgttcaacgtttcgacataacctgcacgctcgtagaattcggaaagtcttgacggaagatatgccgggaagccttcttcagcaggcatttcttcaagtcgtccggaaatttcacgcagtgcctccgcccagcgtgatgttgaatccgccattatagcaatatgatagcccatatcacgataatactcggcaagcgtgataccggtatatatagacgcttcacgggcggctacgggcatatttgaagtgttcgcaataagcaccgttctgtccgtcagcggacggttcgatttcgggtcgataagctcagagaattcctcaagcacctgagtcatctcgttgccacgctcaccgcaaccgatatacacaataatatccgcatcgcaccactttgcaagctgatgctgagtcattgtcttacctgtaccgaaaccgccgggtatagcggctgtaccgccctttgcaagcggtaacacggtatctactatacgctgtccggtaataagcggctttgagataggcagacgcttatttataggtcttggcgttctgataggccacttctgtacaagagtaagctcctgcaccgtttcttcgtctatcctgagttttactatcacatcgttgaccttatacttgccgtcagacgcaacatattctactgtaccctcagtataaggaggtaccatacatctgtgtgtaataagcggcgtttcgggacactgcgcatatatatctccgccgtgcagtttatcgccgacctttacagtcactgtgacatcaaattcacgttcttcatcgagtgcggctattgcactgccctcagtaacatatacgccgctgagagccgtcatagctttaagcggacgctggataccgtcataaatattggatattatgcccggtccgagcgttgcgctcataggtgttcctgtaggctctacggggtcgccgggcataagtcctgccgtaccctcgtaaacctgaatcgttgtcatttcatcggttacgccgattacctctcctatgagcctgctcttaccgaccattaccatctcacgcattgagaacgattttgtatccctgacctttacaacgggtccgttaatcgcataaatacagttcattgcaactcctcccgttatagtgacagttcgccgtgacctgacacaaaagcctttcgctcctgttctaaagcaaggtcaagcgtatagtcgatatatatattttccgacggatagtaaacagacaatccgccaagctcaatattacggtcaacagcaacaccgatgccgtacttctgcgctatatcatcggcaagctgtttatcgtttctgccgacatttattacgcagtctttgctgaaagcctgctctttgtctgctttttcggcaagagcggtcataaatccgctatatttatcgctctttgcaaattcttcaagtttattcttaatatcttcaaacaagctgtctacaagcccgcacctgtgagcaagcaccgacttatgtgcggcaaagtcgctctttgataattcctttgcgtaaagagtatgggtcttctgtctgtcgagtgcaacctcgttttcttcactgcgtctgtactgctctctcgcctgctctgtcagctcgtcagcctgctgctgtgccttgctgattatttcttccgcttttttctgagcatcggaaagaattgaattgcccagcttttctattctgtcctgaacttccggcatacagctgctcccttctgattaattatagtttcagtcctattgcatcacgcacatagccgtcaatggatttgcttatatccgatgttccgtgtcggtcgggtatctccactatcagaggctttgtgctgttcagtttcatatcatacactgtctgtttgcacatattgatgagcttttccgtcataagcacaacgccgatgtctttatcggcctttgctttctccagtgcgtccgtaacttcttcaggtcggcttactactatgccttcaatccctgcaagacgcatacccatctgtgtatctgtgttgtcactgataagaaaaaatttcatttttctgtacctttcggctattatgaataaaggataagtatcgaaatcagaagtccgtagatagcgacaccttcgccgagtgcaacgaagataagagccttcgtgaagttcttgtcgttttctgcggtagctccgatagctgcgggagcggcaccgcctacggcaatacctgtaccgattgttgcaagacccgttgcaagcgccgcaccgagatacttaagtccgtcgcctacgctgagtgctgtctgtgcggcttctgcggcaccttcagccgaagcaaatgcaaaaagcggtacaaatacgctcatcatgaccataacgccgataaacgagcctgcatttataagtatagcttttcttgtctttaaaggcttaccctcttttcttctcttaagcattacaaagaacggcagcataatcagtgccagtgcaaataaaggcagtaaaaacagtaacatttttcagttcctcccgaaattaattcaaattagccttaagcggctcaaagctctttccgtcgcttacatagaaacgaccgaatatctcataaaattcaagtcttaatacctgaatgcctacaaggaatccctccataccgattacgaaagcgtttccgagtatctgtacaatcacggtaccgacacctccgtcgcctgccagcactcctacgaccaacatcatacctgcgtggctaaggataaatccgcctacacggaggaatgacattgtgtttgtaagatatgaaagacaggtttcaaacagttcgatgacaccttcaataatgaagttgccgacagactttttctccttcggcttatccttatcgttctgaacaggtcttccgggtgatgtaagctctgcgggcatcttcatacgttcaaaataaaggcctgcgaatatatcatccaccatcgccctatgctgttttgatacaaaataaacgccgtagacgttatcgtcgttttcggtgataggaatgaacacaaattccttgtcggtaaagtatcccagcttgtcgtagctttcacggggcatctttccgtaaaccgcacggacaaatttcagatcgttcagcttttcgaggtcttctcttgtttttctgagcaattcttcgctcagcgtatcggaagccataattgccgcatcggcaaccgtcttatgctttaaattgacgacgttgcgttttatcgagtttgcgacaaggtgtgcaagaggctctttgaacatcataacaccgagcggcagtatcaccagaagaagtatatacggcaatgtgaacatctcgatgccgaatccgagctgaagtcctgccgccgctacgactgcgatatagaatatcataccggttatgccgtttgccccgaacagtgcggaggaataatccttgcgcctgaatgacagcacgatattcattgtcattgaaaccactatcaatatgacacctatcgcaagcgccgctataagcagataggttgaaatctggaatatgctgttcggttttccgagtacagagtaaagcggttcgatatggaagaaaggctttattatatcttcatttccgaacaccgatccgtaaaggcatccgaatatcgccgagcttatgccgatacgctccattatcggaccgagctttgctttcttccactttgtgagtataaatccgaaaagcgagattacaagcccttgtccgagatcgccgaacattatgccgaatatcagcatatacgttatagcgacatacggcgtcgggtcgatgcccgtgtatgacggtaagccatacatattgacgaacatctcaaacggtctgaacagccggttgtttctgagttttgtcggaggcttcatcctgtcatcgacgaaatacttcttttcctcgataacaatatcggatacgcccgacagatgctccctgaacttttctacttctcttgtcgggacaaaacccgccatatagaatttattgttgattaccgaaacctgacttctaagttcatagctgttgttaaggaaaatcagcttactgcgtaccttttcaaactgcgtttcttcatttttctttatgaccgcaagctcttcctttacatccttcagctttgtttccagctccttaagctgtctgttaagctctgcggcggctgtttctccgtcgccgtgaaggaagtccggtaaacgtatccgctcaaaataaaggcttctgaaaatatcgtctatctgtacgctttcttccaccggggcgaaataaagaccccagacataaccgtccttttcttcaagcggctcaaacacaaagcctttttcactgtagaaatcgagcttcgtatagctttccgacggcaatttgccaaaacgtattttgacgtgcttacagctgaacaaatccttgaaatcaacgtttagattcgacaggtttccgacctgccttaatacatggctgtattcgtctattgatttctcaagctcgttcttttgctctatgacaggcatcacacgctgttcaagctccgtgaaatacatatcgaagtcatggattgcctccatctgtatatcgtcatacgaaacggttttgttttttatcccaagcccgacggacaatacatctgctcgtttcataagaccgccgtaaatgtccttgtctttcagcgtcttgaaatgtgcggaaccgtaggtcatggtataaaatgacggctcaatgtgaaaacatttcgtttcgcaacatcgtacaagagttttattgacttttttgagaggtccgctgaccgatataagtgacatcttctcaactgccattatatcattcctttcgctgtatatttgctctataatatcagcattttttctatctgtgacggctcgagcgagtatcttacgccctctatcacagttgttaaatttctgttttcaatctgcaaaagctcagtcagtgaatatataaccgtgctgtcgcactgtgacaatgcgagctttgcgtcataataacgtttgtttgacgtatataccgccgtttcgatgtccgttgtctgctcctcgttaatatccttgaaataagggagcttcagcagaagcggcaatatcggctcgttatcggctttcgtcagtatctgttccattgtctttttatcgaatctgtcgcaaaaaggcagagtatgcgcaaccacatcttcggttgacattttgaaaagtcctttcagccgatagcatatcttgatattgtacatatcgcaacgtctgcggatacatttttctacttccgtgcgttcactgccggacatatccttttttatacgggaaaaaagcgtcgtataaagatattttgtaagctcataatcaacagaaacaatgggcggaaaagccttggttccgtcggaaagaggagcaagaacgtcataatacggcgtacccttcagaacatccagtatttcatcaaatgttcttgcttttgaaagtgcccgaatatcgtaagaacagatattcgtcagataacccggaaagcccggaatgaacagatcgtaaacgcctgcgccgatatacattgcggcattgatgatctgttttatttcctcctgtataagcagaaaatcatagaacttgtttttactgcccggacagaattttctcagctcgtcatatattctgaaaagacgtttttccatcagcctttcagtctgacttcgccttaccgtattgtcaaccgctgaaaaatcctcacagaaatcgccgtatgttttcagctgagccacgatctcaccgacatttgcctttgagatcaaggtcttatattcatcaagacccagaagcccgccgtacttggctcttgctttggcaatgaccgccgccgaacctgccgacatgaaatcacctccgaatacttatgctatgctgtcattcaaccgaaatgatatttttatatatctcgtctgtccatttatccctgttcttcgagaattcatcgtcaagacgcttaatgacagcgctgcactcggctgcagttgcagagcaatgttcttctccgctctttttaagctcatcgtgatagctgtttatcttgtcactgcgttcttcttcgcagacgatacgttctttttcacggagagccgccgcatcggaaagaatggcttcggcttttttgtttgcctgtgcaactatttcttcggcgtgcttctcataagcgataatctcgctgattacatccatcggaacaccacctttcagtaggcataaatctaaaatcataattaagtttactacaattattcacaaaaaacaagccaaattattaccaaaaagactttgaaaaatttgtatgataatatccttgacaagactttttcctgtcgaacgcaaatatcgacatattaaaaaaccgcaggatgccctgcggttcaatattagtttttaaggctctgtaagggtgcgggaatacgtccgcctcttgaaatgaattttgacgaggagaacttgctgagcttcattaccggaccgcttccgaacagaccgccgaactcaagcgtgtcgccttccttcattcctattgcgggaattacacggactgccgttgtctttgagtttaccatacctatagcggcttcgtctgcgatgattgccgagatcgtatcggcggatgtatcgccgggaacggctatcatatcaagaccgacagagcaaacggctgtcatagcttcgagtttttctattgataatgcgccacggtttacagcgtctatcatacctgcatcctctgatacggggataaatctgccatctatatccctccctttgccaaatggcacaggttataactcatacaaattttataaagatgtatgctagtattatacaatatcgtgccgactttgtcaatacatttttgaaaatttcgtaaaaattcttgcagattattccgattttcaatcaagaaactgctttacatcaacttcctcagcgtcctgccagagcctttcaaggtcgtagaaatccctcgtttccttatagaaaacgtggaaaacaacatctatatagtcaagcactatccagttaccgcttgccttgccgtctatggacttaggctcctcgcccttttcaccgagcttaaaatcgacctcgtctgcaagtgcctttacctgcgtagagcttgaaccgcttactattacaaaataattagcaagtatcgtaaggtcacgcaccttgaggatttttatatcatctgcctttttagaatcgagagcctttatgccctccttcagaatctctatatcagtcattcttcggatttttcctttctgctgtgcttttttcagccttcattatccttgtgtagaaattatatcccgctatcgtacacggcggtataagtccgcccttacccagcgtttcgcctattgaatattttaacgcattgtacatagcgttgtcaagattctcaaagctcatctcccgatatttttcaacatccttatagcttctgtccgcacttgtgagatctcctaagtaaacgatcttttcaagcatcgacatatccgccctgcctgccgtgtgataacgcaccgcattcagaatatcaatatcctttataccgagatttttcgatatgtgatatgcacctgccggagcgtgccacagtgccggagtataaagctcctcgtcgctcacgtccatattgctcagtatcgcctgcgatttcattgcgttaggagtttcctccttctttatatcgtgaagaagccctgcgagatatgccttttcctcgtcaccgccgtgctttttcgcaagtgccaggcacattgacgcaacattcatactgtgcgtaaaacgcttctttgagagcgtatttttcagcattttcacatagtccgcatatttttcggcataacgctgttcgtccttatccagcttttcacacatacagaccacgttcctttatatagccttcaaccgcttcgggtacaagccctgttatactttcaccgtttttcagcttctctctgatttcggtagaactaacctcggtgacgtgaagattcagcacctttatcctgcccatttctgcggcatattcacacatatcgctgtattcgctgttttctcttgcggcggcaaccaccttgcactcgcccagaagcgcctcatagcgataccacttgtcaaaatagaacagcatatctccgccgattatcagatagaacacagcatcgtcggggtactgtcttttaagctcacggatagtgtttatcgtgtagcttgtaccgcccatgcgcttttcaatatcacttatctcaaacttgccgcttgctatttcgtctgcaaaggcaagctcgcacatcttagccctgtcctcaaaagcgataagccccttgttgctcttgtgaggcgatacgcaggtaggtattatcagcattttctgaagtttaaggtcggcgaaagcctctttcaccatatttatatgtccgttgtgaacggggttgaaagcaccgccgaatacgcctatcttaatcatctaattctatcttccttttcttagcgtccttgttctgcctgtaaagaactatcttagtgcctattacctgcacaacaatgctgtctgtcctttcgcctatctcgcctgcaagctcctttgcactgtatccgcagttttcaagaactcttatctttataagctcccttgcctccagtgcgtccgaaagctgttttataagctcgtccgaaattgcgttctttcctatctgaaagatagtgtcgtagttacttgcaatgctcttgagccttgctctttgtctgcttgttatctccatttacttttctccgtttcttttatctcataaagaaataccatatcgcaaatacagcgccaaactgcagaataattatgaccggtatccctatcatgaatctcttatgctttgtcttatgatgaaatatcctcatcgaaatatacatagcgaccgagccgccgagtgcggatacgataaagagcgtcctttcccttatccgccatttgtttttccttgctttgctcttatccacaggcggcagtataaacccgattatgcttattattatcaggtatgccgctgtcagaatatagggtaaatcttttatatccattacttcttgctaagttcagccgccagcttttcaagcgctttcgccctgtggcttatcctgttcttttcctcgtccgtaaggcaagccatgcttgtatcatcgtctatcatgaatatcgggtcatagccgaagccgttttcgcctataggctcctccccgataaagccctcgcattcacccgtaacgcatatctcataatcgtcatcacggataaagtataaggcacacacgaatttagcgtttctcagcggcttgtcaacgcccttcagttcaccgagtaccttgtttatcctgtcctcgttcgttgcgttctcgcctgcgtatcttgccgaatagatgcccggcgcaccgcctaagaattctatcgaaagtccgctgtcgtccgcaagcacaggcgtatgcgtcatatcatatatagtcttcgcctttatatgagcgttctcgctgaaggtcgttccgtcctccgctatatcgatattgattcccgcttccctcatcgaaacaggctcatatcccagaggtgtcagcatttttttgaattcttttatcttgccctcgttgtttgaggcaataatcagtttcatatattgtcctttcgtatacaggctgtcattcaaacagcgcttcaacataatcccgtggtacaaacggttgcagatcgtctatcttctctcccacgccgactagcttcacaggtataccaagctcctcttttctaggtattattataccaccttttgccgttccgtcaagctttgtaagaacgatacccgttatatcagccgtttccttgaacagccttgcctgatttaccgcattctgtcccgttgtagcgtcaagcacgagcagagtttcaacacggctgtcgggcgcattgttgtttactattctcgctatcttcttaagttcgtccataaggttcttcttgttgtgaagtctgcccgcagtatcgcatataataacgtccgcatctcttgcaatgcctgcctttacagcgtcaaacacaacagccgcagggtcacttccctccgagtgctttataatatcaactccggcacgctgtgtccacacctcaagctgttcgatagcagccgcacggaacgtatccgccgccgcaacgacaaccttcttgccgctgcttttaaggttatatgcgagctttcctatagtggtagtcttgcctgcgccgtttacgcctataacaagtattactgtcggctttgtatcaaggataagttcgttttcaccctcaagtatcccggcgattatcttctttaacagccccttcacttccgcagggtcggtagtacctgtagcctttacctcttttcttaaagcctcgcagatatttgcgcttgtcacagcgcctatgtccgataagataagcgtttcttcaagctcctcgaaaaaatcctcgtcaattttcgtgaacgagttaataactcccgttatcttgcttgcaagagcatcttttgtattctttaagccgtttttcagtttttcaaataatcccattgaaaaattttctcctactttatatattcaaccagcttttccaaagcctcatcggcatttaccgtacagtccgggataagcggttcttcacttttgtttatatccacacggtagaattttttgtatgatacactcagcacaagcttcgattccggaagctgaaagctcagcttgtcgccgtatgcggtcggcatatttcccggtatttcgcctatcacctttcctatgccgttatcctgtatcaccgttgcaaagtccattgccgagctgaacgtgtattgcgatgtcagcacatacaccttgccgtcaaaagcgttgtctacaggcttgttcggcgttatctcatcacggtacgagatcagatttccgccgtttcttatatccgttccgccgaacagcttatagtcgcttatatttatatatctcagaaattcgtttatgacctctgttgttccgcctccgttgcttcttaaatcaacggcgatatttccgatattgttatctcttaccgcactgaaaaattctaacaacctatcggtgtattcctgtgacatttcacaacggttgagtgtgaaaatgccgagcgaattctccttgtcgatcttatatgagcatagctcaagctgttttctttcgggcggctcgtccgtcatatcaaaatgctttgtttctttattaacgccgaaaacaacatctatcccgtcggatacatccgcaccgagaagtgtaagccagctgccgtactccagagcctcgccgaacatatagtccgcatagaagctgacctgcggctcgcacgggaacacctttttgaaatgctccttcatactgtccgccgatatgccgtcaattgataagagtgttccgtttttgtatgccgtacttatctcgtttccgccgtttacatactccgtaccggatgcggtaactatagtgtgtgcgtcgtcaagtgtgcagacaagctcggcagatttctcccacagttcatttaccgtcacgctgtccttatccatcagttctctgcgcagctttatgtatacgtcgccgaatcttttctccgcaccgtcgtcaataagaaacaccggatgttttgccctcaccgtgtcatatacatattttaagtccttttgtgcctgctctgagctaagtccggtatcaagcggcagtgtcggctcaaaatcagtctgtgcgtcataaccgcagattttaagcactataccgcctaccgcaagaataacggcaagcaataaagctgttactctcaatttgttcattttctaccccgatatttcatatacaatatacgatttccttatgcaatttcctttatgcgttttcgacctcgtttaaaaattcctcgctgaattcctgccttaacagtccggatacgcccttttcctgcatataaacgccatacagcacatcgcacagttcaatcgtacctctcctgtgcgttattaccataagctgagtgttatgcgagaaacgcttaagatatgtagcgtacttctgtacgtttgcctcgtcaagcgccgcatcgacctcatcaagcatacagaacggtgtcggtctgtgaagcagtatcgcaagatagatagtcagcgctaccatcgacttttcaccgcccgaaagaagcgacaggctctttattacctttcccggaggtgcggcatatatctcaacatcggagttcaacacatcgtccgggtctgacagctgaagccttgcttcaccaccgccgaatatctcgctgaacagcattccgaaatggtgatttatatcgtcaaagctctccgtgaacctctgctttatatcctttataagatctgcaataaggctttcaagctccgtcttggatgtttcaacatcctttagctgttttgcaagaacgccgtaacgctccgacacctcctccagttcttctatagagctgtagtttacgcttcccagcgccgcaatgcttctctttatctcggcaagctccgccttaagcatgaatatgcctgcgtcatctacaggcttcgcacgttcctttgcctcactgcgtgtcatctcgtacttgtcccacagtcccgagattatcttctcggtctgaccttccgccgagcctttacgttcttcctgtctggcaagatcagcactgaacttttctttcgcctcggtaagttcccttatcgacttgtttatctcgctgatacgcttttcagccgcatttgtgagcgatacgttatctgcgattgccttttcgttgtcgcctgccgtttttgctatttcttcggtctgagccgttttcagaattatgatttcattcttctgctcaatgccgtttttaagctcctcaatttttcttagctgttcgcttccgccgtcgctcagcgcaaggatagatgcgtctataccctctatccttgtgcggatgttggatatatcgccgtttaccgtcagaacgtccatattattcctttgtatcctgtcggctatctcttttctcttatcctccgccttgtcaagtccgcttctctgctcgctcagagcctcctcgttcttttcgatttcggcaagcacgctttcaagctgtgactttgtatcgctaagtagcttcctgccgtcattctcggctctttcctgtgcgtcaagctgttcctcggcactgtcacgctgtgcggtaagctgtgacagaagctgctttataccgtcacgctgtgcctcaagtcttgctatcttaggctcgcactgcgatacggtttcggaaaagccctccatttcctccgccatctttgcgacttccgcctgcaagggctttagctgttcgctctcggcttttatcttctcaccgagttcttcaatctgttcggataataaagcaagctcctgctttcttgcgattatgcctgcgtcatttctgacactgcctcccgtgaacgaaccgcctgcgttgatgacctgaccgtcaagcgtcactattttgaaacggtatccgtacttcttcgcaataaacgatgccgtatcaatatcctcaacgaccgccgtctttccgagtatggattttactatcccgtcatacagcccgtcatattccacaaggtcgcacgccataccctcaaagccgttctcattactcagccctccgacttcgagcatctttccctttacgcttgtaagaggtaagaatgtcgcacgtccgaggttgttttccttaagataacgcatactgcgctttgccgcttcctcgttgtcggtaacgatattctgcattataccgcccagtgctatctcaatagccaccgtataacgcttgtccacgctgattatatcggctaccgtacctcttataccgctgagccgtccttgcctgtccgccattattaccgactttacgcttgactggaagcccgccatattcttgtctatctcgtcaagcacctgatgacgtgacgctttcgtttcgtactccttgcgtagcgtttcaagcgtctgacctgccgttttcagcttgtcattcttattggcaaacagctttttatatcctgtcagcttgttctcggcttcggccttttcttcctttgcctgttcaagctcttcatcggtatcgctgagctttattctctgcgtctttgcttctgccgccgcattctcagccgttcttgtaagttcctccttacgctttgaaagctgttcggaggttgcctctatctgctgtaccgaaagctgcagctgcgttcttttaagatacagccgaccctgcttttcgtcaagctccttatactcccccgagagcgtttcgccctctgcgtcgattcccgtcagttcctctgtcagccgttcgctgtccgcattcagccgacctataagagcctgcttttcctctatctcgttttcaaggttctttttatcttcttcaagccttgccttgccgctcttgccatcctctatctgcttttcggtttccgcaatagcttcttctgcatgtgaaatatcgttgtgcagtacggcaatctcagcctttatatcgcttatgcggtcccttgcctcgtcgcttccggctttcagcttttcaagctcggcacggagcgtcattctgcggttgttgttgtcttcttcctcagcctccagctttgcaatatccctgtcgagattttcgcactccgccttgctgagaagtaatttgtcctccgcttccgaaattgtcttttcaagtgcggacaattcgtacatacttaccgttatatcaagatcttcttccctcgaaagcagttccttcgcctttttagcctttgccgcctgcttttcgagcacagggagtcttgtttcaagttccgacgctatatcacggatacggagcagattgtcctccgtgcgcttcagcttgttctctgcgtcctttttctgcgctaagaatttcgatacgactgccgcttcttcaaaaacctcacggcgcttgcttccgcccgattctactatctccgacaccttgccctgacctataacgctgtatccgtcacggccaagacccgtacccatgaacagttcgtttatattcttgagcagtgtctttgctccgtttatcttatattccgattcgccgctcctgtacagcttacgggatattaccacctcgtcactgtctaccctgagcgccctgtcacagttatctatagtcagcgttacacttgcaaagcccatcggctttctgcgtacagttccgtgaaagataacatcctccattttatctccacgcagacttttagcgccctgctctcccattacccagcgcagtgcgtcacttatattacttttaccgttgccgttacttccgacaacagcggtcattctcttgtcaaaatgcagtatggtcttatcgggaaacgatttgaacccgtatatttccatagatttaaaaaacatcaaccgatcctctccgcacggaaatccgtgcctttctcttcctttatcttaaaggaaattccacgctgtgaaagcgcattgcggttagctccgccctgcccgattatcttgcttatattacgcttgtccgtgtaaaagacgtattttcccccgtcctcgcacacagcgttcatcttttccagatacaatatgctctcggctatctcacgcagtgccgggtgatatactccgccgatcatttcctgctcaacatcacggcttgcgtgaagccccatacggataactgcgacccctgccttgttaaacatatcgagcagttttgcacagagccttgttgtctgttcaaaggtaaagctgtcatacactccgctctcgtgcagtctgccaagctcggtattcttaagtatcaccgtcggatatatcctcaccgtgtcgcagtggagtgcgataaactcctttgcggtatcaatgcagtattgctccgtgtccttatacagccccgtcatcatctgaagcccgagttcaaatccgctctgctttataagccgtgaggcacgtcttacatcctgtgccgtatggcctctgcggttagctgtcagcacctcgtcgttcatactctgcgcaccaagctctatcgccgtcatgccgtagcttttaagaatgccgagtatttcctcgtcaatgcagtccggtcttgtcgaacagcgtataccgtcatactgctcgggatatgcgtctgtataacgcttggctaccgtcagcagtcttatcatataatccctgtctattgcggtaaagctgccgccgaaaaacgctatctgcgcctttgtaccgctgtctttaagattttcgagctgtccctcaagtatgctttcaagctccttttcagtgacaggctcgctgtgtccgcttatcgttttctgattgcagaagctgcatatatgcgtacagccgtaatgcggtataaataccgaaatgttagtttgtttcatatcccataaggcttatagcctcttttgcggcgctctgctccgcttccttcttgctcttacccttacccgtgcctattatctgaccgttcagaagcacattcgccgtaaactgcttgttatgtgcctgtccgctttcgtcacttatctcataggtaacacgttcctccgggttctgctggattatctcctgcaataccgtcttgtaatctccgagcaggaatttacccgtgctcagcttgtcaagcggcggtataaacggcagtatgaaattccttgccgcttcaaatccgccgtcaagatatatcgccgcaataagcgcctcaaatgcgtccgccagtatcgagtggcgatctctgccgcccgtatgttcttctccttttcccagaaaaatatacttgcctaaatctatttttcttgcaaagggataaagcgcattttcacacactacgcttgctcttatcttggtaagctgtccttctggcagattagtaagattttcaaagagatgctcggacacaacaatgctcagcacgctgtcgcctaaaaattcaaggcgctcgttactgcgcagatgttttccgtttgtgtatgacgaatgagtaagagcctcttttaaaagctcgggatttttaaacgtatagcctattatctgttcaagctctgtcattagaatacctttctttatagttgcaccgtagcaattaatactaagtgcttttttactatccccaccccaacccctccccgtgggaggggcttatatatgatgggggctaccgccattagcacaagcaaggatgcttgcagtcagccgcacatagccactgcacgatgcagtggcacaaacggctgacgacccgtacaggggcttcgccccttgaccccttgtgcgaggctgttcttctttatgctgtcaaatgatattaatcaaccttccgtattttccgacagcaccttttccatctctgcgataacgtttctctcaacgaaatccttggcctgtcttacggcattcttgaacgcaagagcgtcactgctgccgtgcgccttaagtacaggctttgccgtacctaaaagcggagaaccgcctgtttccctgtagtccatctgcttgcttatttccttgatgcccttcatagtaaacattgcgcctatctttgtaccgaggttgcggaagaatatcttcttgagcgaagccttcataaacttgcccataccctctactgttttaaggtagatgttacccgtaaagccgtccgttacaacaacgtcaacctcgcctaaagccgcatttctcgcctcaacattgcccgtgaaattaagcgtgctgtttttgagcagagcataagtttcctgttcaagctccctgcccttttcttcttctgcaccgacattcagcagtccgaccttgggactagcaacacccattatcttgttcatataaacactgcccataaccgcaaactgccttaacatatccggacggcaatcaacgtttgcaccgccgtcaagcagtatatacatattattaagaccgggcattacaggtgtcagcgacggacgctttacgccctttatacgctttactataagagtaccgcccataacaagagccgccgtactgcctgcgcttatcatagcgtccgctctgccgtcagctaccatctgcatagccacgcccatagagcagttcttcttttcctttaatatcatctttgggttatcctctatctcgataactccgtcagcctgctcaaatgtgatatgatcctttgaaagtccaagtctttcaaagcactcgtcgagcttctttgtgtcacccgtcagcacaatgtcaactccgtactcctttacagcgtcaaccgcaccctttactacctcgtccggcgcattatctccgccgaatgcgtctatagctattttcataatcggttttcctttcggataaactccggtacttatcgctttgcctaattatccgggtctgtattttgtatcatcgacaacaaaggttctgacggattttatacagcttgaaaaagagcttaaccgtgaggatttccgctttgttgtacctgatttcagacttaacaaggcttttgacaagctgggtacgcttaccgaaaggcagaaaagcaagttagaatttctttgcaacgaatgctgttatttcggttgtaccgacaggaaaagctgttatgaaaatgtcagccgtaaaagtctatgtgaggattgcgaggattttatatgccgttctcccggcggcaacgaggggtacaagttttcaaaggctatggaaaaccctgcgtttatcggaacggacgatattgaaaacacctatctgccgatggggttcaatcagttcaaaatagagggcagggggcttggcagtgcggtagtgcttgaatttctgctgtactatatgacaaagccggaataccggctgaaagtaagagaagaaatatatcttgacagtatgcttgatcttttctgataaagcgttaaacggaggattttaatgctatacataatgcgacacggtaaaaccgagtggaataaaaagaaaaaattgcagggcaggacggatattccgctgtgccatgagggaatagaaatggcggaaaaggcacgggaggaatataaggacgtgcatcttgatatttgctactgctcgccgcttatccgtgcaaggacaacagccgagatattgctcgagggcagaaatgtgccgatagtaactgacgacaggctgaaggaaatgtgcttcggggaatatgagggtatcgagaacagcttcagtattcccgactgtccgataaacttactgtttttccaccctgagcagtatacaagctctataggcggggcggaaacatttgaggagctgttcggcaggacaggtgaatttcttgacgaggtaatctatccgcagataaaagagggcaaggatattctgatagtcggacacggtgcgatgaatgcaagcattgtgtgccggataaagaacctgccgctgtctgagttctggagcgcagggcttgagcaatgcaagatgatgaggctcttgtaagaagatatattagcaaatacgattctttgtgggaatatatcgggaagtgctgcgagcgtgaaattacgctgacttacgatgagatagcaaaaatctgcggtgtgccgatagatcattcctttctgacgtataagaaagaacttggatgctacgggtacagggctgagaaaatatctatgaaggataagacggtgaggtttgtcagaaatgagtgaaaatatgagcgataagtgggtcgattacgctgtgcgtattcagagcattgcacaggcaggacttgcgtactgcgaggataagtacggcagggagcgctatgaggagctgagaaaaatctccgcagagatgatctcggcaaagaccgatattccgctcgaaaaggtatacgatctgttctgcaacgagagcggataccagacgccgaagctcgataccagaggggctgtctttattgacggaaagatactgcttgtgcgtgaaaacaacggaacgtggtcgctgccgggcggatggtgcgatgtagatctgtcggttgcagagaatacagaaaaagaggtgctggaggaaacggggctttcggtacactgcaaaaagctgattgccgtgcaggactggaggaggcataacaggctgaattgcccttacggcattatgaaattctttgtgctgtgcgaatatgacagcggagagttcaaagagaatatcgaaactacagaaacaaggctgtttgacaggaacgctctgccggataatcttgcggatgagaaaacaacggcggagcagataaggctgtgctttgagtattatgacaatccgcataaggaaacgtgtctggaataatataaagacggtttaaccgcctgcggctttccttcataaactggcaataagcgagagaatgaaggaggcgtttatgtgagaagtctggcacagcttgaaagagatgaaaaatgcagggtagaacggctgttacttgcaggagatatgaaaagaaggcttatggatctcggctttacaaaaggaacaacagtcacctgcgtgttgtgcggtagcggaataaaggcatatcttgtaagaggtgcggtaattgcactcagaaacgaggacgcagataaagtaccggtaagtgaaataaaaaactaaaaaaatttcgtaaacttgtagacaaacggcagaaaatatagtataataaaatgactatggaaataggcgagggtgtgcgatacagatattagcatatctttcgtaaaatgggatcttttatctgctgagggcggatatgaattaaagccgtgtttttcatcgtcaaggaagaaagacacggcttttgtgcagaattgcgaggtactataatgacaattttactgaaaaacggtcacgttgttgattatgtgaacggttttgaaggcaaaaaggacatacttataaaggacggctttatccgtgcgctcggcgataaccttgaatgcgatgataagaacgcaagggtggtagattgcaacgggcttacggtaataccgggcatatgcgatatgcacgttcatctgagagatcccggacagacatataaagaggatattattacaggctgtgaggcggctgtcgcaggcggtgttacggcgcttgcgtgtatgccgaacacgaaaccgcccgttgacaacaaggaaacggtaaaatatattctcgacaaggcaaagaaagcaaaggcgaaggtttatcctgtcggctgtatcacaaagggtatgcagggcaaggaactgtgcgactatgacgaacttaaggcggcaggctgtgttgcggtgagcgacgacggcagacccgttgaatctgcgaatatgatggcgcaggcaatggtaaaggctcactatgccggactgaaggtcatttcgcactgcgaggatcttgagataatagacggcggtataatcaacaagggaaagatctctcagcagctcggcgtaaagggtatgagcaggctgagcgaggatataatcacggcaagagagcttgccatagcacaggatacgcagatgccgatacacattgcgcacgtttcgacaaagggcagtgtgaacacgataagaggaaatacccatatcggtgttatgtgtacctgcgaaaccgctccgcactactttatgatgacagacgaaaagctgttgtcgagagatgcggactacagaatgaatcctccgcttcgtgaggaggacgatgttatggcgataaccgccgctgttgcggacggtactatcgactgcatagtaaccgaccacgctccgcacagcgcagaggaaaaagcggactttgagaaagctcccaacggcgttgtgggaatggaaacatcgcttgcggcgacactgacgggactttatcacacgggtacaataagccttatgcacatagtaagacttatgtgcgttaaccccagaaagatactgggaattgagggaggctcgctcggcatagacgatattgcggacattgcaatattcgacgctgacgaaagctggacggtagaccccgaaaagctccactcaaagtcaaagaacacctgcttcaagggaatgactcttaagggcagggtaaagtacacactggtaaacggaaaaatagtatacgaggacaagtaagctccgatatacttgaaataaataaaaaggatggatacgaaaatgtcaatggataatcttcttcgtgcaatctgcgaaaagcagaaccccacagtcgcaggacttgatcccaagctcgactatgtgcctcagtacataaaggacaaggctttcaacaagtacggcgaaacgctcaagggtgcggcaaaggcgatacttgaattcaacaagtgccttatagacgctctccacgaggtagttcctgcaataaagcctcaggcggcttattatgaaatgtacggtacggcaggaatgaaaacgctgtacaagacgcaggaatatgcaagaagcagaggtatgtatgttatcacagacggcaagcgtaacgatataggcacaactatggaagcgtatgccgcagcgcatctgggcaaggtaaaggtaggaaacgaggaatacgagccttttatgggcgacgctctgacggtaaacggatacctcggaagcgacggtatcaatcctcttataaaggtgtgcaaagaaaacgacaagggcattttcgtactggtaaagacatctaatccgtcaagcggcgagcttcaggatctgctgatagacggtgttcccgtatatgaaagaatgggcaatatgtgtgaaaagtggggagaggagctccccggcaaatacggctattcgggcgtaggtgcagtagtaggtgcgacatatcccgaacagatcgccgagcttcgtaaaaagctccctcacacattcttccttatccccggatacggcgcacagggtgcaacagccaaggacattgccgccgcatttgatgcgaacggtctcggcggtatagtaaacagctcaagaggaataatgacagcgtataaaaaagaaggctgtgacgagcatgatttcgcaggtgcggcattcagagaggcactgcgtatgagagatgagataatgggctttgtaggaaagatacagctcccttaagtgatagaacaaaaagaaaaatatatgaaaggaacgaattaaatggacttaaaggctaacaaagcaaagaccgcatatctgatacttgcagacggaacggtgttcacgggcaagagcttcggctgtgagggcgaggtcgtaggcgagatagtttttacaacggcaatgacaggctatgaagaaactctgacagacccaagctactgcggacagatcgtaacgcagacattccctcttatcggaaactacggtgtaaatgacgaggattacgagtcaaagacaagcgtggtaagcggttatatcgtgcgtgaatactgcgaggtaccgtcaaacttccgctgtgaaggcgacatagacggctttctgaaaaagcacaacatcatcggactgttcggcatagatacaagaaggcttacaagaataatccgtgaaacaggtgttatgaacggcatgatcacaacaagcgagccgacagacgaattcaaggcacaggcacttgaaagaataagggcttatgttgtaggtcctgttgtgccgaaggtaagcgtaaagcagcctgagaagttcagtgccgaaaacggcaaatacaaggttgcgcttatggactacggctataagttcaatataagacgtgagcttgtaaagagaggctgtgacgtgacggtattcccctacgacacaagcgcagaggaaatactgaaatttgctccggacggcataatgctttcaaacggaccgggcgaccctcaggacaacacggtatccataaatacgctgaaggagcttatccctcacaagatacctacgtttggcatctgcctcggtcatcagctcttagcgcttgcaaacggtgcgacaactgtcaagctgaaatacggtcacagaggcggaaaccagcctgtaaccgatgttactgttgacagaacattcatcacatcgcagaaccacggttatgcggtcgtaagcgacagccttcccgaaagtgcaggcaaggtaagccatatcaacggaaacgataagacctgtgagggcgttatgtacacgaatgcacctgcgttcactgtgcagttccaccctgaagcgtgcggaggtccgcatgacactgcgtatctgttcgataaatttatcagtctgatggaggagaataagaaatgccgttaagaagtgatataaagaaagttctcgttataggctcgggtcctatcgtaatcggacaggctgctgaatttgactatgcgggaacgcaggcgtgccgtgcgcttaaagcggagggtcttgaggtcgtacttataaactcaaaccccgctaccatcatgacggacaagcatatggcggacaagatatatattgaaccgctgacgcttgatgtagtaaagaagataatcaagatagaaaagcctgacagcattctgtcaacgctcggcggtcagacgggtcttaccctttcaatgcagcttgctgaggagggcttccttgccgagaacggtgtaaagctgctcggcgcaaatcccgaaactatccacaaggcagaggatagacaggcgttcaaggatactatggaggctataggcgagccgtgtattccctcaaaggtagttgaaaccgttgaggacgctttggattttgccgaggttatacactatcccgtaattgtacgtcctgcgttcacgctcggcggtacaggcggcggtattgcatatagcaaggatgaattgcacgagattgcaacaaacggtctgcgtctttcgcctatcacacagatacttgttgaaaagtgtatttcgggctggaaggaaatcgagttcgaggttatccgtgacgcaaagggcaacgttatcaccgtctgctcgatggaaaacttcgaccctgtcggtgttcacacaggcgacagtatcgttatcgctcctgcggttacgcttgcagacaaggaatatcagatgctgagaacagcggcactgaacattattcaggcgctgaaggtcgagggcggctgtaactgtcagtttgcattaaagcccgacagctttgaatactcggtaatcgaggtaaaccccagagtttcacgttcatcggcgcttgcatcaaaggctacaggctatcctatagcaaaggttgcaacaaagatagcgataggatattcgctcgatgagattgtaaaccaggtaacaggcaagacctacgcttgctttgagcctgcgcttgactacgttgtagtaaagttcccgaagtggccgtttgacaagttcgtatacgcaaagaaaacgctcggcactcagatgaaggctacaggcgagataatggctatcggaacgagctttgaagaagctatgatgaaggctgtacgttcaatagagcttggtatggacacgatgcgtaaaaaggctttcaagaagctgacagacgaagaagtaagagcaaagctccatgatgtcgatgttgaccgttcgttctgcgtattcgaggcgctgagaagaggtttcagcgttcaggagatacatgatataaccactatcgacaagtggtttataaccaagcttaaaaaccttgcagagcttgagctgtggcttgaggacggcgagcttacgcaggagaaatacgaccttgcgaagaagtacagctaccttgacaggactatcgagaagctgtcgggtcagaagctggctgacaagggcataaagacacgtcacgcagtatacaagatggttgatacctgtgccgcagagttctcggctgaaacgccctacttctacagcacttatgacgatgaaaacgaggctgcagaatttatcgagcagcaccctacagataaaaagaagataatagttttcggctcaggtcctatcagaataggtcagggtatcgagttcgactactgctcggtacactgcgtatgggcgctcaaggaaatgggctatgaagcaattatctgcaacaataaccccgaaacagtttcgaccgactttgatacgggcgacagactgtatttcgatccgctgacatttgaagatgttgactcgctgatagctaccgaaaagccttacggcgttgtagtacagttcggcggtcagacggctataaagctgacaaagcacttacaggagagcggtgtcagaatactcggtacttcggctgaaagcattgatgacgcagaggacagagagaagtttgacgagctgctcgaaaagtgtaaaattcctcgtcctaagggacatacggtattcacgaccgaggaagcactcaaagccgcaaacgagcttggctatcctgttctgctccgtccgtcatacgttctgggcggtcagaatatgataattgctcactgtgacagcgatgttaccgaatatatgactatcatcacggctacagagcttgaaaaccctgtgctgatagataagtatcttatgggtactgaggtcgaggttgacgctatctgcgacggcactgacttccttatccccggtattatggagcatatcgagcgtgccggcgttcactcgggcgacagtatctcggtatatcctgctcagacattatccgacaagataaagagcacgatagtgacatatacggagcgtcttgcaaaggcactgaacgtaatcggacttgtaaatatccagtatgttgtatataacaacgaggtttacgttatcgaggtaaacccgagatcatcaagaaccgttccttatatcagcaaggttacaggcgttcagatggttgatattgcaacaaagataatgctcggcgaaactctcaaggagcagggttatcacagcggactttatcccgttggcaactatgttgcggttaaggttcccgtattcagctttgaaaagctccacgatgttgatacacagctcggtcctgagatgaagtcaaccggcgaggcactcggtatagcaaagacatttgaggaagctctctacaagggacttatagcggcaggcttcaagatattcaagaagggcggagtaatgttcaccgtcaagaattcggacaagcccgagatagtaccgctggcggagaagtttgaaaagctcggctttgagctgtacgctacaagcggtacggcatccatgctgaacagaaatatgatagctacaaactttacctatcgtatacacgaggacaaggagcctaacgtaataagcctgcttgaaagcggcaagataaattacgttatctcaacgtccgaaacaggcagaaagcctgcactcgacagcgttaagataagacgtaagtcggttgagcgttctatcgcttgtcttacatctgtcgatacggcaaatgctcttgtaaagtgtatcgctatggacaagactgtagacgatcttgaaatggtagatataacaaagatataatgaggtgcgattttgagaacaggcgaatataaagtaaaattcaattacacgatattgaggggatttatagacgctttcggtcttataatggcggtacttttgtatcagacaacatacgcatactattatcagatggcgcatccgacaatggtgctgaataatgtttatcctgacggcttacctgcatatatgtggatatgtggaggcatagtgccttttatcgcacttgcggcattcgtgttctcgatagtgtatatgtttatacctcataggtcaaggacgcttgtaatcacggctgacaatgcacagaagtattacgacaatctgatgataacaaacagcttgctgagaatacttgtgcttatggcactgtgggattacacttatataacacagagcaaccttatgggagctatggaatcgtggttcagccttcagacagtgcttgacattatagttgggtcgcttgttgtatactttatgtacggcaggctgaaggcgatagcgaagcctgcagacaggaagaagggcaacgtgataaagccgaagcaaagcgaaagcgatgatgaagcgcttacagcaaaggtgaaaattgtcaaggatgacaatacaataatgcgcagttgattatgcaacaaggaagcaaggcaacatgataaaataacgtgttgccttgatttttacacagcggcaaaaccgcaggaaaggaaaatatatgagctttttttgtgattcatatccgatagttgataaaaaagcgctcggcgaggggatatattcatatacgctgaaatgtcccgaggttgccgaaaacgcacatatcggacagttcgttcagataaaggcggagggatatatgctccgcagacctatctctatatgctcggtcgataaggaaaacggcactatgagactcgtttttgaagtaaggggcaagggtacggataagatctctgagcttaacaagggggatcttatggacgttatcgctccgctcggcaacggctttaccgttcctgcaaagaaggacggcagggtgatagttgtaggcggcggaataggcacgcctcccttgcttgacattgcaaagatgtacggcgacagatgtacggctatacttggcttcaggagctttgacaaggttatacttgacaaggattattcgcttgcaggggcaaacgttatagtatgtaccgacgacggaagcacgggagtacacggtacgatagcactgccgcttgcagatgagcttgcaaagggtgatgttgcggcagtatatgcctgcggtcctactcctatgcttaaagcggtcgttgcggcggcaaagcaggcaggggtatactcggaggtttctcttgagcagcgtatgggctgcggcgtaggtgcgtgcgttgtatgtgcctgcacggttatccgtgacggagaagaaaaggtgctgagagtatgcaaggacggccctgtgttcagcggtgaggaggtagtgttatgagtttcaagcctgatatttcggtagatgtatgcggtaagcatttcaagaatcctgtaatagccgcttccggcgcatacggcttcggtgaggattataccgatctttatccgctgtcggcactcggcggtatttcctgcaagggtacgaccttaaataagaaggacggcaacatccctccgagaatagcggaaactccgagcggaatattaaactccgtcggacttcagaatcccggtgttgacaagtttataaattactatctgcccagactcagaaagcaggatactgtggttatcgcaaatatcgcaggtgcggtaattgacgattatatagctgttgcagaaaagctggatgctaccgatgttgatatgatagagctgaacatttcctgccctaacgtaaagcagggcggcgctacatggggcgttacctgcgagggtgcggcaagcgttacaagagcggtaagaaatgctacaaagaagcccgttatcgtaaagctgactccgaatgtaacgaatatcacagaaatcgcaaaggctgttgaggctgagggcgcagacagcgtttcgctgataaacactctgctcggtatgagaattgatataagaacaagacgacctatcctgcacaacaatgtcggcggactttcgggtcctgctgtgttccccgttgcagtaagaatggtatggcaggtggcgaatgcggtcaagatacccgttatcggtatgggaggcatcgcaacggctgaggacgctatcgagatgatgatggcaggtgcatctgctgtacagatgggtacggctatcttcaacgatccttatgcgccgataaaggtatgcgagggaatggaaaagtttctcgccgaacagaaaatagagaagataagcgatattgtaggcacggtaaagccgtggtgagtttaagtcgacatagatttgattttatgttataacaacctcggacaaaaaatcgtctgtagccgattttaccgcataaaaatgcggtgttgctcacgcaacagtccgtggaagcttagctcagctgggagagcatctgccttacaagcagagggtcataggttcgagccctatagtttccaccaatggcctggtagttcagttggttagaacgccgccctgtcacggcggaggtcgtgggttcgagtcccatccaggtcgccatttttaatggatttctgcctctgtagctcagtcggtagagcagaggactgaaaatcctcgtgtcgttggttcgattccgaccggaggcaccagttaaatatgcggatttagctcatctggtagagcgccaccttgccaaggtggaggtagcgagttcgagcctcgtaatccgctccagaaaattcgtcgtggaaatattcacggcgtttttgctttttacggataattttccgcacagtgtttaagcataaaaagaagctgtggtttcgattatgaaaccacagcttttgctatatcagttttatgcgttctgtttttttctcttagcgtcttcctttgcacgaagatcgttatcaagaatcttctttctgattcttatcgtcttgggagttacctcgacaagctcgtcatcgttaataaattcaaggctttcttcaaggctcattctcttataggggataagtcttaatgcatcgtcactgccgctggctcttgtgtttgtaagatgctttttcttgcacacgttaacgttaatatcgccggccttcggagaaactccgacaaccattccctcgtaaacgggaacgcctgcgtctatgaacagagtacctctttcctgtgcgttaaacagaccgtaagccatcgccgtacccgattcaaatgcaacaagcgaaccgaccgttctggtggggatttcgcccatataaggacggtagctgtcgaatactgtattcagtacgccttcaccctttgtatctgtcataaattcgcttctgtaaccgaataagcctcttgaggggataaggaactctattcttgttctgttgcctataggctgcatatgaacaagctctgcctttcttacgcccatcttttccataaccgagccgacacagttgtccggtacatctataagcagacgctcgataggctcgcatcttacgccgtcaatttccttgaaaagtacacggggtgtgctgaccgaaagctcataaccttcacggcgcattgtttcgataagtatcgaaaggtgcatttcgcctctgcctgctacgttataagaatctgagttttcgctgtctgtaactctcagcgatacgtccttcaaaagctccttgtaaagtcgctctcttatctgacgtgaggtaacaaacttaccctctctgcctgcaaacgggctgtcgtttaccgagaatgtcatttcgactgtaggttcgcttatttttacaaacggcagaggttcgggattatttaccgcacagatagtctgaccgatagtaatgccctcgatacctgataagcatacaatatcaccgatagtagcctctgtcacgggaaccttgttcataccctcaaatgtataaaggcttactacctttgacttgaaaggcttgtgtgagccgttgtagtcgcataccataacttcctggttctgcttaatcgtacctctttcgattctgcccaccgcaattctgcctacatagtcgttgtagtcgatagatgaaacgagcagctgtaaatcgccgtcggggtcgccctcgggacagggaatgtgttctattatcttatcgaacaggggcttgaagttttcgcccataacatcgggtgaatatgatgctacaccgtttctgcccgagcagaagataacagggctgtcaagctgttcatccgaagcgtcaaggtcaagcagaagctcaagcacttcgtccacaacttccttgtttctggcgtcgggacggtctgttttgtttactacaactattaccttgagtccaagctcaagcgccttctgaagaacgaatcttgtctggggcattgtaccctcaaagctgtcaacaaggagcagtacgccgtttaccatcttcaatatacgctcaacctcgcccgaaaaatcggcgtgtccgggagtatctactatgttgattttaacgccgttatagtgtgcggcggcattcttcgcaaggatcgtgataccacgctctctttcgagtgcgttgctgtccattactctgtcttcaacttcctgattgtcacggaatacaccgccctgcttcagcatttcatcgaccagtgtagtcttgccgtggtcaacgtgtgcgataatcgctatatttcttaaatcttctcttttcaacgtcaagtctccttctttataataaaatctacctttatccttataattatactcattttccgatttttttaccatattatatttagataattttgcacaagggataaaactccgccttgtttatttttcacaaaaaaatcgggagccccgatggagctccctttgccgtatggttatcagcagccgcagcctccgcagttgttgccgcatccgcatccgccgccgcagtcgttgtttgcacaaccgccgccgcagtttccgcatccgccgcagcatacgaataagaggataagaatgatccaccagcaagagttgtttgaacagaacatgatatgtttcctccgttgtttttatttgagctaagccgtttgagcgttgctcatagtacataatatgccggcggctgaaatgtgttacttttgtttttgctgtaacactgtggttttgtgattaaaccggaaatatccgcctataattgtatatgagaaaggcggtcatagtatggaattcaacggatttacagacaaggctaacgatgcgctcaattgtgcgcttacctgtgctatgagcatgggacacacttatgtcggaagcgaacatatactttacggcttgtgcggcagtaacggcggtgtggcttatacggtacttcgccaaagcggagtgacctgcaattctatagcgtcacggataaatgcccttatcggaaaagggcttcccacacagcttaccgtatccgacttcaccccgagaagcaggaggatacttgaaagcgccgtgatgatagcaagaaatgcaggaaaaaccgccgcaggaacagatcatatacttcgtgccataatgcgtgacaacgagtgttatgcttcagtgttcctgcacgaaatgggaatttcgggcgaggctgtgctggatcagggagcggatacgcagaaaaatactccgcagggtaaaagaaacggcagcgtactgccatccgcactttcgggatacggcagaaatcttacaatgcttgcacaggaaggtaaaatagatccgtgctttggccgtgaacgtgaaacgaaccgtgttatagagatacttttaagacgctcgaaaaacaacccctgccttgtaggcgaggcaggagtgggaaagaccgccattgcggagggccttgcgatgagaattgcaggcggtaacgtacccgatgaactgaaaacgaaaaagatatatatgcttgacatcacgtctatgcttgcaggcgcaaaatacagaggcgattttgaggaaaggctcaagcgtgtgtttgatgaaataagaaacgacggcaacattatcgtttttatcgatgaaatacacaatatagtcggagcaggtgcggcagagggtgcgatagatgcggcgaatattctcaagccgatgctggcaaggggagagataaggcttataggtgccacgacaaatgccgagtataagaagtatatcgaaaaagatcccgcactggaaagacgactgcagcccgtcaccgtaaacgagcctacggaagaagaaaccgtcaccattctcaacggcttgcgttgccgctacgaaagctatcataaagtgaagataaccgatgaggctatttccgccgctgtcggtctgtcagtaaggtatataaacgaccgcttcctgcccgacaaggctatcgaccttattgacgaaggctcggcaaaaataaggctcagccgaagcggagaagacagcgtcggcaaaaagctgaaggagctgtccgatgaaaaaatacgggcgataaacaataaggatttcgcacttgcgctgaaactcagagagcaggaaaaaacgctctgtgcaaataccggcggatatactgcgacccttacagcagacgatatagcagatgtggtaacgcagcataccggtatccccgtaaggtataacggcaatgatacaacgaagtggctcgccggccttgaaaaaacgctgtccgaaaatgttataggtcaggaaaaagccgtcagagcggtagcaaacgcagtaaggagaggtcgctccgggctttcggacgaacaccgacctgtcggctcgttcatatttttaggcacgacaggagtaggcaagacaaagtgctgtaaggagcttgcgaaagcgcttttcggcacagaaaaagcacttataagatttgatatgtcggaatacagcgaaaagcattccgtttcaaagctgataggcgcacctgcgggctatgtcggctatgaggacggaggcaggcttacagacagagtgagaaaatcgccttacagcgttgttctgttcgatgagatagaaaaagcacacccagatgtttttgacattctgcttcaggtgcttgatgacggcaggcttaccgattccggcggaagaacggtcgattttacaaataccgtgataataatgaccggaaacatcggaagcacccttatcgcaaaaggcaagagcaggctcggattcggcatacagcaacggcaggaggaaatttccggacttgtaaggggagagcttgaaaaatacttccgtcccgaatttctcggcagagtagacgaggtggtcgtattcaatgagctgtcctgcgcagaatataagctgatatgcgaaaaaatgctttcagagctttcaaagcagtgcgaaaggcagggtatcgctttctcgtggagcgaaaggctgtcagaaaagctgtgtaccgaagcaaagagcagaaacgaaggtgcaaggcctatagcaaagctgatagacaagaatgtccgcaacatgatttcagacggtattatttcgggagaattcagcacgggcgacggcatttatgcggatattgcggataatgacagctacagtgtcagaaagataaaaagctgtacctgctaccgatagtgtactgctgtcgggatatgaaaaagctccggtcgttttcccggagctttcagactgtcgataagcttctatcgttgataaaaatgggtgtttagcgttgcttgctctgttggttttgcatcgtgcaaaacttttggcaagcaaccaaagcatccttgctttgggcgtagccccaaggcaggtcgcagggacgccagtccccgtattctccccctttccgggggaaagggggcagggggatagggatagtaagttagaagtttgttttcaaaaacagactttttctacaagctgaaagctccggtaattcttccggagctttaacttattgtattttatctgttgtcaacataatctgttgcacgggcggttttctttatttcctgcttatccagatacatctgtctgtccgcacggttgaatacatctgcataatccccgtcggtcgcatcgttcaccgcatatcctacggcaatacggacacccagctcataatgccttgcgttacggttgaacagctcctgttcctgcttgaagcgtttgacaagctgttcgcacagatcatttcccggggaatttatgattaccgtaaattcgtcaccgcctatgcggtaaatattgtaatcaccgaaaactctcttgattatcgcacttgcatcagagatcagcatatctccgaattcgtgaccgtatttgtcgttgtacatcttgagatagtttatatccattacaaaaatggcataatcgccgtttgcgtgttggctcatcttgtctatacgctgtactgcgtcatgataggcggccttgtttccgacatcggtcgcagcgtcggtgtaagcctgtttgttgattttgttgatatacttcttaagcatttttacggtatcgctgtaccttgaggcaagaacgcctatttcgtcttttgtcttacattctatctcaacgtcaaggtcgcctgccgcaatctttttggaaacttcggtaagatgctttatcggctttactataatgctcgtaaacttgaaggtaagtaaagaggtaactataagcacaacagcaacggcaaatgcgtcctgtatcattaccgagatacgttttctgcctatctccttatcggcaacagagattacgaccgccataccgttggagagaaattttgcgcacagttttcttttttcgccttcgctattgcggatattgatgacatctcctgcctgttcgccactgtagttgtcgtcaatgaatgtaaacaagctgtttttctttatttcctcaagcgtcattccgttcggataacggttgtggtataccatatcacccttgctgtcgcaaaggaaagcatagcctgtatcgtacagctttatttcgtctaccatagctgttatacggctcatagcaatatccatacctataatgcctaccgcagttttgttttcgtcaaagagcggaataacgtatgagatcatttttatatcgttcagattcttatttatgtacggatctatccagaccggttttttggctttgagcggctcgtaataccacgcaacgtgctcagcgtcatccttgtcgtatgcttctataggtgtcggctgatgtgcgactattttttcactgtcctttacccagaatactccgtcggaagatagcttcagctccggattgtaacggatatatccgctgatggcggcatcggtattgttaagtacattttttataagctgaccgacagaatcgttataacgctcaagtgtatcagggtcgtttttgaacttctctatgctgtcaaaacggcttactgcatagtcattgcaggtattcattgcaagctccactgaggaaaacagcttctcaaggctctgagcgctggtcgatgcctgcagcttcattatcgtttccgagttttcgtttgaaatgttgtcgatgcctaaaatgccgatagcgcttatagcaaacgagcatatcagaatacagcctatcataatcagtacgaacttatttctgattgatttcaaagggcatccctccccgatatatcattctgattatctgctgatatattgcaaaaattataacatttatcgacatgaaaatcaagtgctttttgtgcaaaacagtgaaaacggtgttactaaaagcaggaatccgaaagataagttgataatgtcgcttttaattgaaaatatattcataaaaagcaaaaaaacagccacagcaattgcaaaattacttcagatgtggtacaataaattatatatcggatgaaaggagcggaacaatggatatacaggtcggagatattctcagaatgaaaaaggaacacccctgcggaagcaaggaaatgcttgttcttcgaatcggtgcggatttcaagctgaaatgcacaggttgcggacgtgaattcatgacgccccgctcaaagtgcgagaaaaagataaaatcggttatccgcaatgccgttgaagaggagaaatagtgtttgatttacaaagatgctattttgatttttaacgtgaaacggagaatagataatgacagaaaaacttgaaataacagaaaagcgtttcgatgaaataaacgaaaagctgacggatataaacgtgataaacgatcaggagcagtataagagtctgatgaaggagcttaagaacctgactccgataatcgaaaagtacagaatgtacaagaccgcccgcagtgattttgaagaagcagagcagatgctgtctgacggcggacttgacaaggacttcaaggaaatagtgcaggagcagtacgagagcaataaaaagctaatggatgagtatacagacgagcttaagattctcctcttgccgaaggaccccgatgatgacaggaacgttattattgagataagaggcggtgcaggcggagaagaagcggcactttttgcaaactcaatgttcaggatgtattcaatgtatgcacagactaaaggctggaaaacagaagtgataagctccaaccctacagagcttggcggatataaggaaatcagcttttcggtcgagggcgagggagtgtacgcaaagctgaagtacgaaagcggcgttcaccgtgttcagcgtgtacccgaaactgaggcgcagggcagaatacagacatcaacaataacagttgcggtattgcccgaagttgaagaagttgacgttgagataaatcccgccgaccttgaattccagacctaccgttcaagcggagcaggcggtcagcatatcaacaagaccgaatccgccataagaataatccaccaccctacaggagtagttgtagagtgtcaggaggagagaagccagtacaagaacaaggacaaggctatgaagatgctgtacagcaagctgtatgaggcaaagctgaacgagcagaacagcaagatagcggctgaacgtaagatacaggtcggcacaggcgaccgttccgagagaatcagaacatataactatcctcagagccgtgttaccgaccacagaataggacttacgctgtacaagctggagcagtttatgaacggcgactgcgatgaggtgtttgacgcacttgcgattgccgacagaaccgcaaagctggcggcaggcggcaacgattaacagagataaggtgactttttttgaaaacagagataaagaaaccgtcttacgaggtattgtgcgaggcggcagagcttataaagaagggcgaggtcgtggcgataccgaccgaaacggtatacggccttgcggcagacgcatataaccctgaggcgtgtgaaaagatattcaaagctaaaggcagaccgcaggataatccgctgattatccacatctgcgaccttgatatgctgaaaaattcggtaaaggagattccccctcttgcacttacccttgctgagcatttctggagcggttcgctgacgatgatttttccgaagaaggatatagttcccgatacgacaagcggagggcttgatacagttgcggtcagaatgcccgataacgaggatactctgaatcttattaaaatgtgcggcgttcctcttgccgctccgtctgcaaatctgtcgggaagccccagtcctacaacggcacagcacgtctatgccgatatgaacggcagaataccgcttataatagacggcggcgaatgtaaaaacggtgttgaaagcactgttatctgctttacggacggcggaacaggcataaaggtactgcgacccggtgtaataacagccgaaatgctcagccgctttgcaaagacagaaaccgacaagaacgtattcgcaaagcccgatgaaaacgaaaaagtaatttctccgggagttaagtacaagcattattcgcccagagccgacataactattattgaaaccgacagcgatgagaagctggctgaatttttgaacagcaagaatgacggcggcacatacggcgtgattttcggcggcgaaaagggcatagaagtacctactatatcctacggaagcacagcgcaggagcaggcgcacaatctgtttgcggtactgcgcaagaccgatgagctcggagcaaagcgtgcttatgtacgttgccccgaaaaaacgggcgtaggaactgccgtatacaacaggcttcttcgtgcggcggcattcaagacaataatactttaagcaggaacaaaatgataaataagaagatatacggacttacaggtatgtccggtgcgggaaaatccacagtatgcgacagctttgaaagtgcaggctttttaataatcgattgcgacaggctcgcccgtgaggtcgtaagaaaaggcagaccctgccttgataaactgcaccgccttttcggtgacagcgttatcacaaaggacggagagcttgaccgcagggcaatgggcaatatcgttttttcgcacagcgataaactcgccctgcttaacaatacgatatatccttacataacctacgaggttatctcaatgtgcggttatacggataagcacttcgtactgcttgacgcaccgacgctttttgaaagcggcattgattttatatgtgacggaataatcagcgtcacctgcgacaaggaaaagtcgatacagcgtattatgctgcgtgacaatataacaagagaaagtgctgaaaaacggctcggatcacagcacgatgcggaatattacaaaagcaaaagcgatttctgcattgaaaataacggcgatattgatacgcttaaagcaaaagccgatgccacggcaagaaagataataaatggcaactaagagaaaacgcaagaatacgggcggaaaaccgctgataataaccttcgtctgtcttgtcgcagtgacactggcggtattcggagtgttcttcggtgcggataaatatgaacgttccacccacccgatgctttacagcgaccttgtcgatcgctattcttcgcagtataagctggataagtatgcagtatactcgtttatatgcgttgaaagcggattcaacgaaaactccgagtcctatctcggtgcaagagggcttatgcagataatgcccgaaacgtttgagtggataagatacaagctggacgaggaaaacgaccccgatatgaccttcgataatatgtacaacgccgaggataacatccgttacggctgctttctgctcggctatcttaccgacaccttcggggaactgggcgaagtagccgccgcatatcacgcaggtgcaggcagcgtttcatcgtggcttgaggacagcagatatacaaaaaacggcatactgaccgatattccgaattctgacacggcgcactatgtcgacaagataacaaatgcctacgatacttattgcaggctttataaaaaataaaggaaggcaaagaaaaatggctgaaaagaaatcacaggcagaacagcttaaggaaaaactgttctatgtaaaaaaacacgcaacgcttgttatgagcgagcaggaagaaaaaaaggcagacaaatactgcgagggctataagaagttccttgatgcaggaaaaactgagcgtgaggctgccgcaaccgctgtcgctatggctgaaaaagcaggcttcaagcccttcgacaagaaggctcagtacaaggcaggagataagatatacgttctcaacagagaaaaggcggtcatcttagccgttatcggcaagagcaatatttcaaacggcgtaaatctcactgccgcacacattgattcccccagacttgacttaaagcagaatccgctttatgaaagcgatgagctgggatacttcaagacgcattattacggcggtatcaagaaatatcagtggcctacagttcctatgtcactgcacggtgtgatagtaagagccttttgctccgctataagaacctctcgccgtttccaaaatcactgattttgacggctgtgagaacctttttgctccgctataagaacctctcgccgtttccaaaatcactgattttgacggctgtgagaacctttttgctccgcaataataaacccctcctaagggttagttgtgagttcgattctcgcagggggtgccaaatgcacagctgaaaagcctggtaaaatcaaggcttttcggctttttttatttttgctcaaatacaacaaaagtaaaaaagcgagaaatctcattaacaaattgtagcataaacgaagcaacaaatcgaaatttacctctattcaaacatacaagctcttgacaataaagctcctatatagtataatttaataaactactatataggagcatttgtatgaaaacaaacggcggatttcttgttaccaaaataaaacaacttggagaccggatttttgagaagattctcagtgaaaagaatattgatgcgttcaatggagcccaggggcgcattctttatgtgctgtggcaggaggatggtatctcaatcagatcactctcgactaaatgcggattagcgataacatctcttacgacgatgctggaaagaatggaaaatcaagggctgataagccgtgttcagtctgaaacggacaaaaggaaaaccctcctgtttctgactgagaaagcacatgccttaaagggcgagtacgattctgtatctgatgagatgggcagcatttactacaagggttttttagaggaagaaattacccggtttgaggaatgcctcgaccgcatcagaaagaatcttgaggagtggcagaagtcatgagtatttgtatcaaagatcagattcagaacatgaatctcgtcatcggctgcacagtggggtgtacatattgctatgcccgcaacaacgtgaaacgctggcatatgatcgatgactttgctgatcctgaattctttccgggcaagctcaggatgatggaaaagaaacgtccgcagaactttcttcttaccggcatgagcgatctctccggatggaatccggaatggagagacgaggtatttgcaaagatccgtgaaaatccacagcatcagttcctgttccttaccaagcgacctgatttgctggattttgataccgatctggaaaacgcatggtttggcgttacggtgacgaggaaagccgaactgtggcgtatcgacgcccttcggaaaaacgtcagagcaaaacattaccatgttacctttgagccgttattcgacgatcccggtacagttgacctttccggaatcaactggatcgttgtcggcactatgaccggggctcagagcaggaagattcatacggagccggaatgggcatggtctctgacagaccaggcacatacgctcggcattccggtgtttatgaaggaagaccttgtccctatcataggggatgaaaatatgattcaggaaatgccggaagaatttaataaagtgttagaggtacagagatcatggcagaagtaataaatggaatcctcattcgtgaggtggaaacaaagaacatcatgaccaagtccagtctgccggtaggcggttactcggtcaatccctatgtaggctgtacacatgcctgcaagtattgctatgcttcttttatgaagcgctttactggacacacggaggaatggggcactttccttgatgtgaagcattggccggaaattaaaaatccgaagaaatatgccggacagcgtgttgtcatcggttctgtgacggatggctacaatccacaggaggagcaattcgggaataccagaaaacttctggagcagttgatcggcagtgacgcagatattctgatctgcacaaagtctgatcttgtggtacgggatattgatctgctgaagaaccttggacgagtgaccgtttcatggtcgatcaacacactggatgaaaatttcaagaacgatatggactctgcttcgagcattgagcggcgcatcgctgctatgaagcaggtatatgacgcaggtatccgtacagtctgtttcgtatccccggtatttcccggtatcacggactttgaagccatttttgagcgcgtaaaggatcagtgcgatctgttctggcttgaaaatctcaatcttcgaggcggtttcaaaaagacaattattgagtatatcgccggaaaatatcctgaccttgtaccgctttacgatgagatctataacaagcataaccgcagctactttgaagcgcttgaagtaaaagctgaggaaatggctaagaagtatgattgtccctttgtggataatgaaatgccttatggcagagtccctcagggacatccggtgatcgtagattatttctatcatgaggaaatccgtgggacagaaaataccggaaaaagaaaccgttaaacagaaattgaccgcactcttgaatgagggaaactcctcgtccgaagggcaagaatgtgcaaccgagaagacttaccgttttaatatctgaatatagcttgaaaccgataacggacatcagtttacgttctgaaaagccggtaaaatcaaagattcttgatgattttgagaaaattagaaatttcgttcagaggcttctcctaagggttagttgtgagttcgattctcgcagggggtgccaaaaaataaaagccgcccgtcgttcaatatgatgtgcggctttattcttttacagtttgttgcttcccctattcgataagttaatttgttaccctgtttatctctgacattaataaaaagtacaagaaaactatcacaaatgcgtatcaaaatacttgacaaaggaatatatcagagatataattaaatcagattatttattcattacgttaattccgtttgttatatcaacaaaattccccttgtatatcactatatctaacatacgttatattgaaacgtccgacaaaattgcagattatattacaacagtattgtacacttactgtttcggacggcaagaaaatttaccacaaaaaagaaattattaggagattgtcagtatgaacatgaaaaaacttttaaaacctctgacagcatcgtttcttgctctcatcatctccggctgttcttcagcccctgaagctatatcgggcgggcttgtcagtgcagactttgagatctcgcaaagcaccgatatatcggcatcgcaaaatgatcgttccgaagaagatttaacacctgaggaaagatccgcaaaagcacgggaaaaactcatttcactcggaaacggaaacgtgttatgtgacatagatgacaaagttgacactgttgaatataacggtggcataatggaattgccttgcagtatagaacagagctgtaaatcggaagaatctttcacagatgtatcaacaggatgccttatagcgataaacggcgtacttcagaaaatatcatacggcgagcaaaaagatcaatatatgtatgttcagacctatgaaaaggacgatttcataaaggaaaacgaagattacactgcacgcaaaaaaatcaccctcagctttgagccgcagataaacgaaaaggataaggacctgacaaagctgcagcttacaattatcacagtagacaacccgcttttcagacttcagcctgaatatcctgtgggctttttgatgcatcgggcagctacaagccacgtgcttaaaatgtcgcttaattcaccgataaccaattacaccaaggataaaatttcagagagcggtattaccgaactggatttaaccgatgaggttatagaaaaatactcggaaatggctaatattgccccaaaagccataactgaaaatacacgcccctttgcaaatgtcgattccgaatatcattcacatttcaattttgatgaaaacggaaagcttgatctgggttttatcacatcggtaagtgaagacggtgaatttgactgtgaaatatcttcacagggcagataccttgtttctatgtttgtaaacggtgctccccacgcttttccggacggaagtatttataaaagcatagatatgaaaccgggaaagctgtatgtatatgaagcacaggatttttcgaaaatactgggcgaatgtgacacgatagtctttttacctgtcgcctgcctgcgtgacgacgggaaatgcataatgagtcatactgttcagtcagaagctatatggccaaaggatagagcgtaaccaaaattacggataatcaagcaccgacagttaaggcaacacactttcaacagaagaaagcatacagtacgttataaagacgcactgtatgcttagtctatcgaaaaacctctatcattatcaaaaatggggtttggggcgaagccccaagcggggtgagggcggcagccccagtaacccccctttccctgggaaagggggcagggggatagggacagtaagttagaagtttgtttcaaaaacagactttttctacaagctaagcatacagcacattataaagatgcactgtatgctttaaatttaacaaacgagggaaaataatggaacttaaattagaaggtatcacaaaatcatacacaaagggtaaaaaacgcaaaaacgcacttgaagactttactctcactcttaccgagggagtatacggacttctcggacccaacggtgcgggaaaatcaacgctgataaatattataacggggataatcggcagggacagcggcagtatatcctttaccgacggcaatgacaacagctttttgtcgcatctcggctttatgccgcaaggtatggacttttatcgcaactttaccgcaaaggactacataaagtacataatggcactgaaaaaatactctcccgataatgcagacgagtacgctttgacaacgctcggcaaagtaaatctccgtgcggatgccgacaagaaaatcggcgctttttcaggcggaatgaagcaaagactcggcatagcacaggctatagtcggagaaccgaaggtgcttatatttgacgagcctaccgccggacttgacgcaaaggagcgtatacgcttcagaaatgttattagctctcttgccgcagacaaaatagtaatacttgcaactcatatcgtgaccgatattgcgtatgtagcaaaaactgtcgtgcttatgaacgacggcaggataataaaaacaggaacgcaggaggagctttgctccgatatttcagacaaggtatgggagataaccgcacagagtgacaaagtaatggactatatgaaccgtatgcgtgtatcaaacgcagtgtctgacggcaataagtataccctgagaatagtatccgatgaatatcccgaaaacggcgctgtttcagtgccgcctacacttgaggacgtatgtatatattatttcggagatatgtgatatgaaactgtttaaatatgaactgaaaaagaatatactgcggcttcccgttctgctgttgtttgcggctcttatacttgtaagcctgtacaagcacagtgaaactgttcaattatacggcacacaggattatcttgccgacggtcttatgcacaatatttatcaggcgtacaaaggtgagattaccgatgaaaagatacagcggatagccgcatacagaaatgaaatgtcggctattgtaagctcatcggatttcgactatccgactacgcccgatgacagatattataccggctttgcattcggagataacgggtcatcggaaaaagttatcgaagaaatgaaatatgcgatagaatacataaacaatatcattgtgcttagagagaaaacacagaccgcaattgcgttttacgagggtaaaaacgactacaaggtgagagaggctcagcagattgaacgcctgtacggaaaccgtcatatagacgtatacggcaattacgatacttacgccctttacttcgactatgagttctctacctttatttcgatgataatggtgctgtttgtatttgctccctcgttttcaaaacaaaaggctatcagcgatgacaagataatatgcgcctgcggaaaggtcaaaagcgtattttttgcaaagcatttgtgtatgtacgcattttgtgccgccattacggtgataatgacatttacggatattttatccttcggctgtcggtacggcattgaatttttggagcagccgatatatgcgatacacagctttacttatgcgccgcttgacataagcatatttaccgcaatacttattacggcgtttatgagatttctgcttactgtgcttatcggtgaaattgtactgctcatatcctctacccagaaaaacatcggcatttcctacgccctgagcttttgcgcaataggtgcgcttatctatctgcacggctctataccatcacaattctctcctttttctatgatatgtatgagtaactttttcaccgatgcggaatttgttaatgtgcttggcttccctgtgcttaacataattttcctgccgatacttacaatacttctttgcgttacagtaaatcttatttgctttgctgtcgcctgtccgcaacgtgcgatacggcttaccagaaaagcgaggagtaatgctatatgaaaatatttgtatatgagatgaaaaagatactgataaaacagtacgcaataataattctggcagctgtagtaatagtaagactgctatcttctctgccgctcgcaaagcagacatacggatttgactctgccacagagcgagagaaatattttgagataatctctccgtttataggagcagtgaccgaagaaaaaactgaccgtgcagacgagcttgaaaatcagctgaaaacggcaagtcaacaatacgataagatgattgatcagcgtctggaacacaaaatatcggatattgaatattacgagcagatgaagctgtacgaaccgaccctcaatatcaaaaagcagattgaaaaaactgtcgaacaggtacggcaggcgcaagaacgccaatgcgacattctgcctgtaagctatatccccataatatgtgatgcgtcggccgattacctttttgtacttgcaatctgtcttatatgcagtctgagtgtaatcacagagtatacaagcaggacaagatatatcctgtgtactactccggcaggacagtcacgcagtatggcggcaaaaacggcagttctgctcttagcggtcgcagtggcatcggttttactctcgacggttgagggatactgcctttcaaaacagcttccctttgaatactgggcatattccgcaagaggtatagtgataatgacgaactgcacggcagagctttctataggcggcctgtttattcagacccagcttattaaactggtgggaagcatttttatagtctcggttgcaattcttatttccgagctttttaaaagctatgccgcaagcgtattttcgcttgtaactgtgcagatagttgtcgactatgtcggcaatcgctcaaatctcagctatcttctgcctacaggggctatgcgtggctacggttatttttatggtgatgtcacgccgacctccgaaaacaattatatgcagttttcgggagtgcctctttggtatactgcagtgcttatatgcggtttgctgattttttcggcggcagcttgtgcaggaacgattctttcctgcaataaccggctgaaaagaaaaatgaaaaagatacgcaaggcggcacttttgtcaactatgtgcattgtcacttcactgcttctgtcctcgtgcggtattgcgaataaccgctacgaccccgaagatacaatgaaacttgtaggcggctcatataccttgatcggcgaatataatattccctttacaaatgaactgaaaacaagcaaatatgaaatcgttcttgataccaatcagtcttccggcggattttcaatatcgctgattgaccttgcaagcaaagaaaagctcgatattccgcagagctatttttcagacgaaactttcattcattgctttataaccgagcattacattttagtcgagtatatcgccaaagacggaaccgaagcgatgcggtactatgacctgaatgacttttcaacacaaacaatcgctcagaacacccgaggagtagaaaaaaatctgttcggacttacctttaaggacagcgaaagcatatttacgacaagctccttaattttcaccgatgacagagattttttctttgttacagacagcggtttgtataaggtaggcataaataaaaatgcgtcactgataatagacgagcctgtaaccgaaggcttgatttacgatgctcacagcatctattttatcagcgaaaaggacagcatcaagcgttacgacctttcaacaggcattctcagcgaaattgtaagcggtgaaaaaataatcccacgttcgctgtggggagattacgattatatttattacacaagcgagaacggcgaacaaaagttagcaaaatagcactgcaatcatcgcaataaacccgtaattatccgagtttgtaaatttaaattcagctataacagcttcgacaaaaccccgatttgctttttaatcggggttttgccatagtctgcactctgataaaacatacctttgcaaaacctctcaaaatgtgttataataatatccgaacattcatcaaatcaaaaggagtttcttatgtacagatacgaattgcatatgcacaccaaagaaggcagcgcctgcgctgtaagcttggtagaagatatgataaagcagtatgtaaaaatcggtttttcaggtgctgttgtaacaaaccattttataagaggcaacacctgtgtttcacgttctctgccgtgggaacagcttattatgcaatacagcaaggcatacacgaacggcagaaaaatcgccgaagaacttgattttgacctgtttttcggcattgaagaaggctacggtaacggcaaggaatttttagcctacggctttgagccggaatttcttttatcacgtccgtttctgagaaatgccgatctgaatatatgggcacaagagatccactcagtcggcggatttattgcttacgctcaccctttccgtgacagagattacataacaaatcacgatgaagtaccggatatttcgatagttgacggcattgagggctacaacagaggaaatcgtgatattgaaaacgaaaaagcaatccgtgttttcggtaatgcagatacggttatcaccgcaggaagcgatctgcacagcaccgactttgacagtgcctacggaatagaaacacagcacaggataaggagcaacgaagagctggtgaaaacgttgcttgagaggaattttaaggtctatctcgggggatgaaaaacggcagatagcagatcttacagttttatgctctcgtaaaacaaattagtaattatggcaagtcgtagaaatacggcttgtttttgttttctgccttgcttttgtatgtaaatttatctgcaatgtaacagtgtaactattccggatccgattacaagtatcagtgaatatacattcggaaaatgcacaaacattacaggtataaccacctctccgtttttgccacatatcccctcaaccgtcaacttcttctacttgacattacaataaattcttgctacaatatcttttatacaatataacctgaggtgaaaaatgaaaaaattcttgataccgctgttatgcagtgcaatactgcttttatgcggctgcgacctaagtgacaaagtgagaatcggcacggcggctgagggcggaaattactacattttcggcagtgaactgaatgctatagattcgctcgaaagctacaatatcaatataaaaagaacggcaggctctgccgcaaatatgcgtctgctttcagaaaactatcttcagatggcagtggttcagaccgacataatagacgatgcgtggaacggcagaaacggctttaaagaagaataccatgatttcgccgcagtagcaggactgttcaccgaaagctgtcagattgccgtacgcagtgacagtgatataaaaagcgtttcggatcttaaaggaaagactgtaagcatcggcgaagaagaatccggtactgcgcataacgcaaggcagatactgacttcatacggcattgccgaggatatgataaaggcggtaaaccttgattacaaggatgccgcaagtcagcttgaaaacggcactatagacgcatttttctgcactatcggtgcacctaatcctactgtaaaatcactctgcgacaagggcgctactcgtcttgtttcgcttgacagcgacaagatagacgaccttgtaagctcctatggctactactctgcctgcacgataccgacaggcacttacaaaggtcagaccgaagacgtcaagactataggtgttaccgctgtactgcttgcaggaaactcttgccctaaggacacagtgaaagcgataaccaaagcgattttcgataactcagaaaccatacaaaacgcacttcccgtaaatatcgtaaccgacagaaaatcagctgtcaacggcatcaatatcccgtttcatccgggtgccgccgagtattacggcgaaaacggaataaacgtagaaacggagtaacaagatgagcatagcacttgatatgtatcagacagtagcaatagctgtgcttgtcctgatgcttggcgcatttctgcgcaaaaagatacatttccttgaaaagttctgcattcccgctcccgttataggcggtctgctgtttgcaatactcacctgcattctgcatggcacgggtcttgcagacgtcagctttgatgatacactgaaagaagtctgtatggtactgttcttcacatctgtaggcttccaggcaaaccttaaagttctcaaaagcggcggaaagtcgatgatagtatttctgatactggtcatactgctgataatcggacagaacttcaccgcactcggactttcaaatctgctatacggcgaccaccgagatctacacgtactgacacactctttccctacacgacgctcttccgatcttgttagccgttcgttttcaccttattttccccctcaccttatatgcaaaaaatcagcaaaacgcaccttgttttttgcagaatttacagaatgttcataagtatttttgtgaaatgttgatatagcagtacagacaaatttttcaaaactcatcttaaaagtcttgtaaggctttcgataatgtggtataataaaaaaatatattgacacttgattaaataaaaattttgcggaggataatatggctaataaaagcaaagtacaatctgttgaaccggatatagctgacttggtaaacggctggctgaaaagctatggtcttgactataagcttgaacaagcatcacttaattccgaaatagataaggctcttgatgaatatcattcaaagattggtggcaaaggtggtaacagacctgatgctaaactgttgttgaaagataagtatgggactttttatcctgttcttattgaatataaaggttacaaagataaactcgtaaagttggatactgacggaatcgtagataacaaaaaagataaaaatgaaccaaactatacgaatattaagtcgtatgctgtaaatggtgcgatacattatgcgaatgcgattttacactacacaagctatacaagaatcattgcaataggtgtaaccggatacaaagatgagtttggaaaacttcagcacgagattggtgtttattatgtttcagctgacaaaaataatcttggctttggtcaaagagttggagattatacagacctttcctttttaaagacgtcacattttgatgagtttgtagaaaagcttaatgaactcagtcttactcaggcagagattgataagctcaaagaaaagcgtgaaaaagaaatcaatatcagtcttgttaaacttaacaatgacatctacaaagaagaaacaggattgggagaaaacgatagaaatcgacccggaaaacggtgctgattggaatcagtctgctccaattgacacaatcccaacgcttgaggacttcaaaaagaccgtaagtgattatcttgcttgggaagtatcaacacttttaaaaggtaagagcagtgaggacaacgaacgcttgggaaaataaatgcctcactcaatgagaaattggcaagtgttgagtggggcaaatataggattgatgatttgtttaaaatacaaacatcagctaagcgatttgatgctaacaaagttaatattattgaaaatgggcggtatccatacgtagtaagaacaagttccaataatggtcaaaaaggctttttagatgaaaatgagagctttctcaatgcagaaaataccatatcgtttggacaagatactgctactatattttatcaagaaaagccatatttcactggagataaaataaaagttttagttcctaaagtttacaaatttaataagaaaaacgcccaattttttcttgcatctatgaatattgctttttcaaaattttcttggggtagctccagatttaatgttgatgtattaaaggagcaagttattatgctaccaacgaaatgtgactccatcgactttgaatttatggaaagctttatagaggagctggaagcggagcgtatagaggagctggaagcggagcgtatagaggagctggaagcgtatctttcagtctctggactgaaagatacgcaactgacagctgatgagctgtcagctgtcaatgatttgatttcaaaaaatattgagtttaaacctttctgttacgatgtaatatttgataaaattgtacaaggaagaagactgaaaaaagatgaccaaatagcaggagatattccttttgtaatggcaggagtaacaaatacaggtgtagttggttatatttctaatccggttgcaagttttccaaagaactcaattacaattgatattttcggaaatgcattttatagaaattatgattttggtgcaggtgatgatactggcgtttactggagcgagaaaagtgattattcaaaagaaattatgcttttcttaacctgttctatgggaaagtccattgaaaataaattctcatatggtaagaaattacgcagttcacaaagctttaagtttaaaatgcagttacctgtaaaaaatgaacagcctgattatgagctaatgtcaactcttatctcggcaatacagaaacttgtcattgctgatgttgtaaagttcagtgatgagaaaataaaagctacaaaacaagttgtaggataataaaaatcgcaagttattcacttagtgttgagtgatttaacttgcgattattttttatgtcgaatatagctgtttggggtgaagtatacttatttggtgcccacttactttaagataggtgcaaatctgatacggatattcggcatcttcgtgatagtcgaataagtgttcagcatccagtcctcactgccgtcatttacgttctcaccgcttgcaggaggcgcaaatatcttgagcgtcatgtcagcttcaccgtcaagaggcttttcaaagaatgccgacataaaatctatcgtctttgcgtgaggcgccttgtagaaccacttgccgtttatctccatcataagattaagatctgcgtcctcgtcctcaaatgtgatttcgcagaatgtggggttcttttcaaagtgcagaggtatctcgataccctcagcgtcctcagaaccgccccaacgtaattttacagggaactgtgcgtcaccctcgcttttcatttcgggatagaaatactcatcgtgaataatttccttgtaggtctgcattaccggctgctcaataccgcagtcagcattgttcggatcctcaatttcaagtcccagtctgcctctgtcacggaactgatagaatgtaaagccgttgaaccagccctgatccttgtcgttcttgagcatatcgcagaattcctttaccatttcagcctgatcgtaaggtcccgttacatcgccgtcagcgttgaactcactcattaccataggcttcttttctccgccgcaaagctctctgtaacgcttttccgacagcttagtaagattatatgtatcagctaccttgcttctgctaaaagagtttccgccctcgtccgcaacgtcaaaaggccaaccccagtgaagagccatgtacttgtcaacagaccatatatccgttgctcttacagcgtcggcaaattccttttccatctcgatttctccgcccttttcgggatgctccacaccgccgatacagagaatagtctgtacgttgggtgcaaacttctttattacctcacgggcgtggatatagaaatcagccacctgctgataggtagcacgctttgtaaacgagaaccagttacctgtagcctcgtggttgattctcagctgcatacgtccgaatgttgaaagctccttgcctatctgttcaagatgctcgtccgtaacattcggatctatcgtcattgtaagtataacgtcctgtccgtgacgtcttacatcacgcatacaggtgaaaggctcgtcgtcggttgttccgccgataccgcccttatatgtaaaatagtcgtcatagggataatcccactggaatgcgatctccttgtccttgaaagcgtttctcgctcttgcaggccatgtttcgtcaagcggataatagcaatacataaggcttaccgctctgtgaggtctgcccagcttgttcaggatataatcctggtttacatactctcctctttcacttccgtcgccaaggtcaaccgcacatttagcaggacccatgtggatcttcttgatctcgctcatgttaataaactccttacacaacttttttcagaaatactgatttttaagacttatccgtcctttccggtaattcgtttgtccgccgctatgcaccgctcacagacagcttaccggaataattttgtgaaaacctgcgttttcaccgaataaattgagtatatcataaaatgaaaacgatttcaaggctttacaaaaaaaattttttggtatataataaagcagtattgcaaaattgaaaggaacggtaacctatgttagaatatgatgaactcaaagttgagttcgagggctatgagcctgagcttaaagagcttgccggcgcacttgaccttgataatctcaaagcagaaatagtaaagctcgaagaacagagcgcacagcctgatttctggaacgatgtagaaaattctcagaaaatttctcagaaaataggcgaagataagaatatagtacagagctacgaaaagctccgtgaaagctatgacgatgtaatgacaatgctcgagcttgctcaggaagaggatgacgaatctatgcttcccgagatacaggagcttgcaaagcatttcagaacagagcttgaatcgcagaagctcgctacccttctctcaggtgaatttgatcataataatgcgattctcacattccacgcaggcgcaggcggtacagaggctcaggactgggtcgagatgctttaccgtatgtacaaccactgggcagaacagcacggtatgaaggtaaccgtactcgactaccttgacggtgaagaagcaggtataaagagcgccagcatactggttgagggcagaaacgcttacggctatctgaagagcgaaaacggcgtacacagacttgtccgtgtatctccctttgacagctccggacgccgccacaccagctttgcttccgttgaagtaatgcctgaaatcaatgaagatattgacattgagataagcgaagacgagattaagatggacgtttaccgtgcaagcggtgcgggcggtcagaaggtcaacaagacatcctccgctgttcgtatcacgcatatccccacaggcatcgtgtgcgcctgccagacagagcgttcacagcatcagaacagagaatacgctatgcgtatgctgaagtcaaagctgcttgaaatcaaggaaagagaacacctcgacaagatttccgacatcaagggcgaacagcttcagattgcctggggcgcacagatacgctcctatgtattcatgccctacacaatggtaaaggatcaccgcacaggctacgaaatgggcaacatcggcgcagttatggacggcgaccttgacggctttataaacgcttatttaaaggcactcagcttaggacagatataatgaaaaagaacgacatcgttgaaattgagataacggctctttcaagcgaatgttccggtataggcaagaaggacggcatggttattttcgtgccgttttctgctataggggacaagcttgaagtaaagatactgaaagtaaacaaaacctactgctacggcaagatagagaggatcatcacaccctctcccgacagggtcactcccgactgccccgtttacacaaagtgcggcggatgttctctgcggcatattagctacgaggctcagctcagagccaaagagcagttcgtaaaggacgctttcaccagaataggcggtctttcgcccgaatttttgccgataatccgcaacaccaatataaacggctaccgcaacaagctacagatacccataggcaccgataaggacggaaatcttatcgcaggcttctatgccttccactcgcacagaatcgttccttgcgaaaagtgtcttttacagcccgacattttttcgaaaatcaccgccgactttctgaaaatttctaccgggcttaatctgaccgcttacgatgaaactatgcgcaaaggcatattacgtcatttatatttaagaaaaggctattacagcggagaaatatgcctttgtatagtagtagcaaaaaatgttccggaaattaaaattctctcggacagacttcttgaaaaatatcccgagatagtaagttctgtaatcaatgtaaataacagggatactaacgtaattttaggcgatgaagaaatagtattgacatcaaaaaactacatttgtgacatcatgtgcaaaaacgccgtaaacatagctccgaaggcgttttatcaggttaatactccctgtgcggaacagctttattcatcagcctgtgattttgctgagccgaagggcaaaacggtgcttgatttgtactgcggagcaggcacgatcgggctttcaatggcacgcacggcaaagaagataatcggcgtcgagatagtccccgaggcaatcgaaaacgcaaagcagaatgccctcgcaaacggcataaccaactgcgaattcatctgcgccgatgccgccgaagccgcacggatactgcattcacgcaatctccgccccgacgtgataatggtcgaccctccccgcaagggctgcggcagggacgcctgcgagcagatagccgccttctccgccccccgcatcgtcatggtctcctgcaacgccgccaccgccgcccgtgactgcgcatattttgcggagctcggctactccaccgacaagtgcgtagcagtcgatatgttcagcggcacaaaccacgttgagtgtgttgtcctccttaccaaaaatgattgattaaaaaatccacaacaaaaaacatagccgccgtagcactgagtaacagcgctacggcggacaattattcgaagccgcgatcaatgacttacacggaatagatacaggagtatgtaattacagaactactaacagcacctatttttacattgccatgtatcaattctcaaactttttgtttatattagtgattgcgctcaccatcttttgaatttgatccaatgtaagtgatggcagcgtttcatcatccgcaattttatttatcagcatacgcaaagattcctctgtcatttcggttgtattatttgacgggtaagtaacacgaccaccattcggagcaggtatttcatcaattgaaagccactcccagccaatttttgcaataacgcggcaatttatatacgcctgatacatatcaagaatagtttcaccgcggtatgatcctgagtctgtacggcgtactacaagtgctgcatcagctttgttgctgtttacaaaagacagcggaataaggaaacaaagctgatttaagcgagggtaatacataaggatagcattgcgataatttattaatgtttttttggcagatgtcgaaataaccatttcaagtttttgctggaactgcttaaataattccaaatcaagtttcattgctctggcaaatttttcgattttatcgctgcaatcagcaattgacggatcacaatctgcaaagaataacgggaattctcgttttagccattcaaaaggaagtctgtctatgtgtctcttatcacacatgtgatcggtattcacctgtatgtttgtattaggatcaaagaacttatttttgtcattctggtcagagaaataatcagctcttgctggcatttttccaataatctcagtaagttttttgccttccgagcctattcccattacaccgacacaatcaagaacccatttctgcttattcggtacagaatttgccgcaagtaacattatgatatctctatcaagctcatcagtaagacctgtattgaacgcagcgtaactttttccatcgctccccttctgatagataatcttaccttcacttttcagttttgcataagtaatattaagatatgtgcgtaaaataggatatttatgcaaaccttctgtgcgctgagctctctgttcttcggtaaatgtatcccacttctcgcctgtcatcttcacaagattctcaatatgatcaggataaagaaaagcgtcattcattaaactttccacaacgttatccgactgatattcattctcatcgaccggtctgtattgcttatcagtaaagtttctgcgtatataatcgttattattttctatactgaaaagcggcttagacatatttattgctcttttttcggtgctatctgtcgaagcattcaaatttccaacaggctctttaatatcagacgatgatgtatctgttgcgttttttaacctcacaactaatgccggagctgctcccggaactttatacatatattgaaattcgcatatatcgctgtaaaaatttctcagatatattccgggcttcatattaaatacttcaccgcaatgcaagccttttgctctgagggtatttgttatttctgccacatcatgataatttccgtctgcgagaacctcttttaatactttttcaatggaggttaatttataattatttgtcatttcatttttcctttcttatttcatcagaatgttatttaacattctgatgaaatttgtcaataaacctataattcttaataatacgggtttggggcttagcccaaagcggatgagggcagcggccccacactcagccccggcacggatgccgggcgtgtatgtccaagggctttacaaggacgcaaaaccagccaagcacacacagcctttcacgcggaaagtgatttgggatagtaattgaggacgagcacttttttgaaaaacatgcttttttataagctgcatcataatgttatttaacattctgattttaaattgtttccaaaaagtcgaacagcattgaacctatctgtaccgttcccaataccacatctacaactgtatcaaacacagatgtattattcgatttgtcattatcatcatcggattcggttttgaacagttcagctgcagattccgaatcgattttatctttactatccgtactatttatatccgatacctcagatataaattccgtatttaactgaatatccgtgtataaccattcacctcctttacatataggagtagctgaacccagtacaaacgcacaggcggctgcacgggaaatgatagtcgatcctttatagcacatagaaccgttcttaccaatttctttactaacaataagagccgcatcatatgttcgaccaaatgctaacggaatcaagaactgaaagcttccgaatttggaattataaaacggaactacacacgaattgctgtttgttttgcatttatcaaattcagacatcacatcgcatacacgtttttctattgtttgtctgaagtcagcatcacttttagctttcatctttactgctttaagaacattcgcagcgtctgaatctaaagcaaaatgctcggtaactgtgcttaaaaaatcgtcaggcagaaaattaattctactaatgtccggtttgtacaccacaggagctgagggaacaaaactctcaacagtcgtatgtaacgataatggtttaaaattcggaaacaatctcgacaaggcgggtttcaacggattcgcagaatcccaaagcattacgtcattaacaataaaactattgtgaaacttctcgcaattaacagcgatgatagcaacaataggcgtaccaatcgaattgaaccctatatgccatagagcgcagacatcgccggcgcaatcagctttaatgaaatttaaagatcctttacgaagtgaagaatgccacgaatgattaagataagcattcagatatgtgtatttgcgaagtaaatggcatgacatatcgtcgctcagtattgaagtaagtattgctttaacgttattatcaagcaaatcaagaaatagctgaagctttgtttcagggaaaaacaaatccgtatataggattccggtaaatgtactaactctgctattgctaccctgtccgtaaaaggaagcatctatacgtttcggttgcttcatacgaatatacggctgcaaatatccattctcaattctattttcaaaatcgtaaaatgtagataaatcttctttaaagacatctgacagctttgtgtcggatttctttttgtatatgccgtgccgtgtaagaaggacgcctaatttactgataggaatccattgtccgtgttcaagtgaatgtaacagccttaactcgttttcgtttaagctgtcgcgaaagcattttaattttattaaattttccattttttgcctttctgcatttagtactattcgatagttgcctatctaaataggataaatgcacattaaaattaaccaagatttcaagctgttatataacgcctgaatctttacgcttaatcattatgccgaaatatcgtccataatggctgattgaacgtcaaatgagaccgtttgtttccataaccctcccttctttattgaagcgttattcctaatcacctccgagtattaaatttaaattgatttgcctcatcgactgctatgattataacacacacatttcgtattgtcaacagttttttgaaaaaaaatcaataattttagctacgtcaaaaagttacccgtataatttcatgcgatattagatattataatggccgtttaaccacactttttcaagtaattctgttctttttagatatttatatacatatcaaaaaatttatcaaattattagataaatacccgatgttcctctctgcttgttgcattacaatgcagattatgctataatatctaaaaaataaccgacgttttgtttcttacaaaggagaaaaaacatcatggagtataattcaaccattcaaacttattttgaccttacttacgaaaataaagaaacacttgtaagagattatcttgactttctgcacgatgaaacagatttatccctgcccgattttccaagtacatcccgtcaacgattgccgacgctgtatgcaagagcggaatagacgcacttgccgtcaacgcaggacttctgcagagagcgccgcagtcgcttgaaaagtatccccttacggttataaccgagaacgactgcacacagggcggagaaaagttcagcatagtaaatatcaacaatataaatgtcggattcatttctgcgacagtgaacaaggatatatcgcagtatgtgtcacaactcagaaaagcgggcgcagagtacatattcttcttctgctcatggaatgaacgtcatacgcctgcggtaaagcctaagtggagaaatcaggcggtaaaggctgcggagagcggagcagatataattatcggcaacggacttaacgccattgccgaatatgatgttatagagtgcgcagacggaagacgtgttcctgtggcttattcgctcggctcgcttattcctgctgaccctgcgacacgctttgagaagataggagcgttactttgtgtaaggctcaagcgtgataccgcaacaggtaaggtgaataccgacctttgcggatacattccttatgcgttcaaggattacggcacggaacacagagcggtgcttttgtccgatgataatgcacgttatttcgggctgtcggtatacgatacgcttaaaaagcaggtggcaacggcacttggcagtaaaatagagcttgcaagatatgcagagaagcctgagcagcattcgtttgcacttctcggctcggcactgatttctgagcttttcaaggacgacaacgatgttgaaaccgaccgttcgcatctgttcatatctcagcttactatgaacggagcgcactgcgatgttgacgagaaatacttccgtgacggtgttgtgcctctttactacaatctttccaaaggctatgacgaataccttgccgaaaacaaggcggatgcgcttataacagacctttattacgctgtttccacgcctgtttacaggctcggagattcgctttattcgggcggaaaagcgtttatacaatcacgtttctacgaggaaaacaaaagtcagctgaaacggctcgatataaaggatgaagcggtgtggaagcctctgcttgacaagttcattgattcggttaccgctgtgtacgacagggagaagattatacttgtacgcataacggatcccaagctgtactatgtcaacggacgatatgtacgctcggccgaccgctcgtgcaacttcaggctgcttcttgatatggagaactactttataagacgtgtttccccgaaggtcattgacatatcacggttctatcccggcgtgataaacaaaaggggaagaagctatgcggtatgccgtgacgagcatttccgcaataacatttcgctgattgccaaaagtatatgctccggcaataaggcaaactatgtcaactcgcttgcctacgaccctgaaatatggctcacggaagtggctgaaaactttgatataataaaggcaggcaaggcggacagcttcttctttagcacaagcaatgccgtagactactttataagcaggctgagccgtgactttatctgtgcggaattcaaggatattctcaggctgaaaaccagtgagcttgtcacgttcaatgagataagggcttgctatgatttcggcagaaacgcagtgttgaagcgggtttataacggcatctgcgctatacgcaagggcgatattgcgaatgcggatattgatgagatcataaggctcggattatatgcacaaagcgatctagccaaggcactggaatcattttacaacaaaaatgggattatcagaaactgcgtgctttcgactaaggatcttagcttctatctcaagtgcgcaaggctgtggatggcaggcacagacaaggatgcggtggcacagcttgcccgtaaatattacgaaaaacacagacctgtgattcttgatgtttttggcagggcggacggcggcgacatttcagagcttgcggacggtgcggtaaagggcagtgtgataagcggttattcggctctgacagtatgttcggagaaacctgcggatattgatctgagctatattgacgacaagtcggctgtttttaccgagcttacacgctcatactttgcaaattcgcacggcgactggcttttagtcgatttttcggatattgtgaagccgatttacaggcataggtcggcatatgtcgcatcaattgatgaattatgctgttctatggcttacagagcctttatgacagacgatgaggttttcgagccgttcaaggaaaatgatgacagcaaatttattgaaaaagcgatttccgattttgcaagaaccgtaaaagcaaaatacgggaaaaatataatattaaggaaaacatatctaccgctgaacagattggatattacaggaagaatccgtccttttgacgatacggaatttatatccgagaaagagaatctgataagcagagcagaggagatatttgtaaaatgcacagattgctatataattgactatgaaagccggtatctgcctgtgtgcgccgataaaaatgccgatatttccgagcgtatgcttgaaagcgacttctataaggaggcggcagctgccgttgaccgcataatttcgggaacaagcaaaaagacggtaaacaatgttgatatagtcggttatcttgagcggtgcgagcgcatcagaaaggataaccccgatatgtctgccgagctttcccgtgagatattcggcggtgcgtcggagatattcatgacagaataaattttccgtattttaaaagccctttgagaaaaactcggagggcttttggttttgtcgggctgtattattatgggacgagagtttcaggtgcaatacatattattaaagcggtcacagcaaaatgctgtgaccgcttatctgctttattgctttgtgtaattccgccggtaacggaggttgatcctaaattaatccgtcagaacggcgaatttgaagcggctcacagccgcttagtcgccgaaagatacgccgatgctttttcctgtgatgacaagctcatcattttctggaacgaactttgtcttcatcgttacatcggacagcttgttttcggaaatcttactgccgatttttgcgaccgtgtagccgtatttttcctgctttataagcattgcggctcttgcgccgaactttgttgcaagcactctgtcataagcggagggcgaaccgcctcttaatatatgaccgggaacaactgttcttgactcaaagcctgttgcggcttcaatttgctttgctatgcggtttgtaactgttgtttcacccgcttcggcacgctttttcgcacgttcctttttcttcatagcggcttccgcaatatccattgcgccctctgcgaccgcaattatcgagaatgtctttccggactgcgcacgtttttcgcaagcgtcgatgaccttatcaatatcataagggatctcagggataagaataatatccgcaccgcctgcaataccggaataaagcgtcagccagcctgccttgttgcccattatctcgattaccataatacgtctgtgggaggtggcggtggtgtgtattctgtcaacgacctcagtcgcaatatctactgcggtatggaagccgaatgtaacatctgttccccatatatcgttatctattgtcttgggaagtccgattatattcagaccctcttcggaaagaagatttgcggtcttatgagttccgttgccgccgagcgtcagtatgcagtcgagcttctgctgtttataggtggctttcatttcagcgaccttgtctatgttgtcggcttcgattacctgcatcatcttatacggtgtacgctttgtgccgagtatcgttccgccctgagtgagtatgccggaaaaatcctccggcttcattatacggcagttattatggatcagaccgtggaaaccgttggatatgccgactatctcaacgttgtcctcgccgaacatggagtaacaagcttttgccgcacctcttatagtagcgttaagtccggggcagtcgcctccgctcgtcagtatacctattctgcgctttgccatttgtacatccagcctttcctgaaagatttgttgttttctgctaattaaattatagcatacatactccaaaagtcaagaaaatattatagctcggattatgcagattatacaatttctgtgcgttatacgcctgtatatatgcctgcgaaaagtggcagcatcgtttcgttgtcgagtatcatatacataaacgggcggtccaggattacctgcttttcgttaatagcacacgcattgtcaaccatttctacaagagcggcggcacctgccttagtacctttctcgtttacctcgattttagtcttgtgaatgactttgccgatggatatattgcctacagttgatttgccgatgcccgaaaaatccgcattgttttcgtcaaatgctgtcggcataccaagttgtgacaaagcgttgttcagtgtgtctgaatattcattgctgaatttcgggagctttgtttctacgctgcagctttcggtactgcttaatatcctgcagagcttttctccggataaggaggatatgaaggaggctatatcattatcgggaagtaaagccgcaaagctgtattttccgcccttatactgttttataaagcctttacagccgtcgctttcaagataaatgctttcggttgaatgcatcatggtgacattcatcagcttgtcttcggaatttgtgaattttccgtccgcaatatcattttccttgtagacatttccccattctgcatcaaagctgacggcgtttataagatacattatcgcttcatcggggatgttgtcaagtattttgtctatcataccgtcggtattgtcgcttacccaattgttaatctctttgcacgttgcgttgtcaaatgcacgcttgtatatcgccgcaccgaaataatccgcatttttctgcaaaaagtccttttcaacggtaagcctgttttcttcatctctgaaccatatcgaatttgcgtttttcagcttgaagttctcgcctgatgtaagcgagccgctgaatgatgaaagatatttgttcagttcgtcaaggggcattccgctcccgagtaccttttccatttcatctttggtctgaccgtttgcaccgtttgctgtcattgcgagtgcggatgataccgacaggggagagataagagtgtttgatttgccgtaaaagcatttcttaagcagttcgacagagaaattgccgtatgcgcttttaaaagcatcgtcgggttttacggtttcgtggcttgcggctttgatgcctgtcataagatccgttgtttcgtaggtctgatttgactgacaagctgagagtgagagtgctgatatgagtattgcgcttgttaatgtgagggatgtaaattttcgtttcataaatagctcctttcgcagtaagcaaatcgtgtactgtattcgcatataatacaattcaaagcatctgattgtccacggaataatgtattttctgattaaattatataatattttccctcaaagtaaataaaagttacaagattgtaaccatttcgtcggcatcatgcaaccgcttttgccgaccgctgagttcaacgggcggcggtggcgtttttaatgacgatatttcggttttctctattgacaaactgcgttgtgatggattataattatgtaaggagcgtgtaagattttgcacggtaaaattctatgaagtttttttaaaataaggagaaaagatatggcatacatactcggtgtcgatataggtacgtccggtacaaaaacagtgcttttcagcgaggacggcacacctgttgcatcggcgctttacgattatcctctttacactccctgcaacggctatgccgagcaggatcctgcggactggtggaacgcctgcgttaacagtatccgtgacgtagttgcaaagagcggagttcccgcagacgagataaagggcgtaggtctttcgggacagatgcacggacttgtaatgttggacaaggataacaaggtaataagaaacagcattatctggtgcgatcagcgtacaggcaaggaagttgtcgagatcaccgaaaaggtaggtcacgacagacttatcgctatcaccgcaaaccctgctataacaggctttacagccgcaaagataatgtgggtaaagaataacgagcctgaaaattacgaaaagtgccgtcatattcttctccccaaggactatataagatttatgctcacgggcgagtttgctaccgaggtttcagacgcatcgggtatgcagctgcttgatattcccggcagatgctggtctgacgaggtgctgacaaagctcggcatcgacaagtcgcttcttgccaaggtttatgaaagccctgagataacaggtaccgttacaaaggctgtagcgcaggctacaggtcttaaggagggtacgcccgtagtcggcggtgcaggtgataatgcggctgccgctgtcggaacaggcgtagtagaggacggtaaggctttcacaacaatcggttcaagcggcgttgtgtttgctcatacttccgatatatctatcgaccccaagggcagagtacatacattctgctgtgctgtgccgggatgctggcacgttatgggcgttactcagtccgcaggtctgtcgctcaagtggttcagggataattttgcgtggagcgagatggaaacagccgcttctatgggtgttgacccgtactaccttatggataaggaagccggcagtgtgccgataggtgcaaacagactgctctatatgccgtatctcaacggcgagagaacacctcaccttgaccccaacgtaagaggtgcatttgtaggtctttccacaatgcacaagaagaaggatatgctcagagccgttatggaaggtgtttcctattcactgcgtgactgtgttgaggttatgcgtgagatgaatataagcattgatgatatgatggcttgcggcggcggcggaacatcaccgctgtggcggcagatgctcgcagatctttatgcctgcaacgtaaagactacagcaaacaaggaaggccccgcactcggcgttgcacttcttgcggcagtaggcgcaggtatatacagttctgttcccgaggcgtgcaaagcggtaatcaagcccgaaaagatacaggagcctatagctgaaaacagtgccaagtacgaaaaggtatatgcgctttacaagaagctgtatcccgctatgaaggcaaactttgacgagctggcttcacttgatgtataatttgcaatattgtcagtaacggaatacggcttttgtgtgttgctgtaatccgtaggaatattatgttaagtccggttaaccggaaaggagtacctatgaaactttttatcgacacagccaacgttgatgacatcagacgtgccaatgatatgggcattatctgcggtgttaccacaaacccctctcttatcgctaaagagggaagagatttcaagcaggtagtaaaggaaatcacagaaatcgtagacggtcctgtttccgccgaagtaatttcgcttgaagcagacaagatggttgaggaggctctgccacttgccgctatacataagaatatcgttataaagctccctatgtgcgaggagggtcttaaggcctgcaagcagcttacagcaaagggcataaagacaaacgttactcttgtgttctcagccgctcaggcgcttcttgccgcaagagcaggagctacatttgtcagcccgttcctcggcagacttgacgatataggcatggaaggcatgaaccttatcgaagagatcgttgacatattcaatgcacagggcattgaaacagagatcatcgccgcatctatccgtaacccgatgcacgttacacaggcggcaagactcggatgtgatattgcaaccgttcctatgaacgtacttctccagatgcttaagcacccccttaccgacaacggtattgacaggttccttaaggactgggaaggcttcacttccaagcagaagtaattaaagccgctctgagagcgtgcttaaaataaccgaaaggaaaaatgaaatgtacagtaatttagttgacacgatcggctttctcaagggaatagatcccgatgttgctgacgcaatggacaaggagcttgcccgtcagaaaagaaatcttgagcttattgcaagtgagaatatcgtttctcctgctgttatggcggctatgggaagcgttcttacgaacaagtatgctgagggataccccggcaagcgttattacggcggatgcgaggacgttgatatagttgagaatatcgctattgaacgtgcctgcaagctgttcggagcaaagtatgcgaatgtacaggctcactccggcgcacaggctaacacggcggtttattttgcactgctgaatcccggcgacacggtaatgggtatgagccttgctcacggcggacaccttacacacggttctcccgtaaacatttcgggcaaatacttcaacttcgtaccttacggacttgatgaggaaactggcagactgaattacgacaatatacttgcacttgcaaaggtacataagccgaagatgattgttgcgggtgcgagcgcatatcccagagcaattgattttgaaaagctctcggctattgctaaggaagttggcgcatatcttatggtagatatggcgcacattgcaggtcttgttgcaggcggtcagcatatgtcgcccgtgccttatgcagacgttgtgactactacaacgcataagacgctgagaggacctcgcggcggacttatccttacaaatgacgaggagcttgcaaagaagatcaacaaggctatattccccggcatacagggcggacctttaatgcacgttatcgccgctaaggctgtttgcttcggcgaggcgctgaagcccgaatttaccgagtatgcaaagcagattgtgaagaacgcatccgttcttgccgattctctgcttgaaaagggattcaatcttgtatcgggcggtacagacaaccaccttatgcttgttgacctccagcctttcaatatcacgggtaaagagcttgagaagaagctcgacgaggtgtatatcacagttaacaagaatgctatacccaacgatcctcagagtcctttcgtaacgagcggcgtgcgcatcggtacacctgcggttactacaagaggattaaaggaagacgatatgaagcagattgcacagtgcatctatcttactgcgaccgactttgacaacagcgccgacaaggtaagagaaacagtaactgaaatctgcagaaagtaccctctgtacgaataattgcatataagcgagaacgagagattgattccctcgttttcgtgttgtataaaatatcggttaattgttgaatatagaaaggaatttgtaaatgacagcatctgcaagagatattatttttaatcactcggagagagtagctccgctcggacttattgctatacccggttctgaggagcttggcaagaaggtcaacgattaccttgtaacatggtcaagggaagcaggctacgattatgataattttctcattgagaatgaatgccccagattttcttccggtgacggtaaggctcttatcaagaatactgtaagaggttatgatgtttatattattgccgacttcggcaattacagccttgaatatccgctgttcggcaaaatgaaccgtatgtcgcccgacgatcacttccagaatctcaagcgtatcatacaggctatcggcggtaaggctcaccgtatcaacgttatcacacctatactttacggcggaagacagcacagaagaaactacagagagtcgcttgactgcgctgtagcacttcaggagcttcagaatatgggcgtttccaatatcgttgcgtttgacgctcacgatcccagagtgtgcaacgcagttcctctgatgggctttgataatataatccccacatatcaggtgctgaaggctctgttcaagtatgtaaatgacttcaagatggatatggatcattttatggttgtcagccccgatgaaggtgcgctcaacagaaatatgtactattcatctgtactgggtgtagatctcggtatgttctataaaagacgtgactattcgcggatagtgaacggtcgtaaccctatcgtagctcacgaatatctcggtaactcggtcgagggcaaggatgtgttcattgcggacgatattatttcatcgggcgaatctatgcttgatattgctatcgagcttaagaagcgtaacgcaaagagaatttttgcatatgcgacatatcctatctttacaaacggtcttgaagcgtttgacaaggcttatgccgatggcaaaatcgattatgtgttcggtacaaacctttcctacagaacgcccgaactgctcagcagggaatggttctgcgaggttgacgtgtcgaagtatctgtcatatctgattatggctcttaaccacgatatgtctatcagcaaggtaattgatcctcaccagaagataagcgctttacttgaaaagcacaagaacgactgataaggtaatatgatatttcagcctccgctctgtgacgggcggaggcttatctccctgtcccttaggttttctccctcttggctccctctttccttacccatacccacaccccgtcggggtgttggcaaaactcgaataaccattcgaacattgaatatcctgtcaattcagggacgcttaacgctacacgtccgcagattagtacatatatctcaggttagtggcgtttttttgaagagtcaatgttagagcagttgcactgatacactcacgaaattattagtgccttgtccgtacggaaaatgttttaagcggtgttggcactatatttcacagtgaggctttaataataatctgtttttcataaaatccgtaccggcagctaaccggtacggatttttttgtatctgcaaaaaaatcgctcccttgaaaaagggagcgaatgtaaagatgcatttattcgtttgtttcgttgttgttatcgccggtggcctctgcggtatcttcgcaatcggcaggaacggtatcactgttttcgctgacgggagcggctgtattatcatcaagcggttcgccgttcataagcttgtagaaatcctcgccgtcaatcttctcatgttccataaggtaatgagcgaccttgtcaagctgatctctgtggctgagcagtatctgcttagcattttcgtagcttgtgtcaataagctcacggatctcgccgtcaatttctgccgcaacgttttcggagtagtttctgccctgtgaataatctctgccgaggaacacttccgagttatcgtgtccgtatacgataggaccgagcttttcggagaagccgtatcttgttatcatacttcttgcaaggtcggtagcacgttcaatatcgttgcttgcgcctgtcgagatttcgtcaagcacaatcttttcggcaacacggccgccgagaagaacaatgacttcttcttccatctgcgtcttggttctgaagctcctgtcatgctcggggagcgacattgtgtagccgcctgccatacctctcggtatgattgaaacctggtgtacgggatcctgcgtcttgcagtggaatgtgcagacagcgtgacctgcctcgtggaatgccgtaaggcgcttttcgtcctcgcttacaaccttcgacttcttttcgggacctgcaaccaccttgatggtagcttcctctatatcaggctgagtgatagcctttctgttgtttcttgccgcaagcagagccgcctcgtttacaaggtttgcaaggtctgcgcctgtaaatcctgccgtaccctttgctattgtagcaaggctaatatcgggagcgagctttttattttttgtatgaacacgcaggatagcctctctgcccttgatgtcggggtagccgacagtaatctgtctgtcaaaacgtccgggacggagcagtgcggggtcgagaatatcacgtctgttggtagccgcaataactattacgccctgattatccgtgaaaccgtccatctcaacgagtaactggttcagtgtctgctcacgctcatcgtgaccgccgccaagacctgtacctctctgacggcctacggcatctatttcatctatgaaaattattgacggggtgtgctttttcgcctgatcgaacagatctcttacacggcttgcaccgacaccgacaaacatttcaacgaagtccgaaccgcttattgagaagaagggaacgtttgcttcgcctgcaacggcctttgcaagtaaggtcttacctgtaccgggagggcctaaaagcagaacaccgcgcggtatctttgcaccaagctcctgatactttctgggattcttcatgaaatcaacgatttcgctcatttcttccttttcttcttcggcaccggcaacatcggcaaaggttattttaggaccgtttgaaggctgggtccttgcatttgcctttgagaactgcgacatctttccgccgccgctcgcctgacgcattatgacgaatgtaaatcctatcatcagcgcaaccatcagcagataaggcaggaagctcagcaggaacgagttgtctgaaacggggtagaagtcctcgacaagctgactatcgggattcttttcgttgtatgcctttctgtagccctgcgtatcctgtaagaacaggcttacgttcggtacggaatacttatacttctttgtgttgtcgcttttcagggtgtattgtaattcgcccgaaccgagatcaagcgtgtagcccgatacgttgtagttgtcaaattcgcttatcacctttgagtatgttgtatgctcgccgggagttgcactcatctgaagcattgttaccataccgataacaagcagaacgataactgcaaggtaaatgaaaatgcctttgaatttgttgttctgattcatcagtttccctttctgtcggtcgtatctgcatagcatccgaccgcctctacggttatatttttacagcctcgacgttgctctcaacgtgcctcgaccttaagctcacctatgtaaggaagattcctgtaaagctgggcatagtcaagtccgtatcctactacgaacacattgtcaacgtcaaagccgatataatcagccttgattacttctgattttctgactttcttgttgagcagagtgcatacctttatcgacgcaggctctctttcaaggaaaagatcctttacgaatttcagcgtttttccgctgtcgagaatatcctcgacaagaataacgtgtttgccctttatatctgccgaaatatccttagtcagtctgagctctccggatgtggtgccgtttccgtaagactgaaccgttacgaaatccagctttgtataaagatcgacattcttcagcacatccgacaggaacataaacgagcctttcagtatgcctatcacggttacttcttcgcccttatagtcctgtgttatctgtctgcctatttcctcagctctttttacaagctcctcgctcgtaaaaagtactctttcaatgtcatcatgtatgtttttcactactaattctctccgtaatcacgttgtattaaataatacatcgcttatgttaaataaatgttaagcgatgaaaacaaaacggcaatacagccattatagcacgattatgccgaaaaagcaacggcgataatcatttttaagctgtttatcacattaatttcgtctgaatttctcacggtctgtcacaacaaacagctttttctttcttatctgaacaaatctgaactggcacgggtttatctttccctgtccggctcttataattcctacgcagctttcaaccgctttcatattcggcggtatatcgttatccttgaaaatcatcgtaacgatacggcgaagtatacaatcatcggcggtgcgcagtataccgacatcatatttaacatcggcggtgcgagccttttccataagctccgatgcgattttgtcaagatacctgtcatcgtccgacacagactgcgacagcctgcttatcgcaccgaaaagcgaggggtttatctccttcagcaaaggcacgaccttatgtcttatcttgtttcttgtataatcatcagacagattggtgctgtctgtgacataatcaagacagttttcactgcaataaagctctatatcctcacgggtattgtataacagcggacggattatattgtcacgctttgccggaattccgcatatacccgagagtgcagtgcctctgaccatatttatgagaatggtttcgcagttatccgacgctgtgtgggcggtcgctatcagcctgtccttgcttatgctctcgaagaattcatatcttaaccgccttgcacattcctcaaggctgtcgtgcttttgccgtaaatcatttacctttatgcttgcagtgtacagcggaatgtcaaggaatctgcacatcctgcggacaaaccgctcatcgctgtcgctttcctcaccacgcagattatgatttacatggcaggcggcaagcgaaaagccgagctcgtctttcagcgaatataagacatacagcaaggcgacgctgtctgcgccgccgcttaccgccgcaattacagtatcgcccttatttatcatcgaataccgttctatagtatttttaacggaattttttaaattactgctcggcatggacatactccacatctgtaaatctcgtgtactgaccgtcccatatcatgtttatatcgttggtttcaccgtgacggttcttcgcaacgatacacttacaggctctctgatcctctgcctctttgttataatagctgtcacggtacaggaacagaactatatctgcgtcctgctcgatagaacccgaatcacgaaggtctgacagcataggacgtttatcatcctttttttcggcggaacgtgcaagctgtgacagtacgattatcggaacattaagctcctttgccattatcttgaggtttcgtgtcatttccgaaatttcgtttacacggttaagatcccttctgcccgaagaaataagctgaagatagtctattactatcagcccgagattatcgacacggcgtagctttgccttcatttcattgaccgttatcgctgagctgtcgtctatgtagatattcatatttgacagtacgaatgcggcatcggcaagatttctccactgtgcagggtcaaatctgcccgttgacataagctcgcttgaaattcttccctcagaggacagcatacgctttacaagctgttccttcgacatttcgaggttgaatacgcatattgatttttcaggatgatattttgcgacatttgtcgccatattcatagcgaatgacgttttacccataccgggacgtgccgcaactatcaaaagatccgacttattcaatccgtgtatgtacttgtcaagcgaggggaagcccgatttcagaccttgtatgccctgcttgtcggggtttgcacaaagctcggaaagctcgttgagaatgccgacaatgacagcgttcagccttgtaagaccttttacctggttctcgtttcttatatcgtatattcttttttcggcaagctcaagcagagcggcagtggccgtctgtccttcgtttgcattttcaagaatatcgcctgctatgcttataagaagccgtcttgtgtacttatcctcgactatttctatatatctgtcaacgcttgagatgctggggacggtttccatcagctttacaagatagtttctgccttcctcctgcgactcgaaaacattgttcttcatgcagttttcaagcacggtaacaacatcaatattgtcgcttgccgcaaacatctgcatcataacagtgtatatatctgtgtggacttttacatagaaatgctccgggtgcagttttgccgacgctttcggcatatttgcgtttccgtcaagcagtatggcacccagtacggactgctctgcatcaaggctgtacggaagatttacccccgcaagctccatctcagccattattcttcctcaacctttacactgaactgtgcaacgatgcctgtaaacagccttgcctctgcagtgaatgtaccgaatgattttatatcgctttttgtaacgatttttctcttatcaacatcaaagccgaaatcacgctttataagtgcgcttatatccttgccggtaacagagccgaacagctttccgccctgacctgcttttgccttgaatgtaagcaccttgccgtcgatagtatcctttatcttctttgcgttggccgcttcaacatcgagcttgtgctgtgcggacgccttctgtccttcaaggtggttaaggttctcgtttgtagcttcaaccgcaagacccttctttataaggcagtttctcgcataagcgtccttaacttcctttacctcgcccttcttgcctgagcctgccacatcctgtgtgaaaattaccttcattttatatcgtcctttctttaactgcgctgtgcagtcttattatcgtttgagtttacctttataagacttaaatagtagtcatcaatcgacttcttgagagtatcaagcgcttcgtttaccgtaacgtcctttagctgagcacctgccatagtctgatgaccgccgccgccaagagcctccattataagctggacgtttaagttgcccatgcttcttgcgcttattgatatttcgttgctcatcgttttgaacaatacaaacgatgcgtcaacattcttgatagtcagcagttcgtctgccgcctgaggagcgactatcctcagatcgtccgcatagaagtcacacggtgctatcgcacacttgcggtaaatttctgcctctgcgactatctgtgtttttctcttgtagctgtctatagagcttgagaacattttctttacggttatagtatccgcacccatcttacgcagtacagccgccgcttcaaatgttcttacgcccgttttcataacgaaattctttgtatcaagcataatgcctgcaagcagacactccgcctgcaccgctctgagctttcctgcctcgccgaaatactgtataagctccgtcaccatttctgatgcggatgaagcatacggctcgtggtggaatattaccgcattgtctatgtagtttaccatcttcctgtggtggtcgatgacaactaccttctttgccttttcgtaaagctccttgctttctattataagcggattatgcgtatcgcagataatcagcagtgaattgtccgtcaactcctccatagcgtccgcaggctctgtgaacagcggttcttctccgtcaacgtgggggaatctgtcaatcaggacttttgcaagcgaggtgctgtagtcgcataccgcccaggcgctcttgccgagatttcttatggcgcaggtaaggcctacagatgagcctacactgtcaaggtcgctgtacttgtgacccattatgaatatcttgtctgcattgtcaacaagctcaagcagtgagtttgcgatgattcgtgtcttgacctttgtgtgacgctcaacgccctttgaaacaccgccgtaaaattcaaagccgttgtctgtctttacagccgcctgatcgccgcctcgtccgagtgccatttcaagcgcctgacgagcgaactgttcgctttctttcagcgttttacctgttctgccgatacctatcgacattgttacgttaaggcggtcatttacgaaaatttctcttgctttatcgagaatttcgaccttgttacgcaggatttcctgcaggtgtctttcttctattacggctataaatctgtcggacgcattctttctgagtacgcctgtcgtctgtcccgcaaaatcttcaagtagcttgtctatctgtaccgaaacgtgagccttttcactttcaaggcaaccgcttataagctcctcgtagccgtctaccataaacagtatgacaacgggctgtgacagctttttctctgtttcaagagcggttatgtcggttatgttcttgaagaataacagcgtcagttcttttgcttcgtcctcatcgggtattcttgcaaaaaccttatatacgctgtccttgtatctgacggttattccgtcatcggtgaagaaatcggcaggcggaatatcggttatattcgacagctccataccgtattcgcaacaatcgggaaattcttctgtgaattttccgtttgtccagactattcttccggcgctgtcgattataacggcggacataggaaagctatgcacggacatatgcatcttcgattcaagctcatcgtctattcgtgcataatactggaatgtttttcttgtgacctgtatcagttttcctatcgcaaaaccgcctataagcacgacaaaaggcgcagacacccagaatacattgatgtccttcgtgtaaatatatccctggattattaccagtgcgacaaccagtgcggaaaccgatattacaagtccgccgtcacgataaaaattcttcaccttttgcgcctcctttgtattccgttattttacacttccattatgataggcagtatcataggacttctcttggttctctggaatatgaagttgccaagctcatcccttacgttagactttatattgccccattctctgatgttcctgtctgcgcaggtctggagcgttttcttgacaagctgtttagcgtcgtccataagctcctcggattcccttacatatacaaatcctcttgatactatatcggggcctgccgctaccatacctgtttcacggtttatagtggttacaacaacgataagaccgtcctcggacagatgctttctgtcacgcagtacgaccgagccgacatctcctactccgagaccgtcgacaagcacctttcctgcaggcacctgacctactaccttcatttcaacactgtcggtttcaaccacctgaccgatattcagaagaaatatatttttctcgggtatgcccatctttattgcaagaccctcgtgctttttcatatgcttgtattcgccgtgtatcggtataaagaatttcggctttgtcagcgcaagcatcattttaagctcgtcctggcaggcgtgacccgaaacgtgcacctcgtacatagcctcgtatactacctctgcaccctgcttcataagctcgtttacgagctttccgacaaacttctcgttgccgggtatcggagtagccgaaataatgataagatcgctcggtgttatagatacctgtctgtgatctcccgatgacattctcgaaagtgcggaaagcggttcgccctggcttcccgttgtgataattaccattttttcaggaggatatttgttgacatcttctatatctacaagcataccctgaggtacttttatataattgagttcaattgcggtagtaagcacattgagcatacttctgcccgaaacggcgacctttctgccccagctttccgcattgtttataatctgctgtattctgtgaatgtttgaggagaatgtagcgacaattattctcttgccctctgctcctgcaaaaaggctcttgaagctctctccgacctttctttctgtagccgtatagcccggacgctctgcgtttgtactttccgaaagcagtgcgagaacacccttgtttccaagctcaccgaatcgtgcgaggtcaattataccgccctcgataggtgtatagtcaaccttgaagtcgcctgtatgcactatcacgcctgcaggcgtatgcactgccattgcacaggcatcggggatagagtggttcactctgataaattcaacgctcatacagcccattctgacattctgacggggtacaaccacgttcagcgaacactgcgacagtatgccgtgttcacggagctttccctcgacaagtccgagcgtcagccttgtgccgtatacgggtacgtttatcttcttaaggaagtaagggagtgcgcctatatgatcctcgtgaccgtgcgtcagcacaatgccccttatcttctccctgttcttttcaagataggtgaagtcggggataacaagatcgacaccgagcatatcgtcatcggggaaggcaagtccgcaatctatgatgaatatatcgttacagcactcgtagacgtagatgttcttgcctatctcgtttacgccgccgagcgacataatccttacgggtgtctttctgccgcttttcttttcgtcctccgcaaagaaagaagggtactcctgctttctcgtttcctgcttgttattgttatgatgcggcttgttgtctgtaagaacaggctttttatcatttctgctgtctgctgagatgcttttcttttcactgcttttattgtcggtcagcaccggctttttgttctgatttctgttgtcggtaagcaccggctttttgctttcggatgctcttctgtcagtcagcacaggctttttgctctgctgtctgttgtctgtcagaactgttttatttgcaggctttgcatttaatatccctgtaagcgattcgcttgcgggagcgtccttaggggcgttcctgtcggtcagcttgaactgctttgcaaaaggattctttcttcttttcgagtaaggctttgtagccttcggctttatgttttcagtcgccgtcagtaagttttttgagtcaataattcccattcagtataccatccttccgaatagccgacaggtgttgtctttttatctttatgtatgacatacagccattgtcggcggttctgtacggaaaagcggcggtatataatttcgtccacagcttttacggcaaaaagccaaaaccgcttgtacgctcctgcaaaaagacacacctctccctgcaaaagccaaagcgaagctaagcctgtatcggtgatacagccattcctgccgtaagcggcattgtcaatatgtcgtcctgagtacaataaacgtgctgctcttaccgtaactgaacgtttaccttgtaagtaccgtattcgtgctatcgaaattttatgctgaagtaaaaggaaaatatataatttcttaaagccgcttttccattattcttttgtttttataatttacctcgctctttgttcctacgcattcaaacggcttatccttgccgtcaagcacaagcccgtcaaacatatcctcgtactttttgcagtcgagcatattctttccgaagattttcaccagcgtttcatcgtcaagaaacgccgacagcagtatatatacataaaggcactttgcgcaatccgcacaccatgtatccgtttttgagccaagattacagctctggaacacagggaaatactgcggataggtaacgaatttctttgctatctgccactcgctccacggacgcagaaggctgaaatactgtataccgtcatcaagataatcggtaacgtagcttctgaaatcacgctcgaactcggtgcttttgctgtactggtgatttacctgcctgccgctgacataggtttcattcgcactgctttcatttgacagcactatatacttcttgccgtaaagataagcaaacagataagccgagaatgcgaccaccgccgagaacggcgtatgaccgttcaggtatccgtccgcattgcgttcaaggagcgccctgtctatcgttctgcgaggtccgacaattttgctttcgtcaaagcctgcgaccttggcgcactctaccgtagcgcctctcggatttattatatagcacagcgtttcatcgtgatattttctgagcagttcaagagaaacaacgctgtcctttccgccgcctaccgcaacgagataaccgccgacttccctttcacagctgtatttacgcttgccgttatcatcaggtactatctgcataaagctgtcaaaatcagcgtctatattatttctgtagaagaactctccaagtccgttgaagtagagctttttccaccacaggcactgcttttcgtcgagagaaccgcactttacctttacaacaggcggacaggcgcatttccagtagctgacaagctctgccataccgagattgaatattatgtattcgagaaacggagttacgtttttgagaagtccgctttcggttttccacgatggataaaaatgataatcatctatcgaaaaatgaaagaatattccgtcgtcggcaatgtcgtagccgtgatatataaattccttgtgcatttcacgaagctctctgtattttcctgcgttgtccatactgtttcctcctgtttatattataaccggctttgaagtaaattcggcaccgcacggctgttttttatcaagcgccagtgcgtacagatttcccgctctttcttcaagtcttgcaaaacgctccgcttccgcacttgtttttgccagtgccgaaagcgatgtgtccacaggcagcttatgctcccctgcggcaagtatttccctgccctttgaattcattcccagtatcctcgcataagcaggaggatttttaagatcgtttcccgttatgcctaagaatgcacacagcacaagtctgcgtattcttgccatagtaaaattctttgattttatcataagcagtaactgcggaagtgaaaccgccgtgcgtaccgccttatatatcctgctgtccattccgcccgtgccgttgggaagccgttcaaattccgactttgacatagtgcgtagctttgcaaggattgccgtttcgatattttcaatatgtgcgaaattctcataatcggcaaaatcggtatatgcacttacatcttcgcctgcactcaacatttttctgagccttgatgcgctgattaccgtatcactgccctcgtcactgtcgtgtgccgcaccgctcctcattaccgtgaccggctttatcataccgcccagcttgtcaagcgcacggatatattcgacagccagcgtgttgtttggctctgtaagcgtttgcacgacatctgacgtataattcttctcgaccgtctgcttcagtgccgcaggatacgaagcgcctttacgcatcaggctgaaaaactcatcggtctgcaccgcatattcaacagctcctgccgcctcctcaagcacagaaacatcaccgcattcactgccgaagctcagcatatcgacacaaccgagcgaatcggcaatacggcaagcccccatagcaaaatgctccgcactcgacagtgcaaacggagtaggcagttcgaccaccagatccgctcctcccataagtgcggctctcgctctcgcatatttatccgcaagcgcaacatcgcccctctgggtgaaatttccgctcataacgcatacgatatgagttgcgccgtgctgtaaacgggtttgctctatgtgatatttatgtccgttgtggaacggattgtattcgcatataattgccgctgttttcattgtgtaccgttatccttttaagtcaaatttactttctgctgtatctgaagtcgcacatatcggcgccctcagctataatttttgttcttgtgagcttcatatccataatgtccacaagaacatagtccatacggcacatatactgtgcgagttcgggacagccctcgtctttgcacagcttgcatacaccgcattcgtgatagtcataaccaagctcatattcatcgtttgcaggtaatatatcaactacccagtcattctcatattttctcttgtggctttcttccgaccacgcaagacgtccgggcatcttcttttcgtcaagataactgtctacattacctacagctttgtgaaacagctttgaagcacataatccgtcttttagtatttcgtaattctcttccgccatctttcctgtactgcggttcatagcgataaaatatgcacccatcatataagagctcatcagctttgacttgccgatgccttttgcacgggtaactatcgccttatgctcggcaaaaatcttcttcgccatatctttcggaaaattccgtctttcaagttcagcctttactgcgctgtgataaaaatgactgagaattctcacgttgaacgaatagttcatttggtttttaccttgcctttcttaaaacactttatatttccaacaatcaatatttgttgtttaatgtctgttgtatcaccgtttccccgaccgtccgccgtacttcagcccctcactgacctttaaaaaggtcggaatttgaagcggcacattgccgcccgccgttttgctatcctgcggatagctgaaactgctccaaaggcggaattgtctgcggcgaccgttatataactgtaaagtctgttgtatcaccgtttccccgaccgtccgccgaacttcagtccctcaccaacctttaaaaaggtcggaattcggaacgaacattgccgcccgccgttttgctatcctgcggatagctgtaactgctccaaaggcggaattgtctgcggcgactcgccgcaaggtcggaatttggagcggctcacagccgcccacttagaagaatgaaatctgtgcggattgagggagatccccgaatacattcatatcatacagcttgctgagaacggtgctgtttatacctgattgtgcctgaatatcctcaagacagatgaaatctcccttgtcgataacttccttgagcttgattgcggcgttttcaccacagccctctaccgcaaggaacggcagacggagatttccgtcctctatcgcataagttgtcgccctcgacttcttatagtcaacaggcaggaacgtgatgcctctgagcatcatctcatatatcagcagcagtgcgtcaagcatacccttgtcttttgcagtagcctccgggtttgactggataagctgtatcttgtttcttacgctctccttaccgccgagaaccgtctttacatctatattttcagtgtgctttgtaagtaccgcagaatagaattccgacggataatagaccttgaaccagcacagctttacagcaccggttacataagcggcggcgtgtgccttagggaacatgtactttatcttcttacagctttcgatataccactgcggtacattgttttcttcaaacgccttgtatatatcctcgttgaacagcttcttggcattacccttacgggttatctccattatcttgaatgcgagcttcggctcaagaccctgatgcataagataaaccataatatcgtcacggcatccgataacctctgaaatcgtgcaggttccgtcagagataagatcctgtgcgtttccgagccatacgtcagtaccgtgcgacagacccgagatctgtaaaaggtcggagaatttcttcggctgtgcatccttaagcatctgcagtgtaaacggcgtgccgaattcggggataccatatgtaccgcttgaaacgccgagatcctcctcttttatgccgagcggctctgtcgaggtgaacagctccatgactttgggatcgcttgtcggaacatccgctatctttatacccgtcatatcctcaaggtgcttatacagcgtcggcacatcgtgtccgagttcatctagtttaagtatagtatcatgcagtgcgtggaagtcgaagtgcgttgttatcatatcgctctccgtcttatccgccgggtgctgaaccgccgtgaagtcataaacctcataatcgctcggtacaacgaccattccgcctggatgctgtgacgtagttctcttaacgcctgtacagcctgccgcaagacgtgatatttcggcggaatttgccgtcatacccttcttttcaagccacttgcgtacaaagccttccgcagtcttttcctgcacggcggagatagtacccgccttgaaaacgtgatccttaccgaacagttcttcggtatatctgtgtacctttccctgtacctcgcccgagaagttaaggtcaatatcaggcgacttatcgccgtcaaatccaaggaacgtttcaaacggtatatcgtgaccgtcacggatcatatctatatcgcagttcggacactttttcggcggcaggtcaaagcctgagccgtaagagccgtcaaggataaattcattgtgtcggcacttggggcatctgtagtgcggaggcaaggggtttacctcggagatacctgccattatggcaactaccgatgaacctaccgagcctcgtgagccgacaagataaccgttcttttccgagaacgcaaccagcttctgcgctatcatatacagtacggcgaatccgtgctttatgatagagtcaagttccttcttgagtcgcttttcaactgtttccggcagattgtcaccgtaccatgcgtgcgccctgtcccagcaaagctgctgtaattcttcgtctgcaccgtcaatatggggagtatatgtgcctgtggggataggccgtaccacctcgatcatatcggcaattctgttcgtgtttgtaataacgacttccttcgccttttcttcaccgagataagcaaattcctcaagcatttcatctgtagttctgaaataaagcggcggttgattagcaaagtcctcatagccctgtcctgcctgcagtacctcacggaatacagcgtcctcagggtctttgaaatgcacgtcacaggtagcgactaccggctttccgagcctgtcaccaagctcaactatagcacggttgagatctctcagatcttcttcactgcttaccttgccgtttctaagcaggaacatattattgccgataggctgtatctcaagataatcatagaacgatgcgatttcctctatcttctcctgcgattccttttcaagtatcgccctgaaaagctcgcccgcctcgcacgcacttcctatgataagtccctctctgtactgcgacagcagggatttcggtattctcggctttttatagaaataatcaaggttcgatgcggaaataagtctgtacagatttttcagaccgaccttgttctttacaagaattatctggtgataagtagggagcttctttatatccacacttccgaacgccgtgttgaaatcgcctatgtattcaagctttgcggtctttcttgtatcgtttactatgtgcatatatatcatgcacagcatttctgcgtccgcaaccgctctgtgatgatcaaagtcgcccagcttgaaatactttgctatagtgtcgagcttatagttcttgatacccttgagcgccgcctttgcaatactcagcgtatcgactacaggattatcaaagctctttcccattctcgtggcggcacttctgataaacgacacgtcaaactttgcgttatgtgcgcagacgggagaattgccgcagaaagccataaagtcgctgaccgcaacatcctcggtcggagcgtcggctaccatatcgtccgtgatacccgtaagttccgtgatatttgacggtatcggcatcatcggatttacaaatgtcgagaatcggtcaactatctccatattacgcagctttaccgcacctatttcggttatacgctcgtttgcgggatgaagtcccgttgtttctatgtcaaatacgattatatcgtcctcgatttttactttgtcacacccgtcaacaactgcgtttccgtcatttacaaagtatgcctcaagaccataaatcaccttgaagtctggatcgtccttgtttatcttctcaacggtgttcatagcctcaggatatgcctgtgcgttgccgtggtcggttatagctaccgccttgtggccccatgcgtgagcctgctttacaagcactgacggagctgtaactgcgtccatatccgacatattggtatgcatatgaagctctactctcttttcgggagcattgtcctgcttcggctttacctcgacaagcattaccgactgcggattaaagcagttgcagtgcagaaaatcgtcagccttataactgccgtttgcaagtatctttgtaccgttctgaatgaagctgtagctgtcgagctttgtattataaacgaacagcttcattatcatagatgaagtcctgtcgctgaatgcggctgtgattatcgttgactttccgctcttggtttccttcttctcgacattgaagatttcaccccatacggtaacattgtcacgctcagtcattatgcttgccatctcaacgggagcgtcatttatcggcttgcccattacgagcttcgctttactgccgaaatgcgtggtttcaaacatcagatccatttcctcaggctctgcaaacacgtttgcctttgtcattgcaggagcggcaggcgcatttcctccctgtgaggaagcctttggcgcaggtgttttcatagtgtaatcatcacgcagtgaaacctgcattatatccgtaggattgaactgcatctcatttgcgaatgtgtcgagcttataactgccgtgcataacaaaaaccgcaccgtcttcaagaaaatcgtaatcgtctattatttcagccttggcaaacagctttacaggtatcctgcccgtatcgtcgcaaagcgatgccgtgattatcgtgtaaacgccgtttcttgtatccttatgctcgacatcggtaagctcgccccataccgtgacgctgtcgctttcttcgcccagtgacttcagcgactgcggtgcttcggttatctcgtttccgagatataaaagtccgtccgtgttcagcttatcctcaagatatgtaagcgttatcttgcccggacgctttctcggctcgggtcttgatttcttgccccttgaacttttgctctcgcttgcacgctctgccgctttcctgtcgatctcgtcaaaatccggaagcggctgtgccgacaattcctcataatatctttcgtcaaggtctgcataacctactgtcgcattttcgctgaattttaccgttacgctctttgagaaaacgccctttgtgaacttctcaatttccttgtctatcttctcgctgtacagaaggtcaattccgccgtgcataagcgtaaactcaaatgtatctccgtcgtcgcttatctcggaatcgtccatatatccgtttataacaccgtgtgacggcttcaatatctgaataatgtcataaagatatgacgggctgaacagctcaggcgcatatttcggataaatctttaccgacggcacacctagatatttctttattgcattgcccgtttcggcaagcacgctgtacggtatcagttcatctgcttcaagctgaagtatcatgctcttatccgcttcgtcacacagtatcgacagcagtcgtgcatccgctgtctgctgaggcatttcgaccctgtcaagaatttcttttaaaatggcagccatttatttcacgttcctcataatttttctttgttgccgagcatcacaccgacctcgtccataagctcgtcaaccagcttttcctcgggtactctgcgtataacctcgccctttttgaagattataccctcgccctttgcgccggcgatgcctatatcggcctctctcgcttctccaggaccgtttacgacacagcccattacagctatctttatatcggctgttatatctcttgtacgctgttcgacctgctttgctatagaaataaggtcaatccccgttctgccgcaggtggggcaggaaactatcctcacaccgccgcctatgcctactgctttaagtatatcctttgcggcatatatttcttctacagggtcggctgtcagcgatactcttatcgtatccccgataccgtcaaggagcagtgagcctattcccgccgccgacttgattatacccatacgggctgtgcccgcctcggtcactccgaggtgcagaggataatcgtacatttcgtgtatcagacgatagctctccgtcatcagcttgacatccgacgatttgaccgaaagcactatatcgtcaaaatcaaattcacggagcatttcaacatggcgtgaagcactttcagtcagtgcctgtgcggtaggaccgccgtacttggcaagaagctcacgctctaccgaaccgctgttcacgcctattcttatagggatattgcggttgcggcaagcgtccgccacagcctttaccctgtccttatccccgatatttcccggatttatccttatcttgtcaacacctgccgccgcacattcgagcgctatcctgtaatcaaaatgtatgtctgcgacaacgggtatattgaccgcatttttaagtgcgtatataagctccgagtttctcaccgcaggcaccgccgtgcgtattatctcgcagcctgccttttcaagctcgattgcctgccttacattgccctcaacatcatccgcagggatattcagcatcgactgtatatatatatgctctcctccgagagtgagatttcctactttaactttcttcttactcattttaaccgcctgtaattattcttacaatatcattgaatgttactatgaccataagcaccataagcgcaacgataccgataaaatgcaccattccctcatgctccgccttgacaggctttcctctgataagctctatgaaaaggaacacaagtctgccgccgtccatagcgggtatcggcaggagatttactatgcctatgtttattgcaatcagcgccgccagcgtcataagcgagccccagccgaaagaagcaacggtgcttacactctgcacaacacctataggaccagacatttcgttaagaccgtatgtgccgttgagcagattgccgaacgagatccatatcagtctgccgtatgaaacaaagtccgcacacgccgcctgtataacgtttacaaaattgtgcctctcgccgtaaacgataaagtcgagatacaggttgttttcctcagacgtatatccgcttttatattcatctgcaattgccgtaaacgactttgcaaattctgcatcgttattttcaagctccttgaaagcctctgtatagctgttagtatctatatcgaaatattcggtgggaagtgccgcatagccctctttttcgcccaccagctttttatattccgaaatcatttttgcgtaggaacgtgacgcaaatttaacatcgttcagttcaaccgtctgaccgtttctctcaactacaaagtcatagctgtaatactgcgagcctatacccctcgactgcgaatttgaaagctggaacgaaatatccatcgttgtatagatattcataccgttgattttcagtatcttatcgtttgcctgaagcacagacgagcttatcgcaccctcctgaaatcccgcaacgacattggtcgaaacgctgtttgaacataaaacggaaataatgcagaagataaatccgagaacgaagttcataaacgcacctgcggcgattacaagtatcctcatccacacaggcctgtttctgaagctcctcgggtcgtcattttcaacgtcctcgtcaagcatgaccgagccgcctatcggcagtgccttgaacgcaaacacggtttccccgatacgctttttgaacagcttcggacccattcctatcgcaaattccttgaccttcatcttgcacagctttgcgaccgtgaaatgggcgtgtgcgtaaagcgagcttgcgatattattttcatagtcgttgaatatctcacagccgatgccggtagcggtgaacttgccgacactgctggcatcaaaagccgttttacccaccccatcaagacgtttttccgtcttgctttttacttgcacaggcatcttgtttattgtgctcgcattcaccactgatattgccgcctcagatgcgctctctgttgcctcatccgtcagttccgcaaacgcacagcttaccttatgtgcccctctgtatttccatacaagcaaagtcgggaagaaagctattgtgccgtttatatctatctttccgccattaccgaacagcgtatcaaagcactcaatagcaggatttccgttgaaagaaaattccacacggcgcagtgcgatataaatcgtgttcacacacgtttcaaaagctgtcttacgctcggcgtctgatacagactgcaaaagcggattttccggtataaacattgtggcgtttcgggcagcggcatccggtaatgtaagcaccgcatgatttttgtaaacatacggttccccatcaaaagcagtagaaaaatacttcgtcagcgctctgaggtcgaaaaactccgtgccggtacgctcatagccctcgacagtgtagtctgcatcgtatacaagcgcaccgtcaacgatttttttcttttccttgagtttaacaatttcgagcttgccgtacctgttgattcttgccgatgacgccataagtgcgcagcaccactcgataagatcacggtacgtctgcacggacgaagaaaccgttgaatccactgtcaaatcatagttcggatatgaactgaaatctgtagtaacaagcgttattccgacatctgcggcaagatcctttatgtgctgctgcaccgtcttttttccgcccgaatacaccgatatatcaacgtcaaactttgtgctgtcatcaaaagcggtcagcttgtgaatactgcccttacgctttgtaaggctgttatctaccgtaaatattccgagcggaacactttcccaagtcccatcggcaagctgtatttcgtatttcggcgttatccttgcattcgcataagtccttgacaaaaagttattgtcatacaccgttatatcaagctgatttgtgtagaacgtacctatttcaaaagtatcacccgatacaagctgttctttcagggtgacgctgttgttcacgataatatcatcggttatgtttatcgtttcgccgtcacagagtttaattgcgccggtaatgcggtctgtgcggtttttatccttaatagccgccgtgtaagcggctgatacatcaagcatagaatcacctcttaatattcgataaagtttacgcttaaatcccacagcgtttctgcggcagtgtcggcgttaagtaccatagttgcgcttctgtcgccggcatacatcgtgcaggtctttgtgcttgctgtggtcgggtcgaaaaatgttgcagaaaacgaatcgggagaaatcgcatttgctatagcggaaagctgcgacctgttcaccctccaagttacctgtatcttatacacgcccgctctgatacggttgcggaacatcttgcctgtttcgcttctgccgctgtcctcgctgtcaaggtcggaacgttgtacagcgtatgagcgtggcgaaatcggcgtgaagctgccgaattttataagtgtctgcatattaactccttccgttaagtctgcggtttctgacggcattatagcgtgctacggcttcaccgaccgtgtctccgtctatatcgaccgtgacgtgtatatctgcggtctgaccgcctgtgttgctatcatacatagccgagcgtacagcattatatattgctgtttctatgcttgacgagttcgcaactgcggtacggttgccgatagtgccgacaagctcagggccggcttcgttagctatgaataagtcgccatagtcggggaaaccgccgtcggcgtaaccgagaatgccgagtgaacttatatctgcccatgtagactgcccttttagacgacgcttaagaacagggtcaacctcgtcattttttatgcgcatagccgttgtttttgcaaactcataaagtgaagcaccgtaattgccttcatcaaaccattttttcagttcttcgtcattgttaatgttaaaatgactgactgtttcgccatatgcgtcatctgcacttgtgctgtcgtttttcaccatccaatcccgcatatacgtcagcatttcgctgtatgtggtgttatatttctgactacgttccgtcttaccggcagtatcatttattacattacttagcattacacctgcctgatagcataactcagcacatttgtcaaatgacttttgaaatgatgtgccaagcagtttgtcaacttcaccgatgattttgctacaaattgtagttatactgggtgctatattaataaacgaattttttacaaatgcaaatacatcatcaatcgccttgtctatatctccattgctgatgtccgtaactatgtcaccgataaaattgcctaaatccttgagccatttatcaagattaaaaccaaacatttcatctattccgtcaaagaaaggctttaacgtagtgctaagattgttaaataatgatttaatagaattacctatttcaccgcttttcaattttcccaagagcttgtttaattcgccccagatattagaaaaatcaatatcaaatgataacgaacctaaatctatatttttagtcttctcctgcacatcactcagcgcatcagcaaggctctccgcattatccacatcatcgcttgataccacgcttgaagcaagcgtaccggaatttcccgacagtctgttaagctcgtcaaaacctgcaagactgcgttttacgctgtctgtaagattatctgtgctttctgcgacatcatcaacgcctttcgccgctttgtctgccgcttcattttcttctttcagcttttcggaattgtcgtctatgccctcagtgcctttattcgtggctatgccaagcagtgccagcgcaccgactattattcctatccagcccatagttgcctttaatgcgctcgcatacgtcaactgctttggtataagtatgttcagtacgccggtatatgcaagttttgcggctctcataagccttgttgccgctgttacagccggtattgccacagccataccgatagcgattttcagcattgtctgttgtgcaggcgttgccgcttcgacctttgcctgtatatccgaaacaacatcaccaagtccgccgacagcttctgccaccgtcattataacaggctttaatgcgttaagagagcttgacagcacagggagtacgctctgagcaagcggcaggagcgctgtgccggcttctgcggcaaaatcctcaagctgctcttccctgaatgttgtaagcgcacccgaataggtatcgttttcctttgcatagtttcctgccgcatagtccgacttatcaaggaacatctgcatagcggcattgaccttctgctgtgtggtttcaagctttccaagtcctttttcctgtgcgtatatctgcaggttcgtgtcgtttatggcaacaccgagattatccatcattgtgaagttgccctttgccatacctacgaccgcttccatggcgctaccaacggatatacccatgatactcgccacatcagacgctcgttgcatagactgcgttaccatatcggcagactgtgctacagaaaagcccgagccctgaaagagcgaacccatttttgtggcggtcgcaagatacttgctctgtgaaagtccaagcgaagaagcggcagtttctgcggttttctgaattgtcccggcataattcttgaataccgactccgaaccgcctatgttctgctggaggtcacctgcaaggatgatagcattctttattattgcacctataccgagcgcagataatcccgaagcaagtgtcttaaaagcactcagcgttccggcagaggtatcttccgcctgcttttttacattcacaaggttttcattcaccattcgtatcttacggtcaaaatcatccttgtttgcactgactataacgttcagttcttctactgtcacttactgtacctgcctttcgtagccgccgcatattcagccatattctgctttgatacctcccagtccgacacgggtattccctccgacttatcacgtccgtacagcttaggaaatgccttttcaatgctgtgcggatattgcattggagcgttgacaccgatggcaacaagctgaccgatgctataagcaaaggcacacatcaagcgttcgttaagctcggtgtgtgccttatcgtattcattttttgcctgtattgcctgcgttatttcccgtaccgataagtcccagaaatctttatgtgttattcctgccgtcagtgccgggcggtaaagattagttaccagctctcctgcactgctccactctctgccttttctgcgagcgccagcagtttttctgcctgctgacgcttgaaaaaacccgacaccgtaagcgtcttgaagagtatctccgccatatccgaaaggtcgccgcctgcgtctatgtaatcgtcataaatctcctgcgcctttctgacgtcaatattcgcctgaaagcggtttaaagcgccccacagatacagcgttaccgtttcgagcttgtcaaaatctgccatacccgcaacaagcgacttgcctgttttcttctcgatctcgattgccgatgaagccgagattttaagcttgtactcggtatcaccgattttcagcgtttcgtaaggtaatctgttttcttccattttaatatcctccgtttgattttttgcataagaaaagcacaccctctcagatgtgcttaatcttatacctcaccgcttactcatcaatgcaatattcgtgcgatactcgctatgttaaggaacattacagcaaaaccgattatcgagataatcaggaagaaaagcgctacgcttttgattgacttcacatcttttctcattcttgcctgctgtgcgtgttcaccctcaagctcgcttacaagctgttcgagcttgtcgtttgttcttgcattctcgataagtaataactgcgtgatttcatcgtttgacttaatctcgtagtacttgttctccttgccgcagaaatatacgttatcgggcagttctccgccgcttgcttttatttcggcacaagccgcctgtacgttttcgccacaaggttcacctacaacatagttgtagtggttaaggtagttttctaattgcttagtcattatattccctccgtgatactatatttgtatctataatatcacgaagggttataaatgtcaagttatgccgcagcagttacgtcctcaagctctgtaagaggtgtgcttctgagcgtgaatttcaatgccgcattgacctctgccgcagaacgctttaccgataccttcgagctccactgatagcccgtattatccggataaatcagcttgaaccacactgttgcgttcgatgtctgtaacgctctcagcgtggaatacgccgccgctacgtccgcttccgacacggcaggattttcatcttcatcgttataaaagaacgtgaagtccagatcgccgtagtccttgacaccgggtatataacgcttcgcaccgtccgcaaggttcgttacatcaaccttttcaggatcaccgcccatatcgggagttgactgcaagccgtacagcgtcttatatgtgcctgcctttgtgtcggcatactgtaattttgtgccttttgataaaagttccataataattttcctttctgtctaagagttataaaccctgtgattcagttcatctatttttgcggaaaaccgcatacatttacgctgtaattcgccgtcgggcatcatctgtccgaatatacggcgaaagcctttcgataccattacagcgcttatccgtgccgacatatcggctacaacagcaggcgtgtccgccttatcacatacatcaatctgtaccgtgataaccgacagccgctccgcaccgtgaagtacggtatcgctctgatttgctatctcacttaacgtaatgacaggaaaatcggctgtggtgtcggggaactgcaattccaccgtgcctatatcggcaagcatatcagcaattgtgggtataatatctatcatgccattgcactccttattgctcttgcaagctcaaccttgcaggacttgaaaacatactccctgttgccaagcaaagcaggataaagatacggtttcggcggtgcaccgttcgttatatgccagttgcctttagcgtccttgtatctccacggttgcatcgtgtgaggtacacccggtgcgccgtgctgacctgtgccgaactctacaaacatggcatattcaacgtttgtaccgaccgcccagaccttaggctcaaggtgttctgtagagatactgcctttcagccttcctgtatcatacgggcagtttacctttgcgtcacgctttatcttctgaacgcccttacctatgcccttgtctattgccgcatctacacttccgccgagccgtctgagctttgccattaaattttcaagtccttcgattgacatttccatgcttatgtcctttctgccgttgcactgtcgtgcatagtgtaatgtgcgacagagagtatcttataatctgctccgtcacaccttactatatctccgactttaagcgtgtctttatccgttgttgctatcgtcagcataccgtgtattctctcgccgtacaactcgacagaaacactgtcggttaccggctttacaacagcggatattgtcgctgtctgtttaagctccgataccgttcccacatagtcgcttttctttgataccttgcgatacaccgcaagcgttcttgtatcaaccgtcatcattcgcacggataacaccgacctttcggggatagttctgcaatcttttctgcatatcaggcggcagatcggatacaaaggaacgggaaataccgccctcgctgcgagcggtttctccctctgcaccccgtctgttataggctataaccgcaagctctgtctgcacgctgataagccttgcaggcatctcatctctgccgataacgtcaaggatagtgtcctctgcactgtcaagaagcacggcaagcagtccgtcctgcttttcatcgaaaatgccaagacggattttaagcgtttccagtgctgtcattgcgtttctccttacgatgttgacttaggcagtatcttaatgccggtcagcacacctgcttttttggtgtttttgagcgcaacaccggcgataagctcaacatcacctttctttaccgctccgggcgctgtaaggtcgggcatataagaggatattacctttgtacctgtaggcgaaataccgtgaaaagcgtcaagacctatctttattgcgtaaatatccgttgtaccgtaagcggtagttgaaggcgttgttgtgtcaacaatatctaccgaagccgtaccgttgtagtattcaccgcagtcgagcagtgctataccgttgtagtattcaacaggagtaccgaatgaatcttcgtttctgctgtaatagcctgctctccttgcacatgctctgagttttgccagcattttcccgttcataaggagcatatcgggcttgccgtcaagaagtgaaagaaagctgtcaagctcatcaaggaacgcattatagttagtatcggtaagcgccgatgttgaaaggtccaccgttgacgttacctttgtgtccgctgttgaaagtatcttttttaatccgtcaaacgtgcctgttacatagcctgcgcccgaagcggcagatgtgccgttaataacaaggttcgtaaaataatttgacgttgcctttatcttctgctctgcctggaatgcgagctcatcaactgcgccgcttgtgttggctataactctgtcaacctcaaacgaaccgcccatgattaccgcttccgtcgttttcttttctctctttgcttcgcttgccgtgtactcactgtttatggtacgaaccgaagcggtagcaggtgtttttagctgtacatatccgtatgacagcgttgaaccgttagtgccgggtgaaattgaattgtcaaatacaagtctgtcaaggagaaggcttgaacgtctgaatgtgtcaattacctgctgatccaccttatcagccataccgacttttgcttctgcaagtgtgattgccataattttttacctctttctgattatttccctgcctgcttcattctcagggcttcggcaagagaggcaggttcagctttgcccttgcccgatgcgcctattttcggcggattgcccttcattctttcgttgaccgcacattcaacggcttcagcaaatgccttgctgaccgtttcaatgcttgtcttgcattcatccgcaccggtatagtcaagcacagcggcaagccctacgggaagtcccttatccgcaagctgtaccttagcttccgccataagctcacgccttgtaacctccgcctcacgctttgcaagcttttcctcagtctgcttacgctggtattccgctttctgctctgcgttcattttttcgagcttcttcgcctccgagagtttctcgtctgcgtccttctgccactttgtttttgctgtttccagtgccttgcttacacgcttgtcaaactcagactgcatatccttgtcctttaacatatcgtcaaaggttggcttctgcgatgcgctatcctgagcgtcaccgccgttatcggcagtctgattgccgggaacgtttgcatctgcgccgccgtccccctcggcctctgcgaagtgctgtaagccgatgaaaattcttctgttgttcatgtttctgtcctttctccgcccactgcgttcattgcccacaccgttcggaataaattgtttttgagtataaaaataccgccctttttaagagcggtaaaattattaagttttgtgcaatcaattgcacacgggtataagaaaaccgcccacagcagtgagcggttaattatgcgattttctgaattatatccgataatggaatcaatgccgtatcataatccccatcggtgactatatcaacgacaaaatcattacctaatacatcaactattgttccttgtctgccgtctttcagcataacagtgtcatataattcaaatttcacttttggtcaccttcttttcagtaacatatgcactcgtaagtcgcggttcagttgtgccgttttcgataatccaacccgtacaaacattggcttgcttgccattcgggcctttaatttgcattacatactcgtataatttaccgtgctcgtttgtttgctttaacttaagcaaactctgatcaagattggcggatatgttatcaataagttcttgataattctccatagtatatcctaatgcttctttaaaagccctcgctttatcaggctgtttcacaggatctaaggcgtactttgtaaacttttcttttggtattatagcaaaatgctgtaaatcaatacgcacacttacttttttctttattataccactttcccctactttgtcaatagctctgtcttttataaaagccacatattcaggatcaagcttacttatttctcccttttgcaaagcaacaaagctctcggcaaagtattcagatttactggctgtggcatagcctgaaagattgccggcatacttgctcatctgcgaaccgataaggttatttgtttttgcatcaaatgcctgccattgaacgtgatgccccatctcatgaagaaaataatcatgcaccgagccatcaccgactattgaccgtcctgcctgcttatagcgtagcgcaagctctttttctgcgccgttaagagtatcaatgccgctcattacagtatcccatgcgtctttagcctgtttattatatgccgcaagcgtttctgcattcttcagcacatttttattgatataaatgccctgttccaccggagaataagccataaccgcatcagcaccggagaatatctttttgccctttgcggacagaggatcaatagccttgatgccgcttattttcggaatgtcatacttatcaaacaattcttcaagcgcacgatttatttcatttgcgttttcaagagaaactcccttgaaatcagccttgcccttaaaagttttatctccgaactgcgcctctataaactgctgagcataagcctgtgcttcttcaatactctttgccggtgtaaaaccggataccgtttctttcgcaggcgttacaacagtttgagttgctttacccgcacttcctgcaacgtaccgccacttgccgtcctcgccctgctgtaagttctgctcccactcgtcaaagattttggtaccctgatattttgacaaatcaaatcttttcatgaattcgaacagtacgccgaattcaaatgtacagaagcggttgaacagctcttttgacattacaaagcagttgtacgcatagtacttctttgaagccatatattcctcggcagccttagaatattcggggtaaagctcatcaaccagcttaagcgtaagctcaggtgcgcttttatcaaataaatgctcctgaatcatgaatatatctttgatgcaatgtgcacgttttccgccaaaaaggaaatccatctcatcaacatccatgcttccgcctgtgataagatcgtatttctttatctgctttgccatattgtcataatcattcagaccatacttttcgatgctctcttcattgagcatattttcgattatgtagcctcttgagcattggtcaaacttcttattgctgaatgaaagataacgtctgtagtggcaaaggccgtagtaatttacatcggcattcttccacgcccaatactgaacactcagctccgagaaatactttgcaagatcggagatattgtcgccggtgtcatcgccgttcatcttaaggaagcatcttgccgagcctgcattacacttatagttttcgaatatacggttacctatcacagcgctgtcaagatccatcctgtgcgaaacgaaaatcttgatgtcatcattgggtttcttgtatgacagggtacgttgtgcaagggtatttgcatcgggatctgcttcggtgttcttgaagtatacaatctggcgctcaaggaacctgcggtcggtgtgatgctgaagataccacatataaacgccgtatacaatctcacccatatagcctgtggctctgagcttgttaccctcatagccggtggtgtcaaactgtttatcaaactcaaagagtatgtcaaagagcaccttgttgtattcgttgaatatcttctttgacattacaaagcagttatagcctctgtaatactttgaggcaaaatactcattcatagattcaacaagctcggggtgcctgtcttctattatctttatcaatgtatcaatagctataggatcgacaagatttcttgatgcgtaccataactcctttacactgtttctgggacgtactctggtgatctttgtcgtatcgaaagccttgccgacaataacgtcataggatgagatctccttctccatctttgacttattaaaaagctgatataactctgcggtgcgtaccgaaaggttgttttccattcgtacatcgtagtcattgcccggcataaaggaatccataaacgaaagataccttctgtagtgacaaagtccgtaataatccgcatcataatttttccacgcccagtactgaactgtgtactcacaaaaagaaattcttttctcggatatgttatcgcctgtattgtcgcccattatgacattgccttcatcgttctcgtcaagtgccgcaccgcatcttacgggtacatataaaggattgtcaatcaccatacttttaagatcgattctgtgtgaaacgaaaattgcgatttttttgctgttgttttcaccgctgttcattgaaaataaaatccctttcttttatctctttactcttcccgacgaatttccaccggcaagatcaaacacatcattaattccgaacagacagaaatcaccctcaagcgtctgatcgagacagcctgccgcagcagctgtttctatagcattttcaggcgatatattgttatgcagagcataaataagccccgacgcaaacgcatcgccgccgcctattctgtctgtaattcttatatcatattgcgcagatgtataaacctgctttttttcgtcatcataaatgattcccgaccagccgttatcacttgcggaataactctttctctgtgagtatgcaactattttacagccgaatgtttccgcaacggtctgaaggctctttttatagccgtctgtatcaagctgtccctttgtgacatccgtagcgcctgcttttattccgaacactatctcagcatcctcttcatttcctatgcagacatcaacatattgcattatctcggtcattacgggacgtgccttttctgcactccacagcttgcttctgtagtttatatcgcagcttacgataagacccgcttttttggcggcttttacggcatcgacagaaatttttgcaaggctgtcggaaagcgccggagtgattcccgtaatatgaaaccaatccgcaccgtcaaatatcttttcccaatcaaacgacgaaggttcagccgatgctatcgcactgttctttctgtcgtatatcacctttgagggacgctggcttgcacctttctcggcaaagaatatcccgagcctgtcgcccgtataaactatattatccgtctttacgccatatctcataagctctctgcaagccgctctgcctatatcattatcgggaagtgcggtcacaaattcagcctcgtctccgaaattactgagggcaacggctacattagcttcagcaccgcaaaacgatgtattaagctccggcttctgaaacaatttgtaatatccgtcgggcgatagtctgagcattatttctccaaaagaaactaccttcattatgaacggttttcctctctttcaagaagtgattttgttataaatgaaacgggtatccgctgtgatagctgagcgattgcggctgatataccgttgttctgctctttggctacctgctcgtcttcatacgtttccatatctctgtacgcaaagttgcgttccttgaatgaatatccgtcaactccggcaagataaacggagcttgctccggattttataagcagtgctataagcataagtgtaacgttgtcacggacagcttctatagaacacagcaaaggctcgtagcctactgtgtagcccgcttgtgcgtttatattagatgttattatcagcttgtctgtttctattccgcttagcttttcgtaacgtcttatattgcttacaaacacataatcgcatttgatccattcggggcagtggtttacggaaatcactatcgcatcggtagctttgaccttatcaaagaccttctgcctttcagattctaccgatgttgtcctgccgggtgcgataataacaacattgcgtccttcgaaaagtctgctgagatctgcctcgggcgttttttcgccgcctgcagacatatgagcagtgtacagcttatctatatattctcggtcataattgtcacgcttttcaggctctattttcgagaaaatagcgttcataccttcgtatgtgagggtgtttttgttactgaggaatcgtgcgtaattctggtggcatctgtattttgcggacagatagccggataaggaataaccccacgatgtagtcaaataaataggtgctatggtattgtcaatcgaacagagtataggctctgtactgtaatcggcgtctgcggtttcgttcagatattccacaaacagctcggtattgagatttcccgcacctctgcccatacccataatactgctgtctattatcagattatgatcggtatgcaaagcggctaaatactgagcgtttgagtacgaaagctgaaggttgttatgggagtggaagccgacagctatctccttatcgagattattctctataagataaaagaaacgtgcaacatccttctgtttcatagaaccgtgcgaatcaacgatataaaaaacgtcggggcggaatttgtttgccatacctataagacctaggtattcggcatcggaatagctgagagctaccataggctgaaaatataccttatagcccttgtccttgatctttctgcaaagctcaaccgcctgcaaagcctgcgacttgtggaagcaaacccttatgcagtcgggtcctgtaccgtcatactgcggcagcagttctgcatcataatcgccgcagtttatcattacggcaatcagagtattttttctgtcagcaggaaggattctttttatagcgtcaaccgaggaatactgcgactcatccgcagaaaaatctccctttgacgataaatagcccacctcgattatatcaatacctgcctgtattagacgttttacggtgtcttttatgttttcgaaaccgaatttccagttatttacgtatccgccgtcacgcagagtacaatcaagtatccgtatttttttcatacccacctgtaataattaattcttttcccgttcgagctttgcagctatcagcctgttgaccttttcaagatcgttctgtgtgtcaacggctactgtttcggaatcaacctctatgtactgaactctgtagccggcttcgataaatctgagtatttcaatatcctctatagattcgatttttcctctgggagaagaacaatagaactgaagcgcctcaggcttgaagccgtatacgcacacctgcttataatagctgtagtctatgcttcccttaggataaggagcggtgcttctggtaagatatacgcctatattgtcggcattcgttatgactttaggcactgtgaagtttactacatcaacaggatcctttatcttagtcataagattcgtgatctgcagatcgggattctcgaagaaaggatataccgccttgtttattgtttccggctcgatcataggctcatcgccctgtatattgacatataaatccgcaggaatttttcttgcgacctcacctatacggtctgttcctgtcttgtgagtatcggaggtcattattacattaatgtcgttttccttgcaggcattgtaaatgcgttcatcatcggtggcaacatacacctctgtcagagtttcggcttttatggctctgttgtatacccaccatatcatcggctttccgcatatatccgcaaggggcttgccggggaaacggctcgacttgtatcttgcgggaattattcctaacactttcattgctatttatcctctcatttcatgatgatgttgaaaaatgtcaaaactcgggcatttttcatactaatatcaaaataattataacacaaaaagcatttttgtcaatgcgaacagattcaattggttaattttttacaaaaaacagctaaaaccacgcacttctttaactaaatcattagctaaattattaaagcgctattttagtcttaacagctttttaaccttttcacgtcgtggcgagtacatcgggaatatcttgtcggcaacgctccgcactgctttatcggcaacggaatgaattctgtacttataatactcttttgcggaatttatcttttccgtatttacaaaaaacacaagctgtgtttccttggccgacctgttttcaaccgtcagcatatggtggatgaaaataccgtttagtatttcgcctatgtacccgggagcacgttcataggttttgcaatcggtgatttccgtaattcttttcataataggaaactggaactcgcacatacggacaaacagctcttttttcattatatagcaattgaacgccctgtgatattttccggaaaagtattcgcaggcagagttgtaatattcgggcgaatactcttttataagggaaaacatcttgtctattatcccctgctcaaaatacacgccgttatagctttcccacatttcacgaagcgttttgacctctgccctgttataactcatttcggacgcttttgcaaccacgggaattatcatatcatattgttttacagttttttcgatttttttcgtatcatcaagatgatattttttcttttcgtgaggtgtcaattttaactcacgcaccatattgaacaccgtatttttatagcgtttatccgaaaaagaaagataccgccggtaatgacacagtccgtaataatcggcatcaacattcttccacgcccaatactgaaccgtaaattcacaaaatgacatacggagctttgaaatattgtcgcccgtgtcatcgccctgaatctcactgttgccttcttcatcataaaccgcaccgcatctgaccggaaaataaacgggagtgtctactgtttcactgtcaatatctatcctgtgcgatacaaaaatacggatattactcatcttttcccctgccttaaatgttttatcaccaatccaacctattatttaattatagtacagtgcaatttttttgtcaacaaaaaagacaaattgtaataaggcaaagaaaaaaacgtgtcaaccttcgcagattgacacgtttttgctgcagtgcttttttaatttttcccggagcgcctttttcaagccgtgacacctgtgcctgactaattcctatttcctgtgcgacttctacctgagtttttcctctgaaaaaacgcagcttgagaatattcttctctctgtcgtcaagtccgattattgcctctttcaaagctatttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctctgaaaaaacgcagcttgagaatattcttctctctgtcgtcaagtccgattattgcctctttcaaagctatttcatcgagccggtttctgtcatcgttgttgttgcctatctgatccatcttcagtttatagaaaaagtatgttttttcaaaaaagtgcggtttgttgcctagaaataaccttctttatataaaactcatttgctgtatgcctatatcgctttattctgcgaatttcaatagttataatcagcattttttggcaacataaaaaagtgtgccaaccacaacaagtcaacacactgaattatagcattttattcaatataatttcactgcacaggctcttttcttgaacatatataaacaataacagcgcttataacatctatacaaaaaacaaactgacatacagaattcaaagccgcaaagcttccggaacacttacgttccttataaatcctgagatttgccgttaatccgacaagtcctgtaaggaatatcgttatacaatcgaacagcacgaaaaaaacagaaaaagcataagtgaaaattgtaaggaaaaataatacaccaagcacaaatatagcaagatatgccggtatctgaacaagctttataagcatattgaaaaaggctgtctgtcttgctccccacccctttgcaaggcaaaacggcatatacacaagcgtgcatataaatgaaatgacaattgtcacaaatatcacaaataacagccaaagcccattaccgccgaaaaaacgctctacaatatattgatttataaatatggagtagagagcaaacagtaaaatatatggctgaatcatcaccggtatgagtaaaagaaagcgtttcatatttctactattatccttaatttaatatttgcagtaagtataccacaatatactgtataagtcaagcagaaatatgtgattgcaaagttataatgccttttttatcttaccgagagcgcctttttcaagccgtgatacctgtgcctgactaatccctatttcctgtgcgacttctacctgagttttgcctctgaaaaaacgcagcttgagaatattcttctctctgtcgtcaagtccgattatcgcctctttcaaagctatttcatcgagccagtttctgtcatcgttattatcgccaatctgatccatcatatatatggtatcgcccgactcagaaaacaccggttcgtacagcgaaatagggtcgctgactgcctcaagcgctattaccacatcctcacgttttgcgtctatttcttttgctatctgctcgattgtaggttcttttgagttatcattggtaagtttttctcttgcctgcatagctttataagccagatcacgcattgaacggctgacacggatcgagcctgagtccctcaggtagcgccgcaattcgcccattatcataggcacggcataagtgctgaatctcacattaaaatccgtagaaaaattgtcgatagctttcatcagaccgatacatccgacttgaaaaagatcgtcggggttttctcccctgcccgaaaaacgctgtatcacactgagaacaagacgcaaatttccgtttatcagcttctctctggctgtagggtcgccgctgcgcatttgccttagtaattcggttttttcagactccttgaggaccttcagcttcgctgtgttgacaccgcttatttcaaccttattgtaatacaaaaaaacaccgcccatactttcattttccgataaaagtatggacggaataacgttttttattctgtcaatttactgtcaacgacaaatcaagccgtaacataaatatcgtcttcgacatccggcgctatgctgtgctttactctgtcttcgacctcagcctttttcgcattattgaatctgtcgagcgtgccgacaaggtaacctgtgatacggcgtatacggtcaaacggtatctctccgaaatgataggtgagatttgcaaaatctccgtcaatgtctatatcaagctcggtgaccagttttccggggttagcttcgatagcatactgaacgtaagcgtcgatctctttctgatcgagtgtgccgttttttacatttacttttaccataacaatcttcctttcaatttactgtatataaaagcagtaagtacatttcgttgttttctcaattgtaccacaacatattgtgtttgtcaagaggctcaggcacaatttttcgaaattagtacaaatgcgtaaaggaataagaaaacatttgaaaaaagttcttgacaattcttcggggatatgataaaatattaaagtcgtggaaagatggctgagctggtctaaggcgcacgattggaaatcgtgtaacggctaatacccgttcgagggttcgaatccctctctttccgccacacgacgctgagttttcagcgtcgtttttatatacgggtatggtggaattggcagacacgccagatttaggttctggtgcgaaagcgtgcaggttcaagtcctgttacccgtaccagctacaaaccgcacaacaatgcggtttgtttgatttttatgacatattggccgttgataaaaccgttacggtatatcgaagttaaaaattcgaaaattttccttgacaaagtcgatatggtatgatataattaataaccgtcaggagtttgctaatatggctcagtcggcagagcacatccttggtaaggatgaggtccccggttcgaatccgggtattagctccagatagaaagccccattgcatttatttgcgatggggtgtttttttatgttcaaagaatcttgatacaaagccgtacccgtcggcacagctttgtattttcgctatcagaaaaagaaaatcacggcgatagccggttttctatcgtcgtgatttaatttctgttttatgattttaaaaagtgcggtattatcggttatgtggttacgcagctgcaccgaatatcccttccagcttatccattatgcccggcttgctaaggcagtctttataagtaatctcaacaaccttatcatttactatcaccgaatagttcttacgcaactgcggaatcaggagagtatccgacaagtacgagaaatattcataatgaatatttttatattccgaaacaatttctgctttatcataagaagtcgcatcagcaacgtgaatgctgaatttatcgtcatctgcgtatgtacctgtttcgccgtcacagtcaaaaccctttgattttaacaagtcgctgtcatgccaattgatttgactgatataatccaatattctgtcattctgaggctctgaacgaacaaaaaattcaaaagccggaataaaaatgtttgcgcaaatagccacaatcaaaacaaatacaaataaagcacgttttttaacgtgctttctgaatgcaataacagcacatagcgacattagaacaattattttgattatcattattttccccttattttttaagtcgtgatgaatcagtcacgaatgtttttctttgccttatttgatagacaggacttatataatccaagtgaactgtagatacttagattagcaggctttaaccgcaagctccgtgttgcccgtcattgacataagcttgccccaggcattgtaggtgtatgttactgcctttgctcctgtgctgtcggtgatatttaattattttaaatcgatacaataatttactttgttgtatttttttccattacggctttctatatatgctttttctttacaaccggtaaatattgtagatcggaagagcgtcgtgtagggaaagagtgtgtcagtacgtgtagatctcggtggtcgccgtatcattaaaaaacaataatacttcatcaccacgaaagatatgacggaaagggctacccgttcggcgcaaaggcggatgaaatcccaatcggcgcaagaataatcgccgtgtgtgattcgattgatgcaatggcatcggcaagagcctacagaaaagcgcttccgcttgatatagtcagaaatgaaatagaaaagaatatcggacttatgtacgatcctgcggtggcaaagaaaatgcttgacaactggagtataataaaagagatgtacggacacggcgagctttgcggagagtgccatttctgccatgataacggcgaggaaatctgaaagagggtcttttttatgaaaacgttgcagcagattgttgatgagagcagatctatagtgtttttcggcggtgcgggagtgtctactgaaagcggtatccccgacttccgttcggcagacggattatataatcagaaatatgatgttccgccggaggaacttttaagccacgaatatttctttgagcataccgggaaattctttgaattttaccgtgagaaaatgctgtgccttgacgcaaagccgaacaaggcgcatttaaagctggccgagcttgaaagggcaggaaaactgactgcggtcataacgcagaatattgacggccttcattcggcggcaggaagcaagacggtttatgagctgcacggaagcgttcacagaaactactgccttaaatgcggaaaaagctacagcgcagaggatattctcaagtcagaaggagtgcctcgttgcgaatgcggaggaataataaagccggatgttgtgctgtacggcgaaaatcttgacgacaggacggtaaccggtgcgctggcggcgatagaaagctgtgacacgctgattatcggcggaacttcgcttacagtatatcctgcggcgggatttatacgttatttcagcggcagaaatctggtgcttattaatatgtctgccactccttatgacagcagagcagaccttgccatacacgataaggtcggagaggtgcttgacaagataaaggtaaactgacaaatgccccttgcaaatttactgcaaggggtcagactatcgataaaccgattgttaaagctgtacattaaaatgtatcgccaacaccgcttaaaacattttacgtatcgacaaggcgttaatattttcgtgagtatatcagtgcaactgcactaacattgactcttcaaaaaaacgccactaacctgagatatatgtactaacctgcggacgtgtagcgttaagcgtccctgcatcgacaggatatacaatgttcaggtagttttacgagtttagccaacaccccagcggggtacgggtgtgggtaaggaaagagggatgccacgctgagcattgctttagcaatgctcccgctcctcacgtcgctcaagaggaataactgatttgggagaaaacctaagggatagggttaggggcggcagtccctcaccctagtccctttggttgtctcccgcgtgaatagcagcaacgttattaaatggaatagcgaacccgagaagtgctatccgacaaaaagaactatcggtagcttgccttcgtatactaaactgaatgatataatagaagtacatcaaataaaagactttttatacaagctcagtaccgcaattattatgttgcggtacttgatttttccacaaaaaagtagtacaattattgtgtgaaactctatccccgcttaaatgcggatatttacataaagaaaggactaccgtatgactataaagacatacttcctcagcgaagataaaaccgtctatctaaaggcatatatgcttgataacgttgaaggacttcccttctgcgaaaaacgtccgggcatacttattcttccgggcggcggatacgaattctgctccgcaagagagggagagcctgttgcaatgcactatcttgccgagggctataacgctttcgtgcttatatacagctgtaacgcaagacaccctgccccgcttctcaatgcgtcctacgctattctgaagctacgtcagagatgcgaggagttcggcatagatccgaacaaacttgcagtatggggagcaagtgcaggaggtcatcttgccgcttgtaccgcaactatgtggcaggatccgtcgatatacaaagcgctcggctgcaagcccgaggacatacgtcccgatgcggcaatactcagctaccctgttatcagcggcacgacaaatccgcacaagggctcgtttgacgtactgctcggcaaggacgctaccagagatgagctgtcaaagctgtctatcgaaaaccgtgtaacacccaagacaccgccaatattcttatggtgcacagcaaacgatgactgcgttcctgcgcagaacagtcttgttatggctaaagcgtgcgtatcaaataaagtacccgttgaactgcatatgttcgactgcggaccgcacggactttctacctgcgataaggtaacaggctggaacgaggcattctatcttgataactgcaagcagtggataaagatgtccgttgacttccttgcaaagtatctcggagtctgagtaaaagcaaactataaaccaagccgtgaacggcagaatataaacaaaagaaagaggcataaaaatgagcaaagtacctttcaccactaaagaaaagctggaggagataatcaagcagatccccacacctttccacatttacgatgaaaaaggaataagagaaacagcaagaaagctgtatgacgcattctcgtggaacaagggtttcagagagtattttgccgttaaggcaacacctaacccctacattatggagatacttaaggaggagggctgcggctttgactgctcaagctatacagagcttatgctgtccgataaggtcggtgcaaaacagcacgacattatgttcagctcaaacgctactcccgacgaggatttcaagcttgcttacaagctcggcgctataattaaccttgatgatttcactcacatagatgtactcgacaagctgacaggtatccccgaaaccatctgctgtcgttacaatcccggcggtgaattcaagacaagcgaaaagggcaacgtaatggacacccccaaggacgcaaagtacggtatgacccacgagcagataatcgaagcatacaagatacttaaggaaaagggcgcaaagcgtttcggtatgcacgcattccttgcaagcaacacgctgacaaacgagtattaccccgtactcgcaggtattctgttcagaacggctgttgagataaaggaaaagacaggcgtacagttaagcttcatcaacctttccggcggtgtaggcgttccttataagcctgaccagcccgcaaacgatataaaggttatcggcgagggcgttcgcaaggcttatgaagagatactcgttcccgcaggtatgggtgatgttgctatcttcacagagcttggcagatatatgcttgcacccaacggcgcacttgttgcaaaggctatccgtgaaaagcacatctacaaggaatatatcggtcttgacgcttgtgccgctaaccttatgcgtcctgccatctacggcgcatatcatcatattacggttatgggcaaggaaaatcagccctgcgaccacaaatacgatataacaggcggtctttgcgaaaactgcgacaagttcgcagttgaccgtatgcttcctaagattgatataggcgatataatctatatccacgatacaggcgcacacggtttctcgatgggctacaattacaacggcaagctccgcagtgcagaggttcttctgaaagaggacggctcgttcaagctcatccgccgagcagaaactccgaaggattatttcgctactttcgatttttcggataagtacagcttctccaagtaattgttttatataatatcacgatgtgaggtttattgtaaaattctcatatttagattatcgcatatttatcgacttaatatcggggcagacaaggtgacagtctgccctttttcttcatcataaaactacatttggcggtttaagtgatgatttaccacaattatacaaatatgcaaacaaaaacgcatgggaacaggaggaaatttatgaacgtaacattcaaacaaaccggcatttactccccgtcacagataaagaccaatcagcaaaaaccgctcaacaaagccgattccgacaaatcagagaataaagaaaaaatttcagcgaacgaggataagcatgccgaagaaaaaacaagacttgagcaactgagggagcaaaaacagcaggagtacgacagcgtaattcagcagcttgagaaacagcgtgaggcggaaaaacaagccgaaaaaagcggcaagaaatttacagattacggtaaattattgaagatagcgatgcgtataatgaacggcgataaggtgcctatgacggacaggaaaaagctcgccgaggagatgcccgacttatataagcaggctattcttatgcgccgccttgacaatgacaagcccagaaaatacaagagcgaatatgaggacgacaaggacaagaccacagtcgaaaaaatgctcgacggaatggacggctccgacgatccctcggacattatgaccgatttgctcggctcagccgacaaataattccaaaggcaaggactataaaatgaaagacagaagagaaatcaacatagaagtatttgaagacacaatgaagaactataagagcaatcccacgcttaaagcggctgtaagcaattcggttgcgaaccagaagtttacggcggctgacgaaacggtggagctgccgcagtgcgccggatacacgccgaccgttacggtaagcggaaaacgttctcttgaggcggctgttgagtatgcgaagcaaggcatgaagacctgcgtactgaactttgcctcagcgagcaatcccggcggcggtgttactcacggctcatcggcacaggaagaatcaatctgccgttgctcgacgctgtacccctgccttaacacaggcgatatgtggagctgtttctacactccgcacagacaagctgaaaatccgctttacaacaacgattgcatctacacccccgatgtatatgtgataaagagcgacacaaacgtaccgaagctgctgcccgaaagcgaatggcagaaggtgaacataatcacctgtgccgcaccgaatctgcgacacaagccgagcaactgtatgaatcccggagccggcgacaaacgggctgatataaacgataaagagcttgcacagcttctgacatcgaggatacgcagaatattcgaaattgcggcggcaaacggcaacgaggctctgatactcggtgctttcggctgcggtgcgttcaaaaatccgccgatagttgtggcaaaggttttcgcagagcagcttcaggcattcagaggctgtttcaaggctatcgaatttgctgtattccataccgagcgtgaggcaggcaactataacgctttcaaggcggcaataagataacggcaatatcccgaaagggttttaattcaggaggtataactatgaaaactttacttgatgtgtgcaaatttctgaaagccgcaggtacatattaccttgcgaccgtagactgtgacaagccgagagtaagacctttcggtacggctcacatctacaacggaaagctgtatatccagacaggaaagaaaaaggcggtatcgcatcagatagccgcaaatcccaatgttgagatatgcgctatggcagacggcgactggctgagaatcgagggggagcttgtcgaggacgatgaccgtgcggcaagagtttcgatgcttgatgcctaccctgagcttaaggctctgtatgatgcggatgacggcaacacgcaggtgttttactttaaaaatgccaccgctaccctgtcatcgttcacaaagccgcaggaaacattgagcttctgataaacaaaacgtaaaacaagccccgttcttagtcggaacggggcttgttgcttcatattacgggtgaaaatcagaaacgctttattgcgtaatagtacattcccataccgatagatccggtaattacctctgtcagagggaatgcaagccaagcgtaatccagtccgataaaagagaatttccagaataacggcacaagacagataagctgacgtaatacggaaaggaatgtactggtctttgaataaccgatagattgaaagaaaaccggcgtcataaacgaaaatacagcaggaataaagctggctcctatcaggcggaatccaaccgcgcctatgctttttaccgtttcgctctgagtgaacagccctataagctgagtggggataagctcaaaggacagcacaccgagtatcataaacacgccggatattatcagtgagctgcggaagattcttctgcaccttaagtaatctcccgatgtataattgtagctgagtacaggtacgatacacgtctgcaagcccagaagcggtatgaagaagaatgattgcagcttataataaagaccgagcacggtcaccgcctcatcgcagaatcccgcaaggataatgttaaggatggctatgtagacagtgtaaagagcctgcatacatattgacggatagcccagcttgtatatgcttttggcgatacacgggatacgctttatttcgggcggctttcgtgcgccttttacacctacgataactgcggcggttatctgacctataacggtagctattgccgcaccctttattccaagtcctgcggtaaaaatcagcaacgggtcaagaacgatattcgttaccgctccgacaatctgagcaatcatcggcagcttcatattgccttccgattgaagaacctttgtccagtttccttcaaggaaaagtcctatgcttcctatgcttactatcataccgtattcgtttgcgtactgcattgcaacgggcgactgagccgatattgcaacgtacggtcccataaacgctattgatattacggaaatcagcgcccacattataactgcaagaacagttccgacacctgccgtatggttggcgcctttttcatctttcagcgcatactgctttgccataagcgtattggttcctaccccagtgccgaccgcaagagctattataataagctgaacgggatagatagccgacagggcggtaagtccgtcatcggaatactgtccgacaaaaagactgtcgattatattgtacattgcctgtatcagctgagccagcattataggcggagcaatacggagcattatcttccacacgttttctgttccgaaaaattccggagaaacggatcttgctttttctgccaaaaaataaccttcttttcttaatcactcgacgtatgattataacactttatcgggaagattgcaagacaaaaacacagaattacaaaaaagtccaccgtatgcctaagcatacggtggtaaccccagatcaacaaggagattatactctttctaaaactgtgaagcctgcgttaaaacggatagttccgtcctcagcttcctttatttcagcgaatgaagaaacaggctcatccataacggtaccgtttatctttgtatcatagaaaatcttaccgtcttcttccttccacacggtagtgtcaatcacaccgtagttaccctttatcttagctccctgctcctttgccttttccatcatttcttccggaataggcatcattgtttcaaccgtgccgtcttcgcaaaattcgtaaataaaagatgcctgctgcatataatcgttaagcagatcctcgtcagtgatatacttcgggaagtcttccaccgctacgaaaatcattttaccgggttctggataaaccggcaattctttaactttccatttaccgataagattcatactattcatcctttcatactctgaatttttctgatttatgcgtacataagccgttacagcttatgcccaggggtctgcggatttgggtgtgcgtatacctgtaagcaggtactgctcccataagaaccatttgccgtcgcccttcatacgcagttttatgggtctggggctgtcagcgccgccacagggaatgaacagcttcatataaccctgctcctcgcccgaaacgtgcgtactttgtaccgttactctgaacggctctgaaggtgtgtaatcattatcgggtgttgctccctcaaaatatgagaacggaatataggtctttccgtcacggaaacggtcgttaaggaacgatatttccgtaccgttgagcggacggggacctctcagccagttgagcatttccgtaccgatatttttgtctgccgcataagcgcacagtgcgcatacagtaagtgcagccgccttgaacggcgaatcaagacttgcctcaggcagtgcctgcatctgtgcaagactttcggggagtgctgtgaatgtaaatgtttcgctcttgttgcctatagacattgcggcgttatttaccgcacctcctacagcgcttgccgctgtgtttttaagtttgtcaaaaagtcccattgtgttcctcctgtatcatctgtatttaagctgattagctttttaccgggtaattaatttcagcttgtagaaaaagtctgttttttataaaaatagagctaattctctatccctatcccctttaggacactctgttggctttgcttcgtgcaaagcttggtgtgtccttatttcggcatccttgccgaaaacccctttcccccggaaaggggctatattactggggctaccgccccaagtccaagcaaggatgcttgcagtcagccacacaaagccactgcacgatgcagtggtacaaatggctgacgacctgtatggggggctacgcccctcaaccccattttttaataacgaaaaagtttttctacagactgttaatttatgtttcctatcgtaatatcatttatcaatgcggcggtatggagctattactgctccgctcaggaatcctcttcctcgccgtacttttctgccagtgcgtaaaacaaatcctttacgttttcgcttaccttacaatttgcattaagattagtgccgtctgcaaacttcaggctgctcgaatacatcgtttcatcgcatacaaaaaccacacgacttaacggtcttggtcggtgtttcttgattttatccgcaagatcgctttcctctgccgctttgattacattttcggcttcttcctgcgttatctcacggttatccgatttgactctttcttctttgtcgcttacggagcaattacagctgaacagccatttatcgccgcttttattaagatcgaagttatagctaaaggtgtaacacatatgaccgcaggacgcatagatttcaattacatcattataattgtattttttcattctttcgaaaaagcccatgtgttccctcccctttttcagctcatttctgcgtacagcccctgcctttagtgtatttctcagccagctttataaaagcactctttatctcatcgtcaatctcaaaaggcgcactctttactgaaccgtccgaataatataacaagcaacttcttaccgatttgtcatgcggctgcatacccgcaggacaactgttattccgggttttgtattcctctattctttttataagccccgttgtatccgcaagacgcaacacagctaaagcgtcttcgtcttctattgcggtatatcccatatctatccgctttgtttcgaagccgtcagcacaattacagaatgcatccataacatatttaccgttttttgcgtgatacagcgaaaaagaatagcaattgcggcttgacatagcgctgtgtacaacggataaaccggatacttttacggtaccgtctgatttattttcttcacgaaccattccgttgcagtaatcctcaaagctcaatgagtgatacataataattctccgtcataatgagataaacttaggtttagcgtgaaatcggcaaaagagtttgatgataaaatgtcctcagacaggcgggtaaccgcctaccgtgcttatgcacgggataatccgcttatgcggtttatctgtctgaggttattatatcacaaatcaaatcggcgcaagccgacacggcggtacgccgtgcttttgtcttttcattcctcacaaagactatcgagtcctcacagcgtaaggtcgagggcagaaacttctctatccgtaagaacgtacttgactttgacgatgtaatgtcacagcagcgtatgacgatttattcacagcgtgccaaggtgcttgacggtgaagatgtcagcgactatgtaaagaatatgataaaggaaaccatcgaggagaatgtcaagacatactgctccgatgattatcctgaaaactggaatcttatcggtctgcgtgagcattttgcaaatatgcttacaaaggaagatgacttcaactatactacggacgacctcaatacaattgaccgcaaggatattgtaaagctcctgcaggaaagagcggacgcactttatgccgagcgtgaagaaatgttcggcactgaaaatatgcgtgagattgagcgtatctgtctgctgaaggttgttgacaccaagtggatggatcatatcgacgcaatggaggaacttaagcgaggcatctatctcagaagttacgcacaaagagatcccgttgtcgaataccgtattgaaggcttcgcaatgttcgacgagatgattgccgctatccgtgaggatactgcaagacttgtccttaccgtcaaggtaaggatagaagaaccgctccagcgtgaacaggtaatgaagcccgacgctgaaaacgcaggttctcacacgaccgtaaagaaatccgcttcggaaaaggtcggcagaaacgatccctgcccctgcggaagcggtaaaaagtataagaaatgttgcggtaaggacgaataattaccggtaacagtgctgtttcagcttgtgttcataaaacggacgcaagctgaacgctttaattaaccaaacggcataaattatcattgcttacaatgaaaggaactcaaaatggctgagatcaaagcattcagaggactgagatttaccgacaaggcaggaagcacaggcgaggtgtgctgtccgccctacgatattatcagccccgaacagaaaaagcagtatttggctgaaaacccccacaatatcataaggcttgagctgccgaaaacggctgaggataccgatgaggcatacggcaaggcaagagcgtatctcaacgaatggcttgacgaggaaattctgaagtgtgacgaaaagccttcaatatatatctatgaaatggtgtttgacgcactcggttcaagctacagcgtaaagggatatgtttcgcttgtaaagctggaggagttctcaaagggaataattcttccccacgaggaaacgctctcaaaggccaaagaggacaggttcaaccttatgtgtgctaccggatgtaatttcagccagatatactcgttatatatggacgatgacaataaggtattcacgcttatagataatgcaagcaagggcgttcccgacaagcagtttaccgatcccgacggagttacccacaagctgtggtgcgtaagcgatgaagcatttatcgcagaccttgcatcaaaaatggctgacaagaagttatatattgccgacggtcaccaccgctatgaaacggcgctccgttacaagaaattcgttgcagaaaacaagcaggatgtcggcacttccgaatatgttacgatgatgcttgtcaatatggagaacagcggacttgtagtattccctacccacagaatcgtaagggatcttgaaaactttgatgtaaacgcagttattgaaaagtcgaaggattatttcgacatagaaaccaatctttcacgcaccgacagcaccgcaaagctcgacaaggcttacaaggacggcaagaaggcattcgttctctattgtgacggcaagtatacgcttatgacgttaaaggatacctcccttatggaaaagctaatgccgactgcaagcaaggcactgcgtgagcttgatgtcagcgtacttcacacgcttgtgcttgagagaattttcggcatagataaagaaaatatggcaaatcagaagaaccttacatacacaagagttcttgacgaggcaattgaagctgtagacaacggcagtgccgattgttcatttatacttaaccccaccagagtttccgagataagagatgttgcgcttgcaggtgaaaagatgcctcagaaatcaacatatttctacccaaagcttacaactggacttgttatgaacaaaatttttgactgatcaaaggagaaaaacaatgctcgctcgtgaatgcaaaaaggaacttacagaacacataatccctttctggaacagccttgaagatactgataacggcggtttctacggctatgtaggaaacgaccttactcttgataaaaacgctcccaagggcgtaatacttcactcaagaatactctggttctactcaaactgctatcttgtgttaaaggatcagaactgccttaaaaaagctaagcacgcttatgaattcctttcgaaatactgtgttgacaaggaaaacggcggtgtatactggatgatgaatgcagacggcacggtaaacgacagtatgaagcacacatattgccaggcatttttcatctacgctatgtcaagctactatgacgcatctaaagataaagccgctttggagcttgctcttgatgtgttcgctacggttgaggaaaagtgccgtgacgatgtcgcatatcttgaggcattctcaaaggactggaaccttatcccgaatgacgcactttccgaaaacggtcttatggctgacaaaacaatgaacactaccctgcacgttatggaggcttatactgagctttacagagtaagcggtgacaagcgtgtgcttaaggctctgcgttttactcttgagattactcttgacaagatttacgataagaacggcggaaagctgttcgtattcttcgataaaaatcttaacgaaataggcgatatttactcatacggtcacgatattgaagctacatggcttatcgacagagcctgtgatgttatcggtgacgagcatctttcaaagagatgcgccgagatgaacaaggtaatcgtcaagaacattgccgacagagctttatcgaacggcaggctcaataacgaggttgaacacggtgttgtgaacacatggcatatctggtgggtacaggcagagggcgtagttggcttctgcaacgcttatcagagatacggcgacgcaagataccttgagatttcacgcactctctggaactatatcaaggataagatgatagacaagcgtcccggcggcgaatggcattcacagcttgacgataacgatcagcccgcagatttcaagccggtcgtagatccgtggaaatgcccctatcataacggaagaatgtgcttagagataatttctcgtatgtaatcgaaaggattccccctatgtctgtttcaagcagaatttttaaagcagcggctttattttcggctgcagcgatagcaatagtttcatcgggctgcagcggcgaccccgtaaagcaggagattgtcacctcgataaccgatcaggtgcagttttcgtacgaaaccgccaaagctcagtatatgaccatccaagaagaagcaaagatacccgcaagccttgattatgctcagtcggaagcgtattacgcaccgatagacgcaaaagtcaagacgaataacatatccaagaatatgaaggtcaaaaagggcgatgttctcattgcgcttgacacgaccgaccttgactttcagataaatgataaggaaatgaaggttgcggcgatggcggacggcgttgataagggctatgcgcagattgagcttgataagctcaaggaacagcgtgccgccgcagtggtgaccgctccgtatgacggtgtaattgccgagtgctgttattccgctgtcggctcggatgtaaaatccggtacactgctctgccgtgttgccgtgcttgaatcaatattcgtgtataattctcagggcgcaggaaagaatctgcgtttcggtatggatgttgaccttgttataaacgatgtcgattataaaggaacggtgaccgccgctcccgacacagccccctcggatgcaagcaatgacgctacaacatactgtgccgttaccctgtccgatgacagcctgaagaagctgataaacgacaacaacggtatcacagcagtagatgccggctgggctactattcacgcaataaccgcaaaacgtgtgaatgtgcttgccgtacccgaaaaagctatcaagaaggacggcactaaaacctattgcagtgttcttcagggcaacgagaagtacgatctttatgttgaagtcggagcgaccgcaggtggatatgtcgaaatactcagcggacttaacgagggcgatgtggtagtccttgcggaatcaacaggcaacggctcaagcaacacggataataaaaacaataaccaagaagataatgaggacggcgacgatgaccgtaagccgtgggacagcaataaaaagccgttcgaagatatgtaatttcacgacaatcagaataactgaagataaaaacagcgcccggtcattgaccgggcaatttttatagctttgtaacaatatcataaaatccgttcagatcttttacagtaaatttctgaccgaaatcacggttattattatatctgtcgatatacacggaggtacagccgaagtcgtttgccaccagcacgtcttttctttcatcaccgataaatatcatttcatcgggttttatgccaaaataaacggcaatatcgcaaagcccctttatgttcggcttacggtatctgcacgaggttgacgaaacataaagatcgaaaaacggcataagctcagggaaatagcttttgtgcagttcgtcgggcattcccgttgcgacatcggtaagtgtggcaatctttatgcctctgtcacgcagtttttgcagtacaggtacggtttcgggatatgtgtatgccttaagcggaaaagcttcgaaaaagcaataagcgattttatcaggcggtatatccacaccccattttctgactatctcaccgaatatcctttcgtaagaataatcagcctcacggaattttatcgatggattgtagccacgcagtatttccatcccgtccgctatattcttttcggtaagctgcggcaacagcttttcacaaacgtgcaaaaaaccgttttcataataatcgacccatacgcacggcatacccttatattccataagcgtgccgcctatgtcaaatacggctgactttatcataactgcctccgataataattattcaagctctgctaccgtaactcctgcttcgccctcgccgtatgcaccgtcacggaacgatttgacgtggggattcttacgcaggtactgctgtactgccgagcggagcgcacctgttccctttccgtgaattatagtgataactgaaattccgctgagaagacagctgtctataaagcggtctacctccattacgccatcatcaccgagcatacctcttatatcaagttccattccgctcttgcgtgagaagttacttaccagcttctttccgacctttgagggcgtcggctgtttcttgctctctttcttttcttccacaagacgaagattttcaagcttggtcttggttttcatagccccgacctgaacaaagcacatattctttgaatctggcagccttaacagcgttccctctttattgagatccgcaagacgtaccgtatcaccgaccttgagcggtcttggcagaacataatgatctatctttttctgcattatcgggtttgcggtatcatacattgcgttcacagatgagctgatatgtgaacgggcacccttgaccttctgtgcaaaatcggcactttccttctgctttctgagcctttcaagttcttcaagcataaggtcgccctgaaaacgcacttcttcgattatgcttgccgccttgcttctgacgtcctgaagctctttttccttgtccttttcaagctgatcacgctcggctttgagttgttctgtgatttcctttgattttttctgttctgccgccgcagagcttttcagcttttcaagctcctgccttgtcttttcgagagattgaacaacttcttcaaaacgcttgtcctctgtgctgacaagttcctttgcgttatcgattatatcactgcttatgccgagttttgaggatatggcaaaggcgtttgatttacccggcatacctacaattactctgtatgtcggtcttaaggtctttatatcaaactcgcaggacgcattttctacgttgtccgtctttattgcgtacatcttgacttcctggtaatgagtagtagctatcaccttgcagtcacgttttctgaattcatcaaggatagataccgcaagcgctgagccttcaacggggtctgtacccgaacaaagctcatcgagcataataagcgacttctcatcggctgtacggagaatccttgcgatattcgtcatatgtgacgagaatgtagacaggctctgttcgatgctctgctcatcgcctatatcaacatacagctcatcaaacataccgataacgctgttttcgcttgcaggtatcatcataccgcacattgccataagcacaagcaagcctgcggttttaagagaaaccgtcttaccgccggtgttcggaccggttacgataagcgatgaataatcgtttccaagctcaagcgagataggcacgaccttgtccttgtctataagcgggtgtcttgcccttatcagattgaagcaaggcttgtcggttataacaggggtcactgctttcatctttgcaccgagatttgctttggcaaaataaatttcgagcgtcagcactatctcataatcgtttatcatcggctcggcaaagctgccgacaagctccgacatttcctttatgatacgctcgatttccttttgctcctctatctgaagtaccctaatctcgttgttggcttcgactaccgccataggctcaatgaacagagttgctcccgttgcggatgtatcgtgtacaagaccgcttatctcgctcttgtattcggtttttacgggtacgacaaatcttccgtcacgcattgtgacaaggctttcctgaagatatttctgcgttgactgactctttatcagcttatcaagcctttctcttacggcaagacttttacgctgtatcgaacggcgtattgccgcaagctgagggcttgcactgtcagcaagttcttcttctgatatgatagcgttggttatcatattttcaaggtgcttgtttacgctgagctgctcgaaatattcggtaagcgaggtctgaatgccgctgcactgtgaataccattcgtcaagaccggatacttcacgcaggaacattcctatatccataagctccctcagcgacagtgatgagccttgctgtgccctttttgcgccaaagcatatatcctttatgttatagaatttcggcgtaccgaattttgacgacagcgtgaatgcgtcatccgtctttgctatttccgttcttaccgtgtctatatcgaatgacggctttatcttttttatgcgttccttgcatacatcacagtatgcattttgcgagagcaggtcaaggatcttgtccagctccagctttttatagtcttttttcatatttatatcctttatatctatgtttcgattgcgatatttttataataatcaagcgtgggaaacgatctgttaagctgtgccagaaggtagaattccgcaattgcggaaaacagcttttcgtttttctttgagattctgaaacggtacattttgtcggtttcggaatatgcgacatatctcagcgtatgtaaaagcgtggggttaagagcgaatacgttcttttctacaagctcgctgtgttcttcaaaacaatccgaacaatagatgataccctcaacgggtaaaaacatcattgtttcgctcttgtaggctatgcattccctacaggctctgagatcgggcataaatcctatccttgagagaaacctgaactcaaatatcgcttttatgaaacgaagcggcagcttctgcttttcaagctgaaaatatgtcatgcaggtaaatctcagcagatcctcatgctcctcctcagatgtggcgcagtattttattatatcggcaaaatatgccgcaagcgacagtgcctcaatgtccgcagatatattatagaaactgcatataggctctgcgctgttaagcgtatatcctttactgctgcggctgacgcagaacgttgcatagctgaaaagcgatgcggcacccgaattctttccgcctatcttctttgcgccgtgtgccataacctctatcattccgagcttgtcagtgaacaggtcaagaaaacagctgttctcgcctataatgcgctgcccgataacaagccctttcagcgtaataagcattgaacagctactccttttgattatatatcagtcggccttaagtccgaagtcggcaatgtcggactctctgtttctccagtcctcttttacctttacccatatctgcatattgaccttacagccgaaatagtcctgcatatcttctcttgcctcagagcctatctttttaagcattgagccctgctttccgataatcatgcctttatgcgacgctttttcgcagacgatgactatgcctatatcgacaatctccttgccgttgggcttctgccttacctccatcgtttcaacataaacggctgttccgtgcggaatctcctcgttcatatttctgagtatcttttcacggacaatttccgcaagccataccttttccgcctggtcggtcggaagctcatcgtcaaaataatgcggtgacagctttacatatctgtcgattacaggcattatttcttcaacacctatcctctgccttacgcttatcggaattatctccttgaaatcgtaaagctcgctgtattcctttataagagaaagaagctcggacttgtcctttactaaatcgaccttgtttataagcagaacgacatctgtctttctgtccttgaagctgtcgataagattatgctctatcggagaaatcttcttggtcgcatctgccatcataagtatcacgtcaacatcggtcacgctctctcttatggatttgagcatctgatccgacagtttgttctttgctttatgcataccgggcgtatctatgaacacatactgcgtttcgccctttgtaagtacgccgtttattcttgttcttgttgtctgcggtttgtcgctgactatagctatcttttcgcctacgagatagtttgtaagcgtggatttgccggcgttaggtctgcctgcaatagccacaaataccgatttcggattattcatttttcatctttcctttgatatttcttttctttcctttcgctataaacagatacgaaaggcaggcaaacgctgtcagcattgccagattccatatgtcacccgtaaaaaactcaaatataatcttaaatttttcaatatcccagaacagtattacgccgattatcacggccgcaacagccgttacgaatactgcgcctgcggcaacgtcttttccgacctttgcaagcgccgagtagcccggtgaaaccttgtctatgactacctctatagctgtgttcatcatttcggcggaaataaccgtcacgcaggttattatcagtaatatgaactgttcctttgtgaaattatagaattgcgacagatacagcacacacattgtcgcaacaatgtgtatacgcatattcatctcatgactgatacagaaccatattcctcttgccgcatatttaaaactgttagcaagtcttttaaacactttgacctctttttattcccgtgtgatcttaaggttgttcagcacaaggtcctgcagttcaagcatcaccttttctccgtcgggatcgtcctcgtgatcgtatccgagaagatgaagcgttgaatgcgtggctaaaaagccgacctcccttataagagaatggccgtattctattgcctccacggggaaggggtttggggtttcggcaaggatgccgagatagaacgcccaaaggctttgcaggacgcaaagcccacaaagcgttcttatagggatagagaatttgctctattttttataaaaacatactttttctacaatctgaagctcccggacaaaaccggatgcttcagttatatattctctcttataaactcataaatcaaacggtatacattttccctctgcaattcctgcagtatgctgtgacgcattccgtcaaatatttcaagtctgacatcaaagccgttttcgataagaagaccggctttttctttcgcataagcgcctttatcgcccaccatatcctgtgttccgctcattaaaagaaagggcggtttcggtgaaacattcttaagataatccttgcgctgtacttcgctcgcaagctgtaaaaagctcctgtagaagcgacagctgtacattttgttggtatacgggagagtttcataatataaagcacgctcaaggtctgatgtcacccaggataccgtgcatttttccggaaaaggctccgcaacctttccgaacagcttcaggaatacgtccatactcggagcatctgcgcctttttcggaaatttccgcttctatgtccgacaaaagcgctttcgtatcatgtatatacggacagcctgtaagtataactccgctgtaaagcgagctatcgcagtggcaaataacatattgagccatctgtgcgccaaggctgtgaccgagcagaaacagcggtgtttcactttccgagtgaacgtatgacgaaaaatcaccgcattcctttgccgcagtctgaacgatattgtctatatccgcaggcagtgccgtccttccgtgttcacggtattcgcaaagatacaccgaaactcctttagcggtaatatattctgcgaactgctcgtagtattccgacatttcgccaagcccgtgaattatctgtatttttgccttttcgttatcggaaagccattttttgcagtgcattcccttgtattcaaattcctgtgtagtcataaaattctccgtaaaaacaaagcaggcattttcagcctgctttgtttgctatttctgttattcttccgtaggcccatcaagatgaatctgaccgtcctcacgcagatggaactgcttaaccatcttctgaagctctttcgcctgagcggctgtaagtgcgcttgcacttgcactttcctcagctgttgcggcattgttctgaactaccgctgaaatctggcttacgcttgaaagcacttggtcaaccatagttgcctgctgtgccgagccgtccgatatttcgttgataagtgtgtttgcattgctgaaacgttccataacactttcgatagtctgtgcggttgaatctgcgatagccgtgccgtttgaaacagcctctatagtgctgccgataagctcgcttgttgtctgtgctgcttctgcggacttgctcgcaaggtttcttacctcgtctgcaacaacggcgaatcccttgcctgcttcacctgctcttgcggcctctacagcggcattaagggcaagtatatttgtctggaatgcgatgttgtcgatagtgttgataatcttctcgatctcggctgatttttcgtctataatcttcatagcggcaagcatcttctgcatttctgcattgccttccttaaggtcagtggtcgcagtatctgaaatttcacttacgttctttgcgttttcggcgttcttgtttactttgcctgaaatatcgcttacatagtctgaaagttcacggatggatgcttcctgttcgcttgtaccctgtgcaagtgcctgtgaaccgcttgatacctgctcggaggcatcgtatagcatagttcctgccttctgtattcttgaaaacgagtcattaagatttacaagtatctgctcaaatgccgactttatgggagcaaattctcccttgtaatcatagttaatggtaaagctgatgttgccgtatgacatctgagtcagcagatatgtaagctcatcgaccattttcttcagataccactttgcagtattgagcgagcctgcgagctttcctatatcgctgtcgtttatcttgacgtcaaattcagcggaaagaataccctctgagaagttattaagttcgttgctgatttttctgataggctttactattgcttttcttacataaatgcaaagcaggataaatgccgcagtaacgataatcgaaatgccctcgattatcagtgacagcattatcgaagaatgatagacagggtcgtcgtgacctgccattgtcagaatgttgacagtgcatacagcaatggtagccagcatcattatacagcagacaacgcataaaaatgttattacaactacctggctctgcactttattttttagccagtctttattttttttcataaggaacacctcttgaatttacattttgataatcagattttatcacaaatgctgtaataagtcaagaagtaaagcggtgtgtttggtgcaatacaccaaaaaaacgttaacaaatgtacaagttgcacgaaagccgccatgatatattcatagcggctcaaactgttttgtttgttaaacctttgcggtaaacaaacgtctgcaatatttgttgtccagtccgtgatacaggagcagaccgagaactccgcaggagataacctcacctgcacataccgtcagtgccgagaaccataatgcgtccggtacaccgtaagcataggtcagtacaagcggtactataacagtattggcaattatgggctgaagggggtacagtatcctgtgatgctttctcagaagatatgtgcctaccgctcctatgagtgtggcaaggcttccgaagataacatcccatattacagcaccggtcagtatgtttgagataacacagcctacaaccagtcccggaattgccgccggagtaaacaccggcaggatcgtgagcgcctcggaaagacgcacctgaattacgccgtttgtaagccccagcaggctgacaatataggtcagcactacatagattgcggcgataacggctccctgtgtgataaacaggacttttttgtttcgcatattgaattgtcctttcgtagttttgatttatccgtcttctgacggaaagtgaggatattgcgaactcacaaaaaatgattttagcacagttaaagtgctttgtcaagcttatttttgcgtttcttcagccgcccctgcagattctcttatgtcatcgggtacgttttgaaatatcgggcggaacatggatatatacagcttcatattatctgtatccgctttcgaccccggaacagccttttcttatcgcatagcaatcccgaaagggcaaatcggtttattctatattttactgccttatataaataccttgatcctcgatataatcctcaagctcctgcttcatatcccatatagcctcctctttgtcggcagactgtctgtagtcgcctttatcattgggctgtacgggagcttcgggagctttttccttttcgtctgtcatatttatcatatcctttcggcgtattttctgctatttacattttatcacaatctgtaacacagttcaatatgctgtggcacaaaacgtcagtgataacggaagttgacatattcttttaaatgagtataatatttattgatgaagaaaggaagtttaacttgagcgtagatataaaagagaaaaagaaatccggaacggtccttatgacagagggctctatctggaagaagctgcttatattttccgtgccgctgatactgggcaacctcttacagcagttatacagcacggtcgattctataatagtaggaaactgcgtgggcaaggaggcgctggcggcggtaggctcaaccggctctatcgtcagtctgctgatagcgttcagccagggcgcatcggtcggcgcaggcgttattatatcgcagtacatgggtgcaaagcgtaaggacgatgtgaaaagagcggtacatacggctatggcaatcgcagttataatcggccttttgctgacggttgcgggcgtatttatgagcagactgttcctcgtatggatgcagacgccggataatatccttgacggcgcatcgctctatttgcagatatactgcggcggattgctgttcaacgtgctctataatatgtgtgccggaatattcaatgcggcaggaaattcaaaaagaccgctgttatatctcggtgcggcgtcagttgtcaatatagcgctcgaccttatactgatacaaggcttcggtatgggcgtagagggtgcggcgatagcgaccgatgcgagccagcttgtttcctgcgttatggctataatctatatggtgagggtaaatgcggattataagctgtttatccgtcagataaaggtacacagggatatggcgataaggataataaagataggtctgcctacaggcattcagaatatggtcatctccttttcaaacgtgcttgtacaggcaagcgtcaacagcttcggctcggatgcggtagcaggcttcggcgcatatcttaaggtggacggcttcaacatcctgccggtgcttagtataagtatggcggtgactacctttgtcggtcagaactacggtgcgaataagcccgaacgtgttaaaaagggtatgtggacagcactcggtatgggcgttgtttatactgtcataacaggcatcctgctgcttgtgtttgccgatccgattttaaggcttttcacaaacgatgacgcagtagccgcctgcggcgaaaccgcaatgaaatacttctgtccgttctatttcctgcttgcaataatgaatgtgcttgcgggggctgtaagaggcacgggcaagagcattcctccgatgctgatattactgttcgcaatgtgcattttcagaatattctggatatggctcgtagtgccgcttttcccgactattgacggcgtttatctgttgtaccctgtttcgtgggtaataggcgttgtgcttatggcactgtatacctggaagggtaaatggatgccgaaaatcgagtaaatatccgacttgaaatgaatacggaataacgcagatatgcttaaaaacagcactgcgttattttgctaaattgcacaaaatgctattgacgaaaacgattacatatgctatgataatgataaatgtatattgtggtttgcgtaaaaagccaacaactgcaagacggaggagaacatggaaaacaagtatagattcagggatagctcactgtcgtttgacgagcgagtaaaggaccttttatcaaggctgacaatcaaggaaaaggcaggacttatgtcaagtcatatggcggctgtgcctcgccttgatataggcgagtggtatgtcggtgcggaggttgcaaggggatatgtttcgagaaaccccgatgagcctacgaccgtattcccccagccaatcgggctttcgggaacgtttgacacggagcttatggaaaaggcgggacttgcggcaggcaaggaggcacgggtgctgaataaacgccacccgagcggccatctgatgctgtggggacctaccgttgacctgtgcagaaatccgctctggggcagaaacgaggagggctacggagaggacccgttcctgaccggagaaatgtcggcggcgtacacaaaagggcttgcaaacaggcacggggagtaccttcaggccatcccgacgctgaagcatttctgcgccaacaataccgaaaacgagcgtggaactgcctcgtccgatgtcgatatgaggacgctcaacgagtattactatgcggcatttgaacgcccgataacctgcggcggagcatactctgtaatggtggcatataacgagctttcgggtgtcccggcggttataaatccggatatacagaaagtcctcaaagacagatggggactgggattcgtggtaactgacggcggcgatttctcgcagaatgtaacgttccacaaatacagcgaatcccacgcagaaacgttagcccttgcgataaagaacggtacggacgttatgagcgactgcgaggatgtggtcgaggcggcggtgtttgaggcgttgaacagcggacttgtgtcggaaaaggatatagacaaagcgctgtataacagcctgcttgcaaggttcagacttggtgaatttgacgaaaaacatccattctcagatgtgtgcgagatgatgattgacaatgaggagcataagtgcctcaatcgcagagcagcactggaacagatggtattactacgcaatagcgacatactgccgatttatgatgaatgtagcgtggctgtagtcggtatgaatggtaactgcaatcttatggattggtatacaggttattcgtcatataatacaacaatatttgatggaataaaagaaagatacggaaaagcagaatatgataatgcctgcgatcatatagtaataaaatcaaagctgacgggaaaatatctcggcgttgccgatgacgatacggtgagtgcgatttacgaaaaggacgatccgagggcgctttttgaaaaggcggaatacggccacaatgaaacaacgtaccgttcgctttacaacaacaaatacataacggaaaacacctgtaagtgcgacagcgaaagcacttaccgctggttctcgcaggaaataatgaaaccgcagaaacacggagatgaggtactgtaccgcacctatttcggcaaggctctgggcgttgacgaaaagggaaagctgacgcttgtaaggcagtacgggttgaccgatgacaagctgttttgcgaggaggtcatatcagacggtatagtgcgtgccgcagagcttgcaaaaaaagctgatgcggttatagtctgcatcggcaacgatccgatgatagtagcccgtgaaatgtacgaccgtaagacactgtcactgcccgcacatgattctgcgcttgccaaagcggtttacagcgccaacaacaaatgcgtaatggcggtggtgtcaagctatccgttctcgatatgcgaggagcaggaatatatgccggctataatctataccactcacgcaggtccggagcttggaaacgctttcgccgatgtgataagcggcaaatattctcctgccggcagactggcacagacgtggtataaaagtgaatatgagcttgctccgatagaatgctacgatattatcgaaaacgatatgacatatctttactacaggggaaaaccgctctatccgttcggatacgggcttagctacgcaaagtttgaatattcggactttgacgtaaaggaaaacggagatgttataagcgtttcgcttgatgtcacaaatgtttccgaaacggacagtgacgaggtagtgcagatatatttccgtatggagaatccgtcggtaaagcgtccgctaagacagcttgtggcttttgcccgtgagcgtatcgagtgtggcaggacaaggcattttgaatttgatataaaaaagtcggagctgagattctacgatgtcagccgtgaacgttttgccgtagagcagggaagatacacctttatggcgggtgcgtcaagcgaggatataaggcttacaaaaacgatcgacgtaagcggtgaaataatacctccgagagagctttgcaagggcgtcaaggcaaaaaattacgacggcaaatacgggacgaaaatgaaatacagcaaaaaactcgaacagcactatatgctcggcggcggacttatctacaacaactgtgtgcttggtgaagccgacagtatagagatagtgtgcggaagccgtgtcaatacgggcaaaataaccgtgcgttacggcggagagacgttatgcgaggctgaggtgaagccaacggtagatgttaccgaatttgaaacggtgacggcacagtttgacaaggctgtgcttgccggaatcgacagggagaagcctgcggtgtttgagctgtggatgccggaacagatatatattctcggcttcaggacttattgatattttcaatctgaagtgatgctaaaggacggcaaaggcggtttatccgccttagccgtccgttttttatggtacggggtattacagtgctgtatgatatggttggatgtttggcggcatcaggacagtgaaaatatattgttgacaaggcggagaatatatgataatatattattagatttctaacagtttaaatgcgaatttaaaatactccgggaggtacgaatggaaaattcacttcatcacttgcttatgataaaccacaccgcttttcgcaagcggattttttccgccctgaaaaacgaggggctgacttcgggacagccgaaggtgcttgaatatcttgcagagcatgacggagcgatgcagaaggatattgccgccgcctgcagaattgagcctgcaacgatgacttcactgctttgcggtatggagaaaaagggtctgataacacggtcagcgcctgacagacgctcgctcagcgtatatctcaccgagaagggaagaatgctcattccgcttatcaaagaggaattttcaaggatagaggacagggctacctgcggattttccgatgaagagcgtgaactgcttatttcgctgttgtcaaggatgcgtgaaaatcttgactgaatcaaagaacgaaggaaagacgaaaatgtcaaagaaagaaaccgctaaaagatacgttttatttataataagcctgtttttctccgcactgggagtggcttttacaaagcacggggagcttggcgtatctccgatctcgtccgttgcgaatgtgcttagctgtacaaagggaggtttctcgctcggagtatggcttataatctggaactgcatattgatactcggtcagataattatactcagaaagaagtttcagctgatacagcttttgcagatcccgctgtcgttcctgttcggatattttaccgatttcggtctgtggctggtcgggtttattcctgtggaaagctacataatgcgccttgtaatggtggttgtcggaatagtgatactgggtttcggcgtgtcgctgtcggtttcggcgaatgttataatgaattcgggagaggcttttgtaaaggcgatagcagatacggcaaacaagaatttcggtaatgtaaagatagcttttgatgtaagctgtgtggtgcttgcggtgattctgtcgctgttgctgtttgatttcacgatagtcggaacaagggagggtactgttatttcggcgctttgtaccggtcttgcggtgaagctgttccaaaggctgacgaatgagccggtgaacagacttgtgagtgattgacgtattgtataaaaggacagacgtggggcgagggattattgtccttttgtaatggttgtggagatggagaggttggtgggtgtaaaacaatccctccggtagtcgcccgaattttttcgggcgacagcacctcacctttgacaagggacgggcatggatgcccgaagttgaacgcccaaaggctttgcatggacgcaaagccaacaaagcgttcatatggcaagggggatagttctttttgtcggacagcacttctcgggttcgctattcgagtgggtacacctgtcaatatgaaagagggagagagacaaccaaagggatcaggacaagggacttgacagcccctctccctgtcccttaggttttctccctcttgctccctctttccttacccatacccacaccccgtcggggtgtgggctaaacttgaatatccacccgaacattgtatatcctatcaatgcagggacgcttaacgctacacgtccgcaagttagtacatatatcttaggttagaggcgtttttttgaagggtcaatgtcggtgcagttgcaccgatacactcacgaaaatattaatgccttgtcgatacggaaactgttttaagcagcgttggcgatatgtttaacggtgtggactttgataataatcagtttatctacagactaaggtgtcgtttttgcggcaccttttgattttccggcaacacttcatacatcattaacagtacaatacacggctttcaactgcgtttttgtgatattatctaaaattacgctaaaaatacacataattcatcaagaaaatttgttaaaaaatctacaaagaaaagcgttgaatttaaatctgaaataaggtataattatattagttttatgctatgccgttatgctcaaaaaacggcactgcattgcgagaacaattaagaatggagaattatgcatgacggacaatttactgcgtactatggcgataatcaccgaaaagacagccgctgaaaacataagcggtatgtgggcaacggtaattaccggtatggttgttgttttcctgatcttaggactgcttataggactgctttacatcatttccttcttctgcaatctgggaaacaagaagaaaaaggatgctaagcctgaccagacagtcgctcagcctgcaccggctcccgctcctgttgagcttatcgacgaggacgagaacgatgatgaggttattgctgttatttcagccgcaatcgccgcttatacggcaggtgacggaaagacctatgcaatcaagagaatcaaacgtgccgagaaacagcctcgttcaagctggggcaatgcgggtgtaaacgagaatacccgttcgttttaaagctcagatcaaataaaaggagaacaagatggaaattttagacgttttctggaatgcccttgttgcgcttgcacaaaaatcgggcttctgtaacataaccccacagcagggatttatgatagccgtttcattcttacttatgtatcttgcgatagtaagaaagtttgaacctctgctgttactgcctatcgcctttggtatgatgcttaccaatattcccggtgcgaatatgttccacccggaaatgttcggtatcagccctgaccctgcgatagcggcgaactttgccgaaaacggtgtcaactacggcgaggtgcttcataacggcggtctgctcgatatactgtatctcggtgttaaacttcagatattccctccgctgatattcttaggtatcggctgtatgacagacttcggtcctctgatagcaaaccccaaaagcttactgctcggtgcagcagcacagcttggtatcttcgtaaccttcctcggtgcctgcgcattcagccttacgggtattgaaggtgtcgacttctcatttaaagaagccgcttcaataggtatcataggcggtgcggacggacctacggcgatattccttacttcaaagctggctccacagctactcggctcgatagcggttgccgcatactcatatatggcgctcgttcccgtaatccagcctcctataatgaagctgctcacaacaaagaaggaacgtgccattgtaatggagagcttacgtcccgttacaaagagagaaaagatcatattccctgtagcagttacgcttatcgttgctttcatcgttcccgacgctactccccttgttggtatgctgatgctcggtaacctcttcagagagagcggtgttgttgacagacttgtaaagacggcatcaaacgaactgatgaacattatcactataatgctcggtactgttgtaggtgctacagcaacagccgaaaacttcctgacagtaaagacgcttattatagttgcactcggacttatcgcattctgcttcggtacagcaggcggtctgttacttgcaaagctcatgaacaagctctcaggcggcaagataaacccccttatcggttcagcaggtgtatccgctgttcctatggctgcccgtgtttcacagacggtcggtgctaaggaaaacccctcaaacttccttctcatgcacgctatgggaccgaacgttgcaggtgttatcggttctgccgttgccgcaggtgttcttctgaatatcttcggttaaatcaaataacaacgaacccccttgtcaagcgacaagggggttcttattatatcagaatcttacgggcaagtaattttagcccgcttaaatcatccttacagggatgcgacaaggcactgtaaaattttcaatcaataataatcaagcccggcaggatatgcacgggctgatttatcatcttcgtttaccagtctcttctgttaccggtcgagacattctgccctgccacataaactgcttgttataaaaaacttttcagacaagtttatcgtatcttatgaaatttgcgataaaagatattcctgccgatgccagcgcacagccaagtccggtatagaaaaatcccacaaagacatcggggaatactcctgcttctctcagccctattcctccgcccatcatacaagccataattatatatgctttaaggtcgaagaaatgccagaacgggcggcggtcttcatatccgagtattctttttgtatgcttaccgctcattttaaggaacatcattccgaaagcgacaaatacaactaccgacagcagatacataaaccattgccgctcgataacaaggtaagacaatactccgagccttgcgacattgaatccggcaataagccacacgataccagctatcaataaaagcgtcctctttttaactttaaacatttctgtcttctccgatcatttaaattgtttcagacgtttttccgcattttcgtaaattttttcaaataccgccttgcacttatccatttcctcgtcggaaagtccgtccagtatatcccttgcgaactgcttctgaacagctgtgccttcatttactatagttttcgctttatccaaaagaataatagcaatgtactttttattatcctcgctttgtcttttctctatgagtcccttttcttcgagcattctaagcgaagtggaaacgtgcgatttggtggatttgcgtatcttaacgatttcggcggcggtattatactttggattattgtgcaggaacatcaatatatcatattccatttgcgtaagattgtacttatcgcagactgcaccggttagcttttcataatagcaggtaatcgtcctgtggtaatcccggaaaaacaaatcgtcaactccttttcaaacaatcgttctatttagaacaaaggcaattatagcatacagaataccctttgtcaagaggaaggatatggttttcacggcggacaggtaaacaaaaaaacggtgaacgcataatacgttcgccgcctgttttatatcagccgtaaaattacttgaaatattcctcgccgagtatttcgacaaatctgggtttgactcctgtcttattgtcgatgtgaccgtagttctggcacatatcgtagctcggcagggtgtttccttccaccagaacaggtcttgtgggagttatcgcaacgtcccagcctatgtagccgacctgcggtactacaagagccgcctttttgcacatttcgaccgcttcgaaaaacatagggatttcaaagccgttgaaccttgtatgtgtaaaagggtgttcctcgtaatatacgccggtagcgtcacagtaggcgttcttgtgtatcacgccgtctgcgcctatcgaaacatacataccgccgctgcagatattgtcaacacagttagtgccgttgctcatacggacaagagcatacataaaatgtaccttgccttcgtgcagaagggtcaccatacggattgtattaatggacgacgggctgagcctgtccatctgttcattctgctttatcgtttcttcgacaagatattgcttgttgtcgcaaagacgcttgtaaagcgcctcataatcggtgtcgggagttactgtttccttggttatgccctcgccgccgaactgatttacaggctttgcaaatacagtttcacgccccttgcagaattcacgcagatcgtccgccgttgctttttcaagattcagaaaatctctgccgatgtattctctgaacgcctcatcgaattcggatttgttatcgaatatatgaaaatacgtcctgtcattgcaacgctttgagatggttatattatcgttcattgtcataaacgtgcgtctgtttttgcctttaatatttgcaaagccgaacacacggtaatccatatagccgacagaatagcggaaaatgcaccatatcatatcaaagaacattataaatctgttctttcccgtttccttatggatcgttccgatatagccgaacatacgtttaaagctgcctgcaaacagcctgcggaagaatgtctttaactttgtcatttacaaaacctcttgtttataatctgagtaactttgataatatcttatatattatgcgtttaagcggagaagttacaatctccttctctctcggagtaagtcctatgagccataccgatactataaatatcacaacgtagataacgccccagaacagtattccgagatagcccgaagcgtgagcaaggcaggcaatcagtatcgccgctatcgcaggaacgacaagcgatggaagaagcgctgtaatcctcctccagaatctcggaatatcaagtccgatatatttattgtaataccagttcattataagtccgttgccgataaaaacagggatagccgtacctatcgccacaccgacggcaccgaacagggcgcacagcggtatacttatcactatattaagcacggcgacaagcacatatacaagcgaacggaatttgtgcatattttttgctcgcagaatttcgatgccgagattctgaatactcggaagaatagtcggtatgaacagcaaaagcgcaataacaaatgcgtttgcgttggcttcacccgcccacagaagaacgaagggatagcctaccgccacgaatccgaacagaatcattgtgaggatggtaaactgaaaacgtccgacacggataaacagatcgcttatctgcttgtcggggactttatttgccaccatctgatgaactctgggggtgaggattcccgaaaatgtggtagccatagacatatagtagatattgagctgtgacgctacgttgtaggtagctacctcgttcgagccgtgcatccatgcgagcaggagcttatcgacgctccagtttagctgatcgaccactatgccgacaaatacccagcctgtgaacttgaacatagatttgagcagcttgaaatcaaagtcacggaaataaaaccgtatagcaagctttttgttgcagtatatgatattcagcaagcccgaaaacagcgtgaaggcaaggctcatataagctattgcttcggagcgaagccctatcatcagaaggggtattataagcagggggttgattaccgactttactatggcaagcagtttaagaaaaatgtaccgctcgttgaccatagtatttgattcaaatacgctcagcggaaagctgaccgccgctgtgacggtcataatatacataagtcttactgcaagctctatttcctcttctgtcagcttctgaccgaatgcaagacggggatttgcggctatcgtaaatccgactatcagcacaagtacgccgagcagggagtatatgacaaggaacataccgttcagctttgccatattgtatttgtcgtttgcttccttgtatcttgtatagaatcttgtgtacgcactgcccagaccgaagctgaaaagattcagatacgataccataggaagaactatggagtaaacgccgtattcgctctgtccgagcctttctatcattataggcgtgtagacaagcgaaacaaccgtacccagtatcagcgacagatatgagaggagcgagcccatttttatctgatcaattttcattcgcaattttcctgtaaattcattttatcttaaaacgtttaaataacagtattccaaattcatattttaacatattttatggggtttgtaaaggaaaaatgcgagaagtcaggctgatttgcgttttcttaccttaaatgtaaagaatatcatacaaataacaagcaatacctggaatattaccgagaagctaagaccgtttttatacatgccgattcaaaggcaccgcataattataagtgaaacaacattttttcaatcgccgaaacggttttcggttaagcaattacacaaatttgcttttttgcacaaatcaaacggctttatattagtcaaatctaataaaatcgctgcaaacgctttactatcagacaaaaatatgatataatatcctgagaattagtatgaccatcgtccgtaaaggataagaatataccgttaaagacgtgggaaaggttggttatttttttatgaaaatcaagagcttactgatcacagtgcttgcgtgctttgtgatcattccgtctgttgtatttgcttgtatcgcaaatgtcgagatgaataaacttgcaatgaagaattacaagcagacagcgcaatctatggctgaaaatcagacatataacatatcggagtatttccgtataatttcagccagtgcaaagcagatagccgacaatccggatatactgagtttcgacaaggaaaaaaatcctaccactacagacgctttggcgatatattcgaatatagcttctgccgacaatcaaaatgtcagaatcgacagaattatgattgtcaacaaaagcgacttcagacccgttgtcggaacaaacaaagattttaacgatcttaccagagatgatgtgctgtacggtactctcaaaaatatatgtgcaagaaaagacggagaggttacattctatactcccgatgtatatacaaacttcaatgaaggcgacaaggaaaagaacgatcctctcttccccggaaaaacgggaaacagcctgcgacttgtagtaaaatatacagtcggtgactattatatagtaacattcttcaataacactgccctcaagtcattcgcaacctcttctcagtttgcaaacaacagtaagctggtactgatagatcctaacggctcgataatgcacgacagctacataggcaatacttcggacaagaagaacagcgcttatctcaagtttacggacgccgcacagactggctctgctgttgaagttgacaacttcaagggcacagacagcggtgttattcccacaatcagctttacttcaaagatgcctaccataaatgaaggcgaagaaggcaactggacgcttgcgataattgcagaaaccgacaaggcgtataccttatcgggtgaagcgatgggtgccattgtcggcatgatagtattagttgcgattattttcatagcaggtgcgattgtactggtatttattataacaaagcctatcaaggctatcgaagaaacacttgtaaaggtgcacagaggcgaccacgaagcaagaatcaacgttatcgcaaacaacgagtacggtcagattgcccgtacattcaacgatcttatagacgatattgttgtaagtgaaggaagataccgtactattatcgaaatgtcggataacataatctttgagtggaatttcaagtcaaacgatgttttcttctcgaacaacttcaacaagaagttcagctaccgtgcaccctccgaccacttcggtgacagcttccttcttaaggttaaggttcatcccgaggacaacgaccgttatcacaaggatctcgaaaagctgtcaaagggcgaggaattcgaaggcaacgagtatcgctggaagaatatctacggcgactatatctggatactgctccgtactgcgactatccgtgacagagatggaaacattgctaagattgtcggcgttatcgttgatattgaccgtgcaaagaagagtgaaaagctccttacggaaagagcaagctacgacagccttacaggtctttataaccgtgaatccatcgagcgcaccattgataacgaaattgagcttatcaatgtccgcaagagcgaggtagcaatcctgttcattgacgttgacgacttcaagatttacaacgacaaatacagccacgctacaggcgaccaggtactgaaatttgttgcaaatacgatcaattttgtaatcaagggattcggtactgcgggtcgttacggcggcgacgaatttgtagcctgtgtaagaaacattgaaacaaacgagcctacaagagtagcccgtgatattctgtcgggacttaaggaaggctttacatcggataacggcgacaagctcagcgtcaatgcaagtatcggtatttcaatcatcaaggattcttcgatgcccgttgatgagataatcggtatggctgacgacgcaatgtacaagatcaagaagaacggcaagtcgaacttcggtattctcaacaaggaattggttgaaaaacccgttcctgacaaggttgatgaggaagacgttatcggcggaagcgataacagcaatggcggtgatactgttactcctgatacagctaatgatactgcagaacagcagcagtaattaaagttaaaaagagtgttgcgaaagtgacactctttttttatcggaatatgattgatttgtcaaaggaggctatatgataagagaagtcaatgaagatgaatacgaacagctgatgagcctttattgtcagctgcacgaaacaagcgtaccggaatataagggcgatacaagggagctttggcaaaggcttgtgaataatcccgactatcacttaattgcagctgaggaggacgggaagatagtatctacctgcacctgcataatagtgccgaatatgacgcacgggcctcgtccttatgcgtttgttgagaatgtagtgacagacagcgaatatcgtggcagagggctggctactgcgtgtcttgaaagagcaaaagagatagcgaaggctgaaaactgctacaggcttatacttatgacaggctcaaaactcgatagcacgctgaatttctaccgtaaagcaggttatgacgataaggaaaagacagggtttatacaatatttagattaaaccgaatgagccgtttgaaaaaaaagcaaacggctcattttagctatatcaaaagactttttaacgttatccgtctgaattaccgatttgcctgtcaatgcactaattatatgatttcctgccgtatggactgtagacgaatacaagggcaagctgtacggcagaatcgactgccggttcaaggaagagctgacagaggacgaaacggaaatcttcaaagactggctgatcggacagtgtgcagacggatttggcgagcatgtagaacagcagcccattcataccgaggacggcgatctgttcgtctctttctggcatccgggtgacagctatttcctctgtacagaagatgaactcgacaattgcatcgaagaatcacaaggaatgcagtttggagggatatgaaatatgagtgcagaagaaaaataccccctgctgatcggacactcgcttgcaggcagaatccgtctccatagcattcaggaggtagcaaattttatttgcacacatgggcagtatagcgatcttgctgttacgcaaaaggacggcacaccgcttcttgacaccttcggcatctacattaacaagattgcggatatggagtaccgggaggaactgctcaaggtgctgatcccgatgcagatggagatagacggtacgaacaggattgaagaagaaaatgatgaaaaggagaaaacagatatgaacgaatatgaacgcctgcgccgcttagccggacggcacagagaaacctacccgcccggaacaaggctggaactcatcgacatgaacgatccttatgccccggtgccttccggtacgagaggcacggtaaaattcattgacgatatggcgcaaatccatatggaatgggataacggcaggacgcttcccctcaacagcgatgaggactccttccgcaagctgacagcggaagaacttacagaagaacagaatgacggcatggacgaggataatgctcctgtcatgggaatgtgaggtgaaacggaaaaagaataacggaagacggtcggatgccctatggctatccgattttttgatatgttcgcaggcatcggcggattccggtcagggctggaagcggcaggcggttttgaatgcatcggccactgcgaaatcgacaaatatgccaacaaagcctataccgcactctatgaaccgaaaggagaaatttactatgaagacgcaaccaaaatcgatccggcaggactccccgacatcgacctcatctgtgcggggtttccttgtcaaagcttctcagttgcgggaaagcggcttggatttgccgatacaagaggaactctcttctttgaggttgcccgaattgctcgtgagaaacggcctgcatttcttttattggaaaatgtgccggggctgctatcgcatgacggcggccggacatttgaaaccatcctctccacgcttgttgaaatggggtatcatcctgaatggtgtgtgcttaacagcaaatatttcggagtcccccagcagcgaaggcgcctgtacattgtcggacatcgtgatgaacgaggcgccggagaagtatttcctctcgccggcggccatgcggaagatcttaagcagcttatccccggaccgcagggagcgagagtctacagcaccgatggcgtagcctgtacacagtgtgcgggatcgggcggatggggaggcaaaacagggctgtatttcattgacctgaatcccgatcccatcatcacagatacagcgagatgcataacggcaaggcaggattcaggggttagcaaccatcgaggtgaacactctgccatactcgtcgaggatgcgccgagagccatcatttccccaacaaaggagaaggtgcggcagaacggacggcgggtaaaagagccggacgaacccatatttacgctgaccgcacaggacaggcacggcattgtgcatcacggcagaatccgaaagctgatgcccattgagtgctggcggctgcagggttttaccgacgggcagttctataaggcaaaagccaccggactttcagacgggcatctgtacaagatggcgggaaacgcagtgagcgttcccgtcatttccgctatcggcagaaaaatcagagaaatcaatgggaaatatcacattacggaaaggctgtgaaagcaatggaaagcaagcagagaattgatcaattcaatcaggagaatcctcccttctatatcgtcgatcatgaggacggcgaatacagtttgtgcctgccgttggatatgctcggtgatgaatactatccctactgtcaggacgcatttgacgcttatgcagcggagatcggtgaacctgcatacagccacaacggactgaaaacccacggcagcggctacgaatgggaggcggcgttccgtgaagcattcaaagatgatcccaatatcggaagaattctctttgattgtgagatgggcggcttcttctgcgatgcaaatgacttggcgctgctcgaagactttggcagcaggttcaaggatatctgcgaggatacggaacgctttattccgattgtttcggagggcatcaaaaatgcagaagcatgggaagcggaacaggatcgactcatgaaaaccgtgagagggcggcttatgaaaaatccctctgctgtttttgatattatgacgccggacggcaatatctgcctcacgccgaaggagagcaaagcgctgctcgacggcgaaatgcagttcataaaaattggcggtatcaccttttcagcctatgaattgctcaatcaggagattacggatatgcagacggatctgtttgaccaaaatcttgttcggatgaaaacggatgactccgaagaaaccatgaccatgtccatgtaggaggatcagatgagttatacaagaaaaatcatgaggcttgacctctcagcagaaaaaactgcatcaaacgggtattactacacggagcttctgctccccgctgaggactatgaaatccgggacgccatgcagcagctccgtgccataggcagagaggacagcgtgtggatcagcattttagaatgcagcgatcttcccatgcttgaaaatgtccgattggattccccgacactggatgagctgaatttctttgcgaaacggctggtttctttaaccgatgaagaacagcttgtactgcgggcagtttccgggcgtgtaatttccgccgatcccgctggcgtgctggtcagcatgaaggatttaatcaatatgacctatggacttgataccgtcatgatcgcatccaatgtgggaaacgatgaacagctcggtcagtttgtcatcgaagaagaaataaatgaagatgtagcaagcattcccgaaaatgcgctgtatctgctggatcgaaagcaaattggaaggctgcaaagagaaattgacggcggcgtatatgtgaacggcttctatgtggttgccggtgattatgaaatgccaaaggtgtacgatggcaaaacgcttccccatgaagaaccgtcagaatggtttgcattccgcttgcacattgcagaagctcctgtgaacagcgcggatgaaaccgcaggcagcgccgaatggatcaatcttcccatcgataaagcggaggcaaacaggattgcaaaggctcataatgagggctgtattgaagattgcgtgtactttggctttgaatcatctgtcccacagattacctctgagatgttcggtgatatgcaggattttgatgttctcaacacccttgctcggcgcatggcagaaatgtcccccgatgagcagatcaagttcaagtcagtgctgaccgccgaacagccgcgcaatatcattgatgcagttgatgtcgccatgcatcttgatgaatatgagctgtcctattactccgattccgctgcttccttttacaaggattatctgcggaacttcatggacagccgctttgacagcgcatggctggatacgctcctcacgcagaacgaggggaaacggctgctccaaaggcttggcgcagcagaaacgccatacggcgtgatctctgcccgcggacactcgctgtatgagcttgtttcctataacgagccggaggtaaaggagctgtctgcacagggcatgaccgatgaaaagctggatgtcatcgaggtactcgaccgtagggcgctgtttgcaaatggcaggcttctgccagaagaacttcctgaagggctgtatgcctatgatctccgggaaagcgataccggcgaccgcttcgtctccatagagccaaaggtgggtgtgaaccacggcggcacggtactcatgaaggaaatgctcgacttcggggaaagcggacatatcccgcttgacgaggacagtgatccgaactttctcggatacaccatgacgccgcaggagtttgcgggcgaggaacaggcagaaggagaaaatcaggaattcggagggatgcagctatgagtatcaaaaagattactgcggaggatcttcgccgtatggacggtaaggaaggtcttattttgcagggctgcggcggaagccttgacgaatgggtagacggcatcaatgatctgctcacggagtccggcattttgctcgaaggaacaaaattcaaagcggaaaattgctccgcctttgagcatgacggactgacctgccttatgttccccttttcggaagatgtcaagctggatgttggcaggctcgccatgtggcggctgcaaacacacgggcaattgggcggcacatggctttccgattatgttcccaatcgcctcggtggttttgttgacagtgcgcaggaggcgcagaaacctgactgtcctctcatcggacaggacggaaatatcttcaatctcatggggattgcatcgaggacgctgcggcaaagcgggatgtccgaacaggcaagtgacatgtgcagccgcataacggaaacagcgggcagctactccgaagcgctcggcattatcggggagtatgtgaatatcacctctgtggatgacggtcagggctatggtggagatatggagatggaactatgacgcaggatgattttcagaagaagctcgaagcaatcacgaaggatgccgacgatatctatacctcgccggatttccagtgtgatcagacaggcggttttcccacctctctctgcgtatgctgggaaaaaggaaaagcatggctcgctccaaatgactttatgatcacagatctgccggacggtcaggcaaaagatatccttgacgcttgtgcagagtacggtatccgaaactgtgaggatgcggaggactttaataatcttctccgcggacttggcgaggacgcctttcagacagcatacctgccaagtgaagatgaggacgaagggatggtgatgtagaatgagcgagcttgcatggctgtttacgggaatcctgatcggcggctgcatcggtatcggtatactttgctgtatgcagattaaccgtatcagctattatgagcaggaaatccgaaggctcaaggaaaaactgaatcaaaaataacaggcaaggcggtatcaatcgtttcagagcaaatgattggtaccgctttttttgttatgcaatccaatcaatgcggcgcttcggcgcgggcaaaaaagctgacatgaagatagtccatcatgtcgcgtatttgcctgtcggggcttcccgactgaaacggttgtccgccctgtgaaagagggtgatgatcataaaaacgcctgtgtcgagggtgggcaataagtcgtccatcctttcgattctctatgcgctgtttccgctgaaatacggccggtttatcgatgtgttcggcggctccggcagcgtactgctgggaaatccctgcccctgtgcctttgaggtgtacaacgactttgaccgcaatctcgccaatctgttccgatgcatgaaggagcggacaatggcaaccatccatgagcttggtttttgtaacctcaattcccgtgaggatttcattgctatacgcaaattctttgaaaacgagcagtttgatgacagatatttctcagaagaactaaggctgacagaaatcctgttcccccctcttgaagcaaaggaactcaaagagctgcggctgcggattgccgaagattacgatgtccgccgagccgctatgtttttgaagctgctgcgaaacagctattccagcagcgggaaatcctacgcctcacagccctttgatatccgcaagctgttcgggctgatcggacagcttcaggacaggctggcaaatgtagtgattgaaaatcaggattttgaaacgctgatccggcactatgaccgtcccgacgccttcttttatgccgatccgccgtatttttccaccgaggatatgtatgaggtaggcttcggatgggaggatcatatacggctgcgggatacgctgaagacgatcaatggcaggtttctgctctcttacaacgactgcgccgaaattcgggagctatatgatggcttttccatcttcgatttctcccgtacccactcaatggcgcagcggtatgaagccggaaaggaattcaaggagctgctcatcgggaattacgatctgtacgagcgggaacgcgaaaagccaaagcagcttacgctgtttgacggttacggcattggtggaagtcaggattacgaaaaaatcttaaaggagtgtattatatcatgcaaaataaagagataagcggctttgtgctgctgcctgtcccgctggacgatttgattgcctccggcattgaccttgacggagtgattcagacaagcgccggagatggcaggattatcattgagaatgcagcggatacggcagattttgtctgcgacggcaactgcgagggctgccccatgagcgaaatcgactgcgatggggactgtgagaactgcccttgctctgcagactgtgatgaagcggaggtgtgcggctgtgaataagatgttccggattctcggaaaacgcggaaggattacaatcccctatgaaatcaggcagagagtgggattttcgtataacgatgtgctgtcctttgccgaatcggatgatggcagaactgtggttgtcaagcgtgagaaaatctgcgataactgcaaaggagcgcagcccgccgcacagaatgacgaggtaacgctctttgattttttgaacggactctcaaaggaacagcagaaagcagcgctcgtccatctttcaattaaatgggcggagaagcaaggaggtgcgcagggtgtctgagtataaaccgctgtatatatggtcgctggattacgctgtccgaagcaatgagcgtgatctctggcgggaaagctaccgtgaaaattgcgactgcgcaagagcgattgaacgcgccattaacgaaaactaccatgataactgtttgaatgactgtatccagccgatcatcgagcgatacggcttcgaccgtgtaaattgggtgctggccaataccattcaggagaaaagagaggacggccggttcagtcaggaaaacaaggcatgggcaaagggcttctatatcccccatgacgatgtccggtggcatttttgtgtggaggcgcatccggggctgacgaatatttttaccaatcaagcccgcagagcatggcaggcgcttggtttgtttgacgcttcccactgtgaatcggaaaaggacgggcagcttgactatgaaggcaaggtgctggtgctgaaaggcaatgtactcaaagaccgatacaaaacgccggaggatcagttattccttgcagacggcggattcggctgcaggccaaacagcagaggccgcaaggtgttcggaaaatttctgaaagacggcgaggatacccacttttaccgtgaagactttgccggaatcctgaaggatgaatgtttgcccgattgggcgagagaaaagctgaacgaactacagacgccggaggaatccgaaggccccggcatgatgatttaaaaacggaggtaatgtaaaatggcagataagaaacccgctgcctccaaagcagcgcagaagaaatccgtcccgtccattcaggtgcggatcgacagactgaatgattacgagggcagcaatatcaaggcgtttgccagcgccaacatcggcggtgccttcgccatccacggcatccgtgtggtagattctcagaaagggatgttcgtcgctatgccgcaaagcagccataaggacggaaacggcaatacgaaatacagcgatattttccacgccgtgactgccgaggcaaggagcgagctgaacgaaaaggttatggacgcctatgaacaggcgcttgccgagcagcaggacgaggcggcagaagaatctgagatcgaggaacaaggcatagagccgactatgtgacttttttctgaaaagttctgaaaaacgctggacttttgaaattctttcggtatgcttgtggtgaaggatggtgatctcccatgaaaaaacaactgatagccgcaattctatgcggactcctcatatccggacttgccggatgcggaaatcaaccaaaacaaccggtagaatccgttcccggcagtacggtcaaggcagatgatacatcgggcattgatacgagcgatgtcattcctgccgaaccgactgcatcggaagaatcggaaccacccacagaatcctctgcatccgaaccacagcagccggcagaaaaagaaaaatcggaggcggaacctgtgccgcagcagaccaaaacggaatcgcaaaagcctgcggaacccaccgagccgcaacagccgcagaaaccgcctgctgtgcaaacacagccgacagcgcctcctgaatcggagcctgctcctgctgcaccaagtcagccaacggaacctacggtgaccgaccagcccaaagagccggaagatgcggcgccgcctgctgtcacagagcctccaaaaacattcacgcaggcagatcacgagcgcattataaaggaggtgaccgcttatgcggaaagctacaaagcaaaggggtttatcttcgagtggaagaaatcaatggaattcggctgggatgtgggatatttcggcacacctcggatcgaccgtgacggagtcgacggtacaatccgaaccctgaaatatcacattgacaagattgtatcaacatccaccgatccggcaaacgggattaccactgagtatatgacctacaaggtggtgcaaatcaccattgacggaagcatcgcttacgccgtcatctatggcggttgacaatacaaatacagcaaaacaggacgtcgtgaaaatcacggcgtctttttttgtttccaaaacgaatggaggaatataaaattatgattacgaaatgcaaacgtatcggaacggcgctgcttgccgtcctgatgcttttcgccgctcttgttccgctttctgcatcggcagcggaaattacaatggatttatccaaagcagaagtgtcgtgggattataccttgacagattacgatggaaacacattccatttttatgttcgtttgttattgataacatgtaaaccatgtgcttgcacaaagtgtaaaccatgttactcttgacacaagcccctcccctacgaaaagcaggtaatgttagtgcaaagtttttttgacaagcaaagctaacagagcgttcatcaaaagccaagagcttggcggaaattgcaggtttctgcgatataaattcaagtttataagggcaggcggagcgtcagctccgccggaatgcccgttatattatgcctgaacggttatgataaacggctgtatctgcgtattcataccgacggaatcaattacagtgcggacgatactgcaaaggaaggaaatatatgataatacttacaaagctcaacggggaaaagtttatgcttaatcccgatcttatcgaaatagtgactgaaaacccggataccgtcatcacaacaagcacgggacattcatacatagttgagcagtcgatgaacgagatactttctctcatcaaggaatacaggctgtctgtaagacgtcagcgtctcgagagaagcatataaattgtgaatattacagccgttggctgtgctatataaacccttacaggaggaagttattttgaatattacgatcatcataggctgggtagtatcattcggtctggttacattcggtatatttaacggcggtcagcttgactggttcatagatgtaccttcgcttgctatcaccgtcggaggtactataggctgtcttttcgcctcgttcccgctctcataccttaaaaatctgccgaagtatctgaagctggcattgttccctaaaaaattcaatccgcaaagctacatagagcagatagttgaatttgcaaagatcgccagaacaaaaggtcttatctcgcttgaagacagtgcgaacaagtgtgaggatccgttcctcaaggaaagccttatgctgatagtagacgcaaacgaccttgataaagtaaaaagtatgcttgacgacgcaacagactttatgtgtgagcgtcacgaaagaggcagacttttctttgaaaaaggtatgtctgtattccccgcattcggaatgctgggtactcttgtcggccttgtaaatatgcttaaaggtatgggcgctgactcaagcaatctgtcaagcggtatggcggttgcgcttatcacgaccttctacggctcgctgttctcaaacgtattgtttgcgccgattgcatcatcgctgaagaacagtcacgagcaggagcttctttgtatgcagataatagaagaaggcgtgctgtcgattgcggccggctcaaaccccagacttattcaggaaaagctcgaatttatgcttgcacagactgatataaagaagaagggcggcaagtaacaatatccgcctgtttccgacaggacgggaattacggctgaagcaaaaggaatttagtgttgaaataatcgctgaaatgtgatacaatatattggttaagcgtcagaagaaaggcggtggagaaaaatggcgaaaagaagagccggaggcggcgaagaaaaaggtaactggcttgatacctatgccgatatggttacgcttctgttgtgctttttcgtattgctgtactctgcatcatcggtagacgaaacgaaatggcagtacatatatcaatcctttacgtcaagcggaagctatataaaccccttcgtaatggacgaacagccgaagaataacgctgccgatacgaacggtaatgccgaggctcctccaaacactcagaacggcggcactacaagcgaacagacagagggtcttccctccgacttcaatcagctttacagcttcttaaagacaacaacggaaaaaaacgatcttggtcagtatgtgtatattgagcagacaccgacaagaatctttatccggttcaacaatacgataatgtttgacggcaacagtgcggtgctgaaggaagaaggcaagcaggtactcaacaagttcatgcccggtataaaggcggtcaacaagtatataaaatcctgcgaagtatccggtcatactgcaaaggcagtatccgatgtgaacgactgggatctgtcggcggcaagagcgtcaagcgttgtaaaatatatggactacaaccgctgtgttgacagcgagaagttcactgtagaaggaaaagcgtgctatacgcctattgccgacaactcaacagctgagggcagagcgacgaacagacgtgtagagattatgatagtgagagcacagcttgacactacctcacaggctgtcatagacgatattctgaaatacgaatacaggctgaacggtgcgaacaccgatccttatgagcgtaatgacagcaacagctcggacgtcaacagtgacgttgtaaacgaaataatcgacaatatggaaagcaagtatgacagcaacccgggcgacggcaacaacagcacaaacgccgcaggaccgaaatacgagccgtcatatacgggcattcctacagatatactgacatcggcaccgaccgaaacgtcagaataagagaaaacagaaaggggggcgaatttttggctgatacccttacgcaagaacaaatagacgcaatgctgtcaagcgtactttcaggcggagataccgcatcgcttgacacgcacgaagaaaaggaagaaatcaaggagtatgacttccgtactccgaagaagttcactaaggaacagataaagatacttgagaggatattcgagaattattcaaggcatctttcatcttacataacaggtctgttaaggctgtactgcaaggtttcgcttgcaagcatagaggaacagaagtattttgagttcagcaacgctcttccggattatacgataatgggtattgtcgatctcggcatagaggacgatgatattgaggaaagcaatgcgattttacagctgtcaaactcgcttacctttacaatgatcgaccgtatgctcggcggcagaggaacatatcaggataccgacagagattttacggaaatagagataaacgtaatgcgtggcattgttgaacgctttacctcgattatgtcgcaggcgtgggacggatatgttgataccaagccgaagctggaatcaatagaaacaaactcaagagtaatatccgccgcagacgccgacgaaacaatgattatcgttgcgatggaggtaacggtaaacgattcaaaatccatagtgtcgttctgtatgtcggcaattactatggatcagataatgaagaaattctcggctaagttcagctcgggcaaaagggcaggaagtcccactaaggaaacggagcgtaaggaaaaccttatgtcaacgctttcgcagtcggagcttactgttacggcggtgcttgacaatacaacgctcacgctccgtgacgttctgaatctgcaggtaaatgacataataccgctgaacaagccgattaccgacaacgtacagcttaaagtgggaagcacctgctggtttgacggaaagctcggtacactgaacggaaagaaagcgttcaggattgataatatattaaagaattgaggtaaggcaaatgggaaaactgaccactctgtcggagatgcagcttgacgctatcggcgagataatgaatatcagtatgggaagtgcggctaccgcagtttccgagctgctcaacgccaaagtgtggatcactacgccgaaggtaaccatagttcaggcatcagagcttaactacgacagacttgaacctgcgatatgcgtaaagatcgagtacataaaagggctttccggctcaaacctgatgatcttaaagcaggacgatgtacagctgatacttaatcagcttatgggcaaaccgcccgttatatctcctgattttgagtttgatgagctgaacatcagtgcggtaagcgaagtaatgaatcagatgatgggagcttcttcgacggctctgtcggaatttctgggtatgggtattgatatatcgacacctactccgtacattctcagcgagataaatattgcagacctgcagaattatgagcagacggatatggttgccgctatcaattttgaccttaccattgacggtgttataaaatcggaatttatatcggtgcttgatatagaccttgcggcaacgcttgccgacagaatgatcggcggcgcgacatcttccgaaccgattgtgacagaatctgcgcccgctccggcatctcagccggttcagcaggcagaacctgttcagcaggcggcacctgttcagcaggcggctcctgttcagcaatcggcacccgttcagcaggcggcacccgttcagcaggcggctcctgttcagcaatcggcacccgttcagcaggcggcacccgttcagcaggcggcacctgtaccacaggcggctcctatgccgcaggcggatatgtatgcacagcagggatactacggatacccgaatcctgctatgaatccggcaatgaatccggcaatgtatggtcagccggtacagcctgttatgcagcctcagccggcagtaaactaccgtaatgcccagcttgcacagtttgagagctttgaagctccgctcggctcggagcagaaagaaaacttacagctccttatggacgtaccgcttcagatttctgtcgagataggctcgacaaagaagaaaatcaaggatatacttgaattctcgcagggtactatcatagagcttgaaagacaggcaggcgcacccgttgacgttatggtaaacggaaacctcatcgcaagggatgacgttgttgttatagacgataactttgcggtaagaataacggaaatagtaaaatcgaaatttatggacagcctcggtaaaggcgaataacatataataaaacagggatacgaaaggaaaccttacacttatggataagaagatattacttgtagacgatgcggcattcatgcgtatgcttatccgcaacacacttacgacaaacggctacacaaatatacttgaggcggctgacggcgaaatagcggtttcgacatattccgcagagaagcccgaccttgttataatggacataacaatgcccaacaagaccggtatcgaggcactcaaggagatcaaggctatggatcccggcgcaaaggtcgtaatgtgcagtgctatgggtcaggaggctatggtagtagaggctatcaagctcggcgcacttgacttcatcgtaaagccgtttaaggctgaaagaatacttcagaccgttaagaaaatacttgactgatggaatacgtacagcttgtatgtgcgcttatcggcgtacttgcactgatttttctgttcttctggatactgagaaaggtaaacaaggggatactgagcgtaagcggaaaacggctcaaggtgcttgaccgtgcctcgctcggcggtgaaaaatcggtggttgtcgtgagcgttgcaggaaagtgtatggtgcttggcgtaactgccggcaggatagacaagatcgaggatctgtcgattacggaagaagaatatatgtctgagctttatcctgagggaagcggaaagcaggataacttcttcgccgccttcagtgatgcaatggctaaaaacataaagaatatgagagggaagaaagccagccgtgacgaagaaccggattgcggcgatgagcttcccgatgttcgcaaaaccgatgacggaacaaattccgatgacaaaaaattctgacgagaggaacacggagtcgaaatgacaagagcttttggtcttacgattagaaaaatgtttatcgacaacaagcggatttttatccgctttatcgtgtctttaacggtatgtatcgcacttatcggtgtgctgtgcagtgtaacggcatttgcggcggataacaatgcgtcaggcaacgcaggtacggcaacaagtatcagcgatacggcttcggcaaacacctcgggcggtacgcagtcggcggattcgtcggtgatgaaggatcttatcggggtagacggctcgcagtcacttgaggtaatactgcttgtgaccgtgctttcgcttgcaccgtcactgcttgtgatgatgacctcgtttgcgaggatcattatctgcttcagctttctgagaacggcaatgcagacgcagtccacgccgcctaatatggtgcttacgggattgtcgctttttcttacgatattcataatgtggcctgttttctcggagataaacgaaacggcatatcagccgtatgcggcaggcgagatgacaatggaacaggctattgacgccgcaggaaagccgctcaagacttttatgctcaagcagaccacgaatgacgatatgaagtttttccttgatttaaagggtcagagcatgagcgatgtcacaggcggtgcgacagacaatataacacttgaaaactacagcgagaagctgggctttgaaacagtaattcccgcttttatagtaagcgagctgaaacgtgcgttccagatgggctttctgatattcatcccgttccttgttatcgaccttgtagtatcgtcgacgcttatggcaatgggtatgatgatgctgccgccggcgatgatctcgctgccgttcaagataatacttttcgtgcttgtagacggctggcagctgatggtcggaacgattgtcaactcgtataatttgtagcataatattccttgaagggagggcttgatctgacacaggatatagcaatggaggtctttaccgccgcacttgttcttgcgcttaaattaggcctccctgttttaatagccgcagttgtgataggtcttatcatagcgatattacaggcggcaacgcaggtacacgagcagacgctctcgtttgcgcccaaagccatagtggtggcaatcgtactgctgttattcggcccgtggatgatgaacagctgtatagagttcttcaactacatattcggtcttatggcaacggttggtgcaacatgacgctaagcgatgtgtgggatatgattctgaataattttctcggctttctgctgataatgtgcagggtgtcgggaatattcagctttaaccctatattcagccgttcaaattttcccgtaaggctgagagcaggcacaacgatagcgcttgctgtgctgtttgcctcgtccatggggaatataaaatatgagccgaccggcatattcatgatgctgttcgatatgatgaaggagctgggactggggcttatactcggctttatggtgaatctcatactggcggtgactatttccgcaggtgagcttatcgactatcagacgggtctgtctatggcaagaacgatggatccttcgaccggtgtgtcgatgcccctttttgcaaacgtttattactatatgttcattctgtatttctttctgacgaatggacacttgtcatatataaagctgtttcatatatcgtatgaaacgcttccgataggattttcggggttcactgcggacgtgccgtgggcgttggtgacgtacttttcgaccgtgcttacgctggcggtaaagctcgccgcaccgattatcgctatcgagtttatcaccgaaatatgtcttggcgtactgatgaaggctgtaccgtcaattcatatctttgcgctgaacattcagcttaaggtgcttatcggtcttgcggcggtgctgataatggctcagcctatgtcggacttcatcgaaaagctgatgggcattatgtggcagaacctctacggtctgctcggcatgatgggttcttaggagggtaaatggcaggcgaagaaaaaaccgaaaaagccaccccgaaaaagcgtaaggataccagaaaaaagggcgaggtactgcagagcaaggaagttgcggttgcggttttcgtggtgggaatattcgcatttcttgcgatattcggaaactatatgttccagatgcttttaaactttatggagcagtcgatgtcatctatagacaagacgggcaataccgtagagtttgcgatgagcgtattctggaaggtggctataatctgcgtctgtaccgtaggtccgatactggcggtgggggtcgtactgagcgtactgcccgtaatcgttcagacaaagggacttttcagtatggaggcgatgaagccgaaattcagcagattaaatccgtttacgggtatcaagcggttgttttcgatgcaggcgcttgtgggccttgtaaaagaacttatcgagataatcgtagtagttgctatactgtactttcaggtaatggacaggataaacgagttcaaaaagctgatagatacagatgtgataaagatagttgcatatataagcgaaacggcgatgagcctaattgtaacgatattcgttatgcttgtatttgtggcggcggcagactatgttttccagtggtggtcatttgagaaaaagctcaagatgtcaaagcaggaggtcaaggacgagtacaaacagctcgaaggtgacccgcagataaagggcaagataaagcgtaaacagcaggaaatggcacaacagcgtatgatgcaggaagtgccgtccgcagatgtggttgtccgtaaccctactcactatgcggttgctcttaaatatgaccgcaagacagcctacagagcgcctgttgtcgtggcaaagggtacagattcactggcgctgaggatagttgcagtggcgcaggagcataatgtatatatcactgaaaaccgtccgctcgcaagagggctttatgaggcggtagacataggtcaggagataccgagagagttttacactgcggtggcagaggtgctggcgatggtatatgaggagcaacataagacgttgccgccgagagaacgataggcaaacagcggagctgtttgcggctgtgagccgcaacaaattccgcctttgcggctgtgagccgcaacaaattccgcctttggaaatgttgcgatttggcgacaggtggcgaaacggcggggttgccgttgttgccttaatgaatactgcacgataaataattgtgtgactgttgtaatcatccataattttcctatgtaggttattgtaactatggttgtgagtataacatgacaataacagaaattaatatcatatatattttttgtaggggaggggctcgtgtcaagagtaacatggtttacactttgtgcaagcacatggtttacatgttatcaataacaaacgaacataaaaatttcaagcggtttcaggctttctcaagtaccctctgtttttgtgccctctcgtttgagtgcttgtctattatatcacggaaaatgacatttgtcaacgtttttttcaaagtaaatttacataaaacttactcgtcaaatcctgtttttaaaggcactttgtacaatcagccgtaaaaagctgtctatatattctatttactgcatttttctgctatttaatgtattttatcagctttttaccgctgtctttttcggataccttccggtaaggattctctcccttatgtataccagcgtatcctcctcgccgtatcttttcagcattatcagcatttttccaagaagctccatagtttccgggtgcatcatatagtgttttctgttcttgttgaaatattcaaacggcatactgtcgttataattttctttataatatgtcttacaagccgccactctgtcgcagaacatctccacaacatactttacaggcatcttcattccctgcatcgcagaacccggctcctgtccgtaatctatccagtattcaaagtgatgcctgtttcttcccttatggtgaagccacgcctcgctttttcccgtcacacgtctttcggtcgtattcggacttttatcccccgtgtaaaataccacgccgcttatgaattccttcggcgagtattttgacaaatcgtgcataagcccttgcttataaagaccgaccttgaagcacagcctcattacttccatcttgtgatgattgatagtgcttaaatgccccttgaagttttccttaatgtccatgcttatccttctttcgttctttcgagatactttctccagttatcaatatatcttgttttaaagctgacgcttgttatttctttgtatggaattttggtttcttcctgccattttccgtctgcgtcaaactctctcatcgtaagtttattcttccccgcctttaagattatccctatatggaatatatcttcattttcattctcgactatcgcccattcaccgcactctctgagtgaattgaatatgctctgccacgagcttatatcaatttggggagccttgatttgctctgcaaccccattcagtctgtttatctcttcacagacatcattcttgatctctgctttttgcagttcgtcaaagttgcggatcgtatatccgttaagttcaaagtcgttttcttcctgtccgagtacaaatttgtcgttgaaatcactgatatagtaataccaatagcttttgtcgtattcgtaaaagcacctgcatatatagtgcttttcagcgcactctctaagcaccgacattttcttactgcgtttcatatttttcctcactaaaaagcaactgccgcatatataacacggcagtttcatatttacaaaagccgtcagccttattctatcacagccgacatatattttcaagtccgaaagtcattatcgttgttccgtcaattgttacacgctcaccttctctccctctttttcatcgcattctttattctcagccgctttatccggctttttatccggctcttcaccgccgtgcttatcctttttcttcttttcttctatatgcgactggtcgctgacaacaagaatatcaccctgctttattacagtgcttccgttaggtacgaccatatcgccgtttctctttatcattataataagaagcgtagtcggcaggtcaagctcctttatcgtctttcccttccataaatgctttggccctatctcatattccttgagcaatatatttccgctgtccctgtatgacggaatgctgagtataacatcatctccggcatttatcaccgtatcgcctttcggaacgatagtgctgtcgccgtgttttatcataagcacaagcgaatcgtcgggaaaatctatctcgcttatcttgtgtccgttccaggtgtgagtatccgatacgaatatacgcatcatattgaactgcggagtttcgtcctgatagtcgttgaatgtctttaatacactgctttcgttatcaataagtttaagccctgttgcgaccttcggcagtaacgttccctgaaatgcaacggagataaggcagacgcacactactatattgaacagattgctgtccgtgtacacatcgctcaccgtagccattattgcgaaaacgatggatgatgcgcctctcagacccgaccacgctataaacagcctgtcagcccatgtatacccctttgagcatatcgcaaacaccgcagcaggacgtgatataaaggtcatcaccgcaaatattgcaagtgccggaagtattatgcccggcagctgtgaaggattcgacagcaatcccagcaggaagaacagcattatctggctcagccccgtgattccgtcgaagaaatgtacaagctgtgccttattctctcctatgttgctgttaccgatgatgatacctgctatgtatacgctgaggtatccgttgccgccgagcagtataggtgcggaatatgccgcaaatatcatcgccatcataaaaattatgtcaaagctgtttttcgacagcttcacctttttcattacaaacactgcggcaagtcccatcgcaaagccgaacgcaacaccgaggactatctgcagcaccgcaagaagaccaagctgtgaaatatcatcacctgccattatcgcaagtgcaatgaccgtcagcatataagaaaacgggtcgttagaaccgctctcgatttccagcagtgaagccagaccgccacgcaggtttaactgctttgaacgaagtatcgagaacaccgatgccgcatcggtagacgaaataaccgcaccgataagaaagctctcttttacatcaaaccctatcaggaaatgacagcctgccgtagtaataagcgctgtaactatcgtaccgagcgaggataaaagtcccgcacgcaaagcaacaggttttgccgctttccagttggcagaaaaaccgccgcagaacattataaatataagacataccgtacacacctgctcgctgagctgatagttgtcaaacggtatcttcagaataccgtccgagccgcatatcataccaagtgccagaaatataagcaggctcggtacgcctatccttgccgacagcttattgcctacaatgcagacaacgatgattgccgaaaaaaagagcattacaaattccatcgttcaccgttccttctgttcaaatattttctctgtttaactgttttaaaaaaataagctgccaatgtgatttgatagtcaccattgacagccgattttttactattcttaaaggcgtcagccgctgaatgcgacgtctttatttgcctgcaagcttagcgattatttcagccgcctcatcaataccgcaggtagccgtattgatgcacagatcgtaattcagcgattcgccccagttacgttccgtataatacttgtagtgtctgcgccttgccttatccttctgtctgataatcgaaagcgcctcgtccttgcttatattgtcatgctcgcagatacgtccgcatctgaaatcatccgtagaatgcacgaaaacatcaaatgtgctgtactgctccctcagcacatagtccgcacagcgaccgactataacgcactgacctttatccgcaagagccttgataactctgcactccgccgagaaaagctggtcggtaagcggctgtgtgtacataccgtttatcgcaagattgtaaagaaaactggtcgttgttgtctgctccgcacgttctatgtatttgggatcaaatccgctttcctttgcggtaacatcaattatcgtcctgtcgtaatacgggattgaaagcgcttttgcgacctttctgccgatctcgcttcctccgcttccgtactgtcttgaaatagtgattatttttcccataatcattcctccgtttgtgctttattcttatgcctgctgtacctgtgccgaggattcatcctgtttgtcatacattttcgatatgacattcttatagatcctgcgcataaggagtatcgcaacaataagtcctaacaaatcgcttacagggagcgaccaccatatgcagtcaacccctccgataatgccgaacagccacgctaaaggcagtgtcggcacaataagccttactataaatactatcatactgtaaaagccgtttccgagcgcctggaagcccgagcttaacactatcgacactccggcaaatacaaacgatacgctgaatattctgagcgccgtttcaccgagccttatcatatcgtccgtcggagcgaacattcccagcaactgcaccggtataagctggaacagcagcaatccgactatcattatcacaaccgagcagataacaccgagcttcagcgtatccgttatacgcttcggctttcctgccccgtagttataggctatgataggaactattccgttattcataccgaacacaggcatatacacgaagctctgcagcttgaaatatacgccgaataccgtagccgccgcaggctcatacgctttcagtattatattcataccgaacgtcagcaccgaaaccagcgcactcattataatagaaggtattccaacagcatatatcgtctttatcgtaccaagattcagtctgaattttctgaatacaagccttaattctttgttgtagaagtggtgcagtaaaaatcctaccgccgccgctattatctgacctgttacagtggcgattgccgcacccgtaacgcccattgcgggtattccgagaaaatcaacaccgaaaataaacacaggatcaagcactatgtttataaccgcaccgagtatctgcgacaccatcgaaagcagtgtcttgcctgtcgcctgcaatatacgctcgccgtatatctggaagaatagtccaagcgagccgcagcatacgattgacagatattcaacaccgtatcccgctatgatttcggaatgtgtctgtatcgagaaaaatgcaggtatcgccgtaagccctactattaaaaataaaacatagttcaaagcggtaagaataagcgcatgagttgccgcaagacccgcctcataaggcttcttctgtccgagatagcgtgatacaagcgcattcataccgacgccaagccccgtctgaaacgctatcataaggctctgcatcggaaacgccatacctacagcggtcagtgcgtccgggtttatctgtgccacaaatacgctgtcaacaaggttatacattgcctggataagcattgatataactataggcagcgacattgtaacaagtagcttgtttacaggcattacgcccatcttgttttcttttgtctgttccaattttcttttctttcctttattcttctctgtatttcttttaattcagtataccataaatccacgcattttgcaagccgcatacacgaaaatcgtccgtaaaatcttattgaccccaccgccttattgtgatacaatagcaatatataagcttagaaaggagaagaatatgaacgatataaaagccgtgctgttcgaccttgacggcactctgctcgactcgatgtacgtctggcagtacgttgacgaggaatttctgcgcagacgtggcataactccgcccgatgattacggcaggcaatgcagccaccgctctttttacgaaacagcattgtacaccatagatcttttcaatcttcccgaaacgcccgaacagcttatgcaggaatggacagatctcgccatagacgaataccgccacaacgtaaaactaaaacccttcgctcgtgaaacggttgagcttgcgataaaaaacggctacaagaccgccgtatgcacctcacagacccccgagctttacacccccgtgcttcatcacacaggactgtggggaatgtttgaaacgataagctctgccgccgttttcggcaaaggcaaacagtaccccgacatatatctcgataccgcaaaaacgctcggcgttccgcccgaaaactgcattatgctcgatgacgtatccgcttctctcaaagccgcaaggcaggcaggtatgatgacaatcggcataatcgagcctcttagctcgcaaagccccgaagaaatggagctttacagcgataagcttgtgaaagagcttgataaagacatattcacattctgacggaggcaaaaatgaacacaaagataatcagaaagcactttttcttcaaaggcagagttcagggtgtcggctttcgctaccgggcgcagaatgccgcctcgctctacagcgtaacaggctgggtaaaaaatctatacgacggctcggtcgaaatggaggcgcaaggcactgaggaagacattgacaaagtagtacagacccttcaggacagccgctacatcgtgataaacgatatgtacgttgccgaccgtcagcccgacccccacgaaaccttattccgcataaaagacgaatactgacaaaacgatccctcctgcgtgataatgcaggagggatcggttatatattgttgcctgttttaagaaattcagttttcgtcatcgtccgggtcgtcatccacatattcgggttcttccccgttttcagcgttttcctcttcctcagacggttcttcgttctccgccgtttcctcacgagtaacaagctcctcgtcgattgtaaagccacataccatctcgtcaagcagatttgcctgcaccgaaagctcctgtgcagaagccgcacattcctcgcttgtagcggagttcgtctgtactaccgaagaaatctgatcaacgccggcattgatctgctctatagcctcagcctgctctgcgcaagccgttgagatttcgcctaccagctttgttgtggcagttgtcgtattgacgatttctgtcagtgtctgtgccgtcttgtttgcaatcatcgttccgttttcaacagccttcatcgagttcttgataagttctgtcgttgtgcttgccgcctcagcaaccttgcccgcaagatttcttacctcgtccgcaacaacagcaaatccctttcctgcgtcacccgctcttgccgcctctaccgccgcattaagcgcaagtatattcgtctggaacgaaatatcgtctatcgttcttattatcttttcgatttcgccggatgtttctccgatttcctgcatagccccaagcagaccgttcatctgttcgttgcccgattcaacaagctttgtagcctgagccgaattctcagcggcgttttccgctcttgctgcgttacggttgaccttttccgcaacctcagtaagcgatgccgaaagttcctcgaccgatgccgcctgctttgccgcaccgcccgaaagactgcctgccgcagatgccacctgctcagagcctgtagcaacacgctgacctgccttgcttattttgtccatcgtcttattaagtgagatcattatagattcgtatgactgcctgataggcgcaaagtcaccgagataaacatcagccggcttatatgtaagatcgccgtttccgagcgttctgagcatagcgtcaatgtcggatatgatttcgtttatattcttgctgataaggttcgtgctttcgctcagctgagatatttccttgtcaattttcttgccgaagtcaagctcctgctggtgaagatcgccgtgcgataacgtaacgattctgtccgagcactgctttactggcgaaattatctttttcactatcgttattataagcaataccgacagcgcaaagcatacgaccgttacaatcatgccgataacaacagaattataaatgctctgcgtatgctcagacggtgtcgcaatcattatacagctccagcccttcgcattgcttataggcgcatagctgacatattttgaaacgccgtcaagcgtaacctcgccaaatcccgattcacccgcaattgccgatgaaacgcaatcagccatagtctgatatgagccgtcctgcgaagcaagactgatataattcatcatctgcggtatcagttccgagtccggatgtgcgattatatttccctttgcgtcaaccaccatcgcatagccggtatcgccgattgaaatctgaccgataacatttgagaatacattcacgtcaactgttatacgaagcaccgctctcagtagcttatttatatcgtttgaaattataggcacggtaacgtccataacgaccttacccgtcttttcatagtaataaggctcaccgacaaccgctttattggtttctattacctcacgatatgcaggatcgtccgaccagttgatagagtcgtcgttaagtcccttaccgtccctgtccgtcatatcgaccttgacatacatagaattatctcttgcgacagaaatacacttcgagcgtatcgcagatacatctgcaacgtcagaaaaatcggcgtcggcagaaatctgcgttattgcgtttacaacagattcaagctgatttgaaatagtattcgatgcggtatgcactacctcgtccatctcattcacaagcgcctgcttaagatatgtatagctcagcagtatattgattatgcagacaagcataagcgaaccgccgacagcaagacacatccacctgaatattctgccggtaagagatttccctttcttatgtgtattttcaacgttctccggaaccatttcagccccgtcatatacattcttgttcttcttcattccgctacctcacacaaaggataaacaatacggttttttgaccgtctttatataggtttatcttatcatattgtgcaactaaagtcaaatttaaatcacgttttcacatcattttcaacaaaacagccaaataattatagaattttttgtggaaataaacaaatacaaagcaaatatatataccgattttatgatattatcatttcaccgtccacaccgctcacagtcctctcaaaagcacaccctcaccctgcaccggctctttcaaaaccgcactgtccctcgtgcttcttccgttgaatcgtagttattgattttttcagctatttatgttttgtgagggcaagcacggcaaggacaacttaagcgtgtgcatccaaagctttgtacatatgcaatgacaagtatattgattcgaatagcgaacccgagattgactatgataatgagctaccgatagttctttttatcggacagcacttctcgggttcgctattcgagtgggtacacctgtcaatatgaacgagggaaagaaccaagtaattaggaaaacaactgctaaacaactacaatccccaccgtcacggctcggatttgtttgagagatattaaggacagattttctaagctttgtatagataaaagcctaacttttaccagctgtgccacctcccctttttcgaggggaggcaagggtgatagtgcttggctaagaatagtgcgaaaccaacagagcgttcattaaaaggcaagggtgttggcgattttcgagggatagtgcggttttggaagggttgatatgggcgagggttggtgtggcaatccctccggtagtcgcccgaatttttttcgggtgacagcacctcacctttgacaagggaggcaagggtgttggtgcaaagtaagggatagtgcggttttttgaagggtcaatgtcagtgcagttgctttgataaggtcacgaaattattaatgccctatcgacgctgaaaatgttttcggcggtgttggcgatatatttcacttcgtggctttaataataatccttttatcatcagcctttttgttatgtttaagcctttattttgcggtgtctgccgataagggcgccgttttatatcccgaagctgtctttcagtatcttttttccgctttcggtgacaaatattttctcatacgcatttctgaccgcattttcgcttgcgctatcctcgtacagatttactatgaaatctgcctcgatgagtatctgcaggtctttgccgtcaatatccgtatatgtgtggtggcgggcgataagatacatcacacgctctgcgacatcctcatatccgccgaccgactcaagaatttcctttgcgatacccggaccaagcttttgctgtatctcgccgtcatttctgccgtaaagccgttcgccctcgtgaatgcctatatcgtgaagtatcgccgccgtttcaagagctttcatcatttcgtcagacagcttctcctgcttaccgataagccttgcgaagctgtgtacttttataaagtgctgtatccttttagggtcgcccttgtcatattctatcgccgctgtcagaagcctttcgtgcataatattaccgccttattcgctcttgctgtcagcggtgctgtcgggcttgctgtctgttttgctttcggtattgctttcgggcttgctgtctgttttgctctcggtattgctttcgggcttgctgtccgttttgctatcgttattgctttctgttttgctgtcggttgcagtatccttcttttcaaccgtcttgaaaacggtatccgatattacctttatcttatcaatgcttgccgtaatcacacggttatcccacattgtaagtatatacggcttgtctccgtcgattatatcgcagtaaagcgtggtgtacttttcgtcatacagcgttatatttccaagctcggacagctttccgtcggcatagctatagaacttgcaaacgctgacctgcgatattccgtcaaagtacataacgggtattccgattgttatctttccgtccttttcataataggcaagctgtgaaatatcttcgcacactgggcttgtaagatagctgttccaatcgccaggagtattgctttctgcggtgatggtgacctccgctttcttgtcaccgcctacggcaagcagtatgccctgtctgtttccgcccttgtcagcctttacggtgacctgcgctgtcacattgtcgctcagcttcacgctgttggtgttttctgtgttttccgcctgttcgccgttgtcggcattcacgctgtactgcataggctcatcgccgtatgatgttacagtaacggtttttcccgtaccgcttatcgaagctattcgctgtctgtctgcgatgccttcacagaaatttatattaccgagcgttttgctcgttgtgataatgacattatgacgttcatcaccggtatatatttctccgaaagccgcaaagttatcatccatcgcaataaccagaccgggattaagagcaacatcggatactccggtcatcatactgctcatcagatcgtcaaacattacataggcaatctgtgtgtaatatttattgtttatcctgctcgtgtcggtcgcatacattccttccgagttaaccgaacatccgccgatgtcaccgactatgacgcttttcgtcataacctcattatctcctgcaggagctatcattgttgcagtataatagttaagtccgcatacataagacggtatcagcatatttttaaattcaacagtctgcgttgttcctttatgcgtgtatgcaggaacaaacgtttccggtttctccgattcggctttatcaatatcaaagctgtctttcgttacggcgtaaactttattaccgtttgtatataaatcgataagttctcccgaaagtatatattcatctgtcgcttttccgcttaacattccgctttcgtcataggtgcggataaccgttgcgttgtccttactgccgacaaccgcaaaatactctccgcacttaactattcctgcatctgtaagatctgtttcaaagctgaaattatcgctgagcttgccgtccttttccttggcgccgcatatctctgtatcttttaccgttgcgaccagattatcgccgtacacgtttttcggcagagcggccggcttcttttcgaccgtcacaaaggtgtcgggaagctgatagcttatcttgtcccgtgcggctgcggcttcattcagaagcgtttcatagctgtctatgttctgctcgacctttccgggaatatcatatgtaaggtcgggaattattccgcaggctctgagctgattcagtgtaattcctcctgcgacaagcactgccgcacctataaacgacgtgataagacagccctttctgcgctttatgacaacgcaatcctccttatcgtcggatacgtcataatccgcattgctgtccataagctcgcctatggcactgcctatctcccttgcgttactgcctatcttttcatcatcggatattatgccgttaaaatcttccgcttcctcgcctgcaggattagcttctgcgacaggcggtgccggtatgcagaactccatagtaacgcttttgctgtcgctgtcggagttatcggtcggggtgctttcttcctgcgtagcaatactttccttttccgcattatcttcttcggcttctgcggcaggagctttctcaacgtttttccgctcggattcgggcaaatctgtattaccgtctgtataattcgatgtattttctacagtttcgacattttcttcgctgtcaatttctttctgcatacgaagaataagtgcctcagccgcagaaagcttctcactgtcgggtgcttcctgtgcatcggtttcggatgtgttttcggatatatcggctgtatcttcctgccttgttcctgtttcttcttctttatgaacgttcttttttgcgctaagctcctcagtcatacggcgaagcgtttcttcttcacggcgctttctctgctctgcaagctccttgcgctgagtggcaaccgcaattatcatacggtaatcatcgccgctcagaacggaattatccagtatctgcaaaagctcatcgaacttcagatgagggttttcctctattcttctgaactccatattgccgattttactgtttcctaaaagctcaagaaaatccgaaccgcttattttaagctccttgagcttacgcagaaatacgcctgcggtcatatctccgttatcctcaagcaatctccttatttcttccggttttactctgtcgggtatctctacggaagaaacatattcttttatcttttgttccagactaaccatctattttcttcctccgtcagatattcgattctgaaagcagttgtgctttcaatgttacctctgcattggtaaggcagactcctaccgtttcttcggtatagccgcacagcttggcggttttctccgcactgcatccgcacactgtgctgacgctgagtacaaggcgctctatgtcgggcagatcgttgagcgcatttcttatctccgagccgctatctgtctttgtacatagctcgccgcctgttttgttgatgtgtcttatcttagtgcagagtatttttacgagccattctatgaactgcggcgatgaagtaagccttgccgcaggcagtgccgcaaagctgtcaagcactgtcagacgtaccgcctctacagcggcatcctcgcttttcattgccattctcgctattttatatacaggtctgtacacggctctgtaaagctgtgcgtaaccttccgtatcgcctgtctgcgcctgttttataagggcggataattcctgtgcgttcatcttctcacctcaaaatgtacatatatatttatcataccacaaaatccgctttatgaaaagccttttttcgcaaattttcatatttttcgttcccgtacactcgttatattgttgcacagggagatcatttatgataaaataaccgtataaacggagggctttctatgaccgaaaacgaatttgaaaaacgctttatggctgaaatgagcgaacagcagaataccgctgtcaaggctgtacagggagcggttttactgcttgccgtacccggcagcggaaagacgaccgtgcttataacaaggctgggatatatgataaattgctgtggcatcagcccctctgagatactggcggtgacctataccagagccgctacgcttgaactgaaaaagaggtttgccgaccgtttcggaagcgaatgcggcgcaggtcttgaaataaggacaataaacggtctgtccgccaagatcatcgagtatttctccacggtatacacggatgaaaacgtgccgcatcttatgagcagggagggcgaccgtaaacgtctgataagcgaggtttatcgtcttgtcacaggtgaatttgcggatactgctactataaatgacatcagcgctattataacatttgcaaagaatatgatgctgtcagacgaggagatagaggcgctttcgggcagtggctatgacacgctcagaatatacagggagtacaaccttgcgctgtcgtcacgctcgcttatggactatgacgatcagatggtgacggctcttgacatactccggaaatatcccgatatacttgcatactttaacggaagattccgctacatctgcgttgacgaggcgcaggatacctctaagatacagcacgagattattcgtctgcttgccgtaaaaagcggtaatatatttatggtgggcgatgaggatcagagcatctacgctttcaggggagcgtaccctgaggctcttaccgacttcgaaaagacgtataaaaacgcacagatactgttcatggagcagaatttccgctctactccggaaattatcggggtggcggattcattcgtaaagtgcaatcgtttcagacgtgaaaagactatccgtgctgtgaacaaatcaggtatccccgtccgaattgtacgctgtgaacgcagaaacgttcaatatgacttcctgtgcggtatcgccgcaagaaacgaacagcagacagcggcgcttttcagaaacaacgacagtgcggttgttcttgtcgatatgctggaaaggaacaatattccatacaggctgaagggcggcgaaaagacctttttcacaagcaggcctgtgcttgacatcacggaaataataagattcatcaataacccgtatgacattgacagctttatggcgatatactataaaatagggctttatataacaaagcaaaccgcagaggcggcttgcaaaataagctctcagaggcatatcacgataaccgacgcactgctcggcattgatacaggtacgcaaatcagcgtaaattcaaagcggaatataaaacagacggctcagctgatgcagcaggcgcaaaacagcagtgccactgaagtgctgagcattatcctgcacggaatgcagtatgctgattatgcccacaagaacgggcttgacgaaaacaaatatgatattctccgtatgcttgcgagaaacgtaaacagcagtgcggagcttatagacaggctttctgagctgagcgggatcatggcggagcataaggacgatcctgacagcaaattcacgctgtctaccgtgcattcaagcaaggggcttgagtacgactgcgtttatctgctcgatgtaatagacaatgtactgccgtgcatcactaaggacaagctcaacgataaggaggatataaaacagtacgaggaggagcggagactgttctatgttgctgtgacaagagccagaaaagagctgtatctgttttcgtgcaaaggcgaaagctcggaattccttgacgagatagataaaaatctgccgatagaatacacggacagcaacgatatattcttttctctgtttgcaagagatatgctcggacgtgtttactgcgacagcaaaaacggcagaggtattatcatcgcctgctgtgcggaaaagctgtgcatacgctacgcaagcggtaagacagagcttaaaacgcttgccgaaatgctaacggaccgtgaccgcacggtaacatatataaagagtgaggagcttgaaaagctcaatgttaccaacgaaaagccgataccggaaaagacagagaatataaggttcaaggcgggcgacaggatatatcacagctctttcggcaatggtgtaataaagaatatcgacaaagcgggaatcggcacggtttattttgaaagcaacggcgaaacaaaacggttgctgctcaaagcgtgccttgacaaaggaattatcgtcttatcttaacaaataacgtgatattctgtgcttttttcaagctgtgatgtgaggtaatgccgcagacggcttctcgctgtaggcagtacggacaaagcaaaccgtaggatacggatttttggcaatacagagccgtttacggcggatgcgatttgcctcacgaagctgtttacttaaatttccttaatgttatgacttaaatttacatatatttgattaaattttcacatattatgctctgcacttttgtgcaaaatagctgaaatttaaactaacaaactgtggaaatagtgaattgaaatttattcacttttcagttataatataattataatcatcttggtgtaaacgtatacacgcaagagtaactttaaggaggactgaaatgaaactctcaaagagaattctcgcttgtgcaatcacagcggctatggcaacatcaatgctctcagcctgcaacggctcaacgaccacaagcggttctgcaagcgatgccggcacatcgcagggcaattcaagcacgaccgaaaacagcaacagcggtgataattcttctactgacggaaacggcggcagtaacggcggcaacattgtagaagcaccctcaaacggtgacacgctcaagtggctcggttactatgatcttaacacagacgacaaggaaatcgttgacaagttcaatgacgcaggatataaggtagagacaatttcgacaagctcaacggaatactttacaaagctcgcacagcttgttgcttcttccgactctcccgatatggtacgctatgagtggcagtcataccctcacggtgtagcaaacaacctttatacttcacttgatgcttatgttgactttgacagcgatacatggtcgggtatgaaggatatgattgaaaacttcaactacggcggaaagcactattaccttccctaccgtgtaaatcccggcgttgtacttatatacaaccagactgctcttgacgatgaaggtatcaaaacagacccgctggagctttataaggaaggcaagtggacatggacggcatggaaggatataatgaccgaatggtgcaacatcggcgatgattactacggtgtaatgcccacaggcttcgttgcaatgcccttcatagtttctacaggcacaacgcttatagatgttgacggtccgaacaagcagatcatcaacaacatgaagaacgctgacgtccagagatgccaggacttccttgccgaccttgcaaatcagggtatggtaaactccgaatactcaaatcccgacacttgtcttaccgatacaaagacgctgttcgcagagttcggtcttgactggggctggacaacggcacaggctgcagctaaggatcaagatataagattcgttccgatacccagagatgacaaggctgataaatactacaccaacaccgatacattcggttatctcgttcccgcaggtgcaaagaacataaaggctgctctcaagtatatggaaatctgtcgtcttaacgaaatcgaccctgagctgatcgctaagtcaaaggctgaaatgacggccgagcatctttattatcccaaatgccccgaatgcggcgtttctactgcagacaagactatagaaaaatgccccagctgtggtgcagcacgcagagagagaaaaaagcactcggcaatgtccgaagatctgtaccagatctattccgatctgaaggacacaacgagcgacaaattcacattcctctttgatgattgcttcggattctcaaccgaccttacaaatatgctccagcagggcgacagcgaaggtaagggctgtgtactcggcggaccgttcaagctcggcgaatcctacacaaatcttcgtgatacatactatggtacagtagaatcattccttgagccttacagagctttaatgcagaagaactgaggataaacaagtcaataataacaacgaaggcaccgcttatgcggtgccttaagtttgtagaaaaagtcttatatttgatgtgcttctgctatatcattcagctttgcatgcgatagcggctaccgatagttctgtttgtcggacagcacttctcgggttcgctattcgagtgggtacacctgtcaatatgaaagagggagacaaccaaagggatcaggacaagggacttgacagcccctctccctgtcccttaggttttctccctcttggattgacagcaagctcagtaaaactattgatgagcttgtgaagataatcctttcggataagcctgacaagaaacagcgtattgagcaggttaaggaagaaaatcttgctttacaggagcgcatgaaagagttgctcagaaaaaacggttatgctgtcgattatcttgacccgatatacacctgcaggaaatgtcacgataccggtaacggtgacggaggaagatgctcgtgcttcaatgacgctctgaaaactgttgcggcacaggaactcagcaaaagtcttccgatgggacttacctgctttgagagttttgatttatcgctgtacagcgatacggtgacacccggaatgaacaccagacgttctccccgtgaaatgatgacgcagaattatgagtactgcaaggaatatgcggaatatttccgtgtacctaatgaaagtatttttatgacgggcggaacgggactcggaaaaacacatctttcgttatcaatagcaaaaaaagtaatagaaaagaattattccgttgtttacggctctgtgcctgacttactcagaagaatagagaacgctcacttcaacaaatcggaagatgaaacagaggttatcaacactcttaaggaatgcgacctgcttttgcttgacgatctgggggcagaatttgaatctactttctatgtgtcgtgcctttatgagcttatcaacagcagaaccggttacggtaaacctacaatagttaacacaaatctttcgggtgctgagttgaaaaagcgttattccgacagaatagtatcacgtctttattcgatgaaaacgcttgttttcagcggtgaggacatacgcatgaaattaaagaagaaaaagtgacagttaaagtataaccacagatagcagtaacagctttgataaggggtgtattatgaacagaggttttgcggtatttattatactggctttgatttcggttattttatccttcgtcatacctgacaattctaagaggggatttaccaacgctttgtcatcgtatatgattgctgatgaagaaaacaagctgaattatgatgatacaagggagcacctgagagtgcctgcagagcttccttttgagtatgactttgataataaggaatttaacaacgggtttgagtatgaatttaatccgaacatccattcgggatattatcataagccgcagacgctgaaatttgattgcagtgacacgatatggtacaccacagacggaacattgcccgaaaagaacaaaacagcttatctctatgataatgaaaagggcataaggcttgataccggtgtgacaaatatatgcatcagagctgagaaggacggtaaaatgagccgtgtatatgtcggctcttatgtaatactcggctcgacggaagacgcattttacggttacggatacaatacactcgacaaatacgaccgatatatctacagaagtctttacaaggctatgagtaactatgaaacgaagtttgatgtgccgttcaccaatgtttcatatcagagactgtaccgaatattcatgtgcgtaaactacgataatccgcttcttattcaggcgcctctttcttttgtgagctggagcggcaataagaaagatgtcagttcaataaagctgatctatgatttttctaaagaagcaagtgagtattatgttgaaaagacaaagaaaagggcggaagaaatactgaatactgccgacggctcggaatcccttttcgattatcttcttacaatacataatgagattcttaaaaatgccgaatacgactatacgttggaaagtgacggagcatatgaggctttcggtgtacttacggcaggaagcggagtgtgcgaatcgtattcaagggcgtatcaatatctttgtcagtgcataggtgttgacaatctgctgattgtcggaacaagcaatgacgaaccgcatatgtggaatatggttatgctcggcggagaatggtatcatgccgatttaacgtgggatgacggcgacaacggcggaatagagtattattattttgcgttcaatgacaagaatctgaaggattacggagagcggacaatctcaccggagcttaacgagagcagacctatacttgagatgtatagcgattctaactattatccaatccctgcggcgagaggaacagaatattctgtatcgaatatacttttgtattgatgtaattgatgctattaaggatgtgattgattgaaaaagagtgtttttaatataattgccgtgactatctgcacagcggtatttatatcatgtgtcggtggctgttccgtcagcgaaaaggataagaacaacaaggaacacagcttttccgagatgaagacggacggtgagcttgcatataacagcaagggagagttttcggtcaatctgtcggttgataatataactttgtcggacaaaaccggaataaatgatgtaaatgtgttctactcggtgataaacagcgataagttgacggatatagacgcatctgatgcagtgaagctgaataacagcgaatataaggctgtatatgcaaaggtttcggcggttacgctgaattccgagcattcggctacggtttcgttcaacgacagttctttcagccggaataagcccgattgcttttttattgtatttgacaagaacacaaatgaaacggggaggtatcttgtgtcgatgatacctgtaagataccccgcttattcggcggtaagcgacacgacccagatacgttctgagagcagtgccaacaggttcaagctgacgctcgacaagagcagttttgcaaacgggataaacgctgacgatattgtgctgtcgggcggttttgaaggctgcaaggtaagcgaaatcgagagaacgggagataatacgttatctcttgttataagcactgataacggctataagtcgggtgagaacggatgtatcactataaagcgcagtgcgatagccgatgccgccgttgacgtatctgcgacagtaagcattgtttcaccgtcagtagtattttcatccacagactttgaagcatcaacaaattacgccagaataaccgtatcgcttgttgactgctcgttcagtgacagtgtatcagtgtcaatgctcgggtgcgataacggcaatgttgagataacacgttttgatcgtgtgtcggcaagtgagggtgtgttgtatctgtcatttgacacggaaacacctgcaaaggcaatcgaactgatttcgggatgtacgtttacgataaaggataccgcactgagcataaattatccgctgcatttcaatgtcaatcctaaaaatcctgacgtcagtgcgacgattacggaggttaaggaaaacggctcagatttcagcgttacggcacagcttggcgttgttgacggctcgttcaatgtaataagcaagaacagctttatattcagcggcgactattcaaaggcggtaataacgtcaattacggcgcaggataattccgctacggtatgctttgacatacccagaacatcttctatcggcaacgctgagctttacggtacggtcggtcttaaatccggtgcggttgtaagcagatggggaactcagacgggtatttcatcttttcctctttattatagctattcggagagcaacaacagcaagattgtaattcccgatgcccaaaagcttaataagttatgcgaggcgctcagcaagtataccggttttaccggcgtgagcgggaatgcttcgcttgaagatcttgcaggatataagattggcgacacaaatttcggaaagattttctttgaacagtgcgaaaagtacaacggtgtttacgggcttataaacaagacggataagctcgtgagatccgatcgtatctcggcaggtactcagaatatcgaatatgtattcgctgttgaaagatatatgaatgacataaaggcacttcattctctgataaagcctgtcagcgacagccttgcaagattgtttgccgtatatgaaagtatgaatgcgactaaggataatcaggagcttgaggcgcttagctctgaggcggatgagcttatcggaaaaatcacttctgtatattcgacaaaaatcaagggcatatcatattctgaaatgcttgacagggtgacaaaggaatattgcggcggtgcattgacggcattcgataacatctgtgacgatatatataactggtatccgcagagcgtcaatgacaagaaaatgttcagggctatgtcgcagagcgttattgtgaatgcggcggcgatacagtttatttcggttgcaggaagcgaagataagtcgggagaatacgcatcgttatctgatgatatttcgaagctgtgccgatacaccgattcaaatcaggttgaggagataaataacggcgacggcgtgttatgcaccacgcttgacagaacgttcagacttcagaaggtcaattcggcacttcataacgctgtcaatgaaatatcgctctcagaaatcagccagcttgagaatatgctcgaaaaggacagcacattggaaagcgagcttgcaaaagtcggttttgacgtgtcgccagtaaggtatattgtatgctctgacagcgatattacaagcagatcgcaagcggagcagggcagacgtgcatactcctttgtaagacgtgccacgctttatgatctgacctcatctcagacggtgagcgaaaaggaatattgcaattattactacagtatcgaaatcggcgaggacggaacacctgttgcagtgccttatgtaaatgtgtattaccggctttatacgctgaagtgagagtacagaatctatgagcaaaaatgtgataaatacagagcgactgactttaaggcccgttttaaccggggatacagacgaaattcataggtatgcaggcgataaaagcattgatatgatgctttttctgcctaatgatactttggaacagacagctgaatttgtcagaaatgcggttttacagtgggcggatgaaaaaccgtccgttatggaatttgtgatgctatatgacggcagaatcatcggcggtatcggtcttgaagcggtggacgaagtaacttatgaaataggttgggtattaagcaaggagtacagaaataaaggatttaccacagaggcgggtaaagcgcttttggaatatgcgtttgatgttctgtccgccgataaggtgatagctcattgcgatataagaaataaggcatccgaaaacgtgatgaaaaagctcggaatgacgcttaaagataacagcggcacaaggctttatgaaaagaccggagtaacatcgggcgagctgatgtattgcattgacaggaagaaaaagcagaaaactgaatagcggcaaaaataaacggggctgtgcaaacagtcccgttaatattattcattttgattattcctgagtttcagcttcaggctctttttcttctgctgttttagcttcagcggcatcttcagccttttcttcggatttgttcattacatctgcaggatcaagaacttcatcgtcatcatcaaagaattcgtcatcgaaatcttcatcgctatccataatgtcatcaaactgatcgtaagcgatctccttttctgtcttcttcttgagatatataaagacagctgcaacagcaccgagtactgcaagtgtgcctatggcaaaaccggtaaatgctttcattttaaacctctttccggtgctttcacaccaactttattgtaattattatactatatccactgtcggatttcaagtgctttttatcaatatgagcagttttaacaaaattcttataggtttcctgttaaattcatcaatacggcaagtgccgcaacaggtgccgtttcgcatcttaaaatgcgttcgcccagatgcacagcggtagcaccttttgaaagtgcatagtctacttcctctttttcgaagccaccctcactgccgatgaatacagcaatcttcttatatgaaaggtcaagctccgacagcttctttcctccgcattcatagaaaattatcggcaatgtgtcgctgtcgatgctgtttactgcggatttaaaatcagtaaacggcataactccgggaatttttcctctgccgcattgctttgacgcttcatacgctatacgctgtaagcgctgtacctttttatcggcactttttgtgtccggtcttgaaacacaacgttttgacaggaacggtactattctcatcgcaccaagctcagttgctttctgaacgataaaatccagcttatcgtttttgggaacggcctgaaacagcgttatttcaacatccggttcagctaagttgtcctttttatcaagtataccaaactctattgcgcttttgttttcagcggaagaaagctcacaaaggtaatcgtgtccgtttttgtcgcagattattgccttgtcgccctttctcattctgagtacctgagcgatatgctttgagtcctcgtcattcatatatattattctgtcgttttcgtctattgtatccgagaaaaatcttggatacctccatttttcgagttcttcagccatatattctcctttaagcattcggtgcattttcaaataaattgtttaccatttctgtataacagcggtttttgggcttttcaagacggctgtcatcacgaagaatatcgtcagccgcttcgcctgtcattttcaatatatcaaggtcagcgtaaatatctgcgattttaagctgcggcagaccgtgctgtttactgccgaagaaatcgccgggtccacgcagtttcagatcctcgtttgcaatttcaaagccgtccgaggtctttaccattgtatccatacgctgttttgtgtaatcgcttttattatctgtgacaaggatacagtgtgattgctctgtacctctgcctactctgcctctgagctgatggagctgtgacagcccgaactgctctgcattttcgattaccatcacaacggcattcggaacgtctacgccgacctctattaccgatgtcgcaacaaggactttcagcttgttgtccttgaaatcctgcattactgcgtccttgtctgcctgcttcatctttccgtgaagaagccctgtcggaacattggcaaggcaggtattttgaagcgaatttatatattctgtcgcagccgctttttcggatatgccttcttcaataagagggcagacgatatatgcctgaaagccgttgtttacatatttcaggatgaatttgtataatctttcacggtagcttgtatcaacggcatatgttcttatcggaagtctgcctttcggcatttcgtcaagtatagatatatcaaggtcgccgtagattatcattccgagcgtgcgtggaataggtgtagctgacattacaagaatgtgaggctcgttgccttttgagccgagcgccgcacgctgacccactccgaatctgtgctgttcatcggttattacaagtccgagagagctgaaccttgtgcttttctgaataagtgcctgagtaccgacggcaacgtcaatctgtccgtcggctataagctgtcttatctgctttttctgagctggtgtctgtgagcctgtaagcagagcaatggtcactccgagcggagctaagaacttgtaaagcgtgtcgtagtgctgctttgccagaatttcggtcggtgccataagagtagattgatagccgttaaggtatgcaaaataagccgcacctgccgccacggcggttttgcccgagccgacatcgccctgcaacagtctgttcatcggaacggatttctgcatatcgtcacagcattccgatatggctcgtatttgtgcgcctgtcagagtgaagggcagagaggagtagtattcatctatgctcttgttttccataggtgcgccggcaagcctttttttgcggtttttcatagatttaaggccaagctgtaaaagaaacagctcttcaaaggtcagacgatattttgccttgtcatactgttccttgttttccggaaaatgaatccaacgtaaagcgttatcatatgaaataaggctgtatttcttcataagcgtatcggtgagatgctcaggaaaggtaaaatcacgcagtacgtttttaatgcagtttgacataatgccttgagatatgcctgttgtcaggctgtagcgaggcatcagcttattggggtcttgagaatctataaaaacaggcgagttcatttcttttctcagaaaatctcccgccatcttgccataaaagcaatattcattgtcgagcttaagccttgtgaaagaataatcgctgttgaagaatgttatcagcatatcgcctgtgccgtcgctgacaagcactttgaatatattgatcctgccgtagtatgcaggaaatttcttcgtgacaatcgcttttacaacgtgattttcgccgtcatttaccagatccgatattgcggttgtttcgttgaagtcgatatatcctctcggataatgctcggcaagctgtaaagccgttgttatgccgagcttttcgaggagctttgctcgtttttcgccgactcccttgatatagcagacaggggagtcgggaattttttttatttcattcataaattattctactgatatgagatagtagtatacgggctgaccgccgtttacaagtacaatttcaatatcatcgcttatcttggctctgagcgcttcaaaagcggcctgagcggtttcgtcggtaacgtcgcttccgtaaattatcgtgatatatgatgagcctgaacgaatcagctttttggttatcttgatgagcgcttttgtaacatccttttcaacaaaggcgagagttaccatagtaagatagccgttgccgaagaacaccatgattaggccaatcaggaaacccatgattgcagtcatcccgaattttttagcctttgtaacatacagcatataggggatgccgccaatcaaagggcacagtaccgccatcagcggaataaaaatggggataaagccaagcatcgccaccagcataacaatcacgacatagatgacggtgtagatgccgatagtaattaaatcttttccctcaagccgggaactttttttctgggaactcataccagtatcctcctctgagaaaatgaaaatgtggtgtggttagagtgttctaaccacaccacgcattttagcaatttcatgtccaatatccaacccaaaagcaatttcattctacccaaaatcggtatttattttgggtatgcaaagcacctatttgattcggctggcctctcgataatcttttggcataactccatactttttcttaaatgcagcagaaaagttgctgggctttgtataacccacaagaaccgctatctgcccaatgttcatattgctctccaataacaatcctgcggctcgctctaaccgctgctcaataacatacgcatgaaccgaaatgccgtacatcatggagaatccccttgataatttagagacgctgatttgaacctgccttgccagtccttcacagcttggcgcaaaggcaagctcgctgtcaatgattctctttgcctcgatgatgcaatcacgttcactttttgatatgcagcagtattccggcgagaggattcgcagctccaacacttcgctcaaatatactgacagcaattcgtggattttgctttccagaaacagatacccaagcccaccccgataatgtgtaaagtcttgtaactctgcgaaaatatgctccatatagggcgttatgctcacctttgaaattccggtcagcagtttcttttcatagacggtaatctcgccatcctcgaagtagtcctgtaataaacgtttgaaatatggaacgggaattttgatgttcttaaaatagaagtcgctgttttgcgcataacagagagactccattttcccgtgtccacggtaaatgcaggattctccctttgcaagacaagcgccctctctgctgcctgcaatattccacgacacgccgtcgttcaggcagaacagcatttgaatatagtcctcgctgttaatcccgcgcacattcatgtcagaaaaataattcatcttccagtctgaaacaacggcaccctgttttgtcaccacctgcgcaatttgtccggttcccatatcagaaggaatcgggatcgttacggtctgcggtgaattggagagcagatcccgatagaggttgttcatgtattcgcttgtcattggatgccctccttttttcggttagcagtgactaatgtactaatatagtttacacgatttacgcctgaaagtcaattttcagcacgaatgcaagctgctacagaaaaaatcagggacgttcccgcaggggcagagtgccatgtcgcgcagttcgggtacgacgaggcgcagacgcagacacggtcaaccggccgcgtgcgaggcgaagcgttacgctatatgcggcatcgaaaaccacggcttcagaggggttacgaacgggaacaagaaactggaaaacttatgcccagcagttgccttatggtgccggtgatgcgaattgacaaatgcgttcgctgttgcaagcgcgacgggcgtgagtgtcagcatggtatcacccccgttaatgtgcattgaacacggacttggcaaggctgctggttttgaacaggcagaagcacagcagcaccgtgtagcccatgcaagtccagatggcgtagatgatgtcatccacaagcgcgatgttctgcaccagaacggcgtagatggcaacgcagacgatgatgagaaatgcttggaagcccagcgccagcagggaacggatgtagttctgtcccatgccgccccattccttgcccatcatggtcgccatcggaatgggggcaacagaggtgacgagatatatttcaatcattcttccgaatgtgataatgaaaatgcagatggtcagcgcccacatggtaatgccaacgaacagcgactggaaccataggccgaagagcggccccaattccatctccatcagccgatcctcaatgcccaccatgacgcttgaaatgtcgatgctggtatcgccgataatcagcccggaggcgctggcaacgacgctttgggcagcgtcaaacacgcccatcacaatcgtccatgtgtttgttacgatcaggacagcggcagcggacttgaacgcccacttgaagaatatccatgtgtccatgtcgttgaggttatttttgtcggtaatgagctggatcagttccagcgtcatcacaaaggcgagaattgcgcctgcgatggggacgatcacggtttccgacagattttgtatcatgctgaaaatgctgccgttccatgcctgcggcgataagcccacctgaccggagatctcggcaaccttttgattggttgcatcgaacatcccggacagattgctcacgataccgccgatgagcatttctttcagccattccgtgatcttatcccataagaaatccatagggttgccctcctttcgggaggatgccgcccgaaagcagcaccctccgtggatttatgggaagcaaacgagctgccgattagccgaacagaccggacagcagcggcacgagggtaatgccaatcaaagccaccccgccaccggccatcagctgcttcatgccctgagatttggcgccggggttgtcgttgccgtagccttccagcagattgatcgcgccccaaatgccgaggccagcgcccagcgccacaacgagggtctgaagaacaccaacagcagaattaaagaaagccataaatagtacctccgaaaaatatgtttttagattttggagggtacatttcttccacgaagtttcatcgagtcgttgtcaaatcaggctgccgccgtcaggcgacaggttcaccggaaaggtctgcctgatacacctcaactgcatcatccggcttgagcttgaggcgatgggacagaaaacgctctatgtcaaaggcgtatttcttgtcataatccgcggtgtagcggtagaggggatgcttggtgagatcatatttgttggacagaaacgggcggacgccgcgaagctgcaagatgcacttgccgccatccagcacggcaagctcatccacgctcatcagctccttgcccaatttctgatagttcagcgaatgggaaacctcgcggccacggctctcgccggtgttatagctgtcgatggtttccttgcccagcgccgccgccagctctttcagcgtaccgggttccttaccacccaaaaagatggaacagtccatgttgccgatgatcgtatccgcgctgtctttatacagggctttgagctggctctgtgcctgcaagacaaggcagcaggagatttctctggaacggatcgtcgctaccagcttctcaagcctcggtatctgcccgatgtttgccgcctcgtcgatcaggcagcggacgtgaaccggcaagcgcccgccgtacacatcatccgccttttcacacagcagattgaaaagctgggtatagcacatggaaatgagaaagttaaaggtatcgtccgtgtcggacatgatgatgaacagggcggttttccggtcgcccagcgtgtccagttgcaactcgtcataggccgtcagttcccgaagctcctgaatgtcaaagggcgcaagccgtgcgccgcaggaaataagtatgcttttcgcggtcttgccagcacttagcttgaatttggcatattggcggacggcgaagtggtctgacttgcgctttttcagctcgtcgaacatcaagtccaccggatttttgaagtcctcatcgtcctcacgcacctccatcgcattgataaattcaatgagcgtggagaagttctgttcctccaccggcgcttcatagtggatgtacccgatgagggcggtgtagagcagcgtttccgccttcacccagaaatcgtcaccggctttgccctcgcccttggtgttggcgatcagcgtcgtgaccagcttcaaaatgtccttttccgagtggatgtaggcgaacgggttgtagtgcatggacttcttgaagttcagggaattgagaatcttgatctgatacccgttcttttgcagcgcatggccgcaggaaaccacgatgtcccctttgggatcggtgacgacgaagctggtgggataggtttttgaggtgcattgcagtagattgggcttcaaccaaaagcgggtcttgcccgaaccgctgccgccgacgatcaggacatttttgttccgcgccgttttcgggtctttggggcggctattcatcgtcagccgctccgtctgcgtgagaatgatgttgttctcaaatgcgggatcgacgtagggcttgatgtcctccgcgtttccccaacgggcgctgccgtactccagatttttgcggaatttctttgcgtttttgcccttgatatagaccgccagccgaatggcgatggcggcggcaacgcccacgcacaggtcaatgggatgaaagctggggacaagggagtgaaacgccgtgttcaggccggtcataatgttcaggagcttcgtggaagcgtctgaaccgggagccagccgcaccgcctcgctgaccttggtggccagcagtgcgatgaacacatacggaatattgggaagaatgagctttttgacgttgacttgcttcatcgttccagctccttccgctttgtcctgtccaccacagccgcctgaatgagcgacttgaagtgttgcagcttttccagcaccgaggggcgctccgcctttctgacctgcttggcggtatattccttgaacgcggcggtcatggcgtcggcgtccggcgctttgaagaacaccatgtatcgcttttcgcccttgaccttgaatggagcgaagtcaatgccatacttccgggcaatccggttgaatgagccgatattctgatcggtgacttcaatgctctgcaatcccttatccttggcggcaagctgcttgacggtcattttcccgtggggattggccttgctgtactgatgcttctggcggtcgtttttcaactgctccagcagcttggcaacggccttacgaaattcctgttcacctagcttcccacaggagatcatcagggatacgattctctgttcaacttcttcctgcatgacttatcacgctcctttccttcgatttgcagggagaatgccgggacactaaggcggaaccaccagccggtgcagaagatgcttattcatttctgcgcccctgtcccttgacggtcaggatgccgtccagcgtggtggcggtgatccgcaggcgctcggccacggcgatgtcgtttttcacgctttcatccacgatgctgccgcaaaccaccagcacacgagcgcggcgcagatgctcccgcgccatgtcgatgccgtctttatgctcctgcggaatctcatcgcgcaggaacagcggcaaaaacagcgtggggcagatgggcgaaaagcccgcgtcatagactgccctgcaatacttggcggcattttcggtgttctcaaactcgttctcgctccacggagcggtgatgtaggcaagggggcgtttcatcggtatcaaatcctttctcccaaaatcgggcatgaaaaatgacggcctttaggggccaccgtgaaaatcgtgattgaccagcatggcatagtggttgtcgatggtggaaacggaattgaacagcgccgccatgagataggctttcgtattccaaacgcgggtggtgttctcgcggataccgtccatgaccttttcgatatgcatggaggtgatcttttcaaagcgctgttggacgaagccggtgggatactccgcatcccgcccgatcttgaccgtggggctgcggtttatggcgacctccagcatgatctctaccagctcatcaagctgcatccggtcatactgctgacagagaatgtcgtattcgatttgctctctgatctccgcttttttctcaaacccgtccgtcattccgtccgccgcaggcagaaagaatgaatgagtgcttgatagatcagtatttgatttttgagtattagatttcttagtatttaattgcgcgggattatccgtatccggtgcctccgtatccgggttatccagatacgggttttccgtatctggtaaagtcgtatccggtggagagggctttcggggcttctcgaagatggtgtactccgtgtcggaaatgcgcccgtccttgccgcgaagctgacggcggatgatgtagcccgccagctccagctccttgagcgttttcccgatggcgtccacgccctccttgcagattgcagccagcccccgcgtggtgtaattccactcgtcggggagggagagcatcatggagagcagccccttggcttttagggaaagattgctgtctttcaggtgatggttgcacatcaccgtgtaatcccgcgtccgttcaacgcgaaatacagccatattgcttcaatcctttccgcagaatggtcaggctgtttgaccgtcctccttggcaaatcgctcgtccagccgctccacgctccagttctgcttgaactgtcccagcgggccggtgccgaactgcgccagcgcacggcgatccagctccatcagcttttcccacagctccgggtggtgttttcgcagcttccgcagctcgtcgatgcgctggaacgggcagcaccagcaggacgcacggtggtatatctcatacagcccgccgaagtcaaagccacggtcatagcaggcttggagcgcctgcacctccgtaatgccccactccacaaggggataccgctcgtccttgcagcgccacgcttcatcggcggcgataccgacatagtggatcgcgcccagctcgcctttgagccggttgacctccttggtgatgaggtgcgttttgagctgcccggtacaccagcggacgcggatacccggccagccgttgccgtagggcgggatgcccagctttgcgcggttttccagactgcggggcttctgcttgggttcgtcgaacatcaggtattcaaagcccttgggatgccgcagcgtggtaatatggatgccgcgctcccggaaaagatgctcgtccagtttggcaaggtgttcgtacatttccgggaactccatgccggtgtccgctgacagcaccatgtcgatgggcatatcccgttcgatcatcaaaagcagcatggcggtactgtccttgccaccggacaggctgacggcgtgaaactgcttgccgtttgcgttctgaatggtttcccgcataggaaagccgctccgtttccactcctttcccacatcacagctcatagatgggctgctcgtgttcgtagtagggatcgcacagggcggcaagctcggccaccaagtcctccaaatccagagaaatctcgctgtctgcccaatcgctgcccttgtagacgcgatactcggtgacgtattcgccttctccggcgttcacgctgaatttggcaacgacggcaaagcccatatcctccagcagccacaactccatcgaccgggcggcaaacaccgcgccgatatagctgtcgcctacgtcctcatagagaagcgtcgcacgctgcttgaacagctccgcgctgcgatagtccaagctcagcgcattcttgccgtctgcgcgataggcatagaccgtttcggccttgttccaaacggcttgcagcagggcgtgatagtcaatgttttccagaaactcgtcgatctccgtttctgtgtagccgacctccgtacccttgcggaacagcgtggtcagcgctttttccagctctgttactctgctcatggtaattcctccaatcactttagtgacgccgctttttccggtcagggaggatatgcccctcaatgacggcggcgtgtttgcggattttgatttctccgcgcctctcggatgcctgcgccttggcatatcccacgtcggagaggaacaacctcagccgttcgcccttttcacccacaggagatttccatgacaggacatcaaaaataatcatgtggcgggtttcgtccataaagcgctccagcgcaaggatgctgtgcccgccgacaaaatcatcagcgttcatattcggcacctcgcgctctgatctgaaaggcggcaagcccatagcgggcgatcagagtggcgttgacgatcaggcgcagcgcctccgggtcaatgacctccggttccgccaagtccgccatcgtgacggcctccgtcttgtcgcagaggtcgcgcgctgccatgaacagtgcgtagttgtgcggcgaggtgtttttcaacaccgcatagccgaactcaatcccgtccttgcagaagcagtttgccgtgcggcggtaaatgtcgtcgttggaggtcagcaggtacatggccgcataataggcgttggtatccctgcggcggcggtagccctgcacggcacattgatactgcattcggcgctcatgctgctcgttgctccagaggcttccgggataatgcttgatcagcaggttcaggcgctggaacaggcggcgttcatggggaaatgtctctaagactgcctcgcggtagccgaccacaccggcctcaatgcgctcggccagccacgggcagcgcagggcggtacagcccagctttttcacatactcggtacagagctggcagctcacatctttgggcgtgtatttgaacgtgttgatatggggtgttggcggaactcgtaaaaccacctgaacattgtatatcctgtcaattcagggacgcttaacgctacacgtccgcatattagtatatatatcttaggttagtggcgtttttttgaagggtcaatgtcagtgcagttgtacagatatactcacgaaaatattaatgccttgtcgatacaggaagtgttttaagcggtgttggcgatatatttaactgtgtgactttaataataatcagtttatcgtgacagacttaaggcaccgcttatgcggtgccttaagttatatatgcctgttttacacggcatctttttcttcttccttttcctccattgtgataattatgaacgccatagtcataaacacggcgcatatcatcacagcccactgatttattgctgtcacgcacagatcgcctgcgatagcgccgatggcgaacattgcgtttatgctgaaaagaagcaagccttttctcaaatcgtccctgtttttatgagcgacatattcacatatagatgaagccgctgttctcatattgcctatacacattgtggtggcacaggcgtagctctgcggatatgcgcctcttatgcttatctttctgaatgcctctacctgtgcgccgcaggcaagagaaataatgcagttgcaaaggatattaagctcatacggtataaatgccgccgcaaagagtgccgccgcctcgaacagaataactatctgccgtctgtggagtgctctgcccttgaagatatgatgcaccgtctgtgcaagcacaacgcctgctataaatgccattacaggagcaaaatatctgagtgcgacaacaaaattgccttttgccagattcaccgccataagaagaatatttcccgtctgggcattagcgaatacctctcccctgcacatataggagtatgcgtccatgaatcctccggacattgcgagaatgtatacaagcaccatagaattttcgcagactctgattttctttttcataacatcaccgatagtaattgtagcacattgccgcatatctttctattgttaaaaacaacaaaaattatcataggtgttacggatgaaatgtaaaaagttaacgggttgcctgaagcagcccgttaaacgattgtcaattgagtttatttccgcaattccggcagaatgacgcacccggagttaccggagtgccacaattgccacagaatgccggcgaagcctgctgtacgggagccgcttgtgccacagccgcctgaacaggaacttctgtgtttgtatctgcctgcggcacatcctgcggtatatcctgcggtacttcctgtgaaacaggctgatactgcgtattatcctgcggtacttcctgtgaaacaggctgatactgcgtattatcctgcggtacttcctgtgaaacagactgatactgtgcgttgtcctgcggtacttcctgtgaaacaggctgatactgtgcgttatcctgcggtatattctgcggcacttcctgcaaaacgggctgctgatactgctgagggtagccctgcggaacgggctgctgatactgctggggataaccctgcggaacattctgctgatactgctgggggtagccctgcggaacattctgctgatactgctgaggataaccctgcggaatattctgtccgtactgctgagggtagccctgcggaatattcggctgaccgtaaggctgataagggttatactgaggtgctcccgcaggtgcggctgcacctcttataagaccgtttgcggcgttgaattttcctcttgctatacagcttacgataaatgcggccagtccgagcaagcctgccgtaacaaaatacaaggcataaaacaaaatgggcgtgccgatacctacctctgagccgaaaaccgacaagggcgacataccgaatctcgtaggagctatcaaaaatccaagcactgctttcaaaaattcgtcagccgaatcaaagaaaccgtccgacgccatattaaacaacaatgtaatgataatgaatgccaaaatgagtaatatgccgatgataaaatcaatgacagaaatcacctgtgcggctgtttttgctcctcttgcctttccttttatgtaaaacggcgcaagaataaagcaagctattgacgataaagccaccacaatggcaactatgaataaaattgtcggaaatgtcatatattccgaaaacatttcttcaatgtagcctgtcagctcttgtatgtcctgtgatcctaactccataattttcctccttaatgacggataactgtattttccgtaaattatttcatcacattaaatgtgatttacaacaccattttaacacagttgataactcaagtcaacacaaaatatattgccttttggagcttaatgtgatatactgtttttatataagccgtcacacaggctgtcggcttacagataaatgtacttaatgaataacaaacagaatatgattattactattacagagcagtatggctgctcatccggttaaagaaaggcggaacaagatcatgtgtggaatagtaggatatgtaggtgcaaaagaatgcaccgcaatacttgtaaactcacttacgaagctggaatacaggggttatgactcggcaggtatagccgtgtttgagggcgacagaataaaaaccgtcaaggcaaagggcaagctcaaggaagggcttatcaaaaagctcgaaaacgagcctcatttcacagctacggcaggtataggtcatacacgctgggcaacgcacggcgagccgagcgacattaactctcacccgataggaaacggcagagtatcaatcgttcataacggtataatcgaaaactaccgcaagctgaaggaatttctcatatcgaagggatacggctttgagagccagaccgacacggaggctgtggcaaagctgctcgactacaactatgacggcgaccctatagatacaataatcagaacgattgccgatatagagggcgcatattcgctcggcataatgttcagggagcataaaaaccgcatatttgcggcaagaaaagaaagtcctctgatagtcggcaagggaaatggcgaaatgtttattgcgtccgatgttaccgctataatcgaatacacaagagaatactatctgcttgagccgggagaggttgcagatataacagccgacggcgttacgttctatgatatgcacaagaatgtcatagaaaaggaattacaggttgctacctgggatgtttcggcggctgaaaagggcggatatgctcattttatgctcaaggagatatgcgaacagcccgacgcactcaaaaagacgataaatccccgtatcaagaacggcttacccgacttttcagaatgcggtcttaccgatgaaaagctgaggagctatcaccatatctatatagtaggctgcggctctgcaatgcacgcaggcatggtaggaaaatacgttatagaaaagctggcacgcactcccgttgttgtggatattgcttcggaattccgctaccgtgatcctctgcttgcaccggacgatcttgtagttattatctcgcagtcgggcgaaaccgcagatacgcttgccgctctgaagctggcaaattcaataggcgcagacacgcttgcgatagtaaacgtggttggctcatcaatagcaagagaagcaaagatggtaatgtatacccttgcgggacctgaaatatcggtatgctccacaaaggcatatatggtacaggcggcgtttatgtatctgcttgctttccgtgttgcgtatgcaagaaatgcaattgacgaagaacagtgcagacagcttatatcggagctttcacagatcccctcaaaggtacagaaatgcgttgacgatcagacacagtaccagaaggtagcgtccaagctgataagcgcagacagtctgctgtatataggcagaggtcttgactatgcgctcagtatggagggcagtcttaagctgaaggaaatttcctatatccactcggaaagctatgccgcaggcgagctgaagcacggcactatctcccttatcgaagacggtatgccggtcatcgcagttgccacacagcacgatctttacgaaaaaacgatgagcaatataaaggaagtaaagacaagaggcgctactgttgtaatggtatgcggtgaggatatgaagtttgacgggaacgatgttgattatcctgttatgctccctcttgcaagagatcttcttatgccgcttgtcgctgtagtaccgttacagcttattgcatattatactgcggcgctcaaaaactttgatgttgaccatccgagaaaccttgcaaaatcggtaacggtcgaataatcacggaaaaggaatgttcaaatgtacgatataacaggcgcagtttctctgtgggatcatctggctgaaacctcaaagccgataataatatacggtatgggtgacggcgcacagaaaatactcgatgtatgctccttgaagaatgtaaaaatatcgggattcatggcgagcgacgacttcgtgagaggtcacagctttgcgggctttgaggtgaaaaagctgtccgatattgaacggcagttcggtgactgtatcatactcgttgctttcggcactcatattgacgaggtgatacagcggatcatcgccatttctgacaggcacgaattatacgctcccgatgttccggtaataggcggaggattattcacaaaagaatatgccgaggagcacagagccgagcttgaaagagtttactcgatgcttgcggacgagaaatcaaaacaggttttcgacggctggcttgaatatcgtataactggaagaatacacccgcttttacgcaatcagacggataaagcggaaggatatgaaattcttgacctcggcggcaacgaaacctatgcggatctcggcgcttacaacggcgacacgataaccgagtttctggaagtgacgggcggacagttcaacaaaatctttgcgatggagcctgacgggaagaattactcaaagatgaaacgcatacactacaagctgagtccctatgacttcagaacggtaaatgcgggtgcgtggagctgtgatacggtctgcgagttcatatcaaagggcggaaggaattcatcgcttatcccctacgaaaagggaaagcctgtcaatccgtcacggataaaggaaatagaaatgcgaagccttgacagctttgtaaaggacgagcgtataacctatataaaatatgatgttgagggcagtgagagcgaggctcttgacggcagtaagacggtaataaagcgtgacaagccgaagctgctcgtttcactctatcatcgcactgaggatatgtttgctctgcccataaaggtaacggagctgaatccgtcatacaagctgtatttaagacagcacccgtatattcctgcgtgggatatgaatctttactgcatataaaactatgtctgaaagggaaatgaatgaaaaaaatcgtacttgttatcctgcttgtgcttgttaccgcaggaatagggcttttgctgtatatgctgcttacacgcacaactcccgtgtacgcaggcagcagcagggaaattataagtgacggctcaaattttgccgtttcggcaagctattattcggggcttgacaaggcagaggtcgacactgccctgcttgatgtgcaggacggcgttgagggcgcattgacggcttatgacgcaattcttgcaaagggaacgccggtgttccatcccaccttcaatatagccttatcggactacggaacgggttattttgccgtgcagggatatgcggaggatataccgctcgataatcagaagcaggtaggcttctactgtgccgaccttacgcttaatatatatacggacggaaactcaaagataatatccctgcggaacataatgcctactgagcttacacgtcagaatgttactcttcctgtaatatatgacgatgcgttatccgcaaccgctcttctaagcgacagcacagattttgatatgagccttgcttttcttgacggcaagacaagcactacgcttacttttgaatggacatataatgtacgctgcagtgttccgctgaatctatcggggcttgacgagcaaacggtgagcgccgacattacattcactaacaacaacggcgttgtgacagccgcctttgcaggttaatgcaaaaattaaaattaagagttgcacagattaaacatttaatggatattttatagttgctaatcgccataattatgttactgtgcaacgtttttttgacgaaattgcataattctttgcaagaaaacgaaaaaacgcttgcaaaacggcttcatttgcattataattaaaacatgggtgcagtgaaaaactgcgttaaaattctttattataaggagtttgcgataatggaaaagaatgaactgataaagctgaatgaagaagctaaaaagcagtatgacgagctttgcaagcagggtctgaagctggatatgtcaagaggcaagccctctcccgcacagctcgatttatcacttgatatgctgacgcattgtcttgacggtgattatatgtcggaaaccggtgttgactgccgtaattacggtgtgcttgacggtatagaagaagcaaaaagactttgtatgcctatgctcggtgttgctcacgatgaaataatcatcggcggtaactcaagccttcagcttatgtacgatacaatggcaagagcgatgctgctcggcgttctcggcggcgacaagccctggggaaagaacgaaaaggtaaagttcctctgccccgctcccggttatgacagacattttgctatctgccagagcctcggcattgagatgattacagtaccttatactcccgacggtcccgatatggacgttgtagaaaagctggtaagcgaagatgagcttatcaagggtatctggtgcgtacctatgtacagcaaccccgatggcatcacctgctcagacgaaacggtaaagcgttttgctaacctttcgcctaaagcaaaggatttcagaatattctgggataacgcctactgcgttcatcaccttacagatactcccgacactctgctgaaccttcttgaagaagctaaaaagacaggcaagcaggatatggtatttatgtttgcgtccacatcgaagatttcgttccccggcagcggtcttgcattcatcggtgccagtgcggaaaacatcaagtttatcaagagccagatgacattccagactatcggctacgataagctcaaccagttaagacacgctcgtttcttcaaggattttgacggcataaaggagcatatgaagaagcacagagctctaatcgagcctaagttcaggattgttcttgatatgctcgacaaggagattgctcccacaggcttcggctcatggcacaagcccaacggcggttattttatctcattcaacggtcttgacggcacagcaaagcgtactgttgagctttgcaagcaggcgggagttgttctgacaggcgcaggtgcaacttatccttacggcaaggatcctcacgacaacaatatccgtatcgctccgacatatcctaccgaggcagagcttgcaaaggctatggaggtattctgcgttgcagtaaagattgcggctaccgaatcgcttttaaagtgatttctctttcataatgttgacgaaacattaaaatcgtgttataataatagggctgatttacgtcagccctttatatttacgcctgtagctcagctggatagagcaatagcctccgacgctatgtgtcgtgcgttcgaatcgcatcaggcgtgccaaattcaaatcctcgtaaatccgcattacagacgggtttacgaggatttttacttacttggatttttatcattgaaaacgtaaatttacgcaaaaatacatataaattcagaaaaacactagtcaaatgctagtcaagttaggaagctaactatatattaaacataaaaaatcccccgacagagcctttttgctccgccgggggatacctatttattcagcctttaaatccttaacgtacatccatccggtaacatcagtaccgatacctatcagcgcttccttgccgtcctttgacatcgtgataacgtcaaaaatcgtcgtataaacaaacggatacggttctgtaccatcagaaaaagtagcaccggcattaaccttaaccttaccgccaacctttaccgtcttaacatctgctgacggtgccggctgatcggcagttttacggcctatatcactaacattaacccagcctgtcactgcgctacagcctttcggcgtagtaatgcgtattctgccgtttaaaacatcatcagcgatgtgtatgtaatatgtgcctgtcagatgatttgcgggttgtgaggtcgttgacgagccatacagtgcggtatttgacagttgtaccccctcacctgctttgtatgtctttgcagtgggtgtagtaggcttgacggggtctgacggctttgctggggtatctgtgccgctgtgcgtcttgtaccagtagtcagtcttcgcaggataatttataaagcaaatatccccgtcaacgtccttgcctgcgatgctgtcaatgccccactgccacattttctgcccgtagtcatatctgctcgggttgtccgggctttcggtccagtgtgcaagccatatatcacgctttccaacaatacgttccttctgatagtagctttcaagggctgttatcgcattcggtgcgaccttcggctcgcaaaagctctttcccgatatgagctatatcaacacagacaatatcataaactctaccgtaaaattctttactgatataggagaatacttcagccttgcgttttcgggcaatgcaggcgggcttttcaacggctatttttcatcggacaacttccttatcaacaacaatatagaactcaatgcgccgccgcagtcggcaaatgaacctgtacttaaagtaagatcgacctacgaaacaggtatgtaccttgtcggagacatcggcgttgatttcacgggtaaaagctgggtgagcatcagaaaaaaggttggaaaggaccagctgtacagcggtgaatataacatcagcgacagcttttctcccgaaaagatagcacaggtagagcagtatatgagattgttcggcggtctgacgcagaagacgcttacgtctgcggattattcttatatctacgagcactcggaatcaccgggctatgcgggaatacgtcttgctatggaggaaaacaacttcagcgaatatcgtttcaatccgaactatatgtattcctcgcagagcgtaaccattgaatatctcaagaacacaagcattgtgttcaagccattccttcccgataacaacgcttatatgaaaaatgagaatttcgattactacggcgatacgataataagaatagctgacagaaaaaactggatgaagagttttgaaacaaatgttcttattccggctaatacaggaacatttgtgttcgcagacgatgctatgaccgacagtgataaagcgtcaacgctttattctctcggattcggcagttactcggacgcaatgacatatattgaagataagaaagaatacgaccgttacgtcagaaacacctacaccgcagttcccgaaagcgaaaaggagaacataagaagattccttgacgaatttgaaggcaaagacggcgataacgcaggtaccgttgataacgaactgctgtatgtttacggaatgtgcgagtatctgcgttcacattacgcctattcgcttacagccgataatacttccgataaaagcaatactatgctcggaaacttccttttcggcacaaagcagggacactgcgccctctatgccagcgcaatgacgcttgcactgcgtgaaaaaggtatacctgcccgttatataacaggcttcacaacaggaaagctcgagcttaacggaagcacgggaatgtacgaaaaaaccatacacgaaaactcacttcatgcgtgggttgaagtatatacggaggatttcggctggctgccgttcgatccgacaggctacggcggaagcagcatctcaggcgattatattgatccttcccggacggacgcacctgtaactacagcaccgcctcagacgacctcaacaacggtaactacgaccgtgtcaccgtcgcagacaacagctgcgacgccgcccgttacatccgctccttctgacaattcttcggataattcgggtaacaatcctggcagtgacgcacccggtaaaaccgattattcacttcttataaagatagctttcgctgtactcggcgtaattgcacttaccgcactgatatttgcgtttatcaaatcggtaaagcgtaaaaacgaaaaccgtatgaagagcttcagaaagtcaaaggatacagtttccgccgtaaaggatatgtacggctttattatgaagctgttcggtactaccgatcttgttccgtgtgacaatgagcttccgcttgaatttgccgtccgtgccgatgagaagctgaaaacgctcggaacggatacaagccttgtaagaattatgaacataatcgaaaaggcagaattttcaaaagaggaaatatccgagcaggagcgtgccgaggtttacttgtatacaaaacagctttatgcgcttgtgcttcagaactccggacgcataaaaagaatgtggattaaagtcactttttgacaattaattcaatataattcttgtaaattccgtgataatctgttataattatatcagaagtaagcaaaatctgcaaagcggaaaggaaatataatatgagacttataacaagatctgattttgacggtcttgcctgcggtgcattactgcttgaggcaaaggtcgttgacagctggatgtttgctcatccgaaggatattcaggacgggcttgttcctgtaacagaaaatgacgttctcgcaaatgtaccctttgctccaggttgcggactttggtttgaccaccattcaagcgaggaagaacgtctgaaaataaaaggtcattacaagggcgaaagcaggatttctcccagtgccgccagaatcatatatgaatattacggcggtaaggagcgtttcccgaattttgacgatctgatgcttgctgtagataaggttgacagcggacagctgaccgcagaagaaatactcaaccctacaggctggatactcatcggcttccttatggacccacgcacaggtctcggacgtttcagaaacttcaggataagcaactatcagcttatggaaaaactgcttgtctgctgtgcgacaatgtctacagaagaaattctcaatatgcccgatatacaggaaagaatcaagctgtataacgaacagaccgagctgttcaaacagattatagccgagcattcaagagttgagggcgatgttatcatatccgatttgcgtaatgttgatcctatctataccggaaacagatttatgatatacagcctttatccgcatcagaacatatccgcatggatagtaaacggtaagggcggaaaaggatgttccgtagcggtcggttattctatacttaaccgcacgagcagcgttgacgtaggctcgcttatgctcaagtacggcggcggcggtcacagagcggtcggcacctgtcagttcaaggacgaggaaatcgaagaaaagctcccgatgctgcttgacgagcttgtaaattacgacaagtattattctgcaactcccgtgtaaagcacggctttaaataacgaaaggtacatatatgacggtacaggaatatgcggtaaagctccgcagtaacatttcaaaaatcataaagggcaaggacgataagatagaccttgtcataatggctcttttaagcggcggtcacgttctgcttgacgatgttccgggaacgggcaagacagttctcgcaaaggcactcgcaagaagcattgacgcaggcttttcaagaatacagtttacccccgacctgttaccgtccgatattaccggtatccactttttcaatatgaaagagcaggagtttatgttccgtgcaggtcctgtgttcacgaatatacttcttgccgatgaaataaaccgtgctacgcccagaacgcagtcggctctgcttcagtgtatggaagaaaagcaggtaacgatagacggagcgctttttcttatcgataagccgttcatcgtacttgcaacgcagaatcccgtagaaacggcaggaacttatccgcttcccgaggcacagcttgaccgttttatgataaagctctctgtaggctattccgacagggaatcggaaatgcagatactcgataattcaagagcggttcaccctgtagaaaatcttactgccgtaaccgataagacagagcttcttgaaatgatgaacagggtagagaacatcaaggtgaacgaggctgtaagaggatacattgccgatataggaaatgccagccgtcataacagcgagattaagctcggcctcagtacacgaggacttattgcgctgaaaaatatgtcgcaggcaagggcggcactgcgtggcagggaatttgtaacccccgatgatgtaaagacagtcgcaccgtatgtctgcgtacacagacttatctgcagaagtacggttatgcgtgaccccgacagcgcaaaacgtgagattcttgacaaaatgataaaggagcttcccgttcctacggagcagatttaaatggagcttgtagcgattattcttgtgattgcggcggtagcagccgcagaagtgcttattttcggaaagtacgcactgaaaggaatatattacagtgcgtcggtaaacaaggccgaggtctacgagggcgaaaccctcgagctgactgaggtcgttgagaaccgacgctttgttgctttgccgtggataaagacggagctttccgcttctcgctggcttgcgttcagcaggaaggattccgccgcacagacaagcggcggcgacaatacctttattccgggcgttttttcgctgaagccacgaagtaaatgtacaagagtccgaaaaataagatgtatgaaacgtggcgtattctcctttgacgatacggttgtgaccgctaccgatatgctgggtcttgtaagagtttcaagaggcttcaaggtcgggataagcattaccgtcctgcctgtcggcgcagacggagaaaatgcggtgctgtcattcaacgagcctgtcggtgaaattcttgtcagacgtttcataaacgaggatccgtttatgattgcaggctcaagggaatatacgggcagagaaccgctcaaccgcataaactggaagtataccgccgttaccggtaagctgatggctatgaacaacgagtttaccacctcacgaaacacccttatacttatgaatatgcagagaaagggagtagtgccgataacgtccgcagatataagagataccgaagcgtttataaagctgtccgtcagactgatgtgggaaagcattgacagcggctgcggttttgctttcgcaacaaacggcggtaacgcaaacggtacagccaccggctttgtaaagacagccgaacagtgcgagggtgtactcagaatgcttgcacagctttccgacagctgcagctttgatttcggctcgtttttgaatgcgctgaattacggcagtttcacagatgtgattattctgacgccttatattgacgatgaaatggcactgtttgcaaaagagcttgaaagccgtgacaaagcggcggttttctatacaacgggcaacattcccgaaaatacagatgctcagatattgcacgcaagaaaattctcatacacgtttaatacaggctatgcggagggtacgcaatgaaaaaggattttttaatgaaatgcgttgccgctctggctatgcttcttattccactgccgctgatgttcgttttcgaggtgacggctttcaagggctttatgctgtggcattatccgatatactatgccgtagccgccatagccgccgcatccggctattttctgatgtgcctcagacgttcacggcacactccgaaaacgatttttcttgtaaatacgcttatggctcttacggcaacggtgcttgtcgttcttgtagccgtagtttcctcgcagataaacaacgtacttggcgaaaacggctttaacgtattctatttctgcgttgctcttatgccgtctgttattgtatggtatcttctcggaatgagccttaagaagaacagatttggcgatatattcactccgatatggctcggaatatatcttgttgaaacgttcatctgctatattttctgctgtgtaatgtcggcggatatggaatatctcggtgcttcggaacacaggatttcggttcttcttgtggtaatggcgcttcttacggtattgcttatcaaccagtcgaatatacgctccgagattgacagacgcagaaacaccaaccttatagtacccaaagggctcaggctttacaacgcaaagctgatagcgatagtcggtgcggtgatacttgcggcgctgatgctcaaggattatgtagccgcaggtcttacttggcttgtgaaaatgaccgttaagataatagatacgctgctcttcaacatccgctttctgcagaccgagcagatgaccccggaggatacacagctccccgattccgattttctttcggctgcgggcgaaagccgtgattttctgctttatattcttgtcgttgtcattgtcgtactttttatcgtattcagaaagaaaatactgtcgctgatgcgaaagatagcaggacgcatcttcggaaaatattccgtcgatgacactgtgcaagaggtttatgacgattacacagacagctacgaggagcttgatataaggcaggagaggatagtaaacgaaacggataaggactgccttaagcgctaccgtaaagctaaggataacaacgaaaaattcaggctcggctacagattatacgctatgtggctttcaaaacgcagtacggaggatatttccacgaaaacagtagaacagcaccgtcttatctccgaaaagctgtatcacggcacaaacaatatcggagcattttccgacagctacagcaaaatacggtacgatgatgagcctgcgaccgctgatgacattcttctttccgacagcctcataaacgagctttataaatagcacaatgtaaaatttgtgtaaagtctattgacaattgtaaataaatgtgttatcatttccacatgataaaagggagtagtcgggggatcggtcacagaatgatccctgtacggtgtcgtcaatacgatttcgaacgctttaagcctcagagatccgtgccgtactgagtatacgcttatgacaagacttttgtcgcaatttttttgcggcaaaggtctgtttttttatgccttcgcccaaaacacgaaaggaaaggttacggtaatatgaattattacgacatgaacacacaggaggttctttcacagcttaatacaagtatgaacggacttacaggcggcgaggctgaaagcaggctttcccgttacggaaaaaacgaaataaccgagcggaagaaaaagggcgttttaagagtatttgcggagcagtttgcggatttgcttgtaattattctgataatctccgctcttgtttctgttttcaccgacaacatagaaagtgcgattgttatcatctgcgttatcactatgaatgcggttcttggcactgtccagcatttcaaggcggaaaaatcgcttgaagcgctcaagtcaatgtcatcacccactgcaaaggtaatgagggataataacattcatatcgtcaatgcgtccgatgtaaccgtaggcgatattgtacttgtagagcagggcgacattgtctgtgcagacggcagacttgtttcgtgtgcgtcccttcaggtaaacgaaagctcgcttacaggcgaaagcaacggcatagacaagttcaccgagatgctgacaggcgaaaaaatacctctcggcgacaggaagaatatggtctacacaggctctcttgtaacggcaggcagaggtatgtttgttgtaacagcagtcggaatggatacggagcttggcaagattgcagggcttataaacaaggctgagcgtaaaaagaccccgttacagcacagccttgacaagttctcaaaacagctttctgtagcgattcccgttctctgccttatagttatgatactctatatcgtaagaggaacacccgtgcttgattcgctgatgttcgccgtagcgcttgctgtagccgcaatacccgaagcgttaagctcgatagtcacaatcgccctcgccataggtacacgaaaaatggcagagcagaacgctgtaataaaggatctcaaggcggtcgaaggccttggctgtgtgtctgttatatgcagtgataaaacaggaacgctcacccagaataaaatgaccgtaagacaggtctatttaaacggcaaagagcaaaacgccgacgcttctgcctgcaatgcggatttcgcacttctcgaaagagcaatggctctgtgcaacgatgccgcctattccgacggcaacgccataggcgaccctaccgaaaccgcactgtcggattacatcggtgttccggtttatgaaaagattcgctccgattatccgagagtttccgaaataccgtttgacagcgaaagaaagctgatgagtacctgccatatagttgaaggcaagcgtacaatgttcacaaagggcgcaacagataacctgctttcacgtctggtttccgtctgcgataacggcacggtcagaagcataacagacaatgataaaaataaaatcgcacttgcaaacgagcatttttccggacagggaatgcgtgtgcttgcattcgcctataagctctccgaaaatgaagcggcagacacggaggataactatatcttcataggtcttgcggcgatgaccgatccgccccgccccgaaagcaaggcggcagtcgccgattgcataagagcaggaataaagcctgtaatgataacgggcgaccataaggtaacggcaagtgctatagcaagagagatcggcattatgcgtgacggcgatataagccttgacggagttcagcttgacgaaatgaccgatgaggagcttgacagcgttatcgaaaaggtttccgtttatgcccgtgtatctcccgacaataagataaggatagttgaacgctggcaaaacaagggcaaggtagtagctatgacaggcgacggtgtaaacgatgctcctgcgctgaaaaaggcagatgtaggtgttgctatgggtatcacaggtacgcaggtatcaaaggatgccgcttcaatgatacttaccgatgataatttcgctactatcatcaaatctgtagcaaacggcagagcaatctacgcaaatatcaagaatgccgttaaatttctgctgtcaggcaaccttgcgtgcatcgatgccatgaccaaggcactggatgaggaggtggaaagctgtgagcctgttatccgatttgcaaaacctcgccgaaagctgcggcgtgtccgtggaaacgggtgtgttttccggcaaagcaccggacacctatctggtgattacgccgctgtcggacagctttgagctccactccgacaacgctcccggctgcgaaacgcaggaggcacggctgtccctcttcacaaagggcggctacaccaaactgaaaaatgcacttgtccgcgccttgcttggtgcggacttttatattaccgaccgccggtacatcggatatgaaaccgaaaccggctatcatcactacgccattgatgtggcgcaaatctacgaactggaggaataagttatggcgactatcggtcttgacagactgtattacgcaaaaatcaccgagaacgacgccggtgaggaaacctacggtacgccgtcccagcttgccaaagccatctccgctgacctttcggtggaactggcagaggcaactctatacgccgacgacggtgcttcggagatcgtaaaggaattcaaatccggcacactctccctcggcattgacgatatcggctctacggcggcatccgacctcacgggtgcaaccatcgacaaaaacaaggtgctgatttccgcatccgaggacggcggcgaccctgtggcggtgggcttccgcgccaagaaatccaacggcaagtacaagtattactggctgtaccgtgtgaaattcggtattccggcgacgaaccttgccaccaagggcgacagcatcaccttctccacgccgaccattgaaggcaccattctgcgccgcaacaaggcagacgcaggcggcaagcacccgtggaaggcggaggcactggaaggcgatgtgaccgctgcgactatcacgaactggtataaggaagtctatgagccgacttataccgcattacccgaaaaggccacttaacggaggtaacacacaatggataacgagagaactgcagtcatcaccatcggtgacgaggaatacacactcctgcttaccaccaaggctaccagggagatcgccggtcgatacggcgggctggaaaacctcggtgagaagctgatgaagtccgagaactttgaaatggctatcggagagatcgtgtggcttatcacgcttctggcgaatcagagtattcttgtccacaacctcaaagataaggaacaccccaaggagctgctcaccgaagatgtggtggagcttctgaccacgccgcttgatctcgccggatacaaaaccgctatcacggaggcgctctacaagggcaccaagcgtaatgtggaaagcgagaaagattcaaaaaacgcgcaagtcgggtaacggtctccgatgcggaactgtttacccggcttctttattacggccttgcccaccttcatctgtcgcaggatgaggtgtggctgatgccgtttggcctgcttttggacttatgggagtgtcataagcagtataacgggcaggctgttcctgctcacgaacactacattgacgatattatcccggacggcatttaaggaggtgacggtacatggcagacagtttcggactgaagatcggtcttgagggtgaaaaggagttcaaaaaagcactggcggatatcaaccagtccttcaaggtgctcggctccgaaatgaagctcgccacctctcagttcgataaaaacgataaatccgtggaggctctcgccgcacggaataaggtgctgcgaaaagagatcgacgagcagacaacaaaaattgacaccctacgcaaggctctgcagaatgccgccacctctttcggggagaatgaccgccgcacccagaactggcagatccaactcaacaatgccgaagccgccctcaacgacatgaaccgtgagttggacgaaaacgagaaagccatcaaggagggcggcaaggctgcggaggaatccggcagtaagtttgaaggcttcggcaatgttctcaaaaccgtaggtgtggcgctcggtgccgtggctgttgccgcaggtgccgccgctgtgaagctcggcaaagaggtcattgccgcctatgcagactacgagcagctggtcggcggtgttgacaccctgttcaaggactcctcgcaggagatccagcggtacgctgccaacgcatacaaaacggcagggctttctgccaacgagtacatggagacggtcacgggcttttccgcaagcctgatccagtccctcggcggcgataccgagaaagccgcaaagtatgcggatatggcaatcacggatatgtccgacaacgccaataagatgggtacggatatgtcctctattcagaatgcctaccaagggttcgccaagcagaactacacgatgctcgacaacctcaagctgggctacggcggtacaaagcaggaaatggaacgcctgcttgccgatgcggagaagatatccggcgtcaagtacgatatctcttcctacgcagatgtggtggaagccatccatgtcatgcaggaaagcatggacattgcgggtacgaccgccaaggaagcggaagccaccatttccggctctgtcaatgcgctgaaatccgccgtgtcgaacctcatcgtaggcttcggcgatgcggacgctgacatggagctgctgtgcaacaacatggttgacgccttcaagaccgtggtggcgaacatcaccccggttattgagaacatcgtggcggctctgcccacggcgctggatgctctgctgacggctgtgggtgaactgctgcccacactgctggaagcggtcaccgaactgttctcgcaggtgttggaaacgctgctgtctttgcttccgcagcttatcccggcggcggtgtctgctctcatgaccatcgtgaacacgctgatcgagaatctgccactgcttatcgaggcagcggttcagctggtgtccacactggtgactggcattgcggatgcactgcccacactcattccggcggcggtgcaggctatcgtcaccatcgtacaaggactggtggacagcctgccgatgctccttgaagcagccttacagcttatcacgggactggcgcaaggacttctggacgcaatccccgtgctgattgcagcactgccggagatcatcaacggcatcattacctttttactggattcgattccgcagatcattgaaacaggcattcagcttctgacctcgctggtgactgcattgccggagatcatcacggcaatcgtggaagccatcccgaaaatcattgacggcattatcaatgctgtgctgaatgcgataccgctcattattcaggcaggcattgatctgctgatctcgctgatacaggctttgccgcagatcatcacgaccatcgtgcaggcgattccgcaaatcatctccggcattgtcaatgcactggtcgggaatatcgacaaaatcatcatggcaggtgtgcagttgttcgttgcgctgattgaaaatctgcctaccatcatcgtggaaatcgtcaaggccgtgccgcagatcattgcgggcatcgtgaaagccttcggctctctgatgtataaaatcgtggagattggcggcaacatcgtcaagggactgtggagcggcattacccagcttgcctcttggctgtgggacaaggtgtccgggtggatctcctccatctgggacggcatctgcgatttcttcggtatccattcgccctcaaaggaaatggcatgggtcggtgaaatgctggtcaaaggtttgtccgggtccattgaagataacggcgatgaagcggttaaagccgcagaagggatggcagaggacatcaacggcgtcatgggcgatctcgcccacgatatgcagacagccctgcccacggacttcgatgtcagcggcagcttccgttcggcggtggacggtgtgaccggcaaggcagcatccgctttcaccattgccctgaacattacgaacttcaacaattacagcagtgaggatatccgtcagctcaccaacgaagtcatggaaacggcgaaccagttcgcccagcggaaaggagtggtattcgcatgacctattttacctacaacggccgcagttccgctgatttcggcctgcatatcgagaagaaggaggtgttctccgcaccggagtacgatgcggagttcatctccattcccggtcggagcggcgatatcatcaatccgaaccgtcgattttccaacatcaaggtgacctacacggtgttcctcgctcggaagaatatagctgcacttgcctctgtcctgcgggacatcaaaggctggctgtattccgaaccggacagataccacgaaatcaccgactcttacgatgcggagtatttccgctacggtgtcatctccggcaatctggacattgaggagcagctaaacaaggtcggcagtttcaccgtaaccttcaactgcaagccgtataaatacagctttacaggacaggagacggtggcggctgacgcttccgaactgacgattaccaatccgaccgcttttgagagccgaccgtacatcaagctatacggcagcggtgcggtagcactaatgatgcatccccaaggccgtggcatgatgatttccgacttggacgagtatattgagatcgacagtgagctgatgaactgcttcaaaggcactgccctcaaaaacgacacagtcaaaggagcggaatttccagccctcacgccgggtgtttgcaccattaactgcaatggcgatgtgtcaaggattgaggtcgttccaaggtggtgctgcctatgatccctgtactctatgccgcaaatactacggatttcagctcgttcggtcttggtgtgctgacggacactgtttcctgcgaagtcaccgaagagcgaaacggtgtgtttgagtgtctgctcaaatacccggtcagcggtcagcactacgggcttatcaccaaggagtgcatcatcaaggccaaacccaatgacaccgccgccgaccaggcattccgcatttaccgtatcacgaagccattgaacggcatcgtcaccatctacggtcagcacatctcctatgaccttgccaatgtgccggtgttgcctttttcgacggagagtcgctctcctcagctcattctctcgcagctccttgccggagatacacggttcacgggctggacggactactcggatgcaaaggcgttttccgtcacgcagccgaaaagcgtccgtgcctgcctcggcggtacggaaggctccatgctctccaaatggtacggcgagtttgagtgggacaacttctcggtaaagttccattcccaccgtgggcagaagaccggcgtggtcattgagtacggcaagaaccttactgctttggaacaggacgaggacaacagcggcgtgtataccgcactgctcccgtatgccgtgtacaccccggaaggagcagaaaccgaaacggtggtcacgctgccggaggtaacgctccccattgtgacctcggagatcgtccgggcgaaaacgctcatcatggatttctccgaccaatttgacggagttgtaaccgaggataccctccgagcgaaagccaacagctacatcaaagccaatccgctgggagcgaccatccccacggtaaaggtgtcctttgagccgctctggaaacagccagagtattcggcactcctggagcgggtcaacctttgcgataccgtcaccatccggcactcgctattgggtgtcagcgtgtcggctatggtcatcgaaaccgtatacgacactcttgccgaacggtatgtgagcatttccctcggtcagagcaagtccagtatgatcaccaccatttccgaggtgcagtccacggtcgacaaggtggagtccacggtgggacgctttccaaagctgcttcaaaccgccatcggtaaagccaccgggcttatcaccggccagagcggcggctatgtggttattaacacagacagcgaaagcgggcagccctacgagctgctcattttggacgctccctccattgacgaagccgcgaacgtctggaggtggaatgtgggcggtctgggcttttcccgtaacggctacaacggcccctacgaaactgccatcacggcggacgggcagatcgttgcagacttcataacctccggctctctggtagcgaacattatcaaggcaggtgttatccagtcgcaggacggctcgtcttattgggatttggaaagcggcgaagtcgtgcttcgagcctatgtttcgaccgatgaatttgcagagaaaacagcctatctccagcagaatgtggatgggctgaacagctatgtggcgactcttaccgaaactatggagtcggtttccaacgaccaaggcatactggaagagcggctgcgaagttccgaaagcaaagtatctcagcttcagcacacggtggaaggcttgtccgtcaccatgcaggagcagtacatcggcggcatcaactatgtgcaaaactcttccggactgaacggcatcacggatgattggaactattccggcaccgtgaaaacggatgcctccacggacacccagaacaacaccgtttccgactcctgctttgtgctgggagcttactcctcgctgtcgcagtacatccgaggggtagttcccggcacttatacagtttccgttcgcgccaagaaaacctcgaccatgtccgggtatttctatgtgacctacaacggaaacaaaactgcgtatctcttcaataagagcaccgcttttgactggacggattttaccgtcacgctcaccgatgtgaccgaccccacgctgcgcgtctactgctactgccgggatgcatccatttatctggcggacatcatgatctccgaaggagcaattccccgaaagtggacgcctgcacccaacgagatctatacgcaagaggtcaagatagataagcgcggcatcgaggtatccaacagtgcatcatcccagcggacggtcatcacgaacacggagtttgccggttattacaacgatgaggtgatttttaccctgaacaaagacgagacacaaaccaagaaaaccacggtggacggcgatctgactgtgggcaagacgaagttcgttcccatgccgacagcgtccgatgggctgaatatcgtcattctggactaaaggaggcaaggctatggcaatgacaggcggcaccgcctatctggtgaaatccgaaagaacgaactacggctccaacagctggacgactgacctatacatctatgtaaaggtcatttcccagaacgtagtcgcaaacacctccaccatcgctctgggtatgtatgtctattcgaaatactccatagcatggtcggacttcggcaccaacggcacttcctatatcggcacggccacctccggctcaaactgcttcacctttacaaacggccagagcggtagcggcacgaagtggctgattgaggacaagcaggtcactgtgtaccacaacagcaatggtacgctgaccctcccgatctactggcactggggcgtcaacagcccgtggggtcagtacaccggcccttccggcagctacaatgtgacgctgagcaccattgaccgagctgcccctaccgttaccttttctgtttcggctattaccgcaaacggcttcaaaatctctgcaaactccaccgcaacagcggatatctggcagtacagcaccaacggcggctccacatggacgaccttttctacgaccgcatccaccagtgccagcgtaacattgtcctcactttcgccgaacacaaactacacggtgaaggtgcgggcacggcggcagtacaaccaagtctatggcacctccggcagttccacggtcaagacgctgggcggtgctgtggtgaatagtgtcaacacggtgacggcggacaatgccagagtgaccatcaccctcaatgtcaccgtgtacgaaccgtcttacatcaattctctggcgatcaaaagcgggaatacgaccatcctgaccgttaccgggcttgcatggacgaagggtacggcaaaccgcacggttacgctgacatcggcgcagaggacaacgctgttgaacgctatggcgtccatcaaatcgttcacaggtacctttgcggtttcgtcttacagcgggtctacgcagatcggcagcacctcaagcaagactgctacggtgcagaccacggcggcaaattctggcccagcgttggatggcttcacttacgccgacagctacacgaccacaaaaaacctcacaggcaacgaccagctattcgttcagaactactcgaccctcaaggtcacgcccggaacggcaactgcaaaaaacggtgccagtatttccaactacacagcttcctgcaacgggctgtcatcctctaacactaccggctctgccttatctgttggaaagatcgccaagtccggcagcgtaacggtcacgctcacggtcacggactcccgcggttataccgccagcgtttcccaaactattacggtcattccgtacaccaagccgaaaatatcctcggtaacgctccggcgcaccaacgacattgaagcggaaatgcagctcaaattcagtggctctatttctgctgtgaccgtagacgggacgcagaaaaacagcgtggtttatgtgcggtatcggtacaagaaaaccagtgagagcagttacggcagctacaccagcatctatcaaaccctaaccccaaaccccttcccctcgggaaggggctgaatgtggggctgccgccctcaccccgcttggggctacgccccaaaccccatttttataagttatgtaggtttatcgactgtctgagaccccgctcttttgagcggggtcttagtttgtagtaaaaatctgaaatgccgcccaaataggcggcacagattatattgtttactttacttgttattcggcagctttgcgtaatatctcgccaatgtctttgcagaatcctcgctgtgctgtacaaaccatatcttatcaacatcaaacaggatacatccgcagtgccctttgaaggtcggaaagcatattaccttaagatgcgtatctatctcggggctgtagtccataagctcaagcgtttcgccgtaaagcgtagaacgctcatatcctttcagccactttgcgtccatattgctgaacagcgtaccgaatgattgtccgatcagcttttcgagcgggagcttttccagccttgcaagcgcttcgtttgcatagcggaatatccagtctaccgctttacactcctcgttgaataccatctcaatatcggtaaacgcaaacggcatagcatcaaaggagcggtaataatcgtgatactgctcttcggtatccggcaccccgtcatgatcaaagccttttattatccactttctgctcgtctgcagactttcgattatggtattcttcctgcggcatgcgtattcgagtttttcgccgtttacaaggtctatcatatcggatatttcgtgaatagccatagccgatactatacatcctctgtgtgccttgataaagccgtcacccagcatttcttcaagagctgcaaaggtcattcttgtactatatatctttccgtccgacaggtgtatctcggctgatttgccttccattattatgtatagtatagagctgacggaaatcactactttctgccgcttgcttattattgtgatatactcagatttattaaaattagtcaaggtgactccaccgttctttcacatattattgccatataatttacattatacgactttcccggattaattgcaatatcaatgaaccttttccgcttaatacgcacattgcccggctgtaaaagcatatctcagcttactgtttctttataagcatatccgcaaagtattcgcacagctgaggatttcttatcagcacaggaccgataagatgagtaccgtagaaattaccgtaatgaacaccctctttgttgtcatccttgccgtttccgcttccctgctttacatcaaacagcggtgaggtggctccggttgtaaggcttgccttattcacaaagcctattatatctccgccacacagcaaagtagtacaaaggctgtcggtaacaattctctcttttccttcaaccgtttcgtaaggaaagaacgaaagtccctcatgctttgtgccgtcacagtcggtaacgctctgtccgaaaatctcaaacgaattgcccgttgcaagaattaccgtaccgttatcaagagcagtttttatattatccttgtagccttgcagataattgagtgctaccttctgattcctctcggtagcagaaccgataaacacaaaatccgcacccgaaatgtctatctcatcatctatcgactgatattcaatttcaacgttctgccctttattttcaagtgctcttttcaaagcacatacattgccgtaatcgccgtaaagattgcacagatccgcaaataaatgaattatcctcatacgtcctcctctgcctgcgtaagctctacctttgacaagaacttctccttatccgaaaagcaggtgacagtatacagcttgccgagcggtttagccgcaatttcatcaagtgccgcaggaatatcctcgttcacggtcaccttagctatatcaatatccgtatacgaaagccttgtttcaagatcctttgcgtgtctgccgagcagataaagatgctgtatgcagtcggctttaagcacaccgtagtcaatatcccacagccagcttgtttcacccgttgaataacgacggcttaccgaatctattattatgattaccgagcagggctgattttttcttatgatataatcatatacacggtcgcttgcaacggagttttcgtgctttgcaataaggaatgtgcctttgttcacgccgagtttgaactgcaaaatacgtccgctcttgaggaaatagtgtgacagttcgtctgctatgacatcaccgtcaattccgacaatagagcaagccgcaaagcaggcaagaatattatacacgttataaacgctcttgaacagcagttttatcttatatttgccgtttatcgtaacaatgccgctgtcataatcgacattcgttacggtgtactgcgtatcgtgttttttgtgtccgcagttgtcgcagtgatagcttccgatatgtgcatagtgatagtagtcatagctcattctgtgcttacattcggggcagaacgcaccgtcattatatacgcctgtagcgtggtctgtgctgaaatcctgcttatccataccaaaccatatcacattatccctgtccctgccgtatctcgaaacaagcggatcatcggcattgagaataagctgtgattcgggtctgatgctctcctttaccgattcatagacccattcgggatgaccgtttctcgtaagctggtcacggtagagatttgtaattatatagtgcgtaggcgcaaagaatttaaatgaatactttgcgtatctttcgtccgactcaagtaaaagcacatcgccctttacctttcctccgaatgtgcagttggataatattatcgctgtaacacccgctatctgatttgagccttctttattccaaataacctttttacccgatttacgcattacctgtgcaatcatctcaacggtcgaggtcttgccgttgcttcccgtaaccgcaatgacctgttcgggcagtttcacccttgacagtacatcggggcagattttaagtgctatatcgcccggcagactgctgcccctgccgataagtttaagtaaacacttcgacactttacaagcaagtatcgctaagaacattctcatactttcaatctccttaaagaaacccattctaagattcatgatttaaattataccacaaaagtgaactcttttaaagcgattttataaaattttagtccgcctatcaaaaatgttaatatcgtcatacaatttccgagaataaaacaagacaaaaagataacagaggtgctaaaataaaggcaatggtgtaaagcaccgaaaacgttttgtattttacagaaaggaaatattttatcatgagcgaaaacagacttataggcgattatcccgtaataggcatacgtcccacgattgacggcagaagaggtgttctcaaggtaagagaatctcttgaagagcagactatgaacatggcaaaatcagccgcaaaactgttcgaggaaaatatcagatattcaaacggcgaacccgtaaaggttgttattgccgacactactataggcagagttgccgaggcggccgcctgtgcggataagttcaagaagtgcggcgttgacataacgctcacagttactccctgctggtgctacggcgcagaaacaatggatatggatcctatgacgataaagggcgtatggggcttcaacggcacagagcgtcccggtgccgtataccttgcatctgtacttgcaacacacgcacagaaaggtttacccgcattcggcatctacggccacgatgtatgcgaggcagacgatacctctatccctgaggacgtaaaggaaaagctcctgcgtttcggcagagcggctgttgcctgcgctacaatgagaggcaagtcatacttacagataggctctatcacaatgggtatcggcggttctatcatcgaccctgcatttatagaagaatatctcggtatgcgtgttgagtctgtcgatgaggtagaaataatccgccgaatgacgcagggcatttatgatgaggccgaatatcagaaggctcttaaatggacccgtgaaaagtgcaaggaaggctttgacaagaaccccgagcagttccgccgcacagacgagcagaaggaacaggactgggaatttgtcgttaagatgatgtgcatcataaaggatctgatgaacggcaacaaaaacctcccggcaggctgtgaggaagaatcggtaggtcataacgctatcgccgcaggcttccagggtcagcgtcagtggacagacttctaccccaactgcgacttccccgaggctatgctgaacacatcgtttgactggaacggtgcaagagagccttacattctcgctaccgaaaacgatgttctcaacggtcttggaatgctgtttatgaagctgcttacaaaccgtgctcagatatttgccgatgtgcgtacatactggagccccgaagccgtaaagaaagccacaggctatgagcttgagggcgttgcaaagcagagcggcggatttatccaccttataaactcaggtgctgcctgccttgatgcctgcggtaaggcttcagatgaaaacggcaacggcgttatgaagccgtggtatgacgttacagacaaggatattgacaatattcttgatgctactacatggaactatgccgatctcggctatttcagaggcggcggatattcatcaagatttgtaacagaagctgaaatgccctgcacaatgataagacttaacctcgtaaaaggtcttggtcccgtattgcagatagctgaaggctggacggttcatcttcccgatgaagttacagacaagctgtggaagcgtacagactacacatggccttgcacatggttcgctccgaggacaacaggtgagggcgcattcaaaacagcctacgatgtaatgaacaactggggcgcaaaccacggtgctataagctacggtcacataggagcagaccttatcacgctctgctctatgctgagaatacccgttgctatgcacaacgtacccgaaaaggatatattccgtcctgccgcctggaacgcattcggtatggataaggaaggtcaggacttcagagcttgcaacgcttacggtcctatgtaccgcaacataagataaggcggcagtatgaaaaacgtacttgccattgacttcggtgcgtcaagcggaagagccgttatcggctcttttgacggcactgtaataaaactcacagaaatccaccgcttttcaaacgatcctgtgatactcggaaagacaatgtactgggattttctccgcctgttccacgagataaagcagtcacttataaaatcaaaggaatacggcgagatagacagcattgcgatagatacatggggcgttgacttcggcctgattgacaaatcgggaagactgctcgaaaaccctgtgcattaccgtgacagcagaacagcaggcacttcggactacagcaagcgttttattgaccataacaggctgtacgaaaagacaggcattcagataatggaaataaacacggcgttccagcttttaagcataataagggatcgctccgaactgcttgacagagccgacaagatgcttatgatgcccgatttgttcgcatattatctcggtgcaaagcccgttgcggaaatgtcaatagcgtcaaccacacagctttttgacgcaaatacgaaaacgtggtcggaagaatgctgtgaacgtcttaaaataaagcattcgcttctgcccgaaatagtagccggcggaacggtagtcggcacattgtccgatgagatctgcaaggagcttgatataaagcccgcaaagataatcgccgcctgcggtcacgatacgcaaagtgcgatggtcgcagtacccgcaggcgaaaaggacttcgctttcctgtcgtgcggaacgtggtcgcttctcggcacagagcttgacgctcccgtaataaacgaaaaatccgcaaaactcaacatttcaaacgaaaccggctacggtgcaaagacatcgttcttaaaaaacataatcggcctgtggctcattcaggagagccgccgtcagtggataagagagggcaggcagtacagctttgccgaacttgaaaatatggcgagaaaagccgagccgttcaggtgctttatagatgttgacgctcccgaatttacccctgcaggcaacattcccgaaagaataaaggaatattgcaaaaaaacaggtcagtatgttcctgaaaatgacggcgaggttatgcgctgtatctatgagagccttgcgatgaagtaccgcacagccgtaaacgagcttgaggactgcacaagcaagaagttttcaaagctctatatggtcggcggcggaacaaaggataaattcctgtcggagcttactgcagattcgctcggcatagaggtttcaagcggacctgtcgaggcgacctcctacggcaatatagcaattcagtttatagctgacggggagataagggatatagaaacggcaagaaaaattatagccgcttcggaaaagctctgtacatttgctcccgaaaatacagccgaatggaacaaatattataaaatctatcttgagaaggtgaaataatgcttaagaatattcctgcgatattatcgcccgaactgctcaagaccctttgtgaaatgggtcacagcgacagaataataatagcagacggcaacttccctgccgagagtatgggtaaaaactgcaaggttatccgtgcagacggtcacggcgtacccgaactgcttgatgctatactgacgctgttccctcttgatacttacgttgaaaagcctgtaaatcttatgcaggtaatgccgggcgacacagcaaaaactcctatatgggacgaatacaaagcgatagtcgcaaagcacgacgaaagaggaaacaacgctatcggtcagatagaacgttttgaattctatgaacaggcaaagaccgcctatgcaataatcgcaacaggcgaaaaagccgtatacgcaaacataatgctccagaagggcgttgtttaagcatacagcagcaacttgaaaggatataaatatgtacgaaaaaattaaagaacaaatggtagacatctgccacaagctctggcagaagggctgggttgccgcaaatgacggcaatgtaaccgtaaaggttggcgagggtaaatatcttgctacgcagacaggtgtcagcaaggcattcatcactcccgaaaagataggtcttattgatgatgacttcaacatactcgaagccgctgagggcttccgtccctcgtcagaggtaaagatgcacctgagatgctacaaggagcgccccgacgtaggcgcagtagttcacgctcatcctcctgtttcaacaggctttgcgtgcgctcatctgcctatggatgattactgcatgatagaaactgtaatcgcagtaggctcaataccgctcactccctacggcacaccctcgacctacgaggtacccgaagcaatcgcaccttacttaaaggatcacgattgtatgctccttgaaaaccacggtgctctgacagtaggtgcagaccttatcacagcgtactacagaatggaaacaatggagcttcaggctcacatttctcttgttgcacgtctgcttggcggtgtaaaggatattactcccgacaatatcgacagacttatcggtatgagagagcaatacggcgttacaggcaagcatccgggctacaagaaatacctttaatgtaacttttacatatatttgcctctctaaatgtaaaacttttgtgaaaagtgttgcattttttgaccaaaggtagtataatgaatacagcaaacggaaatatatattccgtgatttaaattcaaagaacaggatggtaaaaaccaatggctaatcgttttatacttaacgaaacttcatatttcggcgcaggcgcaagagaaaacctcgttcccgagcttacaggcagaggacttaaaaaggtaatgttcgttaccgataaggtactgcttgaatgcggagtagctacaaaggttacggcagagcttgacaaggcaggaatcgcctatgaaatatacagtgacgttaaggcaaaccccacagttgcaaatgttcagacaggtgttgcaaagttcaaggagatgggcgctgactcactcgtagctgtaggcggcggctcagttatggatacagctaaggctgtaggcatcattatagctaaccccgactttgcggatgttgtatcgcttgagggcgttgcagacacaaagaacaagagcgttccgcttattgcacttcccacaacatcgggtacagcggcagaggttactatcaactacgttatcacagacgaagcaaacaagaagaagatggtttgcgtagatcccaaggatattcccgtagtagctatcgtagacagcgatcttatgatgggtatgcctaagggtctgtgtgcatctacaggtatggacgcactgacacacgctatcgaaggatatatcacaaagggtgcgtgggagctgtccgatatggttgagcttcgtgctatcgagcttatcgcaggctcactgtacgacagcgttcagggcgaccccaaggcaagagaaactatggcgcttgcacagttttgcgtcaccggcattcattcccactatgccgaagcaatttgtaacagttccgccgataaggctgtagaagaactgctttgaataggtgatcgttcctaagtggttgtttatcgtgatcatttgtataacctccttgtaaatcggactatattattatactatatttcacggcaaatttcaagcgttaatgccaaattaccgttcaacgacataaactccgctgttgacagggcgtgtcataaaaacatggggatattttcccgacaggatattttttgcatcgacggctgtttcttcgctttcaaatactccgaaaacaacgcttccgctgcctgtcatttctgatatgacggctccgctttccagcaggtcggttttcatttcttctatcctgctgtcgtgatagatcttagtgaatacgttgcttataaagcctgcaccttcagaaagacttccgcagacaatgctgcttacaaaatcggcataatgaggatttatctcggtcggattttcatcgtattttgcgtaagcctcagccgtactcagagtaaaatcgggataaatgcagacaaacacgcagttcgtgtcgcattcagccgcaatcatatctccgctcgttatgctgtaaagcgtgccgcctttaatgcagataggaacatctgcgccgattttatcaccgacagcacacaatgcttcggcatcgagttttttgccgaacagctcatttagtgcgacaagtgttcctgcaccgtcgacggaagagccgcccattcctcccatcagaggaacgtgcttttcaatatcgacagctatctcggcggcaagtccggttgcgtcgaaaaatgcttttgcagctttccatacgatattcttttcatcgcacggaatgtcggggttattgcaggttatcctgcaatcaaagctatccgtactcataacgctgacggttatatcgtcataaatatcaacgctttgtgtcgcaatgttgagcgaatgtctgccgccgggcagtctgcctgttatgtcaagaaacaggttaagctttgcgtatgctcttacctttattttcatagattacagtacaccgaggtcttcaagaaacagccttatgcgttcaagcgctgttttgatgtgctgaagtgaatatgcgtaggatacacggatatatccctctccgcattttccgaaagcgtcgccgggaacaacggctactctgtgcttttcaatcagctgttcgcagaattcctgtgatgaaagtcctgttttccttatagacgggaaaatgtagaatgcaccctccggttcaaagcaatcaagacccatttcattgaagccttttacgataagacgtcttctcatatcgtattcgccacgcatatattcaatgtcttttttgcaatccttaagtgctgttactgcggcatactggctcattgtgggcgaacacattatgccgtactggtgaatcttcagcatctgagtgactataggagcgggacctgcggcaaaaccgagccgccatcctgtcatcgaaaacgcttttgaaaagccgtttataagaacggtacgttctttcatgccgtctatttcaacgatagaacagtgttcctcatcgccgtaggtaagctctgaatatatctcgtcggaaataacgattatatctgtgcctctgattacctccgcaatcgcttcaaggtcggattttctcataacagcacctgtgggattgttcgggtatggaagtacaagagcctttgttttcggggttatatgtgctttcagtgcttcggcggtcagcctgaagccgttttcaacgcttgtttctatagcaacgggtgtgccgtttgcaagtgttacgatagggccgtaacagacaaagcttggctgagggataagtacctcatcgcccgtatcaatgagcgctcttatagcaaggtctattgcttctgagccgccgaccgttacaagtatctcatgcaaggggtcgtagctgacgtgcagcctgtcattgatatagtcgttgatagcaatgcgaaggtcggcaagacctgcgtttgcggtatagtttgtacgtcctttttcaagaactctgattgcttcttttcttattgcccacggtgtcttgaaatcaggctcaccgaccgacagtgatataacatcatcatagcttgcggctatgtcaaaaaactttcttatacccgaaaactgcagatcctgcacctttcgggaaagtatattttcataatccatcacggagataccaaactcctttcgtccgtgttctttaagaacatcttgtctttttccttatatctgtgcagaatgaaatgcgttgttgtactgagaacgccgcctaaaggcgctaatctgtccgttacgaacatagctacatcacgcagatttgtacccttgatagttacggcaaggtcataaccgccgctcatcaggtataccgatgaaacctcatcatactgagctataactgccgctacatcatcataaccgcactgtatttcgggggaaactctgacttcgataaaggcacagacggagtttctgtcgaattcttcttcgttgatgattgcagtatagccgattatcattccgctcttttcaagctccgctatcatcgccgccacatcgtcagccgaagtatcaagcatcgccgccagctgttcgtttgaaagtctggcgtcctgtcttaaaaggtcaacaagcttttctttctttgtcataatcttatcctccgaattattttatgcttataaatgtgggattacgtttcttgaaaaatgcaagttctgtaaagcccacatttcttgcgagttctatagcctccggaataccttttccgaggtcttgcgtgcaatgtgcgtccgagccgacagtaagtattttaccgccaagctctttataaagtcttacatagtattcgtcaggcagcgtaagacctatcttctgcctgagtccgcttgaatttatctcgatacctatatcgttttttataagagtagagaatatctccttgattatcggaaggtacttgctcatatctatgtaaagctccgattcgcccacgatataacgcagagggtatgtcaggtgacccagtacgtcaaattcgccccaccgagccatttcaagcatttcctcaaagtacagcttcataatcatttcgggctgtacctcgttataatcaagcagataaaaatcctcccagccgttgcacatatggagcgagccgattataaagtcataatcatagcttgacagcattctttttgtaagctccatatcctgtaaaggctgacctagctcaacaccgtatgccatatttatcttatccgcatactttttaataagggcgggagagatctccgacgctcgttttacaggttcttcgtagagatattcctcatcgtagaatttatttatttcaaggtgatctgtgagcgagtaatatctgataccaagctctattgctcgtctgaccatttcttccggatcgttactgccatcgggcgacagatttgagtgattgtgtacgtccatcagaatttcggggtcgttcatatttgctaccttccttttgcggttgttctatatctatacatattttattttaccacaaacaaagctgtttgtctattgtaatattcaaattaattgtgaagattgcaaaaaaataccgaggaaataaattccccggtaagattttatttgtcattgtcaagattgttgttgacaccgtatgaaagcgtcagaaggctgtcgcccagatgaacgttttcaacgattatgtttttatgctcaacgttaatgtcatagtgtgagaagttccagaacgatcttacaccaagctctgtaaggcggtcgactatctcctttgtaaccgatttaggtatacataaaacagcaacctccggcttattttcacggcagaatttttcaagatcgtcaatatcggttattgtcagctttccgagaggatttccgacaattttcttgttggagtcgaatataccgataagactgcatccgcttttttcaaagttaatgtgaacggcaagcgcagtgccgagattacccgcaccgataagaatcgtttttctgtgcttgtcaacaccgagaatacggcctatttcctttcgcagctcagaaacattgtagccgtagccctgttgcccgaagccgccgaagcaattgagatcctgtcttatctgtgatgcggtaaggtgcattctctccgataattcccttgaagaaatcttagagatctgctgatcctccagctcgccgagaaagcggtagtagcggggaagtctgcgtattactgaatttgatatattaatgcttttcgacaagatactgcctccttacagttttttttattgaaatcagagtgttgctttaagtctgttgttgatttcaagcaggaagtcctctgtgtttacctttctcttgttgtcgaggtttgaaagtacatagaggtcgccggtcataacaccgtcttcaatcgtctttatagtagccttttcgagcttatccgcaaagtcggaaagctccttgtttccgtcaagctcgccacgttttcttaatgcgcccgtccacgcaaacagggtagctaccgagttggttgaggtttcctcaccctttaagtgcttgtagtagtgacgtgttactgtgccgtgtgcggcttcatactcgtaaacgcctgtgggagaaacaagtacggatgtcatcataccgaggcttccgaaagctgttgccaccatatcggacattacatcgccgtcataattcttgcaagcccagatatatccgccctcagaacgtacaactcttgctacagcgtcatcaatcagtgtatagaagtatgtgatacctgcggcatcaaacttttccttgtattcattatcgaatatttcctggaaaatatccttgaatgtatggtcatacttcttggaaatagtatccttggttgcaaaccagagatcctgctttgtgtcgagtgcaaagttgaagcaggctcttgcgaagctggcgatacttgcatttatgttgtgaagtccctgaatgatgccgtcagaaccgctgaacttgtggataagctgtcttgtttcgtttccgtccttatcggtcacaacaagctctgctgtactgccgtcggcaaccttcatctcggagtttttgtaaacatcgccgtaagcgtgacgtgcaatggttatcggctttttccagccgggcagcagaggagtgataccctttacgataatgggggctctgaatacggtaccgtcaaggatagcacggatagtgccgttgggcgacttccacatttcctttaagttgtattctgtcattctctgtgcgttgggagtgattgtagcacactttaccgctacaccgtatttctttgtagcgtttgcggaatcaatcgttacctggtcgtttgtttcgtttctgtgaacaagaccgagatcgtaataatctgtctttaagtcaacatacgggcagataagtatatccttgatcatcttccagataattctggtcatttcgtcgccgtccatctcaacgatgggggtggtcatctgaatctttgccattatagccgttcctttcgatattacttgttgtgcttagtgtagttaagcagaccgcctgcgagcatcatacccttgccacgctcggataattcgcaggtaaccttgtattctgtaccctttgttatattcttgacggttatctcagtaccgttttctatagcgtttcttatgccgggaagctcaagaacatcgtcacggtcgattttgtcataatcagcctcgtctacaaagcacagaggaagaataccgttgttgataaggttctgtctgtggatacgggcgaacgatttgcagattatagcctttacgccgagataaagaggagcaagtgcggcgtgttctcttgaagaaccctgaccgtagtttgcaccgccgacgataatgctcttgccaagctcctttgctcttgtcgggaatgtttcatcgcatactgtaaagcagtattccgaaatcgcagggatgtttgaacgcagtggtaatatctttgcgcctgcaggcataatatggtctgtggtgatattgtcgccgaccttgagtgaaacctctgcctttatatcttcagccagaggaacgtttacggggaagggctttatgttcggtcctctgagaacctcaacgttgggagcttcctcaggtgaagcgggaggaactaccatattgtcgtttataaggaacttttcgggcattacatagggaggcatatctcctgcaagtctgggatcggtgaatacgcctgtgagtgctgagattgcggctgtttcgggagatacgagatagatctgaccgtcctttgttccgcttctgcctaagaagtttctgttgaaggtacgcagagaaataccctttgaattgggcgactgacccatacctatgcacggaccgcaggcactttcaagtattcttgcacctgcgccgataagaattgataacgcaccgcagtctgcaagcatattgaatacctgctttgagccgggagctattgaaaggcttacatcgggatgtaccgtcttgccctttaatatatgagcaaccttgagcatatcctgtaatgaggagttggtacatgatccgatacatacctgatctatcttgattgcaccgatttcttttacggtttttacgttgtcggggctgtgaggacaagctgccataggaacaagctcggagagatcgatgttgatttcttcatcgtatacggcatcgggatctgcgctgagagcaacgaagtcttcttcacgatcctgtgcctttaagaaagcaagagttgtttcatcggaggggaatatagatgttgtagcgccaagctccgcacccatgttcgtgatagttgcacgttcgggaacgctgaggctcttaacgccttcaccgcagtattcgataaccttgcctacgccgccctttacggacattatctgaagtacctttaagattacatcctttgcggaaacccagtcgttcagttttcctgtgaggtttacctttacaaccttgggcattgttatgtaatatgcgccgccgcccattgctaccgcaacgtcaagaccgcctgcacccatagcgagcatacctataccgccgcctgtgggggtatggctgtcagagccgataagtgtcttgccgggcttgccgaaacgctcaaggtgtacctggtggcagatgccgttaccgggacgtgagaaatagattccgtgtttctttgcaacactgcctatgtatctgtggtcatcggcattttcaaagcctgactggagcgtgttgtggtcgatataagcgagtgaacgctcggtttttactctgtcgatacccatagcctcaaactgaagatatgccattgtaccggtagcgtcctgtgtcagagtctggtcgatatgcagacctatttcagtgccttttatcatctcaccgtcaattatgtggttcttgatgattttttcggtaagggtaagtcccttgctttcgttgtttcccatttttgtcctcctgaaaaaaagattacagttaattatacattatattaaagtaaaagtcaagaatttgcaaccgtttatgaaagaaggagtgtgtgaaattgcaaaaaattatttgtggatgttgcacaagcgacaaaggagtttattagaggatttatagaaattcgtttctgagcgatccgattttatgaaatttgagaaaataaacccgtttcggttgacttcaacagtagaaatattgtataatttactgtgtatcccgtatttacgggagcttttacgaggcgtatttactgcgtgctgaacaacattaacgaaagatccgaggaagatatatgtccgtaaaaaagaaaacaggtataatactgctcaccgcagccgcaatggtaatttccggcggatgcggcaaagcgttggtatttgataacgaaccgcaggatacgaccggcggaaatataataagcggaattccgttgacggaaagcaaggtaaagcccgcactcagcatacccgaacagacaggctcgcatactacggccgaagcgaccgcaacaacaaaaaagaaaacagaaacctcaccgaaggaaaattcatcctccgatgagccgtctgtcgatacgtcttatgacgaaccgcccgttcccgatgaggagattccgcctgtggaaactgtgacatcggctgctacaacaaaaaaagatgtgactgtaacatcaaaaaagaatgataatgttcctgccgccaccgataatctgcctgtaaacagctatacggcactgaattataacgaagtgaagggcgtatggatatggtattccgaattgtacccgattcttaccggaaaaagcgagtcacagctcagaagcggaataggcgagtattacgataactgtctttcacttggcatcaatacggtctatgttcatgtccgtcccttcggtgacgcaatatataaatccgactattttccgtggtcaaagtactgcacgggatatatcggaaaagatcccgacgcaaagccgttgcacgatgcaacggcactaatggctgacgaggcaatgtgatgtgaaaccaacagagcgttcataaagaggcaaggatgccttagcgtgtgtgcccaagggctttaagcacggatgcttacaagtggccgcaaaaagtcggtatgcaaggatgcataaagtcagtcacacaaagccgttgcacgatgcaacggcacaaatgactgacgaggcagtgacgcaccgaccgcaaacgaccacgattgcaatggacgcaaagccaactaagcacacacagacactcgccctacgaaaagcgagggtgatagtgcggacgcgaaaccggcagagcgttcatatggcaaggatggtggtgcggagcgaggaaattgaaattgcttagaagttttgaagatggtactcctattaatttcaatccccaccgtcttgacggcagaccgacttagtaattataaaagtcggatatatcgcataaaaacgctgtaaaatttaggcttgtgccttgccgtcaagccacctccccttttttgaggggaggcaagggtgttggtgcgaagcaaaggtaatgcgaaaccggcagagcgttcattaaaaggcaagggtgttggtggttttcgagggatagtgcggttttttgaaaggtctatgtcagtgtagttgtaatgatgtactcacgaaattattaatgccttgtcggtacggaaactgttttaagcagtgttggcgatacatttcattatgctgtattaataatcggtttttgtttttatagcacagggatattaattgctctgcgttttttcgtcatcggtttcttcggtatccttatggttcatctctttttcaagcaacggtcttaacagcgaataacgcagcatcttcctgttgttatccaccattgttttcacaagctcctttgtgccgataactattatcattttcttagcacgggtaactcccgtgtaaagcagatttctgtaaagcaggttgtgcgtgaaggcggttatcggaattatcaccgcatcatactcgctgccctggcttttatgtatcgtgatggcgtaagcgtgttcgagccttctcagcatttcggaggtgtatatcgctactctgccctcaaagtctatggtcacgttctgggaaaagcggtctactgagcggatgattcctatatctccgttgaaaattccgcttcccttttcattgttttttgtccacagcacatcataatcattcttcgtctgcattaccttgtcgcctgttctgaaaataacatcgaagaatttcagctccgccttattctgtgacggcgggttcagtgccgactggagctgtttattaagctcttttgttcctgccatgcccatttttgtggggcaaagcacctgtatatcgtctattggcgaaaatccgtaggtgtcgggcagacgctgttttgcaagctgtatcacaagctcggcaatatcgctttcaagcgacttgttcataaagaagaagtcgttctgtctgtcgtcaagtacaggaaattcgccatttactattctgtgggcatttgttactataaggctctgcgccgcctgtctgaatatctctttaagctccacggacggaatataatgcgacgctataagatccttcagcacgtttcctgcgcctacggacggaagctgatttgagtcgcctaccataatgaatttagatgtgggctttatcgctcttacaagcgaacacataagaagcgcatcaaccatcgacatttcatcggctattacaacatcggcagggagcggatttgtttcgttgcgcttgaatttaagctcgccctttgcggtaaaatcgacctcaagcaatctgtggatagttcttgcaggctcgcctgtgagatcggacatacgctttgccgccctgcctgtcggggcacacagaagtatgcgtttcttctgcgctttaagaatcttgataacaccgttcaatgtcgtggttttacctgtgccgggaccgcccgtcagaataaatacagagcctgtaagacaggcgctgatagccgcacgctgaagatcctcgtactgtatattctccgaaaactctactcctcttatctcatcggaataatccttttcatactgtgcggaggttctcaacataaaggcaagtttttttgcaatataggtttcggcaaggtagtattcggggagatacacaaactcacgctttccgagcgtaatccttactacccagtccttttcctcacagtcgtcaaggcatgattcaaactgcctgcgttcaatcccgagattatcgcagacggattcacgcagtttttcagtcggcaggcaggtatgacctgcgtttgcgttttcgtgcaggacgtacactatacctgcccgcacacgatcgctgttctccgcatcaaagccgagatctgccgccatacgatcgaccgagcgaaaatctatatctatgccgcttgtgcatagtatatatgggtttgtcttaatctgctttatgctgtcgtgctcaaatgcagaccatacgcttattgcgtgggcaggtccgaaattatattcgccgagaaattttatgacctcgtttacgcctgttatcttgtgatattcgtttgatatgtacagtgccttgtcggaggttatgccttttatcacggtgagctgcatacaatcgttatctattatatccagtgcttccgtaccgaactgctttactattttctttgctatggcggggccgagcccttttataacgcctgagccgagataggcagatatttcgctttccgtttccggcattgagcgctcacacattgccgccttgaactgtctgccgtactttgggcttgttatccatccgccacgcagactaagccgttcgccctcgttcacatctcccagatttccgactaccgctataagcccttcgtcacaaccgagatttatgacagtgtagccgttatcagcatttttatatataacgtcctccacagagccgctcagctctacggaaatatcgaccttctgattatccaacacgcagcctccagttcttcagattctatatctgttttttctttgtcgctctaagtgtcactctcggacagtcggcgataagattacggcatataacggcgaactcgctgtcgctgagtaattcttcgccggcatttattataaccttgccgtctgtcgctttaagggcggctcttacctttccctccacatcgtcacagccgtcgggcgttacgctgacaggcggtgcggcgggcgtgccgagatttccgatgaaaagaataacgttaacagcccccataataccgagaaaaatcatagcgaaaagcattaagtatgcaccactcataagatcaactccttctgacagtttatctcattatatggtgcatacgcattttacgttacagattgcaggtgcagagaatagcgttccagccctctttttccgatatgctttcaacctttatattattttcctgcagtgccgacagcacctcgtcaagacgctcggtgataatgcccgacactatcagcttgccgttcttctttaaaaatccgctgaaatagggcgacattgacacgattacatctgctactatattggcggtaattatatcaaagcctgtgcctatcttctctctgagcggctcatcatcgcttatatttcctatgtaagcggaaaccatatcactgccgaagccgttcttttcggtattttcctttgcggtgcgtaccgagttttcgaatatatccaccattaccgcctgctttgcgccgagcagaagtcctgcgatggacagtatgccgcttcccgtaccgagatcgagcattctgtcgccctcgtgtatctgcttttcgagaagctccattacaagacgggtggtgtggtgctgacctgttccgaatgacgaagcggggtcgatctcaagtatctttctgccgtctgtgttctctacttcttcccagctcggctttactatcagctttttgcctaccgtgaacggcttgtaatactgcttccagttatttgcccagtcctcctcacgcacgcaatctatcgttacgtcaaggcttccgtaaaaatcatccgtatcgttttccttaagctcatcaagagtgccgccgagtgcggagagcatatccgtcccctgctcgttatcctgcacatagcaggttatatgcggctctacggttttaagtcccataaggctgtcgtctacataatcccagttatattccttgttttcgaggaactcttcaaaatcggcgggatcgtgaattataaatccattaagtccaagctcggacaggcgcattacaagcacctgtattgcttcacttttcgtatatacatctacctgtctgaattgcatagtaatacctcttgttttttatttgccgacggggcataaatatctataatatattatcctacatttcggagaaaaaagcaagtggttaacgcaaaaatgcaccgcccttataaaaaggacggtgcaaaacattcaaggaagaacctatgctgaattctgaattgccgttaatcgttatcctgcagagcctcgtaagcctcttcgcctgtacgaaccttgattacattttcaacgtcgtatacgaaaatcttaccgtcgcctatcttaccggtatagagtgcgttcttggcaacctctacgaccttttcaacaggaaccttgcaaactacgatctcgaccttcatcttgggaagaagtcttgcgtctacgggaacaccacgatagaactcagttgaacccttctgcataccgcaacccattacatgagataccgtcataccggtgatgccgatagatgaaagtgcgtgcttgagaacttcgaacttctcctggtttgcgataatgtctacctttgtcatctttacatcgctgtcgctgataggagctcttgcctttgaaacgtgctgtacgggtacagaggtttcaacaggagcagccgtagtaacaactgctgtatcttctgcggaagaaccgctgtatacgctgtcgcctgcgataacgaaatctgcgtaggagctgggcagaccgtgttctgtcgtatcaagacccttgagctcttcttctcttgaagctctgaggccgatcgtgtgctttaagatatagaatgtcaggaacatcgttactgctgcgaatgcacaaacagcaaccacgccgagtgcctgtatgccaagctgtttgaatccgccgccgtagaacagacccgtgatgccgttctgacctttgcctgttgcgaataagcctactgcgagcgagccccatacaccgttgaagaagtgtactgctactgcgccgacagggtcatcaactttgagcttgtagtcgagcagccaaacaccgaagcaaaccagtaagcctgaaacaataccgattattgctgcaccgagtgcgtctgtgtctgcacagggagctgtgatagctacaagtcctgcgagcgatgcgttaaggcacatcgaaacatcgggcttgccattcttgagccaagtgaatatcatcgttactaccgttgcaactgcaggagcaattgttgtggtaaggaatatatctgcgaggtaatctacgttggaagctgcggcaccgttgaatccgtaccaaccgaaccagaggatgaatacaccgagtgcgccgagagggatcgagtgacctaagatagctctgggcttaccgtccttgctgaacttgccgatacggggtccgaccattgcggcaccgataagagccgtaagaccgccgaccatatgtattgccgttgaacctgcaaagtcaacgaagccgagctgtgcgagccagccgccgccccaaatccagtgagcctcgataggataaacgacaaggctgataacgaatgagtagatgcagtagctgatgaactttgtacgctctgccatagcacctgaaactatcgttgctgcggtagcgcagaatactaagttgaatacgaactctgcacatctgttgaagtctgaaagctgagtaagaacgtcaagattcggaacaccgataagtccgaagaatgtatcttcgccaagcatcagaccgaagccgagaagcacgaatgcaatcgtaccgaggcagaagtccattaagtttttcattataatgttgccggcattctttgctctggtgaaacctgtttcaaccattgcgaaaccgcactgcataaagaataccaatgcggcaccgataaggtaccatataccgttgccgtcgccgacgttgaacatcgtggcgttaacggtttcctgaattttgtctgccgactcggcagcaagagttagcgtggataagaaatccattgataaccgcccctttcaataggtaattttctgactgcggctgtgccgcttttttcttgaaacgggtctgaaaaaattctatctgcacccctctgcgcctttgcagatactgcagaacttttgcaatcccgcttaaaacaaaaggagccgcacgaactttttgtgttcgttcagctccgttgcttacaagtattattatactgacggcggggtgatttgtcaacgcttttttgcaagttttttatttgtttcttgcattttgtcaaatctgcataatatcttgatgaatttttcgtaaagtgattatgcagttatgccaacaatatatcggaaatcggattgcggatatgactgattttcgggcttttcacttctttttatcggaatcgggacgttttttgtcaattatgacgtatgaatgtaaatatccgtcatactgcagattcctgcagttttaattcatttttcggtgtttatcctgaataacgggcagatttttgcaacagaagttcgaatttctcgcaatatttatgtaaaaactaccgcctgtacgggttctgaaatcaaaaaaagcgacaggtaaagccatgtacggcaattcaagggcggagccaccgtaacttctgtcgcttttttagtattatatgctttttatgtcacgctgtgaatattcttattcctcgcatctttccgccatatacattccaagctcggcgaacacgggcggtatatcgtagactgtcctgccgtcctgttcgcacattgtgcattcgcccggagttgcgggagagagcatatccgatgcggtgacgaggttattctccttgcgtatgccggcattttcgaaaaatccgtcataaagggtgctttgctcatcgttacggtacagattgacgatgttgtacttgcatatcatcatttcatcgtttgttatatgagagccgacgccgaactgtgatattccgtcatcgagaagtatttttccgacaatatccagcacatctcttatcatagcggaggtgcaatcgtcaagataataaatatccttgtggaaagtgatgatatttccgttttcgtccttaggctcggcggtttggggagtgggtagctccagaataaagaacagcctctcgttttcgtgcagttttatgaaatcctcaagcaacggcagagttttttgtgccgatacgtttgcggtgaataattttccgtccgttttatacccttcgctgagcttatcggcaaagggaatcgaaaaaccttttctcatagtaagcataatttatacctcttattttcttcctgccaaatacattaaaaccgtcattgcaagcccgaacgcaagtccggatgctccgaacgcacagagccacccactgtcaactatcacttgtaacgcctcaacggcactgctcccgacaaacatttcaaacaggaacaaaacaatcatcataccgagcgccaagaaaacgccgaataacagacccatcagcattccgacaggaaggaacgacaaaagattcttatcaacgtcagccgctttacattcctttcgtgtaagctttttcagctctgctctctttacagctattgcggcggcttgtgaaatatcctcgtttcctgcacagcacgaaaagcttttttctatatgataaccgccgttgcggaacatacttgaataaatatcagcattactatagtcaaagccgtctttcatcacaatagttccgcttctgaatataattaccgtctctccgtcggagcacatttcatcgcagtgtaccatataaaggacattcttctcacaaccgaccaaatacgccttatcatgactttgagtcagatgcacacctttaagctcacctgtttttctgaaatcaggataaacgccctcatagcctgctttataaagcgtatcggtgatattttttcttatcctaatgttttcgggttcaagtccgattatttccgatatagtgggataatccttgcaaagcccccaaaaaatcatatacaattcacgccagagcggttcatatttcacgtcatcaagcccgctgaaacgtttatttgaaattcctgttttagcacgtctgacattctttaagatgattgcggtaaactcattcaagccatacttttcggcataagctgtaagaaccggcaatttatatacaatcctttcaaatggctttataatgcgtaatttttatgtactatatttaatgtaattttattttaacattttcgctgaaaaacaaaaagacttagcgcaattacttttacagtaatcacgctaagccataaatttataaaaatgttaaaattttattaagaaacactagctaaaaagctagctgaggcacttaaagtaacgctcgatgaactttgcgcataaacggcatcgccgggctatttcagtcctgcgataattttttcctgttcttttttggacagctcaagcgcagtcatgacctcttcggaatagttgttttcctcggctatattccttgcgacagcaaagtttataagcgttgacggctttgcaacggcaatgcgctcaccgccgaagtagccgacaagcttgcggtatgcttcgataccgattacctcagctatttccgcctgcgttcctgtcagatgctttatctgcagataatcaagttttgattttgccatcggtacgctcctttctgcgcttttccgcccgaacatatcgtttgatcgtgtcaataagctccgcaccctgacgttctgaaaagcctttgaaaatgtcatatttcggattgacggtaataccaagctcttttttaataatgccgcatagccgttctttgacggtgaccgctgacggggacagctttgcaaactcatacataagcccgaaaatcttgcctatctgagcgttgcttatatatgccttgacctccggggttattgcccggaggttagcttgcaattgtttgattactatgtccgcctgctcatcgttcagttccgatatggactctttgagtgtgagttgatacacaaagccgtgcagatcatctgatttattcccatcgtcgacaagtccgcacttacgtccaaggctgtagatgtatctgcgtttctgctttatatccatgttacaccgtgattttcgtagtatcagataccgatatagcactgttgattgctctgatgacctcttctacagtgcgcttactttcaatggtatctaaaacagtcataaaacgctgccattcaagcgattcagcgaaaagatatgcgtaatccgctgcgtcctcttccgaaaatcctccaatggcaattaggtttttacagtctgtgaggaaatttgcgcctttgagtttcttgcgaagtgcgctctttgcggaatcgtcgcacggtaactgatcgtaaaactcgtctaccgtcagcttgcgttcagggactgcgatgtcggctgaataaacgcttgcaaatgtgcgctcaagttctttgcttttgaaagtatactttggctcgagcgattctttgatgtagtcaccgaacgcatcacccatcaaacgcttcagaacggcaggagatataatctttactgttctggcttcggtgtatgtaacgtcatgtccgtcatcatcctcaaaactgcatgttcttcttttactgtcacggagcttatcactgccaagcttcaaaaagaacgcttcaagctccttgaatttaagctcaagttcagctttttcttttgtcagctttgctatttcggctacttttgcggcaattatttcattagttactgtcattttatcaccgcctttgacatagcctcggcacattcggcacagatatccacgccacgataatttaccgcattggtacgattaccgcagaatctgcatacgggaacgtgttttctgatacggatttcaccggtattgtcatcgaccgtaaggtctatcgcttcaccgggagtcagacctgcatactcgcataagtcttttggcagacaaacattccgcttagctgtaagtcttttacttttcaacattgccataatagttcctccttgtttttattgctccactctgcatttatacgggcttgtgaccgttgctgatcagcagctgcattagagcagggagcttatactccctgatttttatagatttttcgtctgtagcacccgaacccgataatcgggcgaagcttgtttttgcaagttggagtaccgtctttatcgagatatttgtactcacaagagtaacatttctgtgccgtatctcgcttttcactttcgggtgtacgcattttatgtagattatttgatttcacgctgcttctgacctcttttcttcttgattgccgcaatctgcgataatcttgctacatagttcggatttttagcgacgaactcgccgtacgacataccgcatttcatagcttcggcaactattacctctatctgttccatattgctcatttctttcaccacctttagtgcactctgtcttttcacgggcttgtgaccgtccacggcgacattacacgggagctttgctcccggaggttattctgatttgcctttgttatagccttttttatatccactgttgaagatcttatctgctactattatgctgaagtacatttttgcaagaatccatcctatgtagagaattacgagcataagagggattataagcacctcgccgccgattgagttgtcgggacgatcggcaacggcgtttgcataatcaattacgcttacggtcgctgttccggcaaaaaacgcagcggcaagcattaacacattgttaataaactttctcatttgttataccattccttttttatcagctttgtctgtctgttgtgccggcagacaagaagcattattgtcggtgtatctttagctatcaaccagttatccgggttgatgtgcgctcgtttcagaaaatcgtattgtgaccttgtaggtttcttcccgtgcatattgtcacctcacaacgcttcgtacatcaattcgcataaactttgccatagatgcaagacctttaagggtataacatccgttgtcatacgcctgcgaaaacaatctgaccgctcctctgagtccggcttcgctctgagcaactttgtgaagaaactcaagctcctgctccatgttagaagaaacgagcagaggaaacatcatatccacgtcctcacgcttgatgtcagtagtaacgaatttcggcgagagccacttacggttgttgatctgacggtaatttctccgggttttaccctcgaatttttcttcaatgccattgtcacccacaaaagcaacgccgagcgtctgagctctgtcggaaaaataatcggcaaagctacggatagtttctattccgtggaacgtcagaagctgaccttcgtcaattatgataaccataccgtcatgtagcttctgcgctatcgcaagccacagatcatcggtagactgtgatatcggaacattcagctccagcgctattagcttcagaacagcttttgccgacttaaagcaagggttaacagtgataacgatactgttcagcggattatccgaatgatacttctgaacagcttttgttttaccgataccgctgtcgccggttgcaatcgcaacgccgcctttgatctgacaggtcttgatcgtctgatagatcttctccgatatgcttgtcggtgcataatctacctcgctgtagccctctgcgccttctgtcttggtgtcaaaatatgcggcgagctttgcaaactgtgcatccttatttccgctgtatgcacccttcttgagcattgatattgtcgatgccggaatgccgatgcgatttgcggctttgtttgccgagcccatttctgccgcaagctcgtcaaatttggcgagcagtgaaacttcctttgtctgttccatggtttaatcatcctttccgctttaatgcgttattatttatcttatcaatgtcgatgaatacctcatcgacatcggatagaacggggttgtccgccttgaacttatcagaaaatacaggcgtgaactttgtcggcttttcaattctgaacctatctttgcctctttcggcacggttgatagtagccgtcaggaaatcaatagcctgttcctcagtgattgacgctgtcaagcccttcgaatagtcgtgaacggcgtgagtaacagcacgaattgtcttttcacctgcggctatctcgttaggatcattagtaatatacggtacgttcaaatctgtttgtagcgtccatgtaaagcgatatgcgtctgttgctttgtcatagacacgcaccgtcttatattccgcaggatcatagcgcacatagacctcttcgccttggtacttccacgcatcttccgctgagtaccagagcttttcacctgcaagctcgatgtaaacgccgttgcgcttgattttttgataccgtgtcgttctcgcaagcagaagcgaaagatcctcgtcttttgcttctcggaaggtggtgtacttgattgattcgttccagacctcaattcttgtcatgcccttgtatttgcgttctttgccaccgtactcatcgacgttgaagtcaccgtcgatgaggatttcgagcgcagctcttatctgatcgtcttcgggaacaatgccgtatttcagcttgtatttaaggctttccgggcgttctataatagtaccgccgcagaaagtctcgattactcggctgatatggtttttaagtgtgccgaatgtacgctcaataggctttgccttagcgtttctgacaattgcattgtgcattgtaatgtcaagcaattgcaatatagtcggcggtatatcgtctgcattccatgtctttcgtgttctgtgacctctgccacctatatcgtgcgtaaggaactcagatccgttatcaaaataaaccgatttcggaacgccgaaacgctttattgcgtgtcggagtgcaagcaaagtactgtgtgaatcgggctgctccgttaagttccagccgaccaaaacgcccgattttgcatccaaaaatgccgttaagtacattctgtgggtcttctgaccgttatcgcagtaggtcataaaatcaaatgtatggttatctgctatccatacatcgttagcctgcaggtcgtcatacatacgctctatgtacggtatgtacttatcggtcatagccttttcaccgtatctcatcagtgcaattactgcctgagggagcttttcagcttgcctccgaaaactgcgctctgaggggatattgggtaaatcttgcggataaaattctcgaacccattcgatcatcagctgatagcagcgtgataccggaagccggcgctcgtcaaggaagaaatacataaatgcgtcaagtatatgcttcggaatatcggtgtgacctttattccagccgcctcgcttatctatgagcccttcaatgtcaccgttcttgtacgccgcatacttgcggtacagtatatcggtagatatttctatctccgggtgatcaagctgcatttttgctacaaacagcagatctgtatcggcttttttacggttacttttgttccgatacatctcccagaccttgagtatctttatccagtcagccgcttgctgtctttcgttttccgtgtactcctcgaatggctttgaaactgcctttgaacgctgtttttcaactgttttaggcggtgctatttcaagctccttacgcttggagttataataccgctcacgggttttttcgtccatctgatcaatgtcaaaaagatactctttgcggttatttgccgcatcggctttttccgttgccggaagcttgcctgacttagctaattgtctaatgtaacgtggcgtgcaacctttaatagttgccagctctgcagtgcttatcattgcacccatcttgatcaacctcctttctgacctgcaattagatattgcggtcgctcccgtcagggagttacacaatatctatggttcattaagcaacatgacctgccatcatcagtacagggcggtcattccctgcagacgggctgttgcccgtttcggcttaattgtgatataataattgtgagaggtgtaatagtatgcaacaattaacacgagatagcgaaaaaatgttaaagtatattttcaaagcagcagaacctgtgaaagtttctgcgcttaagaaacgatttaaagcttctacaaaaatatcaataaacgaactttcggatataggatatatttacattgcttctaagttatcaagatggggtgaacctttagaggaagtaaaatatcaaataacggaagatggtgtattgaatattaggaagactatagacgaaagaagaaggttaattcttaatagcgtcataatacctatagcagtaagcattgtaacaaatctgtcaataatcttattacaatggttactatcatagcgactactgctggaattatgtaagaatagagaatttttttcttcataaaaacacactttccgacctgccatcatcagtacagggcggtcattccctgcagacggaaaaccttgcggctttccgtttcgacaaataaataaggaaaggatctgtagcaaacttcaagcagttagctctcggtctgcatgtatgctcgtctttccgagctgtcatcacgctcctaccgatttttgcgcttcgtttgtggtgagccagtcaacataatgcgctgggcttgatacgctcaagcgggcgagctgacactctgttgttatcgcttatgggtaagccatacggttaagcacctgttgaggaataggtatcctgtagtcgacaatttggaagcggctttcatctcacacctcccgatcttccgtcgggtaaacgcacgaccagcctgtgcggtttcattccgactaattttttatcccggatttccttccggcggtcggcgggtctgggcttgatacgctcaagcgggaggctcaggcaagtgtgataaactcgcccttgcagtaatcaaacgctccgacataggagtcgtcaacaaaaacattgccgactgtatcggtatcggcatctatatcaagattgcccttaggcagtccgccgtgctcacgataccagtctgtgaggattctcttcttatctttaatgctcatttaaatctccttccgagtatttcgtctgtggtgaccaaaaacaaatctgcaaggcaacagagattagcgattgataatgttttattgccaagctcccaaccacacacagccgcttttgatacgccaattgcatttgcaacttccgcttgcgacataccatgttgctcacgcaaacgctttatattatcgttataggtcattcttactcctttcgcttgttttcgattgacaccgctcgggcggtatgttaaaataactatgggtaagtgtgccttattcgtttacccaagtaaattataatcccaaaatgtgaacttgtcaataaaaatattcacattttgggaaaatagatgttttaaacagaaaggatgaggacgatttgtgcataattgacaacattctgagccttttatccaaaaagaaagtgaatcaagttgatttatgcaaacatattggtgtaagtacaagcactatgacaaactggaagattcggaaaacagatccacctgcaagatatattatcccaatttgtgaatatctgagtgtttctccgatgcttctgcttactggagaagaagctaacagcaatgctatttctttggatgaagaagaattattaactaactacagagcggtaaatgacataaaaaaagctcagatcagagagagagccgccgtccttgctgagcttgaagtggcaaagaaaaagaataatgttcaaacacccttaaaacaatcattaaaacggactgaaacagaagaaaaacaagaaccgcaatacatatccctgccgttcccggcactcccggtatccgcaggagccggcgagtatcttcacgaagatacaacttcttatataaaggtaccggcaacaaatcttaccgggcgggcttcttttgctcttcgtgtccacggagattcgatggagcctgattactttgacggagatattgtgcttgttgatgccgatgcggacgttaatgtaggtgatgtaggaatatttattgtgaatggagaaggctttatcaagcagagaggaaaagaccgtcttatctctcttaataataagtataaggatatcagaatcagcgcagatgatacttgcgtatgtaagggaaaggttataggttcgctgtaaaaaggaggtttataataatgggattacgtttcagaaaaagtattaaactcggtggaggattccgccttaatcttagcaaatctggtgtaggatatagttggggtacaaaaggattccgcatatcaaaatcagcaaaaggtcgcacaagaaaaactttctcagtccccggcacaggtatttcatattctacttcgtcgggaaaatcaaagcggcgtaaatcaacaacagcaaagcagaattattcacaaagcaatacagattttacagagcagattccggttgatcctaaagttcagcgtattaaaaagattgcgattacagcaataatcgcaggacttgttctcatgatgatcggacatcacgaatccgatcctttacatattacactcacttcacttgggtatataggtcttatgctgtcaggcaaccttgcggcaataatcgcagtattatgtaccgctatacccggtcttccgacgccgttcacggctgttcagctcctgtttataaatcttcttaccgactcactgcctgcaatagccataagtatggaaaaagcagataaatcgctcctttcgcaaaagcccagaaatacaggcgaatccttccttacaaaagcaatgtcgctcggcatagtgacaggaggagtgcttatcgccgccgctgtaatgacagcctactttatcggaagcgcagtttcagccgagcttggctgtgcaatggcattcagcacactgtgtatatcaaggctgtttcacggcttcaactgccgcagtgataaatcaatattcaaagtcggcttaacgtcaaacagattctcactacttgcttttcttgcaggaataatattccttgttttagcggtattcgttcccggtgtaagcggcttgttctcggcacagcttatgaatatcggatatttcggtatctcgcttgcaataggctttgtacctacgctgataatacagcttgtaagaatcatcagagaagcacgcagaaaataatctgcgaccgatataaatcaaaagcagttctgaatgaaaaaaaggtttacatttcattttgtatatggtacaataaaactgcggtaataccgtaatttttgtttggatggtaaatagtatgagcattgaaaagaaactctggggcaatcataacggaaaggattgctacttattcacgcttgaaaacggcaatatgacagccgagattacaaactacgcaggctcgcttgtaaagctgattgtacccgataaggacggtaacaagggcgatatactcttaggctatgatacgcttgacggttacatagcaggaacaagcagtcagggcgctttagtcggaagatatgcaaaccgtatcggcggcgctaagttcacccttaacggcaaggaatatactcttgccaaaaacgacaacggcaacacgctccacggcggtaatgtcggcttcaataagaaggtctgggatgtcaaggatttcggcgaaaacggcaatccctatgtagtgttctcctacacgagcgttgacggcgaggagggcttccccggaacgctgacgcttgatgttaagtacactctgacagccgattcgattgagatatgctataatgcggtaagcgacaaggatacggttatgaatttcactaaccactcgtatttcaatctgaacggaaccgacgcaggaaatatcaaggatcatatcgcacagatatttgccgataaatacactcccgtaagccctgtgcttatcccgacaggagaaatagcaagcgtaaagggtactccgtttgactttaccgcacctaagagaataggcgaggatatggataacggcaagctccccggcggatatgaccataactatgttttaggcgaaacaaaggaaatgagaaaagccgcagagatatattccgataagaccggcagagtaatgaccacctacaccgatatgcccgctatacagttctatataagcggcggtcttggcggcgaaacaggcaagggcggcaaggaaatgttcaagaatcagggcttctgccttgaaagccagttctgccccgactcacccaacaagcctcagttcaagcccacttgcgtttataaggcaggggagcagtacaactttactaccatatataagttctctgtaaaataagaaatataacaaaaataccgcaatcccatccggaattgcggtattatatatttattgtccgaaatgtgttgtttccttcggctcaagcgcaagttcttcctccttgcacggtctgacgatcagcttagatatacaattatcgtgaacctcgataaccttgaaaattatatccttatagcgaaccttcgggtgttcgccctcttcttcgggaatatatccgagcaggtcggtaacaaagcctgcgatagtgtcgtattcgtggtcttcttcaagctcatagccgaacagttcgagtacatcttcgggatcggcctcgccgctgacctcgtatgcgccgttcgagcgggggattatcatatccttttcctcgtcatactcgtcctctatgttgcccattatcgactcgattatatcctcaagcgtgatgatacctgccgtaccgccgtattcgtcaatcacaatgcccatacccgacttgagattagtcaggaacttgaacacgtccgaacaactgcacgattcgggaacatataccgcctcacgcagaaagtcctctattttcagcttatccttgttttcgtttccgacaaggcagagaagatcctttactatgattattccgactatagcgtcaatgttttccttgtatacgggtattcttgaaaagcccttttcaagcgcaatatagacaatatcgtcaagagatgaatttacatctactccgacaatgttctttctgtgcgtcattacatccgatgcgacaagatcgccgaactcaaacacgttgtttatcagctgtgccgattcgtcctcaaggttgccgtattcgttgcccgcatcgaccatagacataatgttgtcctgcgtggtttcttccttgtcgtagtagctgtcgccgagtgcctttgataacagcttatcaagacctttgttcaataaaatcagcggtgcaagcagtatctttaccgctcgcttaggttttcgggggtctgcgtccattttgtttcctttcaaatatcaaaatatatttttcggcagaacttcgtgtcctgccgcacattgtagaaaagctctatcttttaataatggggttgaggggcgtagcccccaatagggtcgaggggcgatagccccagcaaaatagccccggcacggatgccgggcgtgtatgcccaaaggctctatgcaaggacgcatacaagtggtcgaacaaagtcggtgcaggacgcaccgacaacaaacgaccacgattgcacagatgcagagccaacaaagcatacacagcccttcaccacggggaaggggtttggggatagggatagagatagagaattttctatatttttaaatttaattttcctcaaaatttcggcagaacttcgtgtcctgccgatatctttatatatcttaccatattttatgacataaatcaagactttatatcaagtccgaagaaacgcaccgcattttcattgcagattttaatagcttcttcagtcggtataccctttatttcagccagcttttccgctgttttatgcgtcattgagctgtcacagcgacttcctctgaacggcacgggcgccatatagggactgtctgtttcaagcattattctgtcacttgggataatctcgcacgaatgtacagcctttttagcgttcttgaatgtcaatacacctgtgaagctgatatatgcgccgagctttaatagctcctttgcggtttccggacttcctgaatagcaatgcaccacaaatttatccggagtagtgcggtgcagtattttcatcatatcttccgtagcgtcacggcagtggataacggcagggatggaaagctcattggccagttttatctgattttcgaatatctcctgctgtctttctgcatcatagccgtcatagtgatagtcaagtcctatctcgcctatagcgaccgcctttttattctttgcaagcgttctcagtatatcaatgtaattgtcgggtgtgtcggctatgttttcgggatgtatccctaccgcacagaatacgttttcgtaacgctcggtaagcgacagagaaaactcgcaggtcggaatatccacgctcatatttatgattgccaacacattatcggataaaatgcggtcgagaacctcatacctgtcctcgtcaaaccacctgtcgtcatagtgtgcgtgagtatctataattttcattacttcaatatctttacgctgtcacggataatcagctttccagttacaagcgttctgccccttgaataatttttatcccttatctttttgattatcgtttcgacagcctcataagacattctcttgctgtcaacatctatcgttgtgatacggggatttgaaatagtagagtagatgtggttatcgtagccgactatcgaaatatcatcgggtactacatagccctcgcttctgagctgattgagcaggcagtatgccgcctcgtcacagttgcagacaaaagctgtcggcttctgtacaggaaggtcaaagtgaggatagcttgtgccttcgggacctctgtcgtcaattacccactcactgcgcagcggtatacctttttcaagcagagccttgtaatatccgaggtatctgtcctgtatgcttgatgttgacgttatagtaccgaggaagcctatgttgcggtgtcctgcgtttataagatagtttgtaagcatataagagccgaagaagctgtctgaaagaatggtgtcggtacggttgtcactgctgtagaagtcaaggaaaacaacaggaatatcaaggtccagcagttcgcttacatattcatcgtcaaactgtccgagtacgattacgccgtcaacctttttatccgataccgaattcggcattgaacggttcgcctggtcgctttctgaaattacatcgagtatgccgtaatagttctgcttttgcagaagctccacgatatgacggtacattacccagtagaacgcacttgcgtcatttataaagtgctttgccactactatacttatgttgaatgtaaagccttccttcgatgactttgacgtatagctgaaacggtatcccatttcgtttgccttctgctttatcttctcacgaagctcatcgctgacgccgtccttgtcgcccagtgcctttgatactgtaactgtgcttatatccatagcctttgctatgtcgctcattgtaacggattttttcttcatcaaatcttacctctgtactcgtcaatttagctaataactttatatctgcctttatataatagtgtaacctaaaaccgagcttttgtaaagtaactttttgcacaaaaaacaaccgtatatatgcgttctgtttataaaattagctaaagttataattgtaacgctccgttttcactgttttaagcagattcagggtaaaaaacgtacactttttaagaaaataatgcgttctgatgaaaaccgttatcacgatttttttgaagtaaaaacctgcgctttgtaacaaatgataaaattacatatagaattttggtcaaatgttacattgaaaacggtttcacaatactgtataattgtaatatagtttaattgagggagagtatgctgatgagtgttactatcaaggacgttgcaaaggcggctaacgtttccgttgcaactgtttcaagagttcttaataaaaaatccaacgtttccgaagaggcgatacaggcggtaaacagtgctgttcaggcactcggatacagccccagctttctcggcagagatttaagaaaaagcgaaacgagaagaatacttgcaatcatagcgtcaacagagcagagcttctactcggacgttataagaggtatggaggtagccgcattctcgcagggctatgatgttctgattgctaccacccacgacgatccaaaccacgaaatgcatctgctcggtatgcttttctcaagagccgtagacggtgcggtactgctcggtcctaagctggacgccgcaaccatcaattcgcttggcgaaaagcataatatagcaatgtgccttgaacgtcttgacaactgtaacgttcttaccgtcacaatagataacgtaaaggcaggccgtgacgcagtaaattaccttatccgcaagggtcataagaagataggacttatcacaactttacagagaagccagtcgagcattgaccgtgagataggctacaagctggcactcaaggataacggcattccttataacgaggattacgtttatttcggcggctatgaaacagagcagggtatgagaggctgtgaataccttatgaacctgccaagccccccgacagcaatattctctatttcggatataatcgcaatcggcgcaatgaactatgcactttcaaagggctacaggataggcaaggatctgattttcatgggctttgacaatatccagtattcacatatgttcgtacctcacttatctacagttgaacagccgtgttacgctcagggcaagctggtaatcgagaagctgattgaaaatatgaaagcgacaaatcccgaccacaacctttatacattaccacacagccttgttcttagagaatccacaggcgattgatataataattgatataaaaaagcatcaccccgttcacctatgtgaacggggtttttacattactgttgttcggcgttattcttatttttctgctttttcggcttcttttcgtcaacctgcactctatccgggttgcagtcctcaaactcgaaccagaacgtactgccgacaccaaccgtactgtctgcaccgaaatttaacctgtgcatttcaagcacaccctttacgatagacaatccgagtccgctgcctttctttgcacgctgatgcgtttcgccgttcttcttgacacgatagtatctgtcccagacatatttaagattttccgggtcgatgcctataccgctgtcgcacacctcaagtcttgcggttgtcggtgtcttgtgatacagatttacccttacagtcttgtcatcacctgtataggtcagagcgttattgataaagttgtacactacctgatctatctttgtgatgtcggcgtttataaatatatccggctcagcattcagcaccacgttatagtccttgatttcattcagcagcgagaagcgtggtactatttcaccgagatgctcagaaaaattcaccttctcatatttaagctccgcaacgccgctctgcagctttgacagatcgagaatatccgttacaagcgaggtcagtctgtccgtttcatcaattatgacctgcagatgcttttcacgcttttcggggttatcgcccgaaagatccctgatcatctccgcataagcctttatcatcgtaagcggagtacgcagatcgtgcgaaatattcgccataagatccttacgcagagtatccgcctttgctatttccacagatgcggagctgagcgtatctgtaagctcgtttatctccgtaaagctgttcttcttcacaggcatatcaaactgtccctgcggcagcttcagcgccgcctttgatatattgatgataggttttgaaatgctgtttgagaaaatgattgacattatgaatgcaacaattatgataatacctgcggtaagattaagctggctgtgcagaattgcggtcgttgtgccgagcggctcaagataattgaatatatacagccttacgatgccgtttgttttaaagaacgtgctttccgtaccgtcgtcaagctgtgctatcagcacaattgccttgctgtcattgttcgttctcggaattgtagcggtgaagaacgtattttcgccggaaatgatttctttcatatcgtcaggcgaaaggctcgtgataagcgagtacacctctttgttgctcttgtcgagcgagcttgccctgaagtaagggcggttgctgtcggagatttcgatatatatcttctgcttgtccgcaatatccgaaacgatagaattgaggttttcgggctgctgcgaccacgcatactttatctgctttgcggcagaagccgtttcctgtatcttcatatattcgtagtagctcgaaagcagcactacctgaaaaaagtacagaaaaactataactattagcgagaacagcacaaatgtcagccatgaacggaaacgtatgctgtttagtctgtctttcattgaaaagcgccttcctgttctgatgtgtaccgatataatattacagccgccactcaagacggctgtaataagtatttatacctggaacttgtatcccatacctcttaacgttacaatgaattttctgtacgggccgagattgtttctcagcatcttgatatgagtatcaatggttctgtcgtcaccgaagaaatcatatccccatacctcctcaagcagcttgtttcttgtaagagctatgttcttgttcttgacaagatagaacagcaggtcgtattccttaggcgtaaggttagccttttcgccgtctatgaatacatctcttgccgtaaaattgatttcaagaccctcaaattttactgtttctccgacaggctcatttccggatttattacgtttgattatcgcattgatacggacgagtacctctttgggcgagaaaggctttaccacataatcgtcaacgcccatctcaaagccgaacagcttgtcatattcctctgttcttgccgaaagacctatataatttttgaaaatggggtttggggcgtagccccaagcggggtgagggcggcagccccacactcagccccttcccgaggggaaggggtttggggatagggatagagaatttgctcttttcttataaatacagactttttctacaaactgaggcagtgccggacggcgctgtctttttgcttttaaggtaatattgacatataaatctgaacaattaaaaccatacacgttttaatacccgccgtttcgctaccctgcggataactcagacaattccaaaggcggaatttggtgcggctcacagccgcccgccccctttgacttttcttctgttaagtgctatactttataaatagtaagacaaaacacggagatactttaaatggataacaaatacgaagaacggctcggcacagcctcgatgctgcctcttatacttaaaatggcactgccgggctttgcggcacagcttataaacctgctgtacagcatagttgacagggtcttcatcggacacatagagcttatcggcacagatgcgctggcaggtatcggtgttacaagctcgataatcattcttatctcggcattttcacagatagtcggcggtggcggcgcaccgcttgcctcaatagcgctcggcaagggcgaccgtgaaagagcgcacaggatactcggcaacggcttttcactgcttgtgctgtttgctgtagtaacatctggcataacctacatctttatggagcccctgctccgccttatcggcgcaagcgacgcaactatcggctatgccgcagactacctctcggtataccttacaggcacactgttcgtaatgtttgcaaccggacttaattcgttcataaacgcacagggcagacccggaatttcaatgatagccgtaataatcggcgcaatcctcaacataggccttgatccgctttttatctatgtgttcggtatgggcgtaacgggcgccgctctcgcaacggtaatatcgcaggcggtaagcgcctttataatagtcggctttcttgtatccgacaaagcgactttgaaaataaagccgaaatatcttaagcccgatataaagataatcggctcgctgttcgcactcggaatcgccccgtttataatggcaagtacggaaagtcttgtcggcttcgttctcaacggctcgctgagcgcatacggcgatatatacgtcagcacacttacggtaatgcagagcgcaatgcagtttgccgccgtgcctctgagcggctttgcacagggctttgttccgatagtcagctacaattacggcaagggcaacacagaccgtgtccgtctctgctttaaatattccgtgataattatgttctcgttctttgccctgacaaacctgtttatgattaccttccccgaatttgtcgcaggaatgttcacagacgataccgcacttataaaaacagtcggcagaatgatgcctcttttccttacaggcatgacaatattcggacttcagcgtacctgccagagtatgtttgttgctctcggtcaggctaaaatttcactgttcatagcccttttgcgtaaagtgatactgcttatccctcttgcccttatcctgccgaattttctcggtgtaaagggtgtatatcttgctgaatccgtagcggatgctacctcggcaatctgctgtacagttatcttcgctcttaccttccgcaagatactcaaaaagcgtgagcagacataaattaaacaatcaagcggtcacagggacagatacagccccgtgaccgctttttcttatgcgattttcaagcaccgcccgcacatttcccgtgccggcggtgctttacgtttatttcagaaattccgccagtatctgaccgagtaccctgtactgctcatcgctgagcctttttcttactgtattgttgtattcgtgaaaagcgtctataagcaatcgaacacaatcggcctgtccgtccgtaagcccgataagcgaaaccgttccggattgctgtaagccgcaaagatagtcaagcgatatattatgttctcttgcaattgagcaaagagcctcatacgtcggacgtttctctccgttttcatatctgcacatcatacttttatctatattcgccctgcttgcaaagtccttttgcgacatattcttttctattctgattttcttcagcctgttgccaaattcattcatacagcacacctctgattgcattttatgaaattatctcataaaatcgttgctaattgagcaattttgtgctattattattgtatgatggacaatttttatccgaataaattgcttaaatgcaaaaggtgattaagtgcaacaacaaataaaatccagacaacgtgttaccgaacacggcgaggttttcaccgccgagcgtgaagtaaaggcaatgtgcgaccttgtaaaacaggaaaccgagcgtatcgacagccgttttcttgaacccgcctgcggaacaggcaatttccttaccgaaattctcgcaagaaagctgtcggtcgtaaagtctgaatacggtcgcagtcctcttgaatatgaaaaatactcgctccttgcggtaagcagtctttacggtgtcgatataatggctgataatgtcgaaacctgccgtgaacggctgtataagcagtgggacaagcaatacaaatccgtctgcaaaaaagaatgcaacgatgatacaagaaaatccgtccgctttatcctgtcaagaaatatcgtctgcggaaacgcccttactcttaagtgcgtagacgaaaactgcaacgataccgaacaggatatagtcttttccgagtgggcattcgttttcggcagtaatatacagcgcagcgattacagctttgacgaactggtaaacggcaataaggaaaaggcttctcagctcaccctcagcgacagcacagaaggagagggtacttttttacggaaatatatatgcaactacaggaggttatgggaaaatggctgataatatttcaaccggaattttaagcggactttacgaaaaggtatacaaccccgatgttctgtcctgccttgccaatctctcaaacgatgaggttttcacgcctccggagatagtaaacaaaatgctcgatatgctcccgcaggagcttttctcatctcccgatacaaagtttctcgaccccgccgtgaaaacgggagtataccttcgtgagatagcaaagcgccttataaaaggtcttgaagccgttatccccgacagacagcagcgaatagaccatatttttaaaaatcagctttacggcattgcgataaccgagcttacaagcctgctctcacgcagaagcctttattgcagtaagtacgcaaacagtgctttttctgtaacacactttgaaaattcggacggaaatatccgtttcaagcgtatcccccactcgttcgacaagtccggaagatgcatcttctgcggtgcgtccgaaacgcagtacgaccgtggcgaagaacgtgaatattatgcgtatgaatggatacatacattacaccccgaggagatttttggcatgaagttcgatgttattatttcaaatccgccgtatcagttaaatgacggtggtggcacaggttcaagttctgtgcctatatatcacgaatttgtgtataagtcacttcaattaaaacctcgttatttatctatgattataccttctcgttggtatgctggaggtaaagggctagatgactttagaaacaatatgttgaactcaagcaaaatatcgacaattgttgattttgcaaatagtgctgactgttttcccggagttactattgccggaggtatttgttacttcttgtggggcttagaatacaatggagaatgtaaaataatcaatatgaatgcaggggaagaaatttccagttcaattcggaaattgaatgagtatcctgtatttgtaagaaacaatatagcgatacagattatccggaaagtaaataaagttacaaaaaattatttagatatgattgttcattcaagaaattgcttcaatttgttcagcaaggaaatcggacataatgaatataaaaaagaagattgtgtactgtattcgctgaatggcaaatcgtatatcaccaagaatgaaatatcagacagagataatttattgaacaaatataaagtgataatgacaaaagcaatgtcaggtggcaataaaccgtctaatgacggatcgtatttggtcatttcatcaacaatgcgtgtgcttaaacctaacgaagtatgtacagaaacctatttgtgtataggttcttttgaaaacgaaacagaagcaaataatctttgtgactatatgaaaacaaaatttttcagattcttactgcttcaagcactgacttcaatcaatatttctaaagataaatttctattcgtccccctccaagacttctcaaagccgtggacagattccgaactctacgaaaaatacaatctcacagacgaagaaataaactttatcgagtctatgataagaccgatggatttaggcggtgacaacaatggctgacgtatttgaaaagtatgtgacccctcgccccgaggtaaacccgactatctatgcctacaagctgaacggcgttaccactcacgacggctacataaaagtaggctacaccgaccgtgatgtaaagcagcgtataaaagaacagctccatacaagtgcgataagctacaccgtgctttgcgaggaatcggcaatgcgtcctgacggctcatgcttcaatgaccgtgacgtacacgccgttcttaaacgtaacggctttcaccgtcttaacgaaaacacggacaagaacgaatggtacaactgtaccgtaaatgatgtccgctccgccgtgcgtgagcttcgcacaggcgaaaggacggatgaataccgcaccgcagactttaaaatgcgtccggaacagagtaaagcggtagaccgcacaatcgaatactttgaaaacattaaaaagaccgagcctgaacgcataccaaaattcctgtggaatgcaaaaatgcgtttcggcaagaccttcgccgcttatgagctttgcaagaagatgaatttcaagcgtattcttattctcaccttcaagcctgccgtagagtcggcgtggagcgaggacttaagaactcacgttgattttgagggctggcagtacgtttcaaacaaggacgcacataataacaagcagaatatcgacgaggcatattacaatgccgacagcacaagaccgatagtagttttcggctcgtttcaggatttgctcggcactaacgaaaacggcggtataaaatacaagaacgagtttatccatactaccaactgggatatagtcatatttgacgaataccatttcggagcgtggagagaaaacgcaaagaagctgtttgacgatcccgacgatgaagatatagactttgacgcagaaaaatatcagaaggaagaagcaggaaatgccgtaaacgaaacctttctgccgataacctcgtcacactacctttatctgtccggtaccccgttcagagcaatgcacagcggtgaattcatagaagaacagattttcaactggacttattcagatgaacagagcgcaaaagaaaactggaagggcgaaaacaacccatatctgtcgcttccccgtatggtaatgatgacctataaaattcccgaaagtatacgctctgtagcctcagagggagaatttgacggcttcgatctgaatctgttcttttccgcaaagggaaaaggcgaggacgctcgcttcgtaaacgagaacgaggtgcagaaatggctcgatcttatccgtggcgcatatctgcctgcaagcgtagacgaccttaaaattgcggtaagtcttggcgttgacaagcgtccgcctatgcccttctcggacacaagacttcttaacgtactgtcgcacaccctatggtttttgccgagcgtagcgtcctgctttgcgatgtacaatcttcttatgcaaagtcagaacaactattacaatcagggctataagataaacgtctgcgccggtataaaagcgggcgtaggtcttgatgcggtaaagcccgttattgattctatgggcgatcctctcgttacaaggacaataaccctcacctgcggaaagctgacaacaggcgttaccgtaaagccgtggacaggcatatttatgctccgcaatcttaaaagcccggaaacctattttcagtcggctttccgtgtgcagtcgccctggacggtaaaaaatgagaagggcgaagtagagataatcaagcacgaatgctatgtgttcgactttgcgcttgaccgtgcgctccgccagatatccgactatgcctgcaatctgaattccgagaatacaaaccccgaaaagaacgtcagcgagtttataaacttcctccccgtcttagcctatgacggctcgactatggagcaggtaaacgcacaggctattcttgatattacccttgccggaacctccgcaaccctcctcgcaaagcgctggcagtccgccctgcttgtaaacgttgataacgacacgttaaaacgtcttatggcaagcacagaggcaatgaccgcacttgaaaatatcgaggctttccgcaatctcaacaaggagcttgaggtaatcatcaacaagtccgaggcggtaaagaagctgaagaaagacggcgtggaaaagctcaccccgaaagaaaagaaagagcttacagaagccgagaaggagttcaagtcaaaacgtaaggaggtacaggaaaagctgatgaaattcgcttcaagaattccagtatttatgtaccttaccgactaccgtgaatcctgcctcaaggacgttataacccagcttgaacccggtcttttcaaaaaagtaaccggtcttgatacaaaggatttcgaccttttgtgttcgctcggcgttttcaactccagccttatgaatcattccattttccagttcaaacgctacgaggacgcaagccttacctataccggaattgatatgcacagtaacgataaggagataggcggttgggataccgccataagaaaagatgaatacaaaaagctgttctataatcaacaggaatcaatgaacgctcctcagcctaccgaagccaccgaagatatagtggagttaaagaaagaagtcacacggtcatcagcggtaaaatccgttcagccatccggcaagtcaaccgctgcaagtccagccactccgcctcttgtgaccgaaaagttcggcattaaatcacccgttcccaaagccgctttacccgttcccgacaggaaacacaccaacacccccgattttgacgaatcgtcaataacagtaggaatgaccgtaatacataaaaaattcggcgaaggaaaagtacagtcaatcgctgataaacatatatatgtaaaatttgctgacggtcagaaaaatttcgccttccccaacgccttcaccgacggcttcctgcacctgccgaaatgatcaaaagcaacagcccggctgaatcagccgggctgttgcagatacatacaacaaaaaatcccgtgcaaaatacacgggattaaacttggtacaccttcagggactcgaacccaggacccactgattaagagtcagttgctctaccaactgagctaaaggtgcatatttaataaaatgaaaaagcacgctacagcgtgctttttatttggcaggggtggtaggaatcgaacccacgtcaaaggttttggagacccctattctgccattgaaccacacccctataggtaaaaagctcggcaccaataaaattggtgcaccatcagggactcgaaccccggaccgaccggttatgagccggttgctctaaccaactgagctaatggtgcattggtgacctgtgggggaatcgaacccccgtcgccggcgtgagaggccggagtcttaaccgcttgaccaacaggccatatagataaaaagaataggctgatgggcctattctttttaagtttggtacaccttcagggactcgaacccaggacccactgattaagagtcagttgctctaccaactgagctaaaggtgcatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacaccttcagggactcgaacccaggacccactgattaagagtcagttgctctaccaactgagctaaaggtgcatatatgtcggcatctatctatcttcccaggcagtctcccgccaagtattttcgacgtaaatgagcttaactactgtgttcggaatgggaacaggtggaacctcatcacaatcattttttttttcaagcagaagacggcatacgagatttcgcggagtgactggagttcagacgtgtgctcttccgatctgcacaaagccgtctggagccgttttttcacggacgaaatacttgccgtagcgcagctcggtcattcgataaacgccgccctcaagctcagtcatttcgccgcacagcttatcgtctttatcaaattcgccgttgccgtttgtatcggcatacacctcaaagaccgcacctgtgagcttattgtcgggataatctgcgtcaaccttagtcagttcaatattccccttgataaagtagttcacaagctcgatttccacgacctcatcaactttgccgacagttacggcgatttcttcctcggagagtacaaaacctgtgggactttcaatttcacggattacccaagtgccatacggtactttttcaaaagaaaaactaccatcatcggctgatgtggtagtctggatagcattttcttttgtaaactcctctgtacctgtcttaaagataccgataaccgcaccgcccagagcatttccgtcctcatcggatttcagaccgcttaccgagccgtaaatgatttcattctcaatggtttcgccgtcatttgcggaaagatgaacaaccgctgtgtcctgacctgcgtactcaaaatggacagggtatttctgctcgttcaggacataggcggaattggttgacagctcttttacatagtagctgccgaacggaaggtcgctattgaccgtgcctttgccgttttcgtccagagaaataatctcaatcagaccatcggcggggataaccgtaccgtctgcggcggtaaggtctgtttctgcatacaatccaaaggttacatcaaagatttcaccgttattgccaacaccgtaggcttcgtctgtttcaaggctctttacaaggtcaatttccacacgctgcctttcattgtaaaagctcgtttcggtttcggtaacagcaatattctgacctgcatacacaagctcgacagcgtgaatttcgtcattcagcaccattccgtaaggagctgtgatttccttgacctcatatttgcccagatacagctcttttgattttgcagttccgtccgtgcctgtggtaatagtgtcaacaacctcgcccttagaagctctcagcgttccgtccagagtataaatatcctcggcggcggtaatctcataaaccgcaccttcaagcccctgtaccgcaaatacgggctgatacattccgttattctcagaaacggaagtgaacacctcgccagatttggaaacggtaattgtgcctttctgcgccatattggagcgaaccacctcaatgaccgtaatgccgctttcttcggcagagccgtcctgcgttacatcaaaatagacaggctcggagttcagaacatagccatacggagcctgcacttccacgattgagtatcctgtgccgtattccaaagtctgcggcgtaatgagataaccgtctgctgtggtataaaaggtgtcaatggtcgtcacttcgggataagtgaaagtcattgttacaagctcaccgttggggtcgtaaatctggaagcctgcgcctgcatacggaatggtagcacctgtttccgcatctttctttacgattttgatatagctttcaaaattagcgttattgataagatagcggtaggtctgactgtccttgctgataaatacctcaaaaggcttcatcagctctcgaccttcccacccagaggtctgctccacgacataaacaccgtaaggcaaatcctttgtctgagcaaagccgttttcatcacaggtgagtatatctcgctcggtttcctttgctgcgtcataactgcctgcggctttcaaataaacctcaaaggttgctcccgtttcgggtgtttcaatctgggtttctccgtcatcggtgtgcttgataatggcgatattgcccttgataatctgctcagtcacatcgtttgcggtactgttgcgctctacggtataaagctctggctctgcgccgatatgatgaattgtagtatcgagtagatagccctcggacgggctgatttctcggatagtccaatcatcatcacagatataatagtctgttgtaaactgcccgttctcgtccgtagtgtaggtgtcaatcagttcttcgcctttataaatgccgtaaactgcacctgcaagagaagcgtcgccctgtgccgtgcctgtttccgcatcggatttcgtcacggtcacattgaactttttgagaatgttcgtaaagctgcggcttgtaaccttttcccattcaataggagctgtctggctttcgggaacaacatagcgaatagccgtatctacttcctctacggtgtaaggtgtttcgccgctgattaggacattttcaaatcttgccacaccgttttcatcggtaacagcatactcatcaacgggcaagccgctaagagatgtgccataaaggtggaacttcacaccctccacaagattgtcctcagagtttttgataatctccagactgccacgcttcaaggtgttgttaaaggttacggtagcagtatgaccgcttacaatcgttaccctttgaacgctctgcggctcgtatcggtcaatggactgctctgtaacggtgtaaacccccggcattagctgaacatctaccgtaccgtctgcgcctgtggtaacggttttatttacaccgtttccagaaatattgaagctaatgccagacacaacaccgtcctcagaggtctttttaatctgtcctgtgccgtaggtttccgtgtcgattttaagatagaaatatacggggtcggaagctccagaaaccattgtctgtttaccaacacagccccagataagcatttctccgcaatcgagattgacatttttctgtgccgatactgttacgggagaagtaatcatcttatcactcgtaaaagtatatttgttgccgcttcttgttacggaaataccgcttgcggagaactgaatatcagacaatgtgttgttggtatcctcaagcgtcaggctgtatttctttgtatcgggattgtatttcagcgtgtaggtgtccgcattgctctggcttcttgccgcaaagctcggaatggtatagtgttttgacatctgcgataaaatccagttgtagcatttctcggcgggtctgcctttcagggaatagtagtaagtgtccccgtcaatcccgtttgcactctggcggtttgaggggcttgtgcggagctgctgctgatattcccagataattgtctgggtcgcaaaagcataatcatctacatttgtgcctgcaacgggagaggatttaccctcgtgccagccatacatcaaagccatcataataccgaactgagcgtcagtcggcaggttttgaaaatacgagctgttctttccgcttttggacacataggaattgcccgtgttgaaatcaacgccagactccacgcagtaaacctgatgtgttccgctattatctgtcatcagatattttcgcttggcgttacctgcgttaatgctttgcacggtaatgttgcctttactgtcataaacgataaaggaataggtcgctttgcttcggtaatactcgccgtcagagccgacatagtaatcgccaaaggaagatgtgcagcttttaccttcctcgctcgtccacgcaaaggcagacatcggcagagctgttatcatcatcagcaagcagagagccgccgacaggatacgcctgcctttctttgtaaacttagttttcataggctgttaaaccgtcctttcttgattttgggcataaaaaatccctctgtctttgaacagagggaaaagcctgatagctgctcacgcaaagaggaaataaatcgagtagctgccgtttcctcttgcttcgcaataaatattaaaagctgtgatttcatcaattccgtatgcgccgagattttcgacagtatggaatgtgatatagcgttcaaggctctgctttaatgcttcgccctgattgttctgtgatgccgttacaggtttccaccaagtagaattactcggagtgagtgagctgtctaaggcaagccccatatccagaccaatgccgatacaatcttccttgaccgtttcaatgtcaaattcataatcataggcggttttaggctttgtatcttcgggaactgtctgcggtggtatctccgcaggcggctctgttttctctggcttttcgacaggagcagagctgctttccgttaccgcaggttttgtttcagatacttgattttttccttgcgatacaggctcgttctgttttgaagtttcgctttcaacaggctcatactctgtaactttggcattgctttcaagctcagtatccgttttggcactttcactttctttactttccgagaaaaaactgctttctgtgctttctgtttcggcggcggcttctgtttccgctacaaactcataattatcactttcttcgggagctgttgaaacatcagcacagccgcttaatgtcaatatcagcacaaatagcattgcaatcatcttttttcgcatagcatagacctcctttgcggcttcattatacgaaaaacctcagaagctctcaaaggtagaaaatctttcaaacaaagagttttgcatatattcctttttcggatagtcttggtagtaaaaaagggggtgaggtgtggagagggggaagccgaaaaagcggctatccacgaaaacgggcagacctcgccctcggtgtgcggctatcgttcctgagctttgtttcgctgcaagtgtcggttgtaaaactccaacgcttttacaacaaaatccgcttcctgtcctttgggaacagatttaggaatgagtttggttatcctctcgtcacggaaagcaggcttttccctttgattgggtttttcttcctccataatgctctggataacctcgcctgtcagcttaccctcctgcataaacttcttcattttgatagcctgtgcaagcgacggggtagcgtcgttgtagctcatagcttcaagcaaggtgtattgctgttcttcggtcagataagagatttcaacggcaggacgaaaagcaatctgcctttcatctaccatttgcaggatttcgggaacaagctcggtcagacggataaaacggcggatttggtcttgactttctccgacaagttctcctaatttttcacgagaagtctttttttcggacttctgtgccattggcacagaagttaaatcattcctttgtccttgcctgttcatcgcttcaagccgcattttataggcaaaggctttctcactcggtaaaatcgttgacctctgtaaattgctttctaccattacaataatggcttcatcacgggtcagctctttaacctcacatttcagcgtttcaagccccgcaagctcgcaagccttttttcttctgtgtccgcttacaagctcataccgtccgtcctctttaagccgaacggtagcaggggtcattacgccgtttcgcttaatgctctcgacaagctgctgcatatcctcgtccattaaaaccttgaacgggtggtctggaaactcgtcaatctgcgataagggaatatctctgattttactcagctttgcttctgcacggctttcatctgtctgaaaaaggtcatcgtaagcggtcagttcgattttggtttctctgcttctcgccaatctctgccacctcctttccgaactgctcataagctgcggcaaccttaccgcttttgtcgtaagcaaaaatgctcttgccctctgcggtagcttccaccgcacggatagaatgcggtatctcagtatcaaacaccttgattttttgaccgtaggcactttttaccgttgccgtgatttccttagaaatgttggtacggggcattaccatagtcattaaaataccgtctatccgcagcttgggattgatttgtcgttttaccattgacacagagcgaagcaacagctccaaacctttcgctgaaaggtagtgcggctgtgttgggataatcacgctgtctgccgccgccagagcatttatcgttatcataccgagagagggcatacagtcgataagcacataatcgtaattcttcttaacctcatttacataggttttcagaacacgctcacggctcatagcattgataagccttacttcaaagcctgataactcaatgttggacggaagcaggtcaacgccctcgctatggtgtatgataccttgcgaaacatcaaaagatttatcgtctatgatgttctgcattacggtggagagcgttatgggtatatcgtcaggtctgttgtagccgagtgccattgtgagatttgcctgtgcatcagcatcaatgagcagaactttctttccttgctgtaccagacctacgcccagattgaccgcggtggtcgttttaccgacaccgcctttctgattggtcagagcaatcactttgcaatttgacatttgtgcgtcctcctttcgcataaatttagccgctttgtcaaggcggctatgtaaaagagtgagagaacgcaaaaaagccgcttactcttaggtgaataagaataagcggctatgtgtgatatgccttagatatgttcaattttcattttcttaacaggagcattgacaaccttgaaaatcagctcgtcaacgcagtccgtgtatctgccttcctgtatcagtctgtttttcagctctacaaggctatgtattaccaactgtcgctcgtggctatccagatatgcgtggtaggttttatctttcataacgaatacctccgtttcatttttcattatagatatgtttaagaaattacgccattgtgccatcgctgcctgtacgcaattttcgtatttgctcattaaacctctggtgcttgacagacttcacggcaattcctatgaaatatctgcttacaaggaaatccaatagatactctttagggatttgataacgctgtttgatataaaagcatttcagctcttttttaccgcaccagcgactaaccgaatttttattgtagcccgtaaactgagctacctgctcaaccgacataacatctgggttgttttttagcagtcgttcataatactgccgcatacggattaaatcctcttgtgtgaacacctcatcaaaggacggagcttttttatctccgccttttcctttgtaaaagccgtctggagctttgaatagctctgggtaatcatctctgtctttcaaatactgaataacatcaaccgtcttgattttgaagcggcgtgtttttttgccgctatctatgttcggcacaagaccgctttccaataaaaacaagcaggtctttttgctgatatgacagatacggtacatctggtctttggttatgtattcggggtattgctgcaaaatctcgttgcaatatttttctgtaatcatcacttacacctctttgcgctttttggtcaacagcagaagaaaggtgtaaaagttctctccaatagtattttgagagtgcctgaaaagtaggtgggaaaaggggttttgttctctcctgagttctctccgttctctccaagttctctcttttttgctttttttgagccatttttgaaacccattcgaactcacggttttttgccgcttttcgccgcttttggctcggattttacctgtaaataaagtagtttttcttgcattattttctgctcctttctaacactttccatatcacataacacattcgaaatcgaatgaccttattggttgccgtattccttaaaaccattgattttacgggctttttcggttattatgtttgatagcagtacggttagttctctccgatagttctctcgcatttcgaactgtcggaaacagccaaagcggagagaaaatcatctttttgcggacaagagcatttacccttaaaatggggcattttttctcaaaatccgctaaagtgtgttgggagtgaaacactcgaaatcagtttgcgggcaaccgcacgtgagttcgaatctcaccgtctgcgccaacaaaacccttgaaggctgaggctttcaagggttttatttatgagcatttatggatagcgaaaaggctccgacagttcaagtcggagccttaagcaagtagaaaaagtctttcatttggatatacttctgttatttcattcagctatggctacgatagcaagctaccgatagttctttttgtcggacagcacttctcgggttcgctattcgagtggatacacttgtcaatatgaaagagggagacaaccaaagggatcagggagagtctgagcctcgcttacgcaaggctcgtgttttttaatgatacggcgaccaccgagatctacacgtactgacacactctttccctacacgacgctcttccgatctgtaattcttacgaaaatagtgcatcgcaaaagcaacttctttttcacttgtgctgctgaatttctttgcactcatgattgcacggcttatcaaaacaaaaatatttcgcagctgcaaagaaatcaattcatcataccgtggtctgcaaagctgcaattcctgaatcatctgaccaaataaccactgataatcgggagatgttccgatatagagaatattattttgcaggttgatattgtaatactttaaaatttcttctacttcatttccggtaaaatgcacccaataaacatcggtttgatcttcacgataataaacatattcctgtggttgatccggcaaatatataataatatttccggctgaaactgttttttcttctccgtgaatgaaaaaatgtccttttccggaggcaatatataaaagctgataatcttttcttcccttcggacgatgtgttactacttcagaacgatttttcacacgataatttccacagcttgttacaatcaaaggtttcgtattatccactacagtagatgtagagttgtttaaataggcaacattcataaacataaaaagcacctccttgcttctataaatatagtatatcacacctgatcactggtcacaagaaaaatcctaaattttgtgcatatattttataatattgtgtattttttaagccgttttgtgtggtataatagaattaagaaatgagaggaaagaattaaaaaaagacgtctttcattgtaattccatgctgaattcagtaaaaattctttatgctcaaaaaaataatcatctattctgacgatggcattatttcgtttttgcaagatgaaaagcagttcgtatcattcatcatgggaaaattctgtccatgtgggcatacaaacaatgaaaggagctcattatgagcaaagaaaaaacatacttaaagtggtataacaaagtcggttatggttccggcgatgttgcagggaacattgtctatgcattgctgacatcattcataatgatctatcttaccgatacgattggattaaacgcaggtgttattggcgttctcattgctgtatcgaagatttttgatggaataacagacatcatttttggtacgttgattgataagacacatacgaaaatgggcaaggcaaaaccgtggatgctttatggttttatcggctgtgcaattaccttgattggtgtatttgcaatcccgatgaacatggataattttgctcagtacgcatggttctttatctgctacacacttcttaacagtgtattttatacggcaaacaacatcgcatattctgctctgaccgctcttgttacaaagaacagcaaggaaagagttcagatgggttcttatcgctttatcttcgcatttggaacaagcctcctgattcaggctgttacattccaatttgttgaagcaatgggcggcggtgcaaatggctggagaacagtcgcaattatttatgcggttatcggtcttattgtaaatacaatttccgctctttctgtaaaggaactttctgataaggaacttgcagacaatgaaacaaaaacagaagaaaccagatacagttttggagaagcattcaaaattctcgtacacaacaaatattatgtgatgatcacagtaacctacattttgcagcagttctatggtgcgatgatcggtgttggaacatactatgcaaaatatgttctcgcagatgagaatatgttcggcacgtttgcgtggtttatcaatattcctttgattatcgccttgatcttcactcctaccatcgtacaaaaatggaatggtatgtataagctgaacaaatacagctacatggtagcaacagttggcagacttctggtagcagttgccggatacatgggaaacattccgctgatgcttgcatttacagcacttgcagcactcggtcaaggtccatggcaaggtgatatgaatgcagtcatcgcatcatgctctgaatatagctggcttaccaaacacaagcacgttgatggaatcatgtactcctgcacatcacttggtgtaaaaattggtggtggacttggaacggcaattgtcggtcttttgctcgactttagcggattcaagggcactttgacagtacagcctgattctgctatcaatatgcttcacattatgtatctgatcgttccgtttgcactggatctgatcatcacatttattctttctaagatgaatgttgaaaaggcaaatgcggaaatcaaagaaaaacttggaatatccgaaaatgaagttgtgatggaatcacagaactaaaatggagggaacaatatgaaatatacactcgactggctgaccaatccggaagtgtttgcagtcaacagaatcgcagcacattccgaccacagaatctatgcaaaccattttgaagccgatgcagacaattcctctctgattcagaatctgaacggcacctggaaatttgcgtgggcaaagaatccgtctgaatggcagcaaaagttctatgaagaaagcaacagcactgacaattttgacaacattcaggttccgggacacatggaattgcagggatacggcaaaccgcagtacgtcaataccatttatccttgggagggacaggagcatctccgtccgccgtttatctctgaaaaggacaaccctgtcggcagctacgtcagatattttgacttgaacgatgctctgaaaaacaagcgtgtattcatttcttttcagggtgtggaaaatgctgtgtatgtctggctgaacggcgaatttatcggctacagcgaggattcttttacaccgtctgaatttgaactgacaccatatatccgtgaaaagaacaacaaacttgctgttgcagtgttcaaaagaagttctgcaagctggctggaagatcaggatttctggagattctccggcattttccgtgacgtattcctttatgcggcaccgtatgcccatgttcgtgatatgagagtgattgcagattatgacggtacaaatggtatcttctctgcaacgctggatattgcgggcaagtgttctgtgaaatcgatcttgacagatgaaaatggaacggtcattgcagaatccaatgaaaaggaatctgtaaacttgacaattgaaaatagcaagccttggagtgccgaaataccgaatctctacacgtttacagtgattctgacagacgaaagcggaaatgaaatcgaggtcagcagaaccaaggttggattccgccgatttgaactgaaaaacggaatcatgtgcctgaatggaaaacgtattattttcaaaggtatcaatcgacacgaatttgatgcgaaaacaggcagagcaatcacaaaggaagatatgctgtttgacatccggttcatgaagaaaaacaatatcaatgcagttcgtacctgtcattatccgaacaattctctttggtatcagctttgcgatgcatacggcatttatctgattgatgaaaccaatctggaaacacacggtacatggcagaagcttggtgcaacagatccgtcttggaatgtgccgggttcacttccggaatggaaagaagctgtgctggacagagcaaaatcaatgtacgaacgggacaagaatcacgcaagcgttctcatctggtcttgcggaaacgaatcctactgcggagaagatattgctgcaatgtcggaatatttcagaagcgcagacccgacaagactggtgcactatgagggtgttacaagagttccggacaatcagtatgatttcatcacggatatggaaagccgtatgtacgcaaaaccgcaggaagtggaagaatacctgaaacagaacagcggcagaccgtatattagttgtgagtatatgcacgctatgggcaattctcttggcggtttgagcctttacactgaccttgaggacaaatatgaggcttatcagggtggtttcatctgggactacatcgatcaggcaatcgaaacccaaaatgacgacgggaaaacagttctggcttatggcggagattttgaggacagaccaagcgattacggattctgcaccaacggtgtgatctatgctgacagaacctactctccaaaggttcaggaaatgaaggctctttactccaacatcagaatgtctattcaaaacggaatgcttaccgtagaaaatcgaaatctctttgcagatacaaacaacttgtcctttgttgtacgattggaaaagaacggcgttgttctgaaatccgatacattttctctgaatgttcctgccggagaaagcaagacaaagaaactgacacttcacaaaatagacagtgtaggagaatatgtttatcatgtttccgccgttaccgcagatcagacactatgggcagatgcagggcacgaaattgcctttgctcaggaagtgtttgaagtgaaagataatcagattccggaaaccacattgcaaaagccaacgattgtatacagcgatgttatcattggcgttcacggagaaaacttctccatgatgttcgacaaaaaagagggcggcatcagttctctgaaatacaatgattatgaatatatcacacgcacaccaaaggtcagcttctggagagcgatgacagacaatgacaccggtgcttccgagccgtacaatcttgcacagtggtatgtcgcaggcaaatttgcaaagtataaaaccgtttcatggctggaacaggaagatgctctgaaaatcacattcacatatcaggctgcctgcattccgacttttgagtttactgtaacctataccgcacactttgacggaaagctgggcgtaagtgtaaattatgcaggagtaagcggtatgtccgatatgccgattcttgcattggacttcaagatgaaaaaacagctttgcaattttcagtattacggactcggccctgatgaaaattacagcgaccgatgcaaaggagcaagactgggattatggaaatctacggcaaaagaaaatctctccggctatctcaatccgcaggaatgcggcaatcgtaccggtgtaagaacgctctctgtccatgatgatatgcaacatggtctgacgttccaaaaggcatctgctccgtttgaaatgaacgtactgccatacagtgcctatgaactcgaaaatgcaatgcatccggatgaacttccaagtgttcgctacacatgggtcagaatcgctgcaaagcaaatgggtgtcggcggcgatgattcctggggtgcaccggtgcatgaggagtacagaatccatgcagatcagccgatgaaattggaatttgtaattatgcccttaagatcgtaagaagaaagggaagcaatgaaaatacaggattttcaagacaatgttacttgtggtggatttgataatatcttcgcaaatatttataagccacaggatatagaaagtcaggaatcacgatatatgagtgctgtggagaaattcacagcactgtatccgaatagaaatgatatacacgtttattctgctccgggtagaacagaaatcggcggtaatcataccgatcatcaacatggctgtgtcattgcaggagcagttgacttagatgttatcggtgttgtagcatttcatgatgaaaacatcatcagaattaaatcagagggatacgatgaatttgcagtttcactggacgatttggatgttcatatcggtgaaaaaggttcttctgaaattgtcagagggattgcagctcgctttaaggatttaggtgtagaaatttccggatttgatatgtatacaacttcaaatgtacttggtggaagcggtatttcttcttctgctgcatttgaaacattgattgcaacggcaattgacagctattacaataacaatcagattggtgcagtagaaatcgcaaaaatcggacaatatgcagaaaacttttattttggcaagaaaagcggattgatggatgcacggcttgccgtccgtgaggaaaaggaacgctctgccattgataaggtgaaagccgcctacggtgagaaatacgatccgatgatgatgcacgacagcaagcgtgacgtggcagatctgctccacgaggaaacggaagtacgatccgtacgggaatttctgcggcatgaacagcaacagcaggcgcagcagaaacagaataagaagaaaagtagagacagttgggagcgctaaaatttcaacgggagtgctttttaaccgatgcactccttctttttacgttaattcgtgaaaatggtagaaatttttacattcttgtgctataattattatgtatttttatatgtaagggcgtattatgatgagcgagaatcttttgtccgtattcaaaaaagaattaggatatgttaatgacacgaatcaatatgtagaactatcaattagaattacagaaaaagagcatagtttggatttaaggaacaatttgcaaggcttagcccaaagcgtaaatctgaatgtgtctactcttacagaagactatatgtgtaggattagcaagagttatattgtgaacatacattcatgtcttgagaattttctcaaatcatttaaacatcttcccggttctcccaccaatatcacagaaattaaaaaaacgagtgaagacgattggttggaatggacactgaacatggccttttcaagtatagaaaacgatattaaaaatgatatcggtatttgtgaatactatcgtttggttcgaaattgcatagttcatagtggagaatcctcatccacactaaaaagtaaacgagctttaataaaaacgacagacaatccgaggttgaacgcccccaatggtttggattctctcacatttgatgaccaagttttattttcaagagcagcctataatgttgcaaagtacatttttaataatagtcagtatgatgtaaacgctataattgaagccaatagagaaatcttgaatgatttaattatgccttttcaagagccgggatctcgctcaagagcaaccaagaaagtaaaatattttattggtttatcatatccagaattgaaagatgtgaattgggagagtgttgtatctacattgctcaattgattagtaaaaatggggcattcgcttaacggtaaagcatcccccttcataagcacatctcgtgctttgaggggtgtttatgaaggggaagatcgaggttcgaatcctcggtgcctcaccatttttgcgtgagtttttcggaaggaggataatgaaatgccggataacaatttacatagcattaataaactgcaagatgacataaaagcagcaaagtggttgtctgtatttttgcccaagaaaaaacgtcaacagataaaggagttagaaacctctttggctaatatgattcatttgattgaatcttttaacaaatacttttcagatgcaggttggtgtgcatatgactctatgaatatgccgcttatggagaatgcagttaaagcatatgaagcgggcgggattgatgccggtgaacaggtactaattcaatactatcaaactgatgtaaaagatattatgcattggttgaaaaataaagccaaaccctttagggaacgatatgaattaattaaatgcgcatttgacgatcattttgctgaacgctatcatacgagtgtccctctgtttctaatcataatcgatggtgcagttaatgattacactaaaagcaaaggtttctttgcagaaggaaccgatgtttccgcatgggattgcttggtgggctgtggcgatgggctaacaaaaataaaagacatatttaaaaagggcagaaacaaaacaaaccacgacgaaattcgattgccgtatcgtaatggcattttgcacggtcgagatctaaattatgctaacaagtatgtctcttgtaaatgtatatcgttaatgtttgctttagctgattggatgaatatgaaagacagcgaaaatactcgaaagcaaaaatttgaaaaagagtgtaatccgccgcctatttcagaatcattgaaaaagataaagcaaaatgcaatcgacaggcaagaaatacagaaatgggtcaagcgagatattaaaatcggagaaactatctccgcaactccaacaatcgaggaatgcaaggatttcccatatctattaccgctaattagcgcatttaatgcttggagcacccgtaattatggttcattatctgtttggttcaaaaatgtaagaaagatcccagcattgtatttgagtacaaatatttctcaacagacggctcgatcaagtatttcgataaggtatccgaccccaacgctcccgatcagaacgcaaacggagatgagcttcccgaaagcgagggcgaagaggataacgatctttatgacgaggatgaggacgatgaggatgaagtagaggaaagacgttctccgctccttcctattctctttgctgtagcatctgtatttgtaataatgaccgcatggctcatatttactatcgtaagcggtaacttaggtaccgaaagcggcggctccgatgagatgactatgccgaatattgtcggaatgatgcttgatgatgtcaagacaaagtaccctgagcttaacctcgatatagacagacagtattctaccgagtacaaggaaaacgaggtaatggatcagaaaactcctgccggcagaaccatcaaaaagagtacaatagttaatattgttatcagtaacggtcctcagaaggtcgagattgacgattactccaacctgaccgtacaggacgcacagataaagctcgaaaagaagggccttaagcccaaaatcgtatatgtcaataatgacgatgtggctaaggatattgttataaagaccgaacctgcggctcattctgaggtttcacagggtacgcttgtaaaggtatatgtaagtaacggcaagctcgtgaaggcagtcaatgttcccaagtttatcggtatgacaattgaagaagcaagagaagaagcagagaagaagaatctcaagctgaaggaagttgccggctcaagcaacgagtatgaaaaagatcaggtaataaagcagaacattgcggaaaactctgttgtaaacgaggaaaccgagattgaagtaaccgtatgcgacggcaaggctgtcaatatcaaggccgaagtttcgcttaatctgccgaccgatgcaaccgatacgggaacgttcaagtttgagtacttcaaggacggcgtttcgttcaaggaagaagaacgtgatatggctgtaaattcgggtaaaactctgacatttgaagtcagcggtacagaacctgccacattcactgtcaagattacgaatgtgaacgacacatcgctcagcggagttcttgcggaaattagtgttgatttcaagaatgaggacacagagcctgaaatagtaagctatgacgagggtctgttcaaaaagctcaagtatgtagctcccgatacttcaaaggatgagtcttcctccaatcctgagcctacagaggtaagcggttcagtaactgttacgcttccgactaacgccgctcagtcaggtacgtttaactttacctatatggacagtgacggaaatgtgatcaagacagaaaccaaggatatgtcacttgcggcaggtaagcctgtatcgtttgatgtttccggtaaggataagcgtacatatcttataaaaatcacaaatgtgaaggacgaggctcttacaggaacacttgctgaaatagaaattgatttctcagatggtactgtaaagcagaatattatatcatacgatcagaacctgtttaacaatctgaagttcatttcgaacgaagcatcgggcgaacattccgaagaaacagatgaataacgaggtttgcctttgaaaaatgtaaaaaccgaaggcattataacaaaggctgtcggcggcaactactatgtagctgttgccgacggcgttttatgttgtaatgcaaggggagtgttcagaaaagaaaaaatatctccgtgtgcgggagataatgtcgttgtcagcatcgaggaaaatgccgttccgcttatcgtagagataaaagaacgaaaaaatcatatcatcagaccgccgctcgccaatcttgactgtgctttactggtaacatctgcggtcgaccctgtgccgaatacgcttgtgacagataagctgatttcaatatttgaaagcaagcacatcgagcctgttatagtaataaccaaacaggatctgcgtgaatgcgaggatttcgccggaatatacagaaaatgcggattcaaggtgttctatatggataacagcacaggaaacggcattgatgcaatcagaagctatatatccggcaagctgtcagcgcttataggcaattcaggcgtaggaaaatcaagccttatgaatcatctgttcccgggacttgaaagaagcacgggagatataagcaaaaagcttggcagaggacgtcatacgacaagacaggcggagttatttgctattgacggaggctatattgccgatacgccgggattttcgactgttgaagtaagcagatacggctttattccgaaaaacgaactgcaatattcgttcagagagttttctgaatatctcggtaaatgccgtttcagagattgcgttcatctgaaagaaagcggatgtgccgtgaccgaagcactgcgtgaaggaaagataaacagctcacgctatgacagctatgtaaaaatgtgtgaagaagccgaaaggctgaatgaatgggagtttaaaaacaaataatgaagaagtgttatataatctgcggcggacctgagccgtgtatgagtgcggaaatatccgagggtgcgtttataatatgcgcagacagcggatatgacaaggcactgcaggcaggaaccaagccggatctgattttaggggattttgacagccttgagaatcctttgccggacaatatagaaacaatgcgttcgcctgtccacaaggacgataccgatacaatgcttgctgtaagaaccgcactcgacagaggatatgacgacattacgctcatcagcgcctgcggcggaagaacagaccataccttagcgaatatagcgacgcttctgtttatccgtgagcacggggcaagagcaagcataaaaggcgacagcacggatatatacatacttgaagatgaaaagataacgctttcgcccgatttatcaagatacctttcggtgtttgcaataagcgaaaaagcaacggtttccatagcaggcgcaggttatccgcttgacaattatgttatggaacgcagctttccgataggcgtaagcaatgagttcaccgaaggctctgattgcacggtcgaagtaaggagcggacttgcggttgttatgaccgtcaagaaataagtaacaaaatatctccctgaggaataaagtgtaatagcttcagctgacgggaggtatttttatgatgagaaggcacagaccgggacgttcaaaatttcctgcgttcatactcggtcttgccggtattcttatatgtgttacctgtatgtcagccgaaacactgcttgttatactgtcactgctgctcattgcactgggagtatggctgatgttcttttgctgaaagagaggtacatattatgaaaatcgtagtttgcaagacgccgagaatactggcaggcttcttaagattgtttttcggtataagaaagacggaaggataaagaactacccccggttgcttatgcaatcgggggtaaacattaagtgtgacgattatctgtatttgccgttctggatattcttcataaactgtcgctgtgacatctcacccgtgctgactttccaggaatcctcctgctcgagcttccagttattgtgataagaggccgggatctgcggttcgcaatttttccagatgccataaatgatcagaccgataaataaaactataaatgtcatattttcctccttttgaataagccgtaccaatttgcatcgggttttatcctttggcttaatgataacagataatgtgtacaataaaacggtcaggaaagaaattttgagaaaaatttaaacgctcgaatattcatggcacagcggcatatattattacggacagacataatgacaggagcggtttcagaggaaattttgactttttgtaaatttttttcgtaaaacgcttgacaaacatcaaacttcgtgttataatatacaagcactcaggagagtgaacagaatatcgcggggtggagcaggggtagctcgtcgggctcataacccgaaggtcgttggttcgaatccagctcccgcaaccatttaaaaagcacttagcatcacgctgagtgcttttttgttcttatttccgtttttcctaatatacttatccaaaaggataaaaggagaatgagaatgaaacataacggacggctgaaggtaaaatttgatttcagcttctttgcggttgtggcatttatgatttttatcgacacgagcggagcggcggtgctgtcgttgattgcctgcattctgcacgaaggcggccatttgctcgctatggctgtatgcggagccaatcccgaaaggataacgttctacggaggaggaatcgccctgtcaaagtcgggaatggagagcctcacggacgctaaacggcttgttatattgtctgcagggtgcagtgtaaatctgcttgttgcggcggcttgttttgctatgcagggaaatgacacggcggcggttttcggtgcagtgaatcttatcatctgcatattcaacgctttacctataggatatttcgacggtgcggaagtgcttgagctgcttctgaccggatttgtatcgctgagaaccgccgagaaagtgaaaaaaattatcggaacggctttagcgttgattataacggcgggagtgattgtatattgcgttatgtgcggtgaaagcgtttcgttatcgctgttttttgttgtgctttttctgatacaggcacagcttgtttcgtagggcttgcaataaatccgataatgtagtaaaatatactgtataactataattttcggaacggaagtagaaaaatgctgaaggaaaaattagataaaattttattgaaggtgcagaagccgtcacgctatatcggcggtgaggtaaacgctgtcgtgaaagataaaagcaaggtggatatacgctttgctttctgctttcccgacacatacgatataggaatgtcgcatctcgggataaagatactatattccctcaagaacagcgtgcctaattactggtgcgagcgtgtgttcatgccccttcccgatatggaagaacagatgagaaagaacgatattcctctttacggtctggaaagccttgatcccataaaggattttgagtttatcggctttacgctccagtatgagctttgctatacaaatatcctgtcgatgcttgaccttgcaggtgtgcctgtttttgctaaagacagaaaggatctgttcccgatagtaatgggcggcggtccctgcgtatgtaatgcagagccgatagccgatttctttgatttgttcgtactcggtgaaggcgaggaagtaaacctcaagatgatgcagcttgccgaaaagttcaagaagaacggcggcacgaagcaggaatatcttgaacaggcggcacagattgagggaatctatgttccttcgctctatgatataagctataacgaggacggaacggtaaaagcgataacaccgaagaataatgctcccgcaaaagtcagaaagcagattatagacgattttgacaaggtctatactcccgacagctttgttgtgccttatacccagatagtacacgacagatcggtagtcgaggtgctgagaggctgtatcagaggctgcagattctgtcaggcaggttttatatatcgtccgttcagagaaaaatcaaaggaaactatagtaaatcaggtaaagagcctcacggaaaccacaggctatgacgaggtatcgctttcatcactgtccacaagtgactacagcgatattgaggggcttttgaacgatataaccgaatataccgataagaaaggtgtcaacctttctctcccgtcactgcgtatagataaattcagcgatgaggtcgtaaagaagataaagagcgttagaagaagcggacttacatttgctcccgaggcaggctcacagcgtctgcgtgacgttataaacaagaatatcaccgaggaagctatattcaaaagctgtaagattgcctttgagggcggatacagctcggtcaagctgtactttatgcttggtctgccgacagaaacgcttgatgacataaaggcgataaaggagcttgcagataagataatcgacctttattacaatacagagggcagaagcaaaaaggcgataagcatctcaatctcgctgtcaacatttataccgaagcccttcacaccatttgaatatgagcctcaggcaacagaggagcagataaacgaaagacagaaatatctgcttgatattataggctcaaagggaagaagacgtattgatgtcagctggagccattatgatacgacaatacttgaagctgtgcttgcaagaggcgacagaaagctgtctgcggttatctatgaggcatggaagaacggctgtaagctggacggctggaacgagtatttcaagcctgatatatggaatgcggcatttgagaaattcggtatcgataaggcgttctatgcaaaccgcaagcgtgaatatgacgagattgcgccgtgggagcatatggatatgctgtttgaccgcagcttccttgtcagagagaatatcaaggctcacgaagaaaaaacaaccgcaaactgccgtgaaaagtgcgcaggctgtggtataaacaaatgcttaggaagggcttgctttaaatatgaatgagaataatatcgctgtccgtctgtttttttcaaagacgggcagagcaaagtatatatcggcgcttgaccttatcacctgttttcagcgtgcgataagacgtacagatattccgatatggcacacacagggattcaatccccatacctacgtcaatgtaaatcttccgctctcgctcggcagcgaaggcataaacgagtctatggatataaaactcaccgagcaaacggatttcgatgttgtgcgggacaagctcaatgcggttttaccgccggatataagaataataagagcagccctgcctgtaaaaaagcataccgaaatagagaaatcggtgtattccgtgaatatcgtctgcaattacgaaaagctggaggaattcatgaaactgccggctattgaagtggagaagaagacaaagaagggcgtaacaacgctcgatattaaaccgttcacagaaatcaaagattatgaacgaggacatttcacactgataatgccgtccggctgtgattttacgctcaatccgtcccttttctttgacgcatttgaaaagtacagcggagaggaaaccgaaagacttgacatagtaagaaccggcatactttgcaaggacggaacgcagttcgagtaattttacgattataagtgcttttgtgcgaaatataatttatctaaaatggggtttggggctttgccccaaggcaggtcgcagggacgccagtccccgcattctcccctttcctggggaaagggggcagggggatagggattttaaaattgttgtttatttaataaatgaactattctgcaatcttacgcatagttttttaaacaaaaaaattcacaaaaaagtattgcaaatttcgtacaaaggtgctataatattaaagcatttgaaatccgctgagggtataagtatgccttttggcatatactgtcagcgtgtttaatgccattagtgcgaaaagcacaaagacattaaaacgggtagtccgctgtatttaacggcaaaagttgccgttttccgtagcgtaaacgcacggaggataagccggtacaagaatatccgaaaaccaggaggaaaacatggacgcattaaaactcattgcacaggacagccttaaggctgaagcacctaagttaaacgtaggtgacacagttaaggtacacgtacgcatcgcagaaggcgacaagttccgtatccagatattcgagggtacagttatcgccaagaagcacggcggcgtaagcgaaactttcacagtaagaagagtagctcacggctgcggtatcgaaagagtattccctctgcactcacctacagtagagaaggttgagatcgttagagaaggtaaggtacgcagagctaagctctattatcttcgtgaagaagccccttgaaacagtagcaaagctcggtgagcttatggcatataagcatacaggcttctggcagtgcatggatactgtaagagaaaaagaacagcttgagaaaatgtggaacaacaacaatgctccctggaagatttggaaataatgggtaaattatccgataaacttgcgggatttttcggaagattatttccgatgtcacgcaacaagactataaagctcaacaacgagataaggcagacagaaagcgagcattttgcacagctttgtgaaatgctcggttttcttgaaaacagcctgaatacttgcacggatatatgccgtgataatgcggagcagataaaactgtgccgtcaatcgttgcgtacattggaagataatcaggttaaattcggtgagtctaccgcatcaaaactcaaagaaataaaatttgatattgaaaatctgaaaaagcaaaatgagtgtatcggcgaaaaactgagtaacgaaatatcagagaaatctgccggaatatccggtgaacttatcggctgtatttcacatcacgcagaggaaatactcggttttataaccgacagcgacaagcgtttttccgatagcgataagcacattgtcgaacttattgaaaacggcatatctgaaaacaataagcacgcaggagaaataaaagcgttcaacaactcgctttccgatgatattaagtcactttcggacagcgttaccgcaggcttcgacaagacctcaaagacgggcgagtatgcggatgcgcttaacggcttatcgtcagataacaaaagcatctcggctgagcttaagtcgctttccgacagcgttgccgcaggctttgacaagacctcaaagacgggcgagtatacggatgcgcttaacggcttatcgtcagataacgaaagtctttcggatgatattaagtcgctttccgacagcgttgccgcaggctttgacaagacctcaaagacgggcgagtatgcggatgcgcttaacggcttatcggcagataacgaaagtcttttggatgatattaagtcgctttcggacagcgttgccgaaggctttgacaagacctcaaagacgggcgagtatgcggatgcgcttaacggcttatcgacagataacgaaagcatttcggctgatattaagtcactttcggacagcgttgccgcaggctttgataaaacctcaaagacgggcgagtatgcacaatctctgcttgatgcagagaatacggcaaatacaatccgccgtgagatgaatctgttcaaaaggcagtcatatctcagaaaattgtattttcatcccggtgaacgtgaagctctggcaaaattgttcagtgacgctatgaacagagaggacagcgcacaacggttcagcgcacttataagcggacttgacaacgagagcagaaataccgtttccgatataattcatcgtatgggaatgatagcggacggcaacaagtccttgcaggatgtctatacacagcgtgagcaggaagaattcgttcgtatgaatgatgaattcagctcaaagataggaaagttgaacgataatctttattattacaacggttattatctccccgttaaccagtttgacagcagtgttttctattcaaaatacgctattgacgagctgaccacactggacagtgtgagaaataaggatataatcgacgcaggcggatatgtcggtgacacggcgcttctgttctcgtcatatacggataagagtattcatgtatttgaggcttctccctcaaatatggatattatccgtgaaacgataaggctgaatcagttagagaacatagtgcctgtaagcaaggcgctgggcgagaaaagcggcacggcaacgttcagtctgggcgagcgcaattcctgcaattcacttgttgaacgtcccggttataattatccgaatcatatcgaagttcccgttattactcttgatgattatgtacgggaaaacaatctcgaggtcggtcttataaaggttgacatcgagggaggtgagcagctgctgctcaagggcgctgtcgaaaccatccgcactcagcacccgatacttctcatcagcatttatcattcggcaaacgatttctttgagattaagcctatgatagagaaaatgtgcgacaaatacaccttcagaataattaaacccgccaattcggctattgttattgaaacaatactgttagccgaggtcagagatgaaagtggcgaaaatatcattaattcgtaaaggaaaaagcaatatggatatgtcattttacaagggtaaaacggtactgataacaggtcacacaggcttcaagggaagctggatgtgcaaattgctttctatggcaggagcaaaagttatcggttattctctcaatccccccacaacaccctctctttttgagctttccggagtagaaaaggaaatagtttcggttatcggcgatataagggatcttgcaaagctgaacgaaacaatgcagaagtaccgccccgaaatagtaattcatatggcggcacagcccatagtaagagaaagctacgcagagcctgtctacacatacgaaacaaatgttatgggtactgtcaatatatgcgaggctgtaaggctgtgcgacagcgtaaaatcattcgtaaacgtaaccaccgataaggtttacaagaacaacgaatgggagtggggataccgtgaaaatgacgcacttgacggctatgatccttattccaactcaaagagctgctcggagcttgtaacaagctcttatattaagtcgttcttctataaccgtgacattgcggtttcgacctgccgtgcaggtaacgttatcggaggcggcgactttgcaaaggacagaatcatccccgattgcgtaagagcaatggaggctaagcagaagataacagtaagaaatccttattcgacacgtccctatcagcacgttctcgagccggtcgttacatatcttgtacttgcaatgaagcagtatgaggacaagagccttgccggtaattataatatcggtccggatgactgcgactgcgccgctacaggcgagcttgtcgatctgttctgttcacactggggcgacggcgcttcgtggaaaaacgttgcggataagaacgctccccacgaggcaaatttcctcaagcttgattgctcaagaataaagcgtgtactcggatggagtccccgctggcatatttccgacgctatcgaaaaggtgacagagtggagcaaggtatatctttcaggcggcgacattagcgccgttatggaaaagcagataaacgaatatctggaggtaaagtaatgaaaaaagctcttgttacaggtgcaaacggctttgtcggaagtgcgcttgtgcgtgaattggtaaagaataatgttgaggtaatcgcacttgaccgtgatggttgcaataacaacatacccaaaaatgtaagatttgtggctcacgagctttccgaatcgtcaaagctcgccgatattattcctgaccgtgatattgatgtattctatcactttgcatgggtaggctcggcaggccctgcgagagcagacaccgctttacagctcaataatgctcagtggacggtagattgtctgcgtgtggcaaaggatatggactgcaagaagtttgtatgtgccggctctataatggagcatgaaacaatatcagccgcattcagacagggtaataagcccggtgccggctacatatacggaagcggtaaacttgttgctcatacaatgtgtatgagcgttgccgcacagataggtatagatctttgttgggcaaagataaccaacgcatacggtgcaggtgagctttcaccccgttttgtaaatacgaccatcagaaagattataaacgatgagcctttacagttcacaagcggcacacagaattatgactttgtatatatagacgatgttgcaagagcgttctatctcatcggagagaacggaaagcctttctgccattatcttataggcagctcggatgcaaagccgctcagagaatttgttcttgagatgaaggctgcactggctcccgacaaggagttcgtgttcggagatgttccgttcacaggcgtaaatatgccgctgtcggattttgattgttcgattacggaaaaggatacaggcttcagagctactataccttttggtgaaggcgtcaaaaaaacaatggattggattaaggagcagaaatgatacagaagtttgaattcaaggaaacagagattaagggacttatagaagtaactcccttcaatgccgatgatataagaggctgtttcacaaaggattactcgaaggaagtgttcgaggcaaacggcataaagcacgatcttgccgaggttttctatacgacaagctacaagggcgttatccgtgcacttcattttcagcgtgagaaacagcagcccaagctggtacgttgcatacacggacacgtttacgatgtagtagtcgatttacgcaaggacagccccacgttcaagaagtggcttgcatttgagcttatcggtgaaaagcacaacgaaatactcgttcccgcaggttgcgctcacggttatcttgtacttgaggacagcatagtatcctacaagtgcggagaaaaattctacggcgaatatgatgacggcattatgtggaacgatcccgacattgcagtagactggaagcttgacagagttggcggaattgataaggttatacttgccgataaggacaagaatctgcagacctttaaagaattcatgagcaagtacggtggcttttgatgagcagttttgattttgacacccttatagtcggctgtggactttccggagcggtaatcgcccgtcatttagcggaaaaaggcaagaaggtcgagatatgggaacgcaggaaccacatcggcggcaatatgtacgaccacgttgacgatcacggaatacttgttcaggattacggtccgcacacattccacacgaaagagaaatatctttttgattatatgtgccgctatgagcagtggtctgattacaagctgacctgcggtgcggtatggaacgatacatatacccccacccccttcaactttaccacgattgataagttctttgataagcaaaaggcagaaacgctcaaggcaaagctgactaaggtttacgagggcagaccgaccgctaccgttgttgaagttctcgaaaacgaggacgatgatataagagcatacgctcagtatcttttcgataacgattatgcaccgtataccgctaagcagtggggcgtatctccctctgaaattgacccgtctgtgcttaaaagagtacctctgcgtttttcgtatgacgagggatatttcgatgacgcttatcaggtaatgccggcacattcattcacggagttcttcagaaatttgcttaaccatgagaatatcacggtcagaaccggtgtcgaggcgcttgagcggattgctgtaaaggataataagctgtatgttgacggcgagccgtataataacattcttgtatatacaggtgcgctggatgagttattcggtgaaaagtacggcagacttccttaccgttcactgcgttttgagtataagtataccgacaaggatagccttcaggacgctcctgtcgtcgcatatcctcaggaaaagggctttaccagaatcaccgagtacaagaaaattcccgtccaggatgtaaaaggcagtacctatgcggtagaatatcctctcccgtataagtcgggcgaaaagctcgagccgtattatcctgttctcacaaaggagagcatggagcaatacgcaaagtacgaggctctggcatcgcagatcgataatcttatctgttgcggaagacttgccgatttcagatattataatatggatcaggcgttaaaacgtgcgcttgagcaatgcgataaaatagataatatataacgaaccgtctgagctgtgggcattgacccacagctttattttttacacttattgcaaaacgctttcagccatgttatactggtagaaagaggtgagcagatgaaaaaaagaatagcacggtcgtccgttttacatataatattgataataaccgccatagccgccgcaatgctctgcagacagcttgacaggatcggtactatgcaaatattcggcattatcagaagtctgatatatatttttatgtttctgatatggggaatcaccctgagaaacaggatagtgcagatacaggcaaaacgctttatgacatctatagcagggcttattgtgttctgggtagctatccgttcggtgaagttcgttatagcccagagtccgttcgctgtccgaatgctgtggtatatgtattatatcccgatgatatttatccctatgtttgcactgttagtcgctctttcactcggaaagcccgaaaactaccgccttcccggagttacatccttactgtatgtcgcttctgtcctgatggtaatattcgttcttacaaacgatctgcattgtcttgtgttcagatttccgggagaaagggaaatgtgggacgacagagattacagctatgcaggcggatattacatagtggcaggatatatgcttttatgcacaatcggcgcatttgtgactttaatatccaagtgccgtataccaaaggcaagaaaaacgtttattatgccgttactgcctgttgtcgcaatggttatctacacgttgctctatgtgtccggagaaatcacgggcggtacgttcattcacaggctggcaggcgacatgaccgttaccgtaagccttcttactgcgctttcttttgaattctgcatacaatgcggacttatccgctcaaacacttattatatacagcttttgcggccgtgtacagttcctgctttgattaccgacaatgattacaatatactcctctcgtccgattgtgccgaaaagatagaccgtgaaataatgcagatggcaaagtcctctcccgtaatgctcagcagcggaaaacgtctttcctccgccaagataaaaggaggctatgtcttgtggctggacgatctttctgagcttattgaggtaaacgacaagctggcagaggctaaggacgatcttaaggatgattatgatctgatttgcgaagaatacgatctcagaaacagagaggctcacatacttgagcgtgacaggatatatgacaggatcagccgtgaaacgtcaggtcagatagctgtattgaacagccttacagaccgcttcgaactgtcggaggatgaagatgagcgcagaaagctattgggtaagatggtggtaatcggcgcttatcttaagcgccggaacaatctcatattcatatcggaaagaagcagtatgataagcgaaaaagagctgtaccttgcgtttctcgagcttacggataatcttgagctgtacggcgtgacctgcggacttaatatcagattaaataagtccgtgccggctgtggcagtaatggagatgtttgatacattcgaaaaaatgattgagctgtcactggataatttatcggctgtgaatatatccgtgacgctaaacggcggtatattcacaatgacggtcactgctgaaagcagtacggattttaatgtaatgaacggtgattttgtaacggcggtatgtgatgatgacggcgaatggcagattgtatacagaagggaggctggaagatgcgaggcttaggcagacgctatctgctgcgcaggacggtaaaagacgcatttgataatctgccgtcgggtatatgttttttcgacagcaacggaatagcagtcctgtgcaacaagcaaatggacaggctgatatatgaattgaaaggctttgatgtacagtgcctcagtgaactgcaggatatattttcggagcataacagcggctcggtcgtacttgtaaagggaaaagcatggcgcttcagacttgatgtggcttctcttaacggtgtcggctactatacgcaggtaactgcaactgatgtagatgagctgtttccctacacgacgctcttccgatctgtcgcacgctcaggtaactttgccttgctgttcagctttttcacatttatgaacattattgaactcctctgtagtataatcctcttgtgagctttccgtcgggctttatatcgtcaagatacatttcaagcacttctcccgtatcggtttcgtcggtgaatttgagcaatacaaaatcgaactttgcaagctcagattgtctgtcgctgagatacagtttgtcggggttcaatatctcgacagtgttctcactgcacatacacggcatattatttccctgcctgtcggttatataatgcggacaatccgctcttttggtttttccgcagggcttgccgttgtttatcggacatcttctcgttatcataagaggaagtctgccgtagccgactattcctgtctttatctcactgtctgcacaaagtgacaccgcatcgctcataagcagttcaaacgaaagtgcggtatcgctcagtcccattttttcgtactctctgagcgaatagcggtttgtgatattgagtcttgacataccgtgcgccttcataccgagctttcttgctattcctatatgcgaaagcgtatgaacggcaatatgctcgtatccctgttttttcagcagggacagctttttcaatacatcgctttcacaatcggcaagaaataccggaggaacaacgattattctgaatttatcaggtgtagcttcgtcaagcagacccataggagcgtaaatataagaatattcatcctcctgcagtacctgctcaagctgtaaggctgtatttacctcacatctgaattcggggcgtatcttttttccgtccttgctgtcaagtggaatataaggcgatattctgtaatgatgagaattcttttcgagtatcttcccgcttacgttttcaattgcttttcttctaagctcgttaagctgagccgccgaaacggataacccgtcatcaacatttacggtgatatttcccggaaaatatacggtaccgccaagcttagtacattgattttcaagatattccgcagtaaccgctctgtttaccgccttttcgggaatatcgcctacagcggacgaacttacgccgcaagccgacagcttatagcaaacaggctgtccgctttttacgttaacggtaatatcggctggaaagcgtctgaaaggcttatgataatactgtttcatagcggaaagcaccttggacgttgccgatgtcacatcgtctttagtgcggacaccctgcatatttttgaaatcatcatcaaaatatccgcttgtaaatccgcttctcgaaaatacgtttttaagcgatataaggtcgggcgtaccgccgtcaagagccaccctgcaggcatttacggcacctgcaacgtattccggacgcttcattcttccctcaatcttgaacgaggtgatacctgctttcgcaagctcaggcaatttttccgtcaatgacaaatccttaagcgacagcacattgtgcctgtcgccgcttgtaaaatcaagtcggcacggctgagcgcacaatcctctgttaccgcttcgtccgccgagtacactgctcatatagcactgaccgcttatgcagacgcacagcgcaccgtgtacgaaaagctctgtttcaatgtcacagctttccgttattgcctttatctgtgcaaatgataattccctgcccagaacaacacgggtaaatccaagttctttcgccattatagcgccctcgggcgaattgaccgtcatctgcgttgaagcgtgtaagggaagctccggcacaatttgccgggaaagccttgcaacgcccatatcctgcactatgaatgcgtcaacgtccgcttttgcacagttttctatcgcttttgcaagcaagggtatctccctgtcaaatacaagggtattcagcgtaacatacaccttaacaccgctgtaatgacaaaaacgtaccgcatcgcacaactgctctgcggtaaagttatctgcattttttcttgcggagaagtattcttctccaaggtatactgcgtctgcaccggcacttactgccgctgtcagactttccattgctccgcacggagctaaaatttcactcataatgtcatctgaccgtcgtttacaatctcgttcatctgtgcgctgagctcggcatatttctttctcagtgccgataactcatcgttcaggtccttgacctctgcgttacgctgatttgcgtattcatcaaaggttttttcgtatgtatccacagtgccttgcagtttatcaatctgagccagcaacagctcatcctgaccgctctttgaaaccagattttcatggtctgttctcagcttttcaagcaattcctctgtgtgtctgttcttttctgtaagttctgccagccttgatttaagcgcctcgttctcagccgatgaagaatcggcattttcgcttgaaactctgagtgtttcgttttccgctttcaactcgtccacttgatttttcagctgtgcattttcatttttcaatgcgttatccgcattttccgccttttcggaaagcgctgtgttttcggctgtaagctcatcaatgcgtgtgcccagctgttcgatttcatcagcgccgatttcagtaagcgaatccttttccgcagtaagagcggtaacctgctctttcagtctatcgttctcggaccttagcgcaagcaaatccgatttctgagcctcagctcccgcaagctgttctttaagtgcggcaagctcactttgtgcctcagacgcagttattctaagcgatgcaagctcggtgtcggaatcggaaagctgcttttcaagctcctctgctcttttttcgcaggcaagagattttgcctgtatctcctgcgaaagctgctgagcctttatcacaacgtttctgttatcgtaattttcatcggctatatcgagcgccgcaagcattacaatatcggtaagtgacattgacgccgccatcgcactcagtttatctatccttttctgaagattctccgcagtttcgtacattctgttcggatcttcgcttttcaagtaaaaatcgtgtccgcttatagatatttttactttttccatataccctccgggatttatttataaaacttattttttgttatcaatattgcaacaatgacggcaagaattacggatatcagaaccgggaaccaggtatacggaagcggcagatccagaacattcataccgtaaaagctgaataccatcgtgggcacggacattactatcgtaataaccgtaagcaccttcattacaatattcagattgtttgatattacgcttgcaaatgcgtccattgtacccgaaagtatgtttgaatagatattgctcatctcgattgcctgctttacttcgatcagtacgtcttcaagaagttcctgatcttcctcgtacagctttattactctgcctctcaatatcttttcaagcactgtttcggtagatttaagcgatgttgagaaatatacaagtgatttctcaagtccgagaagctgtataagctccttgttcttcattgatttgtgcagctgctgttcaacatagttcgacagcttatctatctgcttaagatacaggagatactttcctgcgattcttaacagcatatgaaatacaaatcttgttttgaactgggtctgtatgccttttactatgccttttgtaaattcgtctattatgatgttttctttaaggcagaccgttacaacatggctgtccgttataatgatgcccataggcattgtgtaatagcttatcgtatcgtccttatcctgaaccttttccgcaacgggatagtcaaggactatgagcgtctgaccgtcatcgctttcaatacgggaggtttcttcctcatcgagtgcagaacggataaaatcacggtcgatgttcagttcctcctgaagcgaggaaatctctgtttctgtgggtgcaacggcagatacccagcatccgggctccattgtgtcaagctcaacaattgtgttttcaactgtcttgtaatatttaagcataacgtacctcttttctgcacaggaagccgttatgcgacgactgctgtgctgtattatttttcagttattcgtttcccgctggggtccgcagtcatcgtctttcacctcttttgacagttttattgcataaccgtatttattttaccacactttttacggtttgacaacagttttcgtttcgttttgaaaatttttttcctgctcttttttctccgcctgaatacgactgtagatacatccgcagtaattctgccggtataatccgtactgtgccgaaagctctatggaacgcttatatccgttgcgttttttaaaatcagaataaagatacggtattttatattcatcgctgagcctactaccaagctcgttcagctttgcggcatttttatgagggcttaccgaaagcgtggtgcagaaatactcgaagtccagttcttttgcaagccttgccgtttctctcagacgtatctcatagcacaaaaagcacctttccccgccttcagcgatattctccataccctttgccatatcaaagaatatctgcggggaataatcgccgtcaatcatcttcacgggatacctgaacggcttttcggctatcagacgtttcagctcgtttttacgcttttcgtattcttccttttcggtgatattcggattgtagaaaaacacggtgatattgaaatgctccgcaagatattcgagcacataactgctgcacggtgcacagcaggcgtgaagcagaagagtaggcgcatggttgagcgatgcgattatcctgtccgtttcaagctgataattagtcatcggtttttaccagcttttcttcggctatctgtcgcagttcatcaagcgagccttccctgacggtattttcatctatgataaaaagatacccatcgtgagttacgatataggcgcttgatttatagaaatcaacagacgccacagccgtccagtccgctatagctttagccgcaccgccgtttttcaaaacgatactgccggctgttatttctatcgcatcatatttgttttttgagttgatgccgaaaatctcatttgtgtatttcttcagtgcaaaggcaaccgcaagcattgcggcggcgataagcagaaggcagacaaccacagcaagaagaaacatccacatctgcgttacagccgcaagtactactcctgcgacagcgataagaaccatcgccgcaagataacagatcatataaattccggacgatttgttttttctgaaaatggtgtatttaacaaattcactgacattttctttggtatatttaagttcggattctatcatttcaaactcccttcatcgtaagagaaatacgctttttggcagggtcaatatcaagcacctttacctttacaatatccccgacctttacaacctcaagaggatgctttatatatttgtcgcatatctgcgagatatgtacaagtccgtcctgatgaactcctatatcaacgaatacgccgaaatcaataacatttctaactgtaccgtcaagtatcataccgggcttaaggctgttaatatccgctacatccgttctcagcaggggcggcggcagttcatctctgggatctctgccgggctttgcaagctcgtttgctatatcgctcagagtcatctcacctatacccagctcttccgacagcttctttacaccgatggctctgacctgctcttttattgacggaatgccgcccgaaacatctgcaagtttgaatccgcacttatcaagaagtgcttctgccgccttatagctttcggggtgtaccgaggtgttgtcaagcggatatttaccgccgtgtatacgcataaagcctgcgcactgttcgtaagccttcttgccgagtttcgacaccttcaaaagctccttacggttagtgaacacaccgttttcctctctgtatgtaactatgttctttgcaacggcggaattgatacctgcaacatagccaagcagtgaaacagacgctgtgttaagatccacgccgacgctgtttacactgtcctctactactccgcccagagcgtccgacagttttgcgggcggcatatcgtgctgatactgacctacaccgattgctttcgggtctatcttaacaagctctgcaagcggatcctgaagccgtcttgcgatagatacggcactacgcagtgaaacatcatattcggggaattcctcagccgccagcttgcttgccgagtatacgcttgcgcctgcctcggatacgaccatatagcttacctttcggtcaatcttctttaaaagatctgccataaacacttcgctctcgtggcttgccgtaccgtttcctatagcgataatatcgaccttgtgcttttcgataaggtttttgattattctttccgctcccgcaatatcgctcttcgggggtgtcggatacactaccgatgtgtcaagaaccttgcctgtagcgtcaacaacggctaccttacagcctgttctgtagccgggatcgaagccgagagcaacgctgttcttcacaggcggctgcataagaagctgtcttaggttgtccgaaaatgtgtgtatactgctgtcacacgctttctcggtaagctcgtttctgagacgtctttcaagcgaagggtgaataagacgtttgaagctgtcgtcacaagctgagcgcaccagccgtccgcaatcgttttccgctttcacatacgctctgtaaatatgcttcataacatactgttcttccggttcaatgctgaccttgagcgcatcctcacgttctcctctgtcaagtgcgagaagtctgtgcggaggtatcttacacgcaagctcgctgtaatcataataattcttataaacggtttcagctttttcatcggtagcttttgatactatcagtgcatgacccgtatactcagcatacagctttttacgaagatccgcatcatccgaaaccgtttcggaaataatgtccaatgctccgtttatggcatcgtcaacggtttcaacgcccttttcttcacttatatatttctctgcttcggcagtgggagaagcgagcgtctgagcgagtatgaaatcggcaaggggctgaagtcctttttcttttgctatgcctgctctggtcttacgcttgggcttgaagggtctgtagatgtcctcgacttcagcaagcgtctttgcgtttaaaagatcctgcgtaatcttgtcggtaagatttcctccgctttcgataagcgactttacttcttcttttctgctttcaagattacgaaggtatgtcagcctttcgctgagttctcgcaaaagctgatcgtcaagtcctcccgtcatctcttttctgtagcgagaaataaacgggattgtattgccgccatcgatcagctttaccgtgttttctacctgcgtatttcttatcttgaattcttcagccaactgctttaaaatatccattgcttatctccgttttctcagaataattttcctacgatttcaaatacgggtccgtgctgccacaggaacgtgcttagctgtatttcaaatccctcgccctgattgcaggcaaagtcgataggcttcatcttgggcagaccgtatcccgaaagaagattcataataacgcctgaatgcgtgataacagcggctgatgtaacctcgtttgccatcatatccttgaatatttcttcaaggccttcaaggcatcttaatgtaaaatgtccgtagctttcaccattcggaggtgcggcatcatatccgcccttcagccattcaagatacttttcatcgctctgaagctcggcttgcgtttttccttcgtattccccgaagtcaagctctgcgataccgtctatgcgcttaagcagacgttcgggataaataatatcggcggtctgcaagcaacgcttgagaggagacggcatacgagatttcgcggagtgactggagttcagacgtgtgctcttccgatctgttcttgagaagatccttaacatagggctgatcgagtaagcagatttcttctgcgaactttctcattctgccgtcaacgatcttctcaagaacgttctggggcttgggcttagcagactgctcattttcgttctgaacgagcttgagctgtacttccttctcagcttcgataacagaagcaggaacgtcagcctgtgcaacaaactgaggagcgcttgctgtaatctggagaagaagatccttagcgcaagccttaacagcgtcgctgtcaacatcgtcagcttcaatcttgatcatagagccgatgatagagccgccgccgttgtgtgtgtaagcaaagagattgcctgtcattctcttgaaacgacgaatctgaatgttttcaccgattgtagcgattctctctgtgagaatatcagcaatcttttctgtctgacctgcgggaacaacttccttaagtgcgtctacatctgcaacatcattatcaatgattgtgtttgctacgagctcaacgaactcgataaatctgtctgtcttagcggcaaagtctgtttcaacgttgatttctactacaacgccgaccttcttagcctcgtcaatctttgtatatacaagaccttctgcagcaattctgcctgacttcttggcagcctttgcaaggcccttttcacgaagattcttgatagcggcatctacatcgccgtttgtttcttcaagtgctctcttgcagtccatcataccgcagtttgtaagttcttttaactgctttactgcctgtgctgaaatagccatggtaattctcctttatatttatattcgttgttgattattcttctgtagcttctgcttcagcctcagcaacttcttcagttacgtcagcctgaccctgtcttgcttcgatgatagcgtcagccatagcgcctgcaatcagcttaactgcacggatagcgtcatcgttaccggggataacatagtcgatctcatcggggtcgcagtttgtatctacgatagctactacggggataccgagcttctttgcttctgatactgcaatcttttccttgcggggatctacaacgaacagagcgctggggagcttcttcatgttcttgataccgccgaggaacttctcgagcttttcaatctcgaggttgagcttaacaacttccttcttgggaagaagatcgaatgtaccgtcgttctccattgtgtgaagctgttcaagtctattgattctcttctcgatggtcttgaagtttgtcatcataccgccgagccatcttgcgtttacatagtgagcgtttgctctgagtgcttcttccttgattgaatcagcagcctgcttctttgtacctacgaacagaacctcgccgccttcagctgcaacttcgtgaatgaagttataagcctcgtcgagcttctttactgtcttctggagatcgataatatagataccgtttctctctgtgaaaatgtagggtgccattttggggttccatcttcttgtctggtgaccgaagtgaacgcctgcttctaagagctgcttcattgatactactgccatggtagtgtcctccttgatttttggtttttttcctccgctacgctgatacgttcaagctcgtgagcaccgcagaacgctatacataacgtgtggatttgctgttcaacagcctttttgccattcaacagccttattattataacataataggagcttcaaatcaatattcgtactgaaaattttcattgtgctatttaaacaaatttttgagaaatccgccttttcgttttggttgatacggaaaatcgcatcctacaagtatcgtatcctctccgattatctcaatatccgaccagttgatgaatatatcttcctccctgccgaaaataccgaagcaacggcttttgccgtaaacgatgatacggcatatcttcgcattgcaggaatctatttcaacatcatcgacaaatccgatcctgcagcccgattttatgctgattacctctttgcatcttatgtcactgaaatggcacatcataacacaccaccgccttgtttccggtttgttttatgatatgccgcaaaacgtatccatataccattaatatacggataaacgcaaatcgacacgcataaatataacgccgacaatgcggcgctgtatttattctgattttgcgggaatatgctttttgatagcctcgaagctctcctcacttataacgtgctcaatacggcaggcgtcctcgaccgcaatcttctcatctactccgagcgctgtgagccattttgtaaggagcgtatgacgctcatacattttatttgctatttcactgcccttttcagtaagctcaatgtagcccttcgagtcaacggtaacatatccgttcattctcagattcttcattgccacgcttatactgggctttgaataatcaaaataatttactatatctattgaccttacattgccaagccggttctttaatataagtacggattcgagataatcctctgccgattcgtgtatctgcataacgaattcctttcctgccttttgcaagcattaacatatttttataagtataacacgttttctggggattttcaagtatcaacgttcaacttttacagcaaatatttcagccggaatttaccgtaacgatgagcttatttaagacaatccgatgaaaaacagcttaaaatacacttaaaacagcctgcactttactaaatgacaacaataaagcaaatttgcaagtttatttttgtgaattttcaccttgacaaacttgcaaaaccgtgttaatataagcgagtaaagataaatatgtatgttcaaaagcatacaaatcagtacaaggagagattcaaaatgaagaattttaaaagagttcttgcaatgacaactgccgcagttatggcagtaacatcatttgcaggttgttcatccaacagcgcaaacagcggtaatgttggcggctcaacaaacgtagccgaaggcgaaaagacaatcgttatcggcggaagcggccctcttacaggcgatgccgctcagtacggcgtaggcgttaagaacgctatccagcttgcagtaaatgaagtaaacgctgcaggcggtgtaaacggcaacaagctgaagctcgtattcgaagacgatgaggctgactcgggcgataaggcagttaatgcttacaacacgctgaaggatcagggtatgcagatattcctcggcacagttacaacaggttcatgccttgctgtagttgacaagtcaaagcaggacaacatattccagttcacaccctctgcatctgcacaggacgttatcgctaacgacaactgcttccagatctgcttcacagatcctaaccagggtaaagcatctgctgactgtatagcagacaacaaggttgctacaaagatcggcgttatctacgacagttcagacgcttattcttccggtatctacaacgcattcaagacagaggctgctgcaaagggtcttgagcttgtttccgaacagtcattcacaaaggacagcaagacagacttctctgctcagatagctgactgcaagaacaagggcgcagagcttgtgttccttcctatctaccatcagcaggcttctcttatcctcacacagagcaagaacgcaggcttcgcacccaagttcttcggttgtgacggtcttgacggtcttacatctatcaagaacttcgatacttcacttgcagaaggcgttatgctcttaacacctttcgcagcagattcaaaggatcaggctacacaggacttcgttaaggcttataaggcagcttacaacgatgaaactcctaaccagttcgcagcagacgcttatgacggcgtaaagattcttgccaagctcatcgaaagccagaaaatcacaggcgatatgagcgcatcagacatctgcgaaaagctcaaggcaggtatcacagcagctgatttcagctatgacggtcttacaggtacaggtatgaagtggaatgccaacggcgaagtttcaaagtcacctaaggctgttgttatcaaggacggcaactacgctgctcttgacaactgataatcggtatacaatataaatcattttaagacccgacaggctccggcctgtcgggttttgaattttatgcaaaaaaatgttgcaaacggttatgccgtgtgatataataaatagtattagaacttcactaaggaaggatgttataaatgggttttctcaataacctcataaacggcataagccttggcagcatatatgccgtaatcgcactcggctatacgctggtatacggcatagctaaaatgcttaactttgctcacggcgatgtaatcatggtcggcggatatgtaattttctattcgatgacctctttcagtatcaatccgtacctttccgtacttattgcggttatcgtatgtaccgtactcggtatcgtgattgaaaaggttgcgtacaagcccttaagacaggcgacctcgctgtctgtacttatcactgcaataggcgtaagctatttccttcagaattcagcgttgctcctgttcggtgaaaagcccgttaacttcacctcggtagtaaatgtcccgagtatatcgctctttgacggacaggtggtcatcacaggtgaagcgatagtcgctatcgtcgtttcgatacttatcgttatcggcctttcgctcttcataaacaagacgaaaagcggccgtgcgatgcttgcggtatcggaagataaggatgcggcacagcttatgggcataaacataaacagaaccatctcacttacttttgccatcggttcgggacttgcggcgattgccggcgcacttctctgctcggcttatccgacgcttcagaacacaacaggcgcaatgcccggtatcagggctttcgttgcggcggtattcggcggtatcggttcggtacccggagctatgattggcggtatcctgatcggtgttatcgaaatactcggcagagcgtacatttcacctcagctctccgacgctatcgtttttgcggtgcttattctcgttcttatcataaagcctacgggaatacttggcaagaaggtaagagaaaaagtataattacagaagggattggtttttgtgaataataaaacagccttggcaaaaacgaaaatgctgaagccgcagacaaaaaagagcttcacgacatatataatggttacgcttgcctttgttattatgatgattctttcatcaacaggcaacgtttcaagtcagatagacggacttttagttccgctttgtgtatactcgatactcgcagtatcgctcaacctcactgtaggtatactcggtgagcttagcttaggacaggcaggctttatgtgtgtaggtgcctatgccagcgcactgttctcgatagctacaaaagaaacaatacttgtcgaatgggtgcgttttccgctcgctatacttgtcggcggtatcttcgccgctatattcggcatactgataggaattcccgtattaaggctcaacggcgactatcttgctatcgtaacgcttgcattcggtgaaataatcaagaacgtatttgcggcgctctatgtcggtatcgacagcaagggtcttcatatcgcactcaatcaggcagatatgaatcttgaagcagacggcaccgaaataataagaggagcgctcggtgtaaagggtgtaccgaatgattcttcattcgttgtaggcttcatcctgcttctgataacgcttatcatctcttataactacatcaactcaagaacgggcagagcggtaaaggctatccgtgacaactcaatagccgcagaatccgtaggccttaacataacgaagtacaagctgataacatttgcactcactgctttccttgcaggtatagcaggcgctctgtactctcacaattacgctacattacaggcttcaaagttcgactacaacctgtcgatactgattctggtattcgttgttctcggcggtatcggtaatatcagaggcagtgttattgcggctgttgtacttactcttatccccgagcttctcagaagcatcaacagctacagaatgctcatctactcaatcgttcttatcgttatgatgatactcacatcaaacgaaaaggcaagaacatttatcgtaacgaatttcggaaagctcaaaggtatggtgctgaagattttcaaacgtaaagacacggctgaaaaggaggtcaagtaattatggcacttcttgaagtaaagaatttaggaatatcattcggcggtctgagagctgttgacgaattcaatgtttcaatcgaaaagggcgagctttacggacttatcggtcctaacggcgcaggcaagactaccgtgttcaatatgctgacaggagtatacaagccctctaagggtgttatcactcttgacggtgaaaacataacaggaaaatctacaagagatataaaccgtgcaggtatcgcccgtacattccagaatataagactgttcaaggaaatgagcgtgcttgataacgttaaggtcggacttcacaaccactacaagtacagcactgcagagggtgtgttcagacttccccgtttcttctcgacagaaaaggaaatggataagaaggcaatggagctgctccacgttttcgagcttgacgataaagctgatttcttagcgtcaaacctgccctacggcgaccagagaaagctcgaaatagcaagagcgcttgccacagagcctaagctgttactgcttgacgagcctgccgcaggtatgaaccctaacgaaacggtagagcttatgaatacgattcgttttgtaagagataactttgatatgaccgttcttcttatcgagcatgatatgacgcttgtatcgggtatatgcgaaaagctgtctgtacttaacttcggtcagcttttatgtcagggtaacacttccgacgttcttaacaatccggaagttatcacggcatatctcggagaataagggggactgcaaaatggcaatgcttgagatcaaggatctttatgtaaattacggaatgatagccgccctcaagggcatatcatttgaagtaaacgagggcgaggttatcgcacttatcggcgcaaacggtgcaggtaagactaccacgctccacacaataacgggacttctccacgctaagagcggctctattacattcaacggtgttgagcttaccaaaacacccgctcacaagatagttgaaatgggtatagctcacgttccggagggcagacgtatattccagaacctcactgttcttgacaaccttaagctcggcgctttcacacgcaaggataaggaaaatataagcaaggacattgagatggtatatgagcgtttccctcgtcttgcagaaagaaaaactcagatagcaggtactctttcgggcggcgaacagcagatgctggctatgggcagagcgctgatgtcgaagccgaagattatcgtaatggacgagccttcaatgggtctttcacctatctttgtaagcaatattttcgatataatccagactataagagaaacaggaaccactgttctgctggttgaacagaatgctaaaaaagcgctttcgattgcagacagggcttacgttcttgaaacaggtaagatttcactttcgggcaaggcgtccgatcttatcaatgacgcttcggtaaagaaggcttatctcggagaataaggaggagcttatgggacgtattattacaatcgcaagaggaatgggaagcggcggcaagactataggaaaaatgcttgccaaggagcttgacattccgtactatgataaagagataatcagaatggcaagtgatgaaagcggcatcaacgagaagcttggggctgagtgtggggctgccgccctcaccccgcttggggctacgccccaaaccccattttcaaaaattatataggtttatcgacagtctgaagtcacagttttttactgtgacttttccttttctgctttaacggaggtgtctatgaatcgttacgatgaactgatgaaacgtttgcttgctgtttgcgaagctcggcccgaaataaaggcggtaataattttcggctcgcaggcaagagaaatttcaaagtcggacgaatattccgaccttgctctgaaccgcaaatattactgtatgaaaataatataataggcaaactgggtaagcctgtatattcatttgttgaagacacttttgcaggagaaaaagaacgccgtatcctattcgaaaaatcacttgatgtcgatatgattgttatgtctgaggacagccttgtaaatctacttaaatcacacaatgctgattttattctgaatcgtggtttttcgctttgttatgacgcttgcggcatatcacagcttatttgtaaatcatcaaaaatcacaccctgtgattttaccgctttatcagaggaaagtttccgtaatcttacaaatgattttatgttccataccgtgtgggcagagaagaaaatcagacgtggagagctttggacagcgataatgtgcgtgaacggctatctcaagacaaaactgatcacagttatcgaaatgtatgaacattgcattcacggcaccgcttacgatacatggcataacggaagaatggcagagcagtgggcagagccgttcatcgtcgataagcttggcgattgcttttcccgctacgatgcggacgacttgctctccgcccttgcagccacaagagagctgttcctgaccctcgccaaagagtgcgcctcagcttacggctacactaccggcatacccgaaatcgacagctgaatacagtaaagccgcagacagctttatcgcaggtctgcggctgttttgtttacttttcacagaaaagctctatctgctcgccgagcggtccgtagcagaaagcaatccttgctacaagcggattctcggcaggaatataaatgtttttcggctttacgaatacctcatatccggctttttcaatcctgtccgcaagctcgtccacatctgtcacgctaagtgcgaaatgccttattacgccttgcggcaagtcgctttcggcatttgagaaaacttcgattatgccgtttcccgtatcgaacataactccgataggattgtcacagtcgggaccccatcgccttataatcggtatgccgagcgtatcgctgtagaaagtgataacccttcttaattgttcaccgctgcatctgaatgaaacgtggtgtataccgtttatcatacattatacctcttacagctgtaccggctctatcttccatatctccttggcgtaatcgcttatcgttctgtccgagctgaacttgcccgagaagcacatatttgcccagcactttcttgcaaagtcaaggcgggagtttgcatagtcgctgtttgccttcagctttgcctcaacgtaggattcaaggtcgccgagcaggtagtaatgatcgggaacgtgccagcttgcgccgtctgtcagagcaaagtaaagctccttgaaatcgcctgttccgccatcgctcacagtaccgtcaataagcgtgtcaagcacccgcttgattttcgggttcttgctgacaagctttctcgggtcatagtccttcattatcttttcaagctcctcgacccttgcgccgaatatgtagttgttgttttcgcctgcctcctgcactatctctacatttgcaccgtcatatgtgccgagagtaacagtgccgttgagcataaacttcatattgcccgtaccggacgcttctgttcctgcggtagaaatctgttctgaaatatcggcggcagtaaccagcttttccgcataggaaacgttgtaattctgcacgaatacgacctttatcagcttgtttacttcttcatcggcattgataagtctgcctatctcgtttatatacttgatgatagcctttgccctcatgtatccgggcgctgactttgcgccgaaaataaacgtggtcgggtagaagttctttatgcttccgtccttgataccaaagtagatataaaggatgctgaacgcattgagaagctgcctcttatattcgtgcagacgctttatctgaatatcaaaaatgctgtttgtatcgacttcgattccgtccttggatttcatatactcggcaagctgatttttcttttcctgctttatattcatgaatctctgcatcatattgttgtcgccacgaagtctttcaagcgttttcagccttgaaaggtctgtcacccacgaattatcaccgagctgttcggttatgagcgatgataactccttgttgcaaagggcaatccagcgtcttggtgtaatgccgtttgtcttgttctggaatttctcggggaaaagctgataccagtcctttaaaacatcgttcttaagtatctcggtatggagcgccgcaacgccgtttgtgtagcttgagcagtaaaccgccatcttagccatatgtacaacgccgccggaaatcatcttcatatagtcggtcttacccttgggcatatcatttgcgtacatttcggcaacgaaagcctcgtttatctgtaaaataatatcgtaaatttcgggcaggacttcctttactatatcaagtccccacttctccatagcctcagccattacggtgtggtttgtgtagttgaatgtctttttggcaatttcaagagccttttcgaatgaaagtccctcgttatctacaagtattcttataagctcggggatagatatgacggggtgggtatcgttaagctggatagtaaccttttcgtacagcttttcgatgtcgtatcctgccgccttgtgcttcttcacaatatcggcaagagaagccgcacagaagaaatactgctgcttgaagcggagaatctttccctctcttgtatcgtcgttaggataaagcactctcgaaatatcctcagcctttatctgctctatacttgcgtttacatagtcctgtgcattgaacttgagaaaatcgaaagtattcacaggctcagcctgccatagacgcagtgttcctatgttttttgtgccgtatgcgacaatcggcatatcgtaaggcactgcaacaactgtctgatttgcaaagtttataattaccttgtcactttcgtttcttctgctccacgggtcgccgtacttagtccagtcgtcagcctcttctttctgaaatccgtcaacaatagactgcttgaaaagtccgtacttataacgtattccatagccgtcaagcggtaaagacaatgtagcggcactgtctaaaaagcaagccgcaagtctgccgagaccgccgtttccgagtgcggcatcttcaatttcttcaaggtcggacagctttgcaccgagcgaggaaagaacctctctcgcatcgtcctcaacgccaagacagagcaggttattgtaaatggctctgcctaccaaaaattcggctgagaaatagcacgctctgcgtgtggcaagatgagcctttctgctgtctttccagacaggcgctatctgtttcattatcgcagatgaaagcgcttcgtgcagctgatagggctgtgccttgtccgctgtaacttcatacttgtcggaaagtaccgattcaatatcggctttaagtaattccttgttcatagctcctccaaaaatcatatatccgttaatatgccgataacggcatttgataccagaaatcccttcggggtaaggcttatcgtcttatcgtccgttttatacaggtcgtcgggaatcagcctgcacttatttaatatatcgtcttttgttatgccgaaacgtttttcggccgtatcaaaatcaagcccctcgctgagcctcaatttcagcattgcccattcttcatagtcgccgcattcacgttctgttataactgcaggctgaacctcgctttcgataaacgctctgaggtcacgtccgacagcgaaacgttccccgttgtaataagaatgtgcggcaggtcctatgccgagatattcctcgcaccgccagtatctgagattgtgcctgctctccatacccggctttgcaaaattgcttatctcgtattgtctgaagcctttatctgaaagacgttctaccgtttcaagataaatatttgcatatccgtcttcatcgggaaggataagctctttttttgcaaacggcgtatccggctcgattttcagcatatacgccgaaatgtgacttagcggcagggaagtcatatagcttatcgtttcaataaggctgtcgcttgtctgaagcggtattccgagcattatgtcacccgaaatattatcaaagcctgctttgtatgccatttttacagcatctgcaccgaccttgctgttatgccttctgccgagcgctttaagttcgttatcaataccgctctgcaagccgaatgaaatcctgttcacattatgtgcttttaatgaacaaagtgcgttttcatcggtacagcaaggatttgcttcaacggtaatttctgcgtctgaggcgatgtacggctgaatttcgtccataatatcacatatctcacgccaaagcagtatcggtgtacctcctccgaagtacaccgtgtcaaacctgagattttcgttctgcgacagatagtagcgcagatttcttatcactgcgtccttgtatctgttcgccgtatcgctgtcaaaagctaccgagtagaagtcacagtaggggcattttgacaggcagaacgggatatggatataaagccctttattcatcaagcttaagcactgccataaacgcttcctgcggaacttcgacactgccgagctgacgcatacgtttcttaccctctttctgcttttcgagcagtttcttcttacgggtaatatcgccgccgtagcactttgcaagtacatccttacgcatagcctttacggtttctcttgcaataattttgccgccgaccgccgcctgaatgggtacctcaaacagctgacggggaatgttgtcctttaatttttctgcgatttttcttgctcttgcataagccttatccgcatgaacaacgaatgagagcgcatcgacaacctcgccgttaaggagtatatcaagctttacaagacgtgacggaacaaatcccgacatttcataatcatagcttgcatagccctttgtgcgtgatttcagagcatcgaagaagtcgtatactatttcgttcagcggaagatcgtagtgcatctcaacacggttaagatcaaggtatttcatatccttgaaggtgcctcgtctttcctgacacagatccattatactgccgacatactcagacggagtgtagatattcgcctttaccataggctcttccgccacttcgatttctgacgggtcggggtagttcgtggggttatcaataaatatcgtttccccgtctgtctttgttatcttgtatacaacagaaggtgcagtggtaacaaggtcaagattatattcacgttcaagtcgttcctgaatgatttccatatgcagaagtcctaagaatccgcaacggaaaccgaagccgagcgctatagaggtttccggctcgaatgtaagcgaagcatcgttaagctggagcttttcaagagcgtcacgcagatcgccgtactttgcaccgtcggcgggatagataccgctgtataccatcgggtttacgttacggtagcctgcaagggcctcttttgcagggttgcttacaagagtgaccgtatcgccgacctttgtatcgcctatcgactttatagatgcggctatatatccgacctcgcctgcacgaagctccttagcgttctcaagagcctttgcgcccatatatccgacatctacaacatcaaactcagcaccggtagccatcatttttatcctgtcgcccggttttaatgtgccgtcctttattcttacataaacgataacacctttataagcgtcatagtagctgtcaaagataagcgctttcagaggagcgtccggatctcccttgggagctggaacgttctttaccacctgctccattacttcctttatgtttatgcccatttttgcggaaataagcggagcttcatcggcaggtatacctatcaccgtttcaatttcttcctttacttcatcgggatgggcggagggcaggtcgattttgtttattacgggaacaagctcaaggtcctgttcgattgcaagataggtgttggcgagagtctgcgcctcaatgccctgtgttgcgtctactacaagtattgcgccctcgcaggcattcagcgaacgtgagacctcatagttgaagtcaacgtgaccgggtgtatctataagattgaaaacgtaggtttcgccgtcatcggctttgtatctcagccttaccgcacgggctttgattgtgatgcctctttcacgctcaagatccatattgtccagtatctgttcttccatttctctgtgtgcgaccgtttcggtctgttcgagtatcctgtccgccagagtggactttccgtgatctatgtgcgcaatgatacagaagttgcgtatctcctgcatatagtctttatctgccaagctaaaaatcctttcttttgtaaaaaatcagtctatccataaaattatagcataatccgcacggaaatgcaaactatatttatatataaatactgttttaaagaggatgaaaaatgagtgatatgttatcatacgaggctgtacagcttaaaaagctgcttgccgaggaaaaggatatacgaaacaggtatatttccgccgccgaagaaatatccgatcctcagcttaaggaaaagctgcagaaatgcgccgcagtacacggcagtcacatcagcgttataaacggacttacgggggagaagaatgattgacgagaagaaccgcctgaatgagcttctgagggctgaaaattcgcttgcacagaaatatgccgttatactttgcagtgcggtgagcggcgatataagaacaaagctgacgttcaaccagcgaggcataaacgaagcggcatcgtttattattgacgaaatgaattcacgggggtggaacgtgccgaaaagcgtgttgccaccgaaaaactaaagtttccgtctttcctgccgatatactttacagaaggtaaagaagggtcaatgaaaaggcacggaaagggtggtattattatgtctgccgtaaacacaaattatgaatacaagcctgcttacagtgtaagtgcaacggacaaagccgacaagtcaaaggaaacctcaacggttaagctaagcacggacgcacagaaatatcttgaacagcttaaaggcaaatataagaacgttgattttattgtggctgatttttcttcggatgaggaggcacataagcatctcgcaacaggaaagggcgagtataactgcgtcataactcccgatactcttgaaaaaatggctactgacgaaaccgaaagggctaaattcgagggcattattgataaggctattggcaaactgcccgaaataagaaaacagctcggcgatgattcggagaatgttacaaagctcggtatcagcgttgacagtgagggcaacgtttcgtattacgcacttataaaggaaagccttaaaaagaacgaagacgttgaaaaagccaaagaaaaagccgccgaaaaaaaggcggaggaggctaagaaagaggaaaaattccccggtatgaaaacagtggcaacgctttttatatcgtttaccgtaatgctcggtgtgctgtgcttttgcgaccccgatgcaagaatagctcagtacaatgtcgaaagctatctaagcggtgaaattgctgaaacagatacaggaagccttgctatgctgtcggaaggagccgctccttatgtagagcgtctgaaagatagcgacagtgcctattacaactgctgtaaccgtgtattgataacaatgaaggagagccggacttccggagtatacttccctttgtcatttacttctttaaaagcagatgaaatatatgacaggatataaaattttttttgcgggtagcgatttttcgcattaaaatgccgatttagctattgactaattttcagcgttatgttatactaatgtgagaaagattatcagtttatccacggaggtgtaatatgacgatattctatgagtttgaaggtaagctttatgctaatataacaaacagatgtccgtgttcgtgcgttttctgcataagaaagaacggcgacagcgttgcggataatgacagcctgtggcttgagcacgagccgagctatgaagaaattatcaaggctttcgacgattttgataagacgggacttcacgagcttgttttctgcggttacggcgagcctatggagcgtgccgatgttctgcttgaggtcgcaaagtatgtaaagcagactaccgatatgaagattcgtatcaacacaaacggacttgttgattttatcaaccctgcgtttgattcatacaagatgagatatttaatagattgtatttccataagccttaacgctcccgaccctgagagctatcttgaggtctcacgtcctaagttcgggcttccgtcattcaattctatgcttaattttgccgcaacagtaaaaactatcgtgcctgaggttatgtttaccgtggttgatataataaagcctgagcagattgagcagtgcaaggagcttgcagaggggcttggtattcctctgagagttcgtcattgggttacggataacgagagttatacctgacaggagggcagtatgaattattctcaacagagaaattgcataatgaatatcgttgtttcgaatcctgtccaccctaccgccgagcaggtctacgatatagccagacgcagttatcctaaaatcagccttggtacagtttaccgtaatctcaatcagcttgcggaacacggcatactgaagaaaatatgcagctcttacggaagtgttcgttttgacggcaggacagatccgcattttcatatgatatgcagctgctgtgaaaaggtctttgatgtggagcttggtgaaatgatgtgtcttaacgataagatacacacaaagtatgactttgatgtaaccgagtacgagataagcatcaagggtatatgcagtgaatgcagagagaagcagggtaaaagcgaatcggcgtgaattcagtaaacagtgaggttgcattttgaattttgataaattaaaagaactatgtagattgtcaagaataaaatggtctaagcacgctttggaaagaatgcaagaaagaaatatacggcgagatgatgtgaaaaattgtattatgcatggagagataatagaaaattatcctgatgattttccgcatccaagttgtcttatatatgggtatactataaatgatcgttctgttattcacgttgtagtcagttgtaacggagaaaatgtcggaataattactgcctattttcctgattcggatgaatttgaaaatgatttaaaaacacggaagaggtgatttgtatgtgtatgctatgtaagtgcaaaatgataaaaaacagctttacaactcatgttgtcaattacagtaattcggtaataataattaaaaatgtaccttgcgaggaatgtgaacaatgcggagagatattttacacagatgaagttgccgaacagctcgaaaaacttgtagaagcggcaaaaagtcttttacaggatatttctgttatcgactattcaaaagttgcgtaatcaatatctgaaatattgaaataaaagtgggcaattttgtatttgctcactttatttttatctgaaaaaacagggaaacgctttcaatctattgcttttttatccgaataaggctataataaataggataacttaaaaaggaacgtgatacaatgcttataagaatagcaggtacggtcagcgagtctattgtagacggaccgggaataagatatacgatatttacacagggctgtccgcatcactgtgagggctgtcataatcccgaaacgcatgatttcagcggcggcaggcttgcggataccgacaagatatataatcacattgcggaaaatcctctgctgaagggtattactttttcgggcggagagccgttctgccagcctgcaccgttatatgaccttgcaaagaggataaaggaaaatacaaagctcgatataatggcatataccgggtttacctttgaacagcttgttgaaaaatcaaagacggatgaggacgttaaaaatctgctgtcggtagtggatatactggtcgacggcaaatttatacttgcccagagaagccttgaactgcatttcaaaggaagccgtaatcagaggataattgattgcaaaaaatcactggaaacgggtaatgttgtaattaaggagttgtgatgaagaaaagaacgacaattcgcatttctgcgtttttgctgtgcttatgctgtgcttttttcacctcgtgtaaagaggatgacggcaagggatatgtgttcggatatgatatatcgtcaaatcccggaagccttgaccctcaatacgcttctgacagggaatcatatcttataatcggctcggtgttcgagggcttgttcaggatcggagcggacggcaatgcggaaaaagcgatggctgaaagctataccgtttcagatgacgggcttacatataacttcaaactgaagcaggacagatactggacagacgtaaacggctacagcaagaaggtcacagccgccgattttgttttcggcttcagaagattattcctgccggaaaccagagcgccgaaggcgtcggaatatttctgcgtaaaaaattccgataagataaacagcggagaaattaccgacctgtcacagctcggagttacggcgcagggggattattcgcttacaatagaactgcaatataccgagccgtcattagcgatgcttcttgctatgccggcggctatgccgtgcaacgaggaatactttatcaaggcacagggcaaatacggtctcgacgcagagcgaactccatcaaacggtccgttttatgtaaagacgtggaattatgacgcatggagcaacaataacaataacctcgttcttcgttacagcgacaagtataatgagcacgatgaggtaactccgctcggacttaacttcttcatcgaagataatcatattacggatttcaccgacggaacatcgcagagcatcgttctttcgggcagtaaggcaaagagctatcttaacaagaattatatctatgacgaattctcgaccgccgtttacggcattacaatgaacacttcaaattcgatattcaagagcgacaagctccgctacgccttactgtatgcgaccgacaccgcagagctcgaaatgcctttcggatataccgttgcggatggtgcggtgcctccgtccgttaaaaattcgctcggaagctaccgtgatgctgtgggcggcaaggcagtggtaaagcccgatgagattaaggcgtatacggcatatcagagtgcgtgtgccaatatcgacaaggcggatttgtacagcgtcaatataattgctgtagaaaaccgtgacgaagaaataggcgaatcggtaaagggcattttacagcagtggcaggcaaagctcggaatgtattgcagtatctcatatataagcgaaagcgaatatgacgagaagctgaaaaacggcgattatactctggcactgacacgtcttaacggcagttataattgccctgaggcgtatcttaacagctttacgggtaacgtgaacaaatacagtgctatgaacagcgaatattccggactgctcgaaaaagcgtcacaggcgaaggatgagaaggaggaatatgagttgtgcagacaggcggaaaaacagcttatatccgacggcagattcattcccgttgcatatgttactgaatattttatcagtacaaaaaactgcgaaaatataatttatgacgcatttacaggacaaatcgactatcgcaatgcgctctattttgactgataatatgacagtaaagagaaaaaccgataaaaattgcgggtattgattgactttttattataggtatgataaaatcaatgtaagcgattacaaaggcaaagggggcaaatttgtatggaaaatagaacagaattacagccgtacagcgtccttatgtcggtatacagcggagaaaatcccgagtttttcgctcagagccttgaaagcctgtatgtacagacttatcctgcggatgagatagttgttgtatgcgacggcgagctgaatgaacagcttgacggagtgcttgagcaatacagcgaaaagttcggcggtaagctgaagatacatcgccttgaaagtcacggcggcacggcaaaatgtgctaacacaggacttgctatttgtaagaatgaatatataatgaagatggattctgacgatatatgccttgaaaacagggcggagaagcagatggcttatctgtcccggcatcctgagatttcgatacttggcagttttatctgtgagttcaacagcgatacaggtgaagatattgccgtaagaagacctccgacagaaaacgacgagataagaaaatttgcaaaacgcagagcgccgttcaataaccagacgctcgtatataaaaagtcgcttgcacagtctatcggcggatactgcgaggagcttgaacgctgtgaagattatgactttatggtgcgtatgctgattggcggtgcaatagcggcaaacattcccgaagtgcttgtacgctatagggtaacggcgggaaatctgaaccgcagacgcaattggcgtaatacaaagagctttattgcggtcagaaaaaagataagaaagatgggcttctcgggttttatggatttccttattccttgtgcaagccagatagttctgtttattgtaccgggctgtgtgaccggatttatctataaaaaactgctcagaaaataagaatgacctttgcaaaagcagaggtcattcttattttcggatatacaaatcccccgattttgaaaatcgggggatgcgttttacttagcggtagttaccgccgctcttacatagtcgctgtacttcgttgaactgtctgaggtcttatatgctctgattctgaacgtataagtagtgtttgccttaagtccttttgcagtgcaggtaagtgtactgttgcttgttgtctttgctatctgagtccacttgccgcccttgtactgttcgacaatgtagcctgtagcggttgtgtttttgttccacttcagagtagcggtagtttgggtaacagattcctttgtaaagcctgttacattcgtaacgctcggtgcggatgttctcgcagcaagtcttatataagcagtttcggtggttttaccgtttaccgtcttgtatgttttgatgcggaatgtgtaagttgtgcttgctttcaggttcttcgcagtgtacgaagtattggtgtttgacgctgtttttgtaagctgtacccactttccgcctgtgtactgttcaagcacatatcctgtagcgcgtgaattcctgttccattttacagtaatgcttgaatctgtagaggattgctttgcaaagcccgtaacatttgcaagtgtggtggtacctgcaacattcgaatataatccggtcaacacagtgtcaccgtatcggtatgctctgattctgaatgagtaggtcgttccgtttataaggcctttctcagtatagcttgtcgtgtcaacaggaagctctgctatattgcaccacgatccgttcttgtatcgttcaacgaagtaaccgacttcaccttcacatttatcccactgtaacgtaactgaatttgttgtagctgattttaccttgaagttagtaacatttttaacgaccggcttggaagtccttgccgcaaagcgtacataatcgctgtaggcatagattcccttttgggttttatacgcccttatccttaatgtgtaaaccgtatccggtttcagattgtataaatcgaccgcaggatattcactgtcatttatctgtacccacttaccgcctttgtactgttcggtaatatatccatcggcgtcttcaactttatcccaattgatgaaaatttccgtggtggttgtatgccttgctttgcaattggtgacacttgcgggaggcgtcagcttttcgggtatctgttccttcttgccgtacttgattacagcatcaacaaaagccttatcataccagccgagcgttgaacggttgaggtgaccgtggcattcgcctctgtcaccgccattgaacgcattgttatcccacagcatacaaggcacgccatattcggcggatttgcccatgtaatactgtgcccactttacacgttctgccgcattgtttttgttggaggcactggtttcaccgattattgcagggacacctttatcaatgaaatgcgattttattgtgctgtacagataatccacttcatttttcagatcattcgtaaattcagctgtgccgtttgcgttaagagcaaaattataaggtgtatatgcgtgtaccgacacgataagacgattgggcgtagaatcatccggtaatttgaaagttgatgttgtacagccgtctatggatgcatcgtatccgggaaccattatacatctgtcggtatttttaccgcctgccgcacggatagcatcaaccgctgtctgattgagtgcgtttattgcactgattgaatcacggacagcattattcggattgtttacgtcaaaccaccattcatcgcctgtgccagcaagtcttggctcgttgagcgtttcaaatatcagcttctggtcgtaatccttgaaatattttgctacctgcgtccatattgatgttacgaatttcaccgaccgttctttgtattcagatgaagggtagtagtactgtgtggatgtgtcgtggtgaatgttcaggataacgtacatatcgttatcaatgcagtagtctacaacttcttttactcttgcaagccacttagagtcgatagtgaagttgtcgccggtcgtgtggttgccccacgatacaggtactcttactgcgctgaagccttgtgcttttacggcgtctatcatcgcctttgttgttttcggatttccccatgacgtttcgctggaaaggctgtttccgcctcctattgcgtcaagggtgtttcctaagttccagcctgtgccgatgaagcttacaagctctgttgctgtgttaccgttcatctctgccgctgatgcgacctgcgtaacacacattgtcatcaaagccgcaattgcaaaaattgctatggctgtaatgacagaaagggttttctttgctgttgacattttttctcttctttcctggtaatttgccattataacattcctattataatattctttatatcagaaagcggagcctgttttatgactgcgccttcttcaaaagcaacacacggcagtctgtaaagaaaactctgcttaaagacagctattcggattttataaaggttggcggctcaatacttcttatggggtatgacagccttgattgcatacagctttaattgcagaaaggaaagaatatgggaactgaatttttctggttttatgatgttattcttgcggctatacttataggtatgatgttcataggagctaaaaagggctttgtccgtatggtgctgaggctgtgcgcctttgcggcgtcatttgtgatagcgcttatgataagcaacggcgtttcaggctggatatatgacagctttatcagtaaaccgcttgaacagactatctcgacttctataaacgatgcactcggtgacaacgttgttacacagataggcaagatagatatggaaaaggcaaaaataaacggtaagagcattgacagccttgagctgaaagccgacaaggcaggcaaggtaaccgtaaatctcggtaatgtgaacttaagcaacacaggcataagcaaggtcgatcttacctcattcggcgtggataaaaacattgattattcaaatatcgatctcggctctgtgcagatatacgaaagcgacattgagaagtacggcatcgagaatatgatacttactgaggttcttgcacagaatatcaagaacagcgctattgccgacagcgtaaacgaaataatagataaagtcggcgaaaccgttcctgctctcgaccttaaaggcaagacgatagaggacattgacagcggtacgataaacagcgttgttgtaagcgtagtgcagtcgtcgggcaatcccggcaaggctgttcttgacaacgttgcaaagcccgtagtgcttgtaccgctaagaacaattatatttgtcgttctgttcattcttatatttattatcctctcgatattaataaaggcgacatccgttataaacaagctgccgcttataggacagctgaattcgcttctgggcggtgttgcaggacttttgcagggacttgtaatagtgttcattgttgtgataatagcccatatggctgttgagctgacaaacaacacgcttatattcctgaacgatatgacaatcaacaagtcttttgcgttcagtaaaatatacaacttctcgttcctcgatttccttaactaaatactcagttaacaaaagagaactataataataataagtaagctgttaacggcagtgttattttacgaaaccgccccttcgcataagcgataacagcttacaatacaataaaaatacaaaagaacctaaagaaaggttggatataaatgctttgctcaagatgtaaaaaaagacaagcggtagtttttatctcaacaatacagggcaacgacaagcgtgacgagggactttgccttatctgcgcaaaagagctcggtgttccgcaggtaaacgactaccttgaaaaaatgggaatcagcgatgaggaccttgaagaaagctataaaatgattttcggtgacgtcgatgaagaaacagacgcagacagcggcgcagacgatgacttcacaccgggcggcgcaggcacaatgatgccgttcttcaagcgtttcgccgcaaacaaggacagccagaccgaaagcgaaaagcaggacgtaaaggacgataagaagcacaataagaaaaaagaggagaaaaagagaaaattcctcgatacctattgcaccaatcttaccgccaaggcaaaaaaaggcgagattgaccgtataatcggcagagagaaagagatctaccgtgttatgcagatattatcccgccgtacaaagaacaacccctgcataataggcgaacccggtgtcggtaaaaccgctattgcagaaggcatagctcagaagctggcggacggcgatgttcccttcagacttcagggcaaggagctttatatgctcgaccttacctcccttgtcgctggcacgcagttcagaggtcagtttgaaggccgtgtgaaagcgcttattgaggagataaagaccgcaggtaatataatcctctttattgacgaggttcataaccttgtcggcacaggcgacagcgaaggcactatgaatgccgcaaatatcctcaagcctgctttgtcaaggggagaggtgcaggtcatcggcgctacaacgtttaacgagtacagaaagtatatcgaaaaggattctgcacttgaaagacgtttccagcccgtaacggcaaacgagccgtcaatagaggatactatcgagcttttaaagggcatcaaggaatactacgaagaataccacaagctgtatgtcagcgatgatattttaaaaagctgtgccgttctcagcgaacgctacattactgacaggtatcttcccgacaaggcgatagacctgctcgacgaggcggcggcttgcgccagcataaacagcaaggagcttaccgagtacgaacagcttaaaaagaaaaacaaggctcttgaaaccgaagaaaacaatctgtccgccgaaaccgagaacaaggattatcagcgtatagccgagataaagaccgagcttgctaagaatacagcccgtatcgacgagcttgagcctatgataaaggaagtacacgttacagaaaacgatgtctgcaaggtcatcgagctgtggacgggtatcctggcaagcaagctgcttgaaaccgaattcaagcgtatcgcaaaccttgaaaccgtgcttaaatcaaaggtagtcggtcaggacgaagcgtgcgagcttgtagccgccgctataaaaagaacacgagttcagctctccgcacgtcgcagacctgcgtcattcattttcgtaggacctaccggtgtcggcaagaccgagcttgtaaaggtgcttgcaaacgagcttttcaatacggtcgatccgcttataaggcttgatatgtccgagtttatggaaaagcacagcgtttcgagaatcatcggctcgcctcccggatatgtaggatacgatgaggcaggccagctcaccgaaaaggtacgcagaaagccctattccgtaattctctttgacgagatagaaaaggctcaccccgatgtaatgaacattctcctgcagattcttgacgaaggcaaggtaaccgatgctcacggcagaacggtcagcttcgagaataccgtaattgccatgacctcaaacgcaggctcatcgttcaatacaagcggtcttggctttgcaaaaagcgaggcggatatttcaaaggacaaggcgatgaaggctcttggcgaattccttcgccccgaattcttaagccgtgttgacgaggtagtagtgttcaagcccctcaccctcgatgcctacaagggcattgccggacttatgataggtgagatgaaagagcctctgctcgaaaagaacataacgcttaacgtcagcgatgaggcttatgagcttgttgcgaaaaaagcgtccggcggcaagttcggtggcagagatgtccgcaaagttgtccgcaaggatattgaggacaaggtagcaaatatcatagtcgaagccgacggcaacatatcacagatagacgttgacgcagacggcgacgagataaaggtaacaggcaagtaaaataagcagggcattgcattaactcagtcaggtaatgcaatgcccgttttataatcgaaaggattactatggcagtaattattacaggcggaacaggagctattggcagcgctatggctcgtgcctttgcaaaaacaaacgatgttgctataatctacaaaagctccgatgaaaaagcccgtcagcttgaaaaagaactcggctgcaaggcatataaggctgatgttacctccgctaaagaggtgtcggctgctgtagaaagcatagcaaccgattttggaaaaatagatgtgcttatcaataatgccggcatatcccagattaaaatgctgagcgatgtcaccgagcttgactggtacaatatgattgatgttcaccttacgggcgcattcaatattacaaaggcggtactgccttttatgataaatcgcaaacagggaagcatcatcaacatttcatcggtgtggggagtatacggagcgtcctgcgaagtgccttactcaacggtcaaggcaggccttatcggcttcacaaaatcgctctccaaagaggtcgcccccagcggaataaccgtaaactgcatcgccccgggagtaatcgacagccctatgaacaatgctcacctgtcgcccgatgagatgaacgagcttattgcagaaactccgctcggcagactcggaacgcccgatgatgtggcaaaggcggctgtatatcttgcctttgcaggcttcgtcacaggtcagatactcggagtagacggcggattttattgattaacttaatacatttgagctgtaccttttcggtacagccttttctttttccctgacaaacagtaatattatgtcccgcaccctcatatattgtgttaaaacccgtacaagagggaaacagctaaaggaggattatatggacttttccgtaaagaaagagcctgtatttgtcacagaagtgatatatgacggacaggcggagcagggtgtcgagtttgattatgtcctgccggattattaccccgacattttcagaatattaagatgcacccttcgtcccggaatagtatcctgcaacatttcgggcgacaagctgatactcgacggtgtgatatgcatcaccgcactctatcttagcgagggtggaggtatggagtgcgtagagcatcgctacagctattcaaaaacggtcgatctgccgaaatcagccgacaacggcacggttactgtcgagcctaaggtggattatactacctgccgtgcggtttcgggcagacgcattgatgtcaggggagcggtcagcttcaggataaaggtcgagaacataacaccgtttgagataataacggatattgaaggctgtaacatacagacaagaaaaaataaagtaagctgtacaagaaagctcaccgcaggaaagcagtttgttgtccgtgaagatataggcgtatccggcattgacggcacagtgaaagccgttgtaagctgtgatgccacagcggtcgtgaatgactgcaagataatcgcagacaaggtcgtgcttaagggcgaggcaaagctgaaagcgctctatcttgtcggaagcgataacggcacatatcttcagacaatggaagccgagattcccctcagccaaatagtcgatatgcagggtattgacgaaaggcacacctgctacgccctgttcagagttctgtcatgcgctcttacggtaaagtccgccgatgacgatgcgtcgggagtattcggctgtgagctgacaatcggctctcagattaccgcaacgcttgaagaaagcatttatcccgtcaccgatatgtattccacgtcctacgaatcaagctacaccacttctgcgttgaaaaccgaatccgaccacagatttatcagcagaacgcttaatataaaacagcttatcgagtgcgaaaacggcattcccgacagcgttaccgatgcagaatgcttcgtgtcggaaataatctgcagaccgtgtgaaaacggcgagcttaaagtgagcggtaaactgctgtgctttatcagcgccgtaaaggacggcgagcctgtattcattgaaaaaaatctgccgtttgatgttaccgaacagcttggtatggttaccgacggttgcgtaatacagcctgtcgtgaacatatcgtccgtaagctacagcattaccgatgacggtatcgaaataagatgctcgcttcttatgcagggatgtatgtatgtttgcggcacaagtcagataataaagcagatagagcttaacgaaaacgcagaaaagcaaaagcgcgatgattattcgctgaagctgtattttgccgatgaaaacgaggatgtatggaacatagcaaaacgctataacacttctgcggcggcgatagaatccgaaaacgaggtcaccgacggcaaagtgtcaggcctgcttctgattccgataatataacaatactcaagatacagcattttgctgacagataaggagaatttatgccaaaatcaatttataaggatatttccgagcgaacaggcggaaatatctatataggagttgtcggtcccgtccgttcggggaaatcgacctttatcagcaggtttatgaacgtgctggtcgtaccgtcaatcgaagacgaattccgcagggaaagggcagtggatgagcttcctcagtctgcggcaggaaaaacgataatgaccacagagccgaaattcgtgcctgaggaagcggtaagtatcaccgttgacgaaagcgtggaaatgaatgtaagacttatcgactgcgtaggctacatagttcccggcgcaaagggctatatagaaaacgaagcgccgagaatggtcaaaacaccatggtttgacgaggaagtgccgttcaatatggcggcggaggtcggtactcataaggtaatcacagaacacagcaccataggacttgtggtaaccacagacggcagtatcaccgatattccgagagaggaatacgaggcggcggaggagcgtgtgataaacgagctgaaaagcataaaaaagccgtttaccgtagtgcttaactgcagcgatccctcatcggaagaatcaaaagaacttgcttgcaggctttcagaaaagtacggctgtaccgttacaccgctgaattgcctttacatcaccgaagaaaatataaaggaactgctgtcagatgtgctgatgggctttcctgtaagagagataggcataaaactgccgaagtggttagcgtccctcgataatgaccattacctgaaaaagcaggtattcgaagctgtgaggacatctgcggaaaatatctcctgtatgggtgatttagacagcttcacgggcaaaatagggcagtgcgaaagcgtcagccgttgcagtaaggataaaacggagcttggctcgggaacagcctatgtcacagtggagctggggcaggagcttttctacaaggtgcttggcgaaaccacaggcatcgagcttagcgacgagggcgaccttatgccttgtatgattgaacttgcgagaatcaagaaagagtacgaaaaagtcagcaccgcacttgagcaggtcagagccacaggatacggaatagtaatgccgtctgccgaagagcttacccttgaagaacccgaaattgtaaagcagggcggaaaattcggcgtaaggctcaaagcgtcagccccgtcaattcatatgacccttgcaaatattaacactgaggtaaacccgatagtcggcagtgaaaagcaatcggaggatcttgtaaggtatcttctcagagaatttgaggaaaatcccacaaagatatgggaaagcaatattttcggaaaatcgctccacgagcttgtaaacgagggcctgcacaataagctgagccgtatgcccgatgacgcaagagcaaaactgcaggaggcgatacagaggattatcaatgacggctgtaacgggcttatctgtcttatattataaaagtccgccatataaaaagaccgcacctcatcacaggtgcggtcttactctggatcggaagagcacacgtctgaactccagtcactccgcgaaatctcgtatgccgtcttctgcttgaaaaaaaaaaaacaagcaacgcttgagagggctggaataaaccttctgtaccttagggtaaacgtcaagagccgcaagcgacgatatagcatcttccccctcttcgcaaagcggcagatccgttgttcctatatattttccttcaagatttccacgagtgattccgtgacggataagataaagtctgtaattcttcattttttacttcctttcggttgatttttactgataattatgccgattacggcgatttttgttttattatagagttattacataaaaaagcacttgattttttgtataaaatcacgctttacaatagggaataactccgttataatatactgtatgaatattgtcagaatcagagaggttatatcatataatgaataccgattttccaagaatactttccctgctccgcaaagaacgtggacttacacaaaaacaggttgccgcagatcttggcatcgctcaggcactcctgtcacattatgaaaaaggcaaacgtgaatgtggtcttgagttccttgtaaaagcggctgactactataacgtttctactgactatctgctcggtcgttcgcccgtttccaacggcggtataattaccgaaagcgatattcccgacggaaactcgtccggtgattcaaaatcgggcgacattatgcttgcacttaacaaaaagctgataactaacagcattgaagtgattttctcgattttgcaaaaaatcaaatcatcaaagctcagcaagagcgtttcatcaatgcttacgctttccgtatacaaagcgttcaggataacatataatgcaaacagaaagaacgacgataatcttttcggcgtatcgcccacttccgcactccatcttatagattctgcaatctgccttgaagtcggtgccgccgcagacgccgcaaacgatgcagacaacgcaccgtcaataacgacaaattcgatagaagccgaatatgacaagcaaggaacagcgcttttaagccttatcaagaacgcagaaaagcgtttagaccgtataaatacagattaacaccactgcagaaagggactttatatgaaaaaaatcgtttccgtaatcatagcgttatctgtgacagtaacagccttagctgttataatcgacaagctgtacaaaaaagccctgtcgggaatgcccgcagctgcggacaatttcaggtcctgaggtctttaaagaaatccgtaagcagctttgcacattcatcctgcaaaactctgcttctcaccatcggacgatggttgaacggataatcgaatatttccatgagcgaggcgcaagccccgcccttttcatcaaaagcaccgtaaaccagcctttttatacgggaattgattatagcgcccgcacacataggacaaggttcaagagtaacatataatgtacattccgtaagccgccacgagttcatagctttggcggcttgttctattgcgattatctccgcatgagctgtcggcatctgctcggtttcacgcatattatacccttcaccgattattctcccgtccttgtcaactacgatggcgcctacaggacactcacctttttccgccgccttttttgcgagttcgatacagagagtcatatattcttcatcagcagtcacagtaacacctccggaagataatcatacgatttaaattatactacaaaaagagtttaaaatcaatattaaaagcaattctctttgataatccgtgttccctgcttgcgagcataaatttcaatatgtgacaaatttctgaataattgacacacggcaaggaataatatgtttgcaagatcaaaaaccgtttcttcagaaaggaatgactatataatgaaagctacgggaatagtaagacgtattgacgacctcggaagagtcgttatacctaaagagataaggcgaacaatgagaataagagaaggcacaccgcttgaaatatatacaagtgtagacggagaggtaattttccgtaaatactcccctgtcggagaaatttcaggtacggcggatcagtacgcagatgtattgtacaaagtcggagggatgcctacagttatatgcgaccgtgaccacgttatagccgcatccggcattcagaaaaaagaagtgcttgaacgcagggtatcaagctcgcttgaagaccttatcgagcaaaggaaatctctttaccgtacagcggacggtgtaaaaatgaaccctatcgaaggtgtagatcgctttgccgttgcctgtgcgccgataatggcagacggagatgtcaacggagcagtcatcatgctgtcggataaggaaaattcggctgttgacgacaaaacaaaggctcttgtcgaagcagccgcaatgtatttcggaaaacagatggaagatgtctgaaaaaaatgtacccacaggcgaaaatatcgcttgtgggtataatttttgcttattttccgaacatcatatcagtaaatttaactacatactcgttccagaatgtcatatcgtgaccgccgccgctttcaaggtaaacgtgaggtatattgttagtgtccaaaaacttatgaaactgcctgttattctcaagcaaaaagtcctctgtgccgcaagccatatatatctgcggtattttcttattttcttgtgaaagccgctttacaagaatctcaggattgttatcacttgagacaacttcgtcaaggtttccgaagcattcatggtaatatgcgtaatttgccacaccgttgtcaccgccgtccttcatacctgctatttcatgaacaataagggcggatgacattgcgcacaccttaccgaatgtatcgggataagtgaatgcagtatgaagcgcaccgaagccgcccattgaataccccattatcgcagtatcctctgcagtctgtgcaagcccgaatgtatttcgtatatagtcgataagctcttcaccgacataagtgcaatacttatgccctgtagataatccgtcaagccagaatgagttttcgccgtgaggaatcactacggcaaaattgtatttttccgaaatatattccggtatccagttgttgccgtcctgtgtgtaaccatgcagaatgaacagtgttttcatattctgcttatcataaaccccaccataattgcgcttatcatcgggaatatacattttgaatgaagtatgacggttgagcgaatgcgaaaagaaacgtatatcaatctgcgacataaaaatacctccgtctaatattaaataatagcacattctatctgttactatcaatctaaaaatcaggctgaacgccaaaatcgttatttccgagttatttcaaaagcacggaaacgtatttccgtgcttaagtatatatcttatttatatctgtacagcgaaatcttctcaaagccgtcaagaagatcatctgtataatcgaacgccttcgcaactccctttgcaacgcactctatcggatcgtctgcaacatagcacggtgctcccactgcttctgttacaagatccgtgaagcccttgagcattgcaccgccgcctgtcagcactatgccgtttgtcagaatatcgcccacaagctctggaggggtctgctcaaatacttcctttatcttatcgactatctccattacgctgtcatggagaaaatcgtacatatccttatcgctgatctcaacactttcgggaaggccttttataagatgtctgccctttacggttattttcacatcgcctgtcggattatatacgttggcgatttctttttttgcctgctctgccgtcttttcaccgataagtattttgtatttcatcgtaacgcctcttatgatggccgcatcaaacttattacctgccatcttaagcgaacagctttttacaataccgttgaacgaaacaaccgcaatatcagccgttcctccgccgacatcgacaaccattgtgccgttaggctttgaaatatcaatacctgcaccgagcagtgcggcaataggttcttctataataaatacttttcttgcaccggcacaaagcgcagcctcaactacagctctgttttcgacatcggtaacagacgaagggacgcaaagaataattctcggctttacaattcgtccgataacctttctgataaattcgattatcattgcttccgtcatctcattatcagagataacaccgtctttgagcggttttaccgcaacaatatattctggcgttctgcctatcattttgtacgcttcgtttcctactgcaagaacacagtgtttctttttatcataagcaacaacagacggctcgttgacaacgatacccttgtttccaagcgtaattataacattcgcagtgcctaaatcaattccaatatcagtagcagacatactcgtaatcctttccgtttacaaataattattttctatcaaagccaaaaggctatccttatcgttttcgcaatttccgtttacaacctgttcaagcaagaaattgagagcctgcccgatttctttacccgtaaagccaagcttcgaaatatcggaaccgttgactttaagctgtttaaggctcataggcggttcgttttgaagaaactcccttgtatgcttttcgatgctgtcaaaaagcgctttttcgccgaaatatgcaggtgattttccgcaggtgtcataataatgcacctttatcagtttaataaaacgctccgcaccgtaacgtgcaacgcctcttcttatactgcgaatatcatcgttaataactataccatgattttcgattaaaaacaatacctcgtctttaattttattgctgaaacgcaatctttcaagtattttttcggcaattttacagctgacatcggcatgaccgtaaaaatggcctgcaccatccttcataaaaaagctgtcaggcttgcctatatcgtgcaaaagcattgtaaggcgagcttctacagtaggctcagcagcagctacggtagcagctatatgaccgtaaaccgtcttatcgtgatactttgaatgctgttcaaagcctatgcacggatacatctcgggaataatctcgcagataacatcgctgtaattacggagaatgtcatagcaatcgccggtaagtattccgcacagctcactatttatccgctccgcagaaataaatgaaagcaggaatttctgtctgtgaatagcgtccgatgtttccttatcaatgctaaaaccataacgtgacgcaaaacgcaatgcacgaagaatccttaaaccatcgtcgtcaaagcgtttcatcggatctccgacgcatcttataatgccgtttttcaggtcctctgccccgccgtacaaatcgaccataccgaccttatcattatacgctatggcattaatcgtgagatcccttcttgcaaggtcatcggcaagattcggagtaaatccgacttttgaaggatggcggtgatcgatatattcgccgtcaattctgtaagttgtgatttctaccggatgcttattgattattaccgttacggttccgtgctttaatccgaccgtcagcaaacggtatccgtcaaaaacttctattatctgttcgggcagtgcagatgtcgttacatcatagtcttccggacattgaccgagcagataatcccttacacagccaccgacgcagtatgcttcatacccattgttattaagtttttgtaatacctcataaacatattcaggaagctgcataaaaaacctctcgaaaagaattatataaaaacaatatccgctcgtgaaagcggatatcgtcttatataagatgttaaaatctcaaattattcattgatagctgtaactacgcctgaaccaacagttctgccgccttcacggatagcgaaacggagaccttcttcgatagcgataggagtgataagctcaacatccattgttacgttatcgccgggcatgcacatttccttgtcagcgggaagtgtgataacgcctgtaacgtcagttgttctgaagaagaactgaggtctgtagtttgagaagaaaggagtatgacgtccgccttcttctttctttaatacgtaaacctgacccttgaacttcttgtgggggtggattgaaccgggcttgcagagaacctgaccacgctcgatttcgtttctctggataccacggagaagtgtaccgatgttgtcacctgcttcagcgaagtcgaggagcttacggaacatttcgatacctgttacaactgtctgcttaggctcgtctgtaagacctgtgatttcaactgtatcgttgagcttgaggatacctctctcaactctacctgtagcaactgtaccacgacctgaaattgtcatagtatcctcaacaggcataaggaaggggagatcagccttacgatcaggagtaggaatgtaatcgtcaactgcattcataagctctatgatgcaagcatattcgggagcgttgatgtccttgctggggcaatcaagagcaaccttagctgaaccacggataacggggacgtcatcgccggggaagtcgtgctctgaaagtgtctcacggatatccatctcaacgaggtcgagaagctcgggatcgtcaacgtcatcgcacttgttgatgaatacaacgattgcgggaacgcctacctggtgagcgagaaggatgtgctccttagtctgagccataggaccgtctgtaccagcaacaacgaggatagcgccgtccatctgagcagcacctgtgatcatgttcttgatatagtcagcatggccggggcagtcaacgtgtgcgtagtgacgcttgtctgtctcatactcaacgtgagctgtgttgattgtgataccacgctctctctcctcgggagccttgtcgatcatatcgtatgcttcgaactgagcatagcccttgagtgaaagaaccttagtgatagctgctgttaaagtagtcttaccgtggtctacgtgaccgattgtaccaatgtttacgtggggcttggtacgttcaaatttctgctttgccattggaattttcctcctttaattatgtgtattccatacacttagtattttatcagattatttctcaaaaaacaagtcttttttgctctttcagaaaaattttattagtccttagctctcttgctgatgattccatctgcaattgacttgggaacctgaatgtagtggctgggttccattacatactgaccacgaccctgtgacttagaacgcagatcgtttgagtaaccgaacatttctgacagaggaacgaaagcattgatctgcttaacgccgtttctgtcttccataccctgtatctcaccacgacgtgaacttaagtcgccgataacgtcgcccatgtattcttcgggaactgttacaactaccttcatgataggttcaaggataacggggttggccttgcggcatgcttccttgatagccattgaacctgcgatcttgaatgccatttcagatgaatcgacctcgtggtatgaaccgtcataaagctcaaccttaacgtctaccgtctgatagcctgcaagaacaccggactgtaaagcaccctgaatacctgcgtcaactgcggggatatattcaaaagacaaaagcacggcgtaccgccgtgtcggcttacgccgatttgatttgtgatataataacctcagacagataattcgttcacacggattatcccgtgcataagcacggtttggcggttacccgcctgcctgagaacattttatcatcaaattgatgaaaataatctgacgaaaggaaaaaacagctatgcctaatccatatttacctttatgggaatatattcctgacggagagccgagagttttcggtgaccgtgtatatatctatggttcgcacgacagagcaggctcagatgatttctgcgactatgttttaaagtgctggagcgcacctgtgaatgatcttaacaactgggtgtgtcacggtgttacgttccgtgtaaagccggacggtgattttccgtcggataccgactggacgcccgataaaaatcagatcctgtttgcacccgatgtcgtttgcagaaacggaaagtactatctgtatgcatatattgtcaatgcgacaggctgcgttgcggtgagcgacagacccgaaggaccgttcacaccgctttcaaaatacaagtacactatatccgatgagatatgctgtaacggctggttcatcgatccgggcgtgcttgttgacgatgacggaagaacttatatttactgtggctatgagcgttcttttatggctgaggtcgatacggatacgatgtacacgataaaggataacagctgtatcgagcatatcatacctataaccacagataatgacggaggctttgacacagaagaaacgcttttctttgaggcgtgttctccacgcaaggtcggtgatacatattatcttatctattctcccaaacgtggcccacgtcttgcttacgctacttcagacaagcctacggggccgtttaagtacagaggatatattgtagacaacggtgttgattatccgggaggcaacgatcacggctcgatagctcagataaacggtcagtggtatatattctatcaccgtatgaccaacggtacggtaatgtcaagacgtgcctgcgttgagaagatcgagatacttcctgacggcactataccacccgttgaaatgacttcgctcggctttgaggacagccttgatccttacagaataacggaggctgagattgcctgtgtgctaaaaggcggagcgtttgtaacggaacataataagttcgaaagagtggtaacgggtataaaggacggcgctgtaataggctataaatactacgatttcgggcttgacaacggcaacggcagaatgtacttcaatgccgatataacgggacttggcgctgactgcaacgtgcatatacgcatcgacagcgaggacggcgaggaaataggctcgttcaaggtaggacacggaaacggtgtttacaagacagaagtaaagccgatcagcgacagacacgcagtgttccttacggttgacacggattattcaggctggacggctgcctatttcaaggaaagaccgctgtttgagctgaagaggtttgtattcacaaagtaattttcggttgttacgaggtgaaaatatgaagataggttctatcggatataatcatgttcatgatatgaaatatgaaaatttcattatggacagacctaaaggacctggtgcggttttactgctgcttataaagacaccttcggttttcagggtaggcggggtgcagtatcaggtcaaagaaaactcgtttatactgatgtcagcggatactccttgctactatacggcgcaggaagatgtgtatacagatgactgggtgtatttcgagaacggctactgggataaggaatatgttgaaaagctggggataccgatggatatacctgtatatctgggagatattgacgagctttctcaccttgtccatatacttgtctacgagcattattcgggtgctgtgaacagcgaggagatcgagaaaaagtatatagatgtactgtttcttatgctgagcagaacgctgaagtcccgtagctgtatgtcgtcaaaacaactgagcgaaagacattatcgctttacgcagatacgaaccctgatattcactatgccagaccatgtcggaaatgtagacgaccttgcggcacaggcgggtatgagccgttccggttttcagcatctttataaaaagctgttcggaacaacggtaataaaggatataatcgagggcaggacgaaacgtgcgaaacgcctgctgtcctctacaagacttactataaaagagataagcacacgctgtggttatacgaatgaatacagctttatgcggcagttcaaggaacaggtcggaaagactccgacagagtaccgcagcagtatataaggagaatgtttatgaagaagatattatctgccatactggcattatgtatgatagtttcgattactgcttgttcatcggaaaatgaatcgtccgtaaagggcagtgagaacaaggtaatgcgtgacataacaacgcaggagcttatcgaggatatgggaatcggtataaatctcggaaatacctttgaatcctgcggaaactggataaacaagtcgtctgttacaaattatgaaacagcgtggggaagtcctgttattaccgagcaaatgataaagggctacaaggactgcggttttggcgttatgcgtctgcctgttgcgtggagcaatatgatggacaaggaaacgtataccataagtcccgactatgtggcaagagtaaaggaagtgctgaactgggcgcttgacagcgatttatatgtaattctcaacattcattacgataacggctggttttcggactttgccgatgataaaaagagagatgaatgttttaaaaaatatgaagctatatggaaacagctttgcgaggaattcggcgattacggcgaccatctgatgtttgaatcgctcaatgaagaaggcggttgggaggaactgtggaacagatacagtaatgagggtgacaaggaaaagtcatattcgatactgaatgaaatcaatcagaagtttgttgatatagtaagggcttcaggcaaaaataacggtaagcgccatctgcttatcgcaggatacaataccgatattgaccttacctgtgacaagctttacaagatgcctgccgatccggaaaaccgctgtgcagtatcggtacactattatacacctgtgacctttgccatacttgaaaaggacgcaagctggggcaaggcacagacaacgtggggcagtgaagccgacaaaaagctgctcacaaagtatatggatatgatgaaaactacctttgtagacaagggtatccccgttattataggtgaatatggctgtacaacaaagaacaagcaggcaaaagacattaatctatatctttcaagtgtctgcaaggaggcatattcgagaggcatgctccctgtgctgtgggatgtaaccgatgtattctatgaccgcacgacctgtacgttcaaggataaggatttactggacggacttatggcagcaaaggaaaccgaaagaaacgtataacaaagtaattcctctttataaaatgactcccgaagtgaaatactccgggagcctttttatatggttgtttacgccttcagttcaaatgacttgcagtctgtgcaagccttctgagtggggtctgcctcgtgtgtgccgatctggatatgatcgagtgagcagtaatccgcacagcagcagtgatgcttacagtttgttatagaacaagctatgcacttgtttgcgtgttctgttcccatttttcgtacttcctttcagaaataaatatgagtaaagttgtctttacgcacattattataaccggaaagccgaaaaatataacagaattatcattccattattatgcttaaaatatcggaaaattcaggtacgatataatccgctttatattctttaagctcgtcttcggagccgaagccgcatagcacaccgacagattttataccgcactgttttgcgccgattatatcaaatttcctgtcgcctatcataatggcggatgaacggttttctatatgctgattgtcaagcacatagtttattatgcttgccttgtcctcaaacgagaagtcaagtgacgcaccgcatataaatgtaaaatattttgccagatcgaaatgctcaagcacgattttagcgagcttcagcggctttgaggtggcgaggtatatcttttttccgttgtcataaagtgttagtgttttcagtgtttcgggaacacctgctatgaccttgttttcatatactccgacagtgtgatagcgttcacggtacttcagtaccgcctctttcgccttttcttcgggaaaattatagaagatatggaacgattcccaaagcggaggaccgataaatcttttcagattttcttcgttgttttcttcaatgccgtaatagtgaagggcatactgcacgcattttgctataccctcgtatgaatctgtcaaagttccgtcaaggtcgaataaaatatgctcaaatgccatttttcctgtcctgctctataagtatttttactgcgttcactgccgttcttatcgctctgtcgctgtccatacagacagtatcgggaagtcctgcgttgcttctttcgacgttccagagggctgtgaatacagcgcctgcacgttttcttcttgcaagggctacggagaatattgcggcggattccatttcggaagtaagacagccgcattttacataagccgaccagctgccggagagcttatctcctacaggcatctgtaatggctctatctcgccgtaaaagctgtccttgctgtgaactactccgacgtggcaacgcttgccgtcaacatcttccgataatgcgtcgcctgcggctttaagcgcagtggttacttcaaaatccgctaccgcagggtagttttcgggaatatactcgtgcgatgttccctcgcttcgtattgatgcctgtgccacaaccaagtcgccgccggaaacgcttatatccataccgccgcttgtgcctattcttataaaagtatccgtgcctgagcggataagctcttcaacggcaattgcggcggaaggaccgccgatacccgttgatacaacgcttaccttttcaccgaggagataacccgtataggtcgtatattcacggtttgacgcaacaaattccgcattgtcgagatattttgctataagcggaactctgccggggtcaccgggaagaatagcgtatcttccgacatcgccatttttaatcttaagatggaactgttcgttttctgtaagaagtgccataatatcaccctttcgcaaaacgtttatttctttgctctagcccttttcttagcggctttttttgaaatcacttcgtcagccggagcggtggtgccgcccagaacagagggggctgccttgttcttttccttttcacgcttttcgatatttccgtgtatcttatcccagttcccgaatatcgcaagaagtatgccgagtaccgttataataaggagcggcatataaaggtatccggggtcgcccggcagcatttcatgcaggatgagtacgcatatcaatccgacgaaggtaagagcgccgcagataaaatattttttcagcatagcaaagaacacaggcactatatagcatataacggtgaatgaaatccagaatatcaatatgcccattatcgagcttacgtcggtagtctgggtagttatcagcgaaataagtccgagaatattcagcactaccgctattactcccgttgctatcatcataagtacctttaatatgattacaaaaaccttcattttatccttttccgtttcaatttatttttttaatttctataatttaatgataacacaagaaaccggaaaaatcaacatatttattgtgagcatcctgtgaagaaaattgcattcggttttgttttttccaacccgtacaatttataaaattaaaaaatacctcttatataaaaattgcacacgcagataataattctgtgagaaaaacgaaaggaaaagattatccgatgccacaaaagataaaacttatcagcggtatttttactgcggttacgcttttttcaaatataatgtacggcggtgcgtgtgcagagaaatatatatccgtaaattcgccgtgttacccgatgaaatgcagtgcggaatacgaaagacctgagctttatgtctgcggaacgccgtttggtatcaagctgctgacagacggtgttatagtaacgggatttgccaaggtaggcgacagcacagatgcttttgaattatctcccgccggcaaagcaggaatagaaaagggagatgttataacaaaaataaacggagagaaaattacgtcctcagcaaatatgagcgagcttatatccgggtgcggcgaatatgcaacactgacttatataagagatgactgtgaatatacagccgatgttgaaataaagtgcgacagcgatggtgaaaagagaataggactttgggtgcgtgacagtacggcaggaatcggtacaatgacgttttatcagccgaaaacacttgcgggtgcggggcttggacacgctgtatgtgatgttgacacgggggagattcttccgctcggaacaggccagatagtacctgcggtgataaccggtgtaaaaagaggggaacgtgactgtccgggtgagctttgcggtacgctgaaaccgtcggacgtaaagggcagaataaccgataactgcggatgcggactttatgccgtgcttgaagaagcagatatgcaggggcagttgatgccgcttgcattcgcaagtgaggtacagtgcggacaggcatatatattatcgaccgtagacagcggcaagcccgaaatgtacagcgttgaaatagaaagcgttgaaagaaattctgcggacaacaagaatatggtaataaaagtaacagatgaacggctgacagagctgacgggcggaatagtgcagggaatgagcggaagcccgatagtgcagaacgggcggcttgtcggagcggtaacgcacgttttcataagcgaccctgctcacggatacgggatatttgcacagagtatgtatgagcatttactgtcactcagtgaaactgaagaacaggcggcataaatttgtaaacgaaaaacgcttttgcaaagtcgttatgaggctatgcgaaagcgtttcgccgttatcgcagcaaaaatcgtttatccgaagaaacgtgatagttacagacctgctttaattcacataaataagctacaaatcgacatacatattgtgtaaaatcacgaaaatggttttttgttgcagaaatttgtcgaaaaatgttgaaaactgtcaattcacggatatataataaataagaagaagcaaatttctacatattgggttaggtaatccgataattcgtttttatattatcaattcggacttcgattcaaaaaaactgaaaaaatttggtaaaatcatcttgaattattttccagtttgtgttatattatagaagcaataaaactatggaggtaagaaaatgtcacataatgaattggttttttcgatagactgaaagcggtcacagcgaaatgctgtgaccgcttatctgctttattactttgtgtaattccgccggtaacggaggttgagccaagattaatccatcagaacggcgaattgactgcatcagcatgatgctttggtaacgtctacccacttctcatatcccgaacacttttcaagctcagggatagtaagctctatagcactgttggagcttccgcaggcaggaaagaccgtttcgtacttgttcagcgactcgtcaaggtaaacggctactccgtcatttacggcaaaagggcatactccgccgacagcgtgaccgataagctctgccgcctgatctgcggtaagcatttttgcctttgcgccgaatgcgtggcggtacttggcattgtcgatctttacattgcctgccgttacaacgagtatcgggctgtcaccgagcataaacgataaggtctttgctattctgcaaggcttggtgtgaagtgcgtgagcggcaagttcgactgtagcgctcgactcggatagctcaattattctgtcctctatgccgtaagccttgaaatattcctttactttttcaagcgacattttagctctctttcctttatcagtctatataaggacgcagtgcgtcaagcagcatatttaaatttgcgtattgatgggggaatgctccgaaagccattttcggcgctacctgtactgtcgtcctgaaatccttaccgtccgttataagtgtaaattcaagcttgtactgaccgataaggagcttctttatcttaagcctctttatagcggtgagcggacacgaaccgcagttgccgtcgcctataaaatcatagcgtatcatcagcagtctgcccttgtcggtaacggctaaatagccgtattccatagcacttcccataaaggatttatcgttgtatacgcagtatacggggaacattgcggtttcatcgggatacagcacctttacaagctgtgcgtgcatatccgcttcatcatatttcagcttcatattacttgttacgtaggtcgattacacgctttgccttgccctcaaaacgttcaatcgtcttgggctcaacaagtgtgacctttgtatcaatgccgagaaccgtcttaagattgtggcggatatttttctgtaagttggacagcgattcaaggctttcaagcacgcttccgtcaacaagctcgcactttacctccagtctgtcactgcttccctcacgggtaacaacaagctgatagtggggagcaatctgcgggatagtcattataacgctctcaatctgtgaggggaatacgtttacgcctctgatcttcagcatatcgtcgcttctgccggagggcttgctcatacgggcgtgagttcttccgcattcgcacttttcgtaggtgatagaagtaatatcctttgtgcgataacgcagaacagggatagcctcctttgaaagtgttgttataacaagctcgccctttgagccttcggggagaacctcgcctgtttcggagttgatgatctcggggaggaagtgatcctcgttgaagtgcataccgcaacgcagtgaacattcgcccgaaacaccgggtcccataagttcgctcatgccgtagttgtcggttgcaagcaggtgaagatagtcttctatctgcgctctcatttccggagtgcatccctctgagccgaaaagaccgagccttagcttgagctcatctctgccgatacccatttcttctgcaacctcgcctattctcatagcgtatgagggggtagcgacaagtgccgttgtgccgaagtccttcatcagcataacctgcttttcggtgttgcctgatgagcagggaactactgtagcacctatcttttcaaggccgtaatgcagaccgagcgcacccgtgaaaagtccgtagccgaatgcaatctgtactatgtcttcatctgtagcgcctgcggctgttacaagtcttgctacgcagtcagaccacatatcaaggtcgttctttgtgtagcctacaacggtgggcttgccggttgtacccgatgaagcgtgcagacgtgttacgtttttgagcggagttgcgaacataccgaaaggatagttgtcacggaaatccgtcttagtggtatacggtatgtactgtatgtccgacagtgcctttatctttgtacaatcaaagcctgcctcgtcaaattttctcttgtacagcggtacattgtcataacagtattttgttatgtgcttcagtttttcaagctggagcttttcaagctcggctctcggcatagtttcaatatctttctggaaaaaactcatattataaccctcttttttattcttcgctctcggtgtatgcacagctgaaacctgtgaactgtgctgtacctcctacagcgtataatcctgtcattgtacccgtgaaaccgcccgaaacctcgcttgtcagatatttcacctgaccgcttccgagatgtgtttcggtgtcgccgcatttcacgaagaaattgtaattataatggtcggctctgacgataagcgttgcgttgtcggcatttaccgcaactctgttctgctcgtgctttattccgccgatgttgagcttcagtattgcaaaagtgccgtccgccgtctttttaagtgcaatatcgtaatgctcgttctcgcacatatacattgtgacaccgccttcgccgttgccgcaaaggtttacgttgacacaaagctccatatcaaagtcacgctgacgcattgcgataaaagtaggtgaatctgcatcgtcaagggtcagatcggtgccgcaaagctcgtacttgtccgcagacagcttatagttttcggggtggtacttacgcagataacaccagtcaaccgaaggatctgtattgccgaatgtgaataccggtaattcgttctgaacgaaatcgccttttatttcatactgtgcgtctgttgtgccgtcaagacctgcgaacagtctgccgttttcgtcaaagtgtgcaggggagaggaaaacctctctgccgaggctgtggaagggcatccatatagccatctgtctgaagccgagacttaatatatgccagtcgccgttcttgtcctgtatcagatctccgtgaccgataccctgtattatgtacggtgctttgttgcggttagtgagtatggggttgttgtcgcctgtgacatactcgccccatatatcgtccgatacggcatatgtaatcatatgaccgtattctgtgccgccctctgccgccataagataatatcttccgtttatcttataaacgtgggggctttcaagataacgtccgcccgaacctttccagatagacttgctgtgggagagctttttgcccgtagcaatgtcaatctcgcactgtacaacgccgctctcgccgtagtcgtcctgtccgttgcttatgaagaatgttctgccgtcctcaaagtacagcgacgggtcgatgccgccctgatcgacttcgatagggtctgaccattcgccgtagatgtcatcggtataaacatagaagtttctgtgggtggtgtcgtttgtagtcaccatatagaacctgccgttgttatagcggatagtgggagcgaatacgccgcctgacgcaggtatcttgtcaagcattacctgttccggacgtgtcagcacatagcctatctgcttccagtttacaaggttatcgctctcaaagagcgcaacaccggggaaatactgaaaggtgcttgttaccagataatattttccgtttgcaaaacagacggaggggtcggggcagaagcctttcagcacggggtttttgtatatcatgctcaaattcctttttaaaaagctaaaataaatttatgcgtactttaatagtataccgcttaaaagtgcgaatgtcaagtaaaaagctaataaagcggtcatgtattagctttctaagaacgtggtatatgtaacttgcctgtgcatttgaacaaaggtgtataaatacacaaaaaagcatttattatttgttgattatgtgcaaatttattagaaagccgttgacaaattacaataatttgctatgatataaataaaggtacattttaattaaataaatggtaactattgattacattaatcagaattctgccgattttcaaattagctaattcaaaaggagtgattctatgaaaaaaacaactttgatatgcactttaattcttgtttctctgctcagcggctgtgccggcaataacgcctcccaaccggtttcatcgccggatacctctgttacatcatctgcatcggaatcaacaaccgaaagcatcacaactcccgaaacctccgtgcctgaagatgccacttcctcttatgaagacgaaaaatttactgcaataggcgtggtggacagttctgcagaggaaagcaaacgtgatatagcgtcatttatctacgactacggcagtgaatataagacgcccggcaaaaccacaattgacaaaatgttcagtgaggcgctcggtgataaaatcattgacgatgagcaggtgcaaaaagaggttgccgatattcttgaaaagtgtggtaagcttgaaaccgagctttacaatgcaggtaacaagataaaggatatgccggatataaccgctgtcccaaaagacgattacgataagtggtttgaaagttcggcacagccgactgcgtttacgtctatgaaggaattttatgaatcggaaaagtcggtatattccgatattacgacatttgaacagtttgaaaaggactttgacacattcacatatcaggacggtaaattctgcgtgaaaggaatttcaatcggcaggtgcaatgagacgggattgcacggtccggctttagaaagtttatcacagcgtgaatgcctttatgattgtgccaaagcctataaagacggtgataacgtaaaattggcttatatggtgcttaattctcagacacccggtacaagctgttatatggttttctccgccgaccttactaaaaccgacagcggttacagaatcgtccgtaacgttgactggagcaaggcattcggtaaaggcggcaaataactgcgtataactattataagctataaacaaacagaaagcccggtacggaaaaatccgtaccgggctgatcttattctgttgtgctcggaattaatacattccgcccataccgcccatgccgcctgcgggcattgcgggagcaggattttcttccttcttgtcggcaacaaggctctctgttgtaagaaccatagctgctactgaagcggcgttctgtaaagctgaacgtgttacctttgcgggatctacgatacctgcggcgatcatatcaccgtatacttcgttctgagcgtcaaagccgtagcctaccttgccttcacggcggatagtgtcgataataacagagccttcaagacctgcgttagcggcaatctgacgaacaggctcttcaagagcacggagaactatcttagcacctgtcttttcgtcacactcaagggttgcgataagagcttctacagcgggcatagcgttgataagtgctgtaccgccgcctgctacgataccttcctctgcgcctgccttagcggctgcaagagcgtcttcgatacggagcttcttttccttcatttcgatttctgtagcggcaccgaccttgataacagcaacaccgcctgcaagctttgcaagtctttcctggagtttttccttgtcaaattcgcttgttgtgttttcgatagcggctcttatctgagcgattcttgcctgaatctgctctgttgaacctgcgccgtttacaatcgttgtattttcctttgaaactgttacgctcttagcacgaccgagctggtcgatagttgtatccttaagctcaagaccgagttcggaagtgataacagtaccgcctgtaagaattgcgatatcctgtaacatttccttacgtctgtcgccgaagccgggagcctttacacctacgcatacgaatgtaccacgcagcttgttgaggataagtgttgtaagagcctcgccctcgatgtcctcagcgatgataagcagcttcttacctgcctgtacgacctgttcaagtaagggcagaacgtcctgaatgttgcttatcttcttgtctgtgataaggatgtaagcgtcatcaaggttagctgtcatcttatctgtatctgttgcaaagtaaggtgaaatgtagcctctgtcgaactgcataccttcaacgacttcgctgtatgtttctgctgtcttgccttcttcaagagtaacaacaccgtctgttgtaaccttttccatagcctctgcaatcagcttacctactgtttcgtcacccgatgaaacagtagctacacgggcaatgccatcgctgttttcgatagcctttgaattcttctttatctctgctactgccgagtcaactgcctttgagataccacgcttaacatccatagggttagcgcctgcggcaatgttcttcataccctctctgataagagcctgagcgagcagagtagctgttgttgtaccgtcgcctgcggcatcgtttgtctttgtggaaacttccttaacgagctgtgcgcccatgttttcgaaaggatcgtcaagctcaatttccttggcgatagtaacaccgtcgtttgtaatcagcggagcgccgaacttcttgtcaagcactacgtttctgcccttagggccgagtgtaatctttactgtgtttgcaagctggtcgatacctgcctgtaaagccttgcgggcttcttcaccgtatataatctgtttagccattgtgaatgttcctcactttcaattattctacaactgcgaggatgtcttcctcacggagtattgtgtattcttcgccgtcaaccttgacttctgttcctgagtatttgctcataagaaccttgtcgccgactttaagctgtacgggaacgagctttccgtcaactgtcttgccggggcctaccgctacaacttctgctacctggggcttttcctgtgcggcacttgtaagaattataccgccctttgttgtttcttctgcttcgagcatcttgataactactctgtccgataacggtttgatcgtcattttgaatgacctccttgttatatttgctgtcacttttttaactgtgacggtgctttttatttccaagttgttagcactctttatgtttgagtgctaaccgctgattattattgtaatcactttacgcataaaaatcaaggggtaaaatgtgaaaagtgataattttgttacattaatataaaagtcgttcagcagattgataattatttatgcagatttacacataaaattgacggaatttttgaaaaaggtgttgaaaaaaggcgtgaggggctgtataatataaatagaaacagggcgataaggatttatcaataaagtttgtagaaaaagtttatttttaaaaaaatgagcaaattctctatccctaaccccaaaccccttccccttttgtttttataatttacttaaaataaatccgttattcattccgcttaaaatcatttgccgagcctgcatggaaaacttgtcacgctgtcaccgtgaaaaaagcggaaagcggttactgccgcattcaacatatattttacaacataaaaacgatattgtcaagaataataagtatgccgaaacggtcgtattttgttttataaagccgaaaaagagaaaaataattttgcttttccgcttttttgccgctttgcttatcatcactctttcgctttctgcggcatatattgaagcagtgaatatacggaaacgaggtactgattatgtattttattgttttacgctcggctacagccgccgaaaaagcaagaaaaatcctcagtggctataaaatatcatctactacgggaaaaatcaccacttcaaagggctgcaggttcggaatttacacggaacacgatcccgacaagacctgccgtctgctgtcgctgggcggtcttaactgtatggagataagaaacggcggtgatgccggatgatatatcttgacaatgccgccaccacctatccaaagcccgtttcggtgcttcattcggcggaaaaggcactgtacgactacggggcaaatcccggaaggtcggggcacaggctttcgcttgaaacctcacggcaggtgttttacgcaagggagaaatgtgcggaatttttcggcggtgaaaccgaaaacacggttttcacgctcaactgtacccatgcaataaattttgcgctcaagggcgtttgcaacgcaaaggggcattgccatgtgataacgtccgaccttgaacataattcggtaataaggccgcttcacgctctgtataaacaaaaacagataaattacagcatagccgacagcggcggcagtgacgatgaactgctgtcggctgtggaaaagcaaatccgccgtgatactgccgtggtcattatgaccgcagggtgtaacgtaaacggcagagtgactccgcttgccagaattgcggagctttgcaggaagcacaatatatgtcttatagccgattgcgctcaggcggcaggcgttataccgcttaatctggcggacggtatcaatattatatgcgcacccggtcataagggactttacggacctatgggtacgggagtgcttgtgactgacggaaaatatccgctcagcacacttatagagggcggaacgggcagtgcaagcggagaaatcgaccagcccgactttctgcccgacagctttgaaagcggaacgataaatactcccggtgctatcgcactcggcaggggagtggaatttgtaaattcaaaaggaatcgacaggatttacgctcacgaaatgtcgctgtgcgatttatttataaagcgtgttgaaaatatcgggaaaatcagggtctatcgtccggaaaaggtaaaatctctccctgtggtatcttttacggcgggagatgaaaacagctcggtcacagccgatatgttatcaaaaaatgggttttatctgcgtgggggacttcactgcaacttccttgcccacaaaaagcagggtacgcttgaaacggggacggtacggcttgcgccgtcggtgttcaatacacgttcggatattataaagctgacggaattgctttataagaagtattcataacaattacagcccgcagcggtaagaccgttacgggctgtggttatatataaatattatttcaaaagagcaatcgtatcttctgctatctgttcgggagtcagatgtgccttatgcataagctcgtttacatcgtatctgtcgtagaacttcttttcaagaccgaagcacaatgttttaacatcgctgctgccatagaaacgtgctatcttttcaccgaaaccgccctcaagaattccgtcctcaagagttatcacaacatcgtggtttttcttgaggtcttcaagcatatccttgtcaatgccagtgatatagtggggacttataagagtgggagcggtgcctgtcttttcttcgattagctttgccgctttctcaccgagctgatagaaggtgccgagtgctatcactgctattcttgagccgctttttgtaatctcgtacttgtttatatccgaccagtcgctttttacttccttgccgtccgaaatcaccgcaccgcccggtacacgcaccgcaacgggatacttgttttgttcgattgcccagtcaagcatagaaagatattcttcctttgttgcgggagcaagataaacaagattcggaatgttggagagcataggaatgtcatagagtccgagatgggtaacatcgctcataccgtagacagagcctgcaaatacgcttatcgcaacggggctgttgtttatgcatatatcctgcgagatctggtcataggtacgctgtataaatgtgctgtatactgtgtacaaaggcttaccgccgcctgctgcaattcccgaggccatagccgccgcattttcttccgcaattcctacatctataaactgtctgcctgcctcatctcttctgcctttccagaagccgcctactgtgggagtaccggaggtcagaacgcatacgctttcgtccttcttcattttttcaagaagcatcttagctgtaaggtcgccgtaatcctcgccgtcataattgtactttgccttgcccgtttcaacgtcaaacggcatatgccagtgccagtcctccttgttttcttccgcaaaagacagaccctttcccttttcggtaactatatgcactgcgacaggacgcttgctgtcctttactttactgaaagcggcgataagactttcaatatcgttgccgtcctttacgaacacataatcaagacccatagctgtgaacaggttcgtatcggcttttccgttgccatcacgcagagccttgagatttttgtacataccgccgtggttttcagcaatagacatatcgttatcgtttataataatgataagatttccgtcaaattcgcctgcgtagtcgatggcctcaagagcctcgccgccgctgagcgaaccgtcgcctattaccgcaataacgtttccgctttcgtgctttaaatcccttgcctttgcaagaccgagtgcaaggcttacagaagttgaggtgtgaccgatgacgaaaaagtcgtgttcgctttcggcgggattagagtagcccgaaatatcgtcaaaatgctcttcataaaggaaaccgtcttttctgcctgtgagcatcttgtggcagtatgtctggtgagatacatcgaatactattttgtctacaggcgaatcgaatacatagtgcagagcgaccgttgcctccgcaaaaccgagattgggaccgcagtggcctccgtgacggctgagcttgaatataagtgcgtcacgcatttcctgcgtcagctttttcatttcgtcaacgctcagcttctttatatccgacggtgagttgattttttcaagatacattgttattctcctttttagtatgcgtctgccgctataagacggacagcacgttgctttcctgttacaaccgtattgtatcacatggagttaactccaagtcaagaggttttgaaaaaaattttcggaaaaatacgcaatactgttttttcaacaatatatgcaaaaattgtaaccaaattgtaaccatttattagttgatttttcaaaattagaatgttatacttgagtaaacagttatttatattaaaaatccgaaaaatcataaaatcaataataaaaaggtaaacgccatgacatctttatcttcatcagcatcaacatcagctaaaacggtcaataacaacgctcaaaaaaatatttctgtttctgtctgtgaaaaaaacgccttaacggctgtaaacgggcgtaaaaagcgaaaacaaggacggctgcgggatttctgcatcgtttttctttcggtcgtgatagccttttgtacggggataatgcttttctgcggttatgctatgacacaaaggaatcaaaacagacctaacagaccttctaccgaagtacagacgtctttgacagtcacaaaaataaagcctgtaccgagaatcatatccgtatcggtagcggaagagctgaatgcagacttcacacgcaatgtagcaatagaatgcagaaacgatggcggtacaacggacgggttgtattattcatataacggcgatagtgacaggaaaaggcttgaaggcggaaaagcggtattagctctgccaaaaggaagctacattataaccgtgaccaacgacagcggaaaagccgtgcagagtgatgagtttacgataaacgttgatgcggtaaccaaaatcacaatagacaaaaccgatacatatatgaatgttggaatgacaggcacgcttacaaccgcttttgaaactatcggtaatcccacagacagcgaaaagtcggtaaagtggaacagctccgcaccgaaaacggtcagcgtcaaggacggtgtgatcaccgcactgaaagcgggtacggcgacaataacagcaagcgtatcggacagcatttcagacagtatagaaataacggtcacggatttactcagagcgccgaagattactgcaacaaagccgcttcttcagcccggtcaatacagtgaggcggagggaagtatgattgacgctgtgcttgagagccgtgtaaataccgcaggctacggaacaagagcaggcgtagttgcggcggcaaggtttattccgcttgaattcaattacaagataccgtatttctatgaaaacggcaggcttgatccacagcccgaaagaccgtattgtgacggcgagggcagattctatcacaagggactttatcttacccacagcaagtttgacattcttgataagaaaggcatattattcggtcctgcaacgtggggcgaaccgctcacaaactgggaggacgcattcggacttattcccggtgcgaaatatgcaaacggcatgacctgttcgggatttgtttcgtggtgcctgtataacggcggtgtaccgctgggcgatgtcggcgcaggggatactcccggctatgacgatgaatattccgatttcggcgagcgtgtatggcttgacgaggaggtaatgcgaagcggaatattgcaggtgggcgatcttatcggctgtgacggtcacattgcgataattgcaggctttgacgagaataatatctatattgcggaggctctcggaaaaggtattgttatggaggtgcgtgaacgctaccgtgaggtgtggcagtgcggcgattatacatacgctatgcttatgggagatatttatgcgaagcataacggcaaaggaaacgtaactgaaatgtggaaggattattccgccgaaaataatcaataaaaaacattgatgcccggcctttttgcttatgtgtgataaagaagtaatagaagtgtaaaaaattttgccgttcctatccggcacttgcgcagggtgtcggataggtcgggcttattcttcgggcaagtcaatcttgccgacaaagctataataaatatcaatgcgctggtggcgtacttcgttctcgtcatactcacattcatagacaacgattttctccaccatttcacgcaagagggtgtgtgtcagttcctcgatagaaaggtacttgcggacaacgttcataaacttttcagcgtttaccgtggcttcctgtgccttgtccagttcgccctgcaatgcggcggctttctccttcagttcccgctgctcggcttcgtagtctgcggacatttccataaaacgctcgtcattgattttcccgtttacattgtcctcatacagacgtttgatatagcgggaaagttctgcaatgcggctctgcacctgttcaagctgcttcgtggctgccgcctgtttccgcttgccgcccatttcattctgctggataagcagcttcacgaaccgggcttcatgcttctgtgcataggcggtcactttccgcagattgtccagcacacccgccgtcaaaaggtcggttcggatgaagtgcgccgtacagtcggcggtgcgcttcttatagctgccgcagatgtagcaatcctgctttctcttgtcggtctgataccgctgctggtacatcacatgaccgcagtcggcgcagaacagcaagccggagaacaagcccacatcatcgtagcggttggggcgtttgcgctgcttgcgtaactcctgcacccgttcccatgtctgcaagtcgatgattggctcatggtggttctcgaaaatcgcctgtttctcaatggggttgtctatgctgtgcttcatcttgtaggacggtttttccgtcttgaagttcacaagacagcctgtgtattcccgattttccaacagatgaacaacggtattggtcgcccacttacattcatagccggggtggtagcggcgtatgctgcctgtgcgctggtattccagcgttcccggcgtggggatttcctgctcggtcagcatacgggctatcttggtcggaccgttcccggcaaggcaaagctggtaaatctgcttgactaccggggcggcttcctcgtcaatgatgaaattttcgtcctcgtccatgaggtagccgtacacgggcttgctggtaacaggcttaccgctcatgccttttgctttcttaactgccttgatttttttgctcgtatctctcaccatccattcgttgaaaagattacgcagcggggtaaaatcgttgtcgcccattgcgctgtccactccgtcattgatagcgataaagcggacgcctttctgcgggaaaagcatttctgtatacattccaacttgaagataatttcgccctaaacgggacatatccttgacgatgactgtgccgactttcccggcttcaatgtctgcaagcatggcttgaaatccgggtctttggaagttcgcaccactataaccgtcatctgtgtaccagcagagattggtaaagccgttctgcttggcgtaggtttccaaaatgcgcttttggttggatatagagttgctttccccttgcagttcatcttcatgggataatctcggataaagggcggtaataaggttttgggttgtctgtcttaacatggtttcctccgtttccgacagccagccccactattccgtacttcgattgtaccatacagcggggcggcttgtatagcggcaaagtgtaaaagtgcttctttaccgcccgtcaaaatgacgttttttgcgttagggttatcacgcagattcaacttcataaatattttacttttatttgatagtccatttcattctgctgtgttataatggcaaaaattgaattagcgaggtaaaaggcttatgaaaaaatatatttctttgtttttatgtctgacttgcattttaactttagttgcgtgtgggaaaaaagctgctcccattcagttgccccaaacaagcgacattacatctgttgatgtaactgttggggaaaacaccacaaatcattcagacacagcagaatcctcaccgtcataaacaccgatgtatttatgccctctgcgtaaatcgtgataaatcccagctttacaagcggatctccctcgccgtgtataaagaacagattcagtatacaggtaaacagtattataggcataatgggtttaaggctcttgaaaatcagcttgaagctgatccccgacatcatataaataatcagcataaacagtcccgccgagataagcgagcaataatttcccgccataaacagcattacgacataggctatatcaagcactatcttgaaacggctgtcgagcctgtggattattgaattgcccgggaaaaactgtcctattgtaatatccttcagcatatcgttcctttatctatatactgcattattctgtccttggcacgttcaacagtatatatatcttttcctaaatctacacctttatctctcagcttcatcataatctttgtgatctgaggaacatcaagacctatctttataatttcgtcctgtcttgcgaatacgctgtctgtatcctcgtggcagaacagcttgcccttgttcataacaagcaccttatcggcatattttactatgtcctccatagagtgagaaacaagaagtatcgtcttgccgtatttcttgtggtaatcgcttatcttgccgagtaccttttccctgcctatagggtcaagtcctgccgcaggctcgtcaaggataagtatctcgggatccattgcgataacgcctgcaagtgcgacacggcgtttctgtccgcccgaaaggtcaaacggcgagcgttcgagaagttcctcacggatacccatattttcagccgcctcacgcactctgcggtcgatctctgcttcatcgcagcccatattcttagggccgtatgctatatccttgtacaccgtttcttcaaacagctgatactctgaatactggaatacaagtcctaccttgaatcttatcgagcgtatatcaacgcccttgctccaaatattctgaccgtctatcagcacttcacccgatgttggctttacaaggccgttcaggtgctggataagcgttgattttccgcttcccgtgtgaccgattattccgcagaattcgcctttttctatagtaaggtctacattatccacagcggttgactcaaacggagtgccgacgctgtatttataggtaagtcccttaagttctatcacattcattttttattccttatttttgagaatgtcgtacagcacctgtgcgcattcatcttcatctattatatcatcgggaacgtcaagtccgcattttttaagctcgtacataagctcggtcgcctgcggaacatcaagtccgaccgactttaacagctccacctgtgagaatatccttttcggcacatcgtcaagcagtatattgcccttgtctataactataacacggtcggcctttgcagcctcctccatataatgagttatcagcacaacggttataccgtgctccttgttgagcgtctttatggtcgccattatctcttttctgcccttcgggtcaagcattgcggtcggctcgtccattactatacatcgtggccgcattgcgattatgcctgctattgcaactctctgcttctgaccgcctgaaagctgatgcggagcgtggttgcggtactcgtacatatcgaccgttttcagtgcgtcatctacccttttgcgtatttcatcgggaggtacgccgagattttcgagtgcgaacgcaacgtcttcttcaactatagtcgctactatctggttgtcgggattctggaaaaccattccgacagtctgacgtatatcatatatcctgctctcgtctgtcgtatctataccgtcaacaagcaccttgcccgaggtgggaagaagaatgccgttgaagtgctttgcaagcgttgacttgccgcttccgttatggccaagcacagctacgaagctgcccttttctatcgaaaggtttatgtcggtaagaatgcggttcttgcctgtttcgtcgccgttttcgtcaaatacggtataatcgaatataaggtcttcggttttaattatctcgttatctttcaatccgttctcctttgccgccgtttaatcgaaatatactacagcggtgtttcccgcaggcactgcaagccctgtctgttcaacgggaagtcctatctcctgcgaatctactcttatcttgtattttctgcctaccgtcatctgtaataggtaagtcattaccgatgaggaaagacctgtcgtgtagctgttgagtacaatgaacagagggttatcggaaagcacctcggtgcacatattcataaggtcgcatatgctgtcctcgagcttccacatctcgccgtttgttcctctgccgtagcttggggggtcgagtatgataccgtcatagcggttgcctcgccttatctccctgccgagaaactttaccgcatcgtctactatccaccttatcggcttgtcggaaagaccgctgagctttgcgtttgtcctgccccagtccaccataccctttactgcgtcaaggtgacatacctttgcgcctgcctttgcacaggcgagcgttgcgccgccggtataggcgaacatattaagcacgtttatctctctgcctgcgttctttataagctctgagcataaatcccagttgaccgcctgctcgggaaatattcctgtatgcttgaagcctgtgggctttaccataaaggtaagtcccttgtagcttatgttccagctttcagggagctgttttctgtattcccagtttccgccgccgcttgatgaacggtgatataccgcatccgccttgctccacagcggcgaggggtcggggtttttccatattatctgcgggtcgggtcgcacaagcgttattccgccccatttttcaagccgctgaccgtcagacgcatctatgagtctgtagtcctgccaatcctgtgattttctcaagtttgttcaccttatcctgtaactgtctactgtcggtcgtatcgtgtcaagaaacgaattttcgcctatcctgtttattttaaagaataccgcctgactgccgccggttgaagttaccgaaacgaatattctgccttccgtctggaacagtgtgacgttcatactcactctgccactgccgagatagctgtaacgctcgtatgcacggatggcgcatcgggtgctgccgactactatatcagaactttcttcaagagatgcgctggtgctgcctctcataacggtgttgtgaagatccataagtataatatcaaaattgccgtacagctctgcttctatctttgccataaaaactcctttaacatttcatcggcacaggcactctttaatcgtgtctgcgatgagatgtgtccaatgatgcacttccttttcgtctttgccctctatcataactcgtacaagcggttctgttccgctttctctgacgagtattctgccgttttcgcccatagcctgttcagcctgtgcgataatatcggttatcttctgcgtcttgtcccatagtccctttttgtcctcggtaatctttacgttgacaaggagctgcgggaagtcgggtatatcctttacaagctgtgacagcggacgtttgcatttcgacagcagttcaagggtctgcaccgctgtaagctgtccgtcgcctgtggttgcgtggtcgaggaaaataatgtgtccggactgttcgccgcctatattataaccgttgttcagcatttcttcaagaacgtaacggtcgccgaccttcgtgcataccgtttctatcttgttttcgttcataaagcggtggaagccgagattgctcattacggtgacgacagccgtgttgtttttcagcgtacccatttccttcatataacgtgagaggatagctatcagcttatcgccgtctattatgttgcccttttcatcgacagcaaggcatctgtccgcatcgccgtcaaacgcaaagcccacgtcacagccacgctttttaacaagctctacaagctgttctatatgtgtggagccgcatttatcgtttatattaaggccgtccggctcgttgttgatgtatacatattccgctccgaacttatagaaaagcgactctgcggttgcgcttgcactgccgttcgcacagtctatcgcaacaagaagtccctgaaatttaccgccgacggtcgactggatatgctcgttgtactcgcttacggcaccgtacatagttcttactctgccgacatccgagccgtcaacaagcgtcattttttccggagtgtcgagtatcagcgcctctatctcgttttcaacgtcatcggggagcttgaagcctgtcgatgagaacagctttatgccgttatattcaacgctgttgtgcgaggctgagatcatcacgcctgcatccgctccgtaatatcttacaagataggctactgcgggggtgggtactactccgagaagctcaacgtccgcacctaccgaggttatacctgcgataagcgcagattcgagaatatccgaagatattcttgtatccttgcctatcagtatccttgctttacctttatgagttttctgctttgtaagtacgatggctgcggctctgcctatattcattgcaagctcgcaggtaagctctgttacggctatacctctggcaccgtctgttccgaataatctgcccatgatgcttaaaatacctttcttctttttttcaaacacaacaatctatttttataaatcacattttggagaaaaagtctgcttttataaaaaatagagcaaattctctatccccaaccccaaaccccttccccgtgggaaggggctatttactggggctaccgcccctagtccctgttgggggctacgccccaaaccccatcatctgaaaatatatagttttgcgacagttagtacttaatacaagtcagtcaagtctttgctgaccgtcacgcacaagtccgagatgcttatacgcaagctcggtcgcacatcttcctctgggtgttcgtgaaataaatcccagctgcataaggtacggctcgcatacatcctcaagcgtgaccgattcttcaccgagtgcagaagccagcgtttcaagtccgacaggaccgccgttatagccgtttattatcatagtgaggaaacgcttgtcaaggctgtcaagcccgagcttatctatctcaagcctgttgagcgcaatgtctgccatttcctttgtaatctttccgttgcccataacctccgcaaagtcacgcacacgcttaagcaggcggtttgcgatacggggagttcctcttgaacgctttgctatctccatagcgccgcttctgtcgcagggaatggaaagtatgaccgatgaacgcattacaatatcgcaaagctcctcgggggtatacatttcaagacgcattatcactccgaacctgtcacgcagaggtcctgtaagctgtcctgctcttgttgtagcgccgataagcgtaaatctgttcaggtcaactcttatcgactgggcggaaggtcctttgcctatcataatatcaagcacgcagtcctcaagagcgggatagagtatctcctctacctgtcttgaaaggcggtgtatctcgtctacaaacagcacatcgcctgcctgaagccctgtaagcaatgccgcaagctcgcccggcttttcgatagcggggcctgaggtgactttgaaattaacgcccatctcgtttgctattattcctgcaagcgttgtcttgccaagtccgggaggaccgtacagcaaaacgtggtcaaggctctcgtttcttttcttcgccgcctgtatatatacctgtaaattttcctttaccttttcctgtccgatatactcattcagctttcttggacgcagggaaaactcaacatcggtatcctctgcggaaaactgaggctcaactattcttgcgccttcgtcatcggctgtatatgaaaggtcatttctctcaatcatttatacgctttcccttcaaagttaatgcgtgacgagcatcagaatttagccagctttttaagtcctgcccttataagctcgtctgagggtgctgacgggtcaagtccgctgagtgcggaggctgcctcgccgtttgaatagccgagtaccataagtgcagatactgcctcggcataggtatttgacggggcggcgactatcggcactgcactgccctttacacctgcggctacgtcctgctttgacaccttatccttaagttcaagtacgatgcgttctgcggtttttctgccgatgccgggtgcgtttgtaagtgtcttgccgtcaccggacgcaacgcaaagtgcgaatgcctgcggcgtcattcccgataatatcgacagcgccgctttagggccgacaccggaaacggaaatcagcatcttgaagcaattaagctctgcagcatcataaaagccaaacagctcgaccgcatcctcccttacagaaagataggtcagcagttttgccttttctccgattttaagctgtgacagcgtattcgctgtggtgcggcaggcatagcccacaccgccgcagtcaatgaccgcaaggttaggctcgataaggtctaccgttccgttaacactgtatatcataaatcaaaactcttttcttatatatttgatgcctttatgtttctgagcaatgagccgcttgtctgggcgtggcatattgtcattgcgagtgcgtccgcagtatcatcgggctttggcacgcaggagagcttgagaatgtttttcgtcatctcctgcacctgtttttttaccgcctgaccgtagcctacgacagcctgctttacctgcaggggcgtgtactcgtttatttcgataccacgctgtgccgccgccattattataatgcctcttgcctgtgcgacatctattcctgttttctgattgttcgtgaaataaagacgttctattgaaagcgcatcgggtttccaactatccagtatctgacagtaatcttcatatatttcacaaaggcgcttaggaaacggcgtatccttatcggttgttattgcgccgaaatccttgacgctgaattttccgccgatataatcaacgacaccgaaaccgacaatcgcatagccggggtctattccgataatacgcatacagcctccgtaagcatatgttctgagctgtgcttacagccaaaacaaaaaacaaaattccatactaaatgattatatcacaaacccgtcttaaatgcaacttttttgttgcagacgcacaatcggacaataatacaatataaattaaataaaaatcagttgaaatctgtgtccttttggtatataatagtatgtacaaaacgaatggagaaggtatgaaaaaaacatctttgatcccggcactgttttttgcggtatccctgcccgtttgtcttgtccgatacggctcataaagccacatctcctttttatcaaggtttattcctgcaactttaagaaaaagtttgtttttgagaaaagcaatctattctcaatccctagccccttcccctcgggaaggggctatattactggggctaccgcccctagtccctgttgggggcttcgcccctcaaccccattcacgacaactttagaggctttttgacaacccattattcctgttcttccttgctctcgattctgaacagctttaccgttgtaccctctacagccttttctatgagaggcgcaaagtcaaacgactgctcagcctttatgacctcgtcaaatacagggcgtgtcttggggtgtttcggcgtaaataccgtacagcagtcctcataaggcagggtcgatgtttcaaacgtatctatctttcgtgctatatctataatttccttcttatccataccgataacagggcggaataccggatattctgcggcggcatcggtacactgtatagcctttaatgtctgacttgccacctgtcccacgctttcgcctgtgacaagtgcgccgtactcgtttctttcggcaattatgttggcaattttcaccataagcctacgcataattattgtgaaaaattcttcggggcagttatccctcagcgcttcctgtatctccgtaaacggaacgcagtagaatctgatatctccgcaatagcttgtcagcttttcgcagagcgtttcaaccttcatcagcgcacgctcggatgtatacggagggcttacaaagtgtataccgtctacaataagaccacgcttcgccatcatatagcctgcaacagggctgtcgataccgcccgacagcaaaagcagagccttgcccgagctgcctacaggcataccgcccgcaccgattatacgctcggcactgacatatgcacccttgtcccttatctcgcacattacggtaatttcgggattatgaacgtctacagacaggtgaggatacgcttcaagtatggccccgccaagctccgcctgtatttcgggagttttcatagggaacgatttgtctgaacgctttgcgtcaaccttgaacgtctttgcgtttttgagtgcattttcaagataaggtacgccctgcgattttatctgctcgaaatccttttcgaacaccgcacaacgctgtaatgcgcctataccgaatattaccttcagcttttcgataacttcgtcaaggtcgcattcgcccacaggctctatgtatatggtagactgctttctcatgtaatgaaatttaccgcagtgacgcagtcttcttctgatattctttacgagtatatcctcaaaagtgcctttgttaagccctttcagtgctatctcgccgtattttgccattataagttcgttcattatatgtttcctttcctgctgcttttctttgtacgtctgaaccgtgcaatgccgttttctatttcatcgcagagtgcgtcaatgtcttcctttgttgtttccatcgaaaagctcactcttatagtgctgtccgctctttcgctgttcattccgaaagcgtcgggcaccgagcttatcttgccttttgaacaggcagagccgctgctcacataaatctctttttcttcgagcgaatgaagcattatctcgcttctcaccccaagcacagagaaactcagtatgttatacacgctgttgtccgggctgtttatataaacgtcctccattttcgaaagcctgtcacgcagataaccgttcagctcactgtaatgtgtaaggtcggcagggtatgccttcacagccgcctcaaatgacgctataagctcggtaggctctgttcccggacgcagatttttctgctgtcctccgccgtatacaagcggagtgaatcttatcttatccgcacagtacattgctcctatgcccttaaagccgtgtatcttatgtcccgaaaggctgataagatcgcccttaagcgtcaccttgcaaaagccctgtacgccgtctatatgaacgatagtttcgctgttcgcattttttacgagtctgtacagcttttcggtattgaccttaaagccgttctcgttgtttactgccatgcacgatacaagtatagtatcctgtgtgacattatccgcaatatactgctcgaaattatcaatagcgtccttaggcgacaaacggactatttcaaagcccagcttttcaagataatccatcgttcttgctacggacggatgctccatagcggtagtcactattttatttcctctgcgtttataagcgtctgcgactcctcttatcgcaagattgttgctttcagtcgcacctgatgtaaaatatatttctccctgcagacccagctttttaagaatcgttttctttgcactgttcatcagcttttcagactcaataccgagcctgtgcagtgacgatacattgccgaaacagcttcttgcggcatcttcagccgcttttattgcctgctcgcagggctttgtagtggcggcattatccagatatatcaaaattccgtctccttttcattgggacttcgcccacttatctatagggcgttgcccgcttgtctataatcgtcttaattatacaccattttgcgataaaaaaacagggtatattctgaaatttttatgaaaaaataaccttgtatacgcattaccgccgattttatgaaaggaagaacataatatgtatatttcaaaacgttgttttgtgcggataatcagcttttttaccgccatattggttgccgcaggcatatctgccacgctgaatatgaacagctccgtccgttataaaaggagctttgagcagagcatgacacgaaatgtagaggatttgtcggccgagatcgacaacatcaagaacacgctttacaagggtatgtatgcaggcacaccggagatgatgacacagctttcgtcaaagctgtggagcgatgcgtccaccgcaaaagcctcacttgccgagcttccggtatccgagcttcatcttgaaaacacctataaatttctgtcgcaggtgggcaacttctcaaagagcctcgcaaagcgttattccgacggagaaacgctgacagaggatgacagaaaatcgcttaaaacgctcggcgaatatgccgaccgccttgccgacaatatgtggaaggtggaacagcgcataacaaacggcgaattatcctttgaaaaagccgcaacagaggtgcaggaagcgaaaaacagcgatgagccgtcgtatataacggagggcttcaccgattttgaagaaggctatgacaactacccgacgcttatatatgacggacccttctcagaccatatcctcgaaaaaaatcccgaaatgctgaaatccgcatcggcagtcaccctttcggacgcactgaaaaaagccgagaaagcctgcggcactgtcggcttatcgcacgatgacaaaaacgacgaacagggaaaaatgccgtcctacgtctttacaaaggacagcaccaccatagccgtgacaaaaaacggaggttatctcagctatatgctctgcggcagaagtgttcccactcgttctgtcaccgctcttgaggctgtcgcaaaggctgaagaatatctctcgatgctcggcataaaccacataaccgacacctattacgagataaacggcaacgtctgccttgtgaactttgcaggcacacagggagatataacgatgtacaccgaccttatcaaagtcggcgtggcgatggataacggcgatatactcagctttgacggcagaggatatatcacaaatcacaagaaacgtaatctgcccgaaccgaagattaccgcagagcaagcaagaaaacatctctcatcagagcttacagttactgatacctcccttgccgtagtgccttccgcaggcacaaacgagctttattgctatgaatttcactgcacatctcctgacggcagacagatgcttgtatatataaatgccgataccggcaaggaagaacagatactgttgcttgaaatcagcgaaaacggtacgcttaccgtataaaaataatataaaagactgcaagtccaaaatcggatttacagtctttttgtttattttcctgttatcagtttctgcatagcaggaagcaggacattcatatcgataggcttcggaacatggtcgttcattcccgcctttatcgcattgtccttatcctcggaaaacgcattggcagtgagcgctattatcggtatatcggcttttttgcggtcgtctatcctgcgtatcttggctgcggcctcatagccgttcattatcggcatctggatatccataaggataatatcatagtaatcatcgggcgctttctccagcatttccacacagtcaacgccgtctttggctcgttcgattataaggccctcatcagacaacaattcggttgctatttcggcatttatattattatcctcggtcagaagcactcttctgcctttaagggaagtcttgtcaatatctgtatcggcacgttttgcctttgcttcctcttctgacgatattctgcaaggaagtgacacagtaaatacagagccttcgcctattgcgctgctgacggttatctctccgcccataagatcgaccagtttctttacaatgcccattccgagccctgcaccctctacaccgctgactgtagaagtccgttcacgcgagaatgcctcaaatatatgcgatatgtattcttcagacattcctatgcccgtatcggtaattgagaacaccgtattgcacatctgctcgttgtcgccgtcctcctgccttatagcacaagttatctctccgtctgctccggtatatttgatggcattactcattatgttcataacgatttcagagaaatgcgtttcatcaatatagatgtacctgtattttatattcttacgcattgatatagtgagttttttcttctctgcggaattttcaaacatagttatacaggacgtgaacaagtcatcaatatcgtttatcgtgttttcgataactgtcttgttgttttcaattctggcaaggtcaaggacattattgagtaacgacagcagtttctgcccacaattgctgatattgtccatatacccgctgagcttgtccggctcgttgagatggtgctttgcaagctcgacatagcctgttatagcattcatcggtgtacggatatcgtgagatatattgaacaggaacgttgactttgccctgttggctgaatatgccgcttctgccgcttcttcgagtattttctgttgctttttctgctggttgcggtaatgcctaatataaatgcagacacagaaaaacaacataactatcgcaactatcccgacagcaccgattatcataacgaaattattacgttcactgataaatacataagtcggctccatatcggtctcgatacacaacgcaccgatgatctcattacttccgtcattcgctctgacgggatagcacgctgtgaaaatatgaccccacgttgtatcgattatctcctgcgaatagacattttctcccgaaagcgctctttcgatatacggtatcatctcttcctcaatatatgtaccgggataggcaaagtcatctgcgccaaggtcaagaccgtccacaagatatataagcctaccctctgtatttctctttgctgtatagaagtatcttgtcgagttcatattgcgtatctgattgagatatgtctgaagcgatttgtaacgctcggtattcatatcgtccacagtatttatttcggtaaaatcctctctggtaagtgcattcgatacgcccttgtgcatagcgtcggtgcgcgaactgtcctctgctatcgcattatccagtatactgtcattatacattttttgcaaaatatatgtatatcctgtaacgaacagcacaccgacaacgactatcagaacaagattataaatgctgcgtcttgctttagctccgcttttttctacagaattattattgttcaatcccacttatgtaaacctccgtgacagcatagccgtcgtgcatacggatttcgattgcacagcgaaatccgcatactgcatataaaaattatacattagcaaaattgcattgtcaagaagcatacaagagttatgtcacacttagccaaaaataaatcccccggtttaaaaaccgggggattgtatgatcttatttaaatattaaactaagattgaatgctcatcgttaggatcgaacaggtgtaccttgttaggatcaagagcaagcttgataacgtcctgaggacgagctgtacatctgggcgatactcttgctgtcagcgggataccttcgcatgtgaggtagaggtaagactcagcacccatcatttcggtaacgtctactgtagcttcgatcagacctgtcttagcgtttgaaaggaacatttcttcatcgtgaatgttctcgggacggataccaaggataacttccttgtcaacatagtacttaagagcttctgtatctgccttagcaccgggcagttcaacatagaactttctgcctcttgttgtctttgtatcttctgaaccgaattcaactgtgtacttgccgttgagcataaggagcttagcgttgataaagttcatctgaggtgaacccatgaagcctgcaacgaacttgttaacggggttctcatacaggttgataggtgaatcgatctgctggatgtaaccatccttcataactacgattctgtcacccatcgtcatagcctcgatctggtcatgagtaacgtagatgaatgtagtacctaacttcttgtgaagctttgaaagctcagttctcatctgtgcacggagcttagcgtcaaggtttgaaagaggctcgtcaagtaagaatacctgaggatcacgaacgatagctctacctaaagctacacgctgtctctgaccacctgataaagctttgggctttctgtcgagaagatgtgcgatgtcgaggatcttagcagcttcttcaacaagcttcttgatctcatccttaggcacttttctcagctttaagccgaatgccatgttctcgaaaacagtcatatgaggatacagagcgtagttctggaaaaccatcgcaatatcacgatccttaggagctacgtcattaacgagtctgtcgccgatgaaaagctcgccttcggaaatttcctcaagacctgcaatcattcttaatgttgttgacttaccgcaacctgaaggaccaacgaggataatgaactccttgtccttgatgttcatagtaaagtcagaaacggctactacgccgccggggtaacgcttatagatacctcttaaagataaacttgccatttatgtgtagatcggaagagcgtcgtgtattttttttcaagcagaagacggcatacgagatttcgcggagtgactggagttcagacgtgtgctcttccgatctatttgaacgtgttgatatacatggcgtcctccttttggcatgaaaatagcggacaaacaaactgcttgtccgctcaacggctctggtcacgctggcgctttttctgccatgcgtccagtaatttgaagatggtgttctcgatctggaacggggtataggaacgcgggaagtatttgcggagcttttcaccggaaagggtgatgtcgtttttctccggtttcttctgctccatcataatggagagcatggtgtcctcgttcagctcgccgctctgactgagctttttcatccgctgcgcctgcgagagcgagggggtggtctgttcgctgtcgatggtttccagaagcagcccttgttccttgggtgtcagcgccgcaagctgataggcgggactgagggcgattttcttctcgtccaccatctgctgaagctccgggactaactgcgtcaaggcgatgtagttgcggatggtatctccgctcacaccggcatcctgaccaacttcatcatcgctgcggaacttcgccgaaattttcggcgaagtcagatccgttcgtgcgccctgccgcttgatggcctccatcttcatcttgtaggctttggcgcgttcggaggggagaatgttctcacgctgaaggttgctgtccaccatgatgatggtggcagcgtcccggtcaatgtcgcggacaatgacgggcatggtggccagcccagccagctcgcaggcgtgtttgcggcggtggcctgcaatcagctcataaccgccgtcctcccgtggccgcgccagcgcggggacgaggacgccgtattccttaacgctttcggcggtttcctgcatggacgcatcctcccgcacctgaaaggggtgatccgggaacggatgcagctcggagagcgaaatctgaacaactacttcctgctgcggtttcggctttttggatggcgcgggctttttgcccggttccttctgcacggctttttcaggcattgtgttcctcctgtcggcatctgattttgggtacaaaaaaaggacatttcttcttttcagaggaaatgtcctgatttcttggacgggctgacagcccgcccaaacagtatttagtttttgtcgttactataacaccccctacgatataactacttcgcggctcgatttttcggtttggaaaaggatgaaaaaccttgccagataaccgaaaacccttgatatacggggcttttccggtttgtcgtaattataccgtaagggcacaccttcgccactcacgcgctggcgggcggcgtggatgcgaaaaccctgtcgggaatcctcgggcataccaacgccagctttacgctggacacctacacccatgtgaccaccgatatgcagagaaacgcttccactatcgtggggagctttatggatgagattatgcttgaaggagatgataccaatcgctaaaaaaagaaaaaatggtgagggcacattacgcctgcgtaaagacggtcggtgggaaggaagaattgttgtcgggtacagtgagaaaagcctgcctattacaaaatgcgtaacggcgaaaacaaaaacagaatgttccactaagctcgaagcgctgaaagaacagtacggacgctcttccgacagaatcaaggcggatatgccgttcggggattggatcgacttctggtatcagacctactgccggcacactctccgcattaccacaagaaccgactatgaaaaccgcatttacaatcatatcattcccgaaatcggaaaaattctgctgaacaggctgtcacagtcggatttacagcaattctacgcaaaggaaaagacagacggaagaaaactgcacgcaaaaacctacggaaagggactttcggacagaacgataagggggatacatgccaactgccgcacagctttacagcgggcggtgcaggagggcttaattcgcaccaatcccgccgtcggctgtaagctgctaccgaagaaagcacgggagatgcaggtgctcacgcaaaatgaaattatccgatttctgcatcaggcaaaggaagaaggttgctatgagctcttcttgctggagctcggcacggggatgcggcgcggtgaaatattagcgctcaaatggagtgacctcaacttcgcaacaggagagcttcgcattgaacggcaggtatatatcatcaaggcagaggtgattatatcagcgccgaaaacaaaagcctcaatacgcactgttattctgccgccgtcactcttgaaaacccttgtggcgtataaggaaacggtggattcggaatggatgtttccgtcaccgacggataacggcagaccgagaaatccgtcatcggttagaaaacggttacaactgatcttggaacgggcgggctgtaaaaaggtgcgctttcacgatctgcggcacacctttgcgaccatggcattggaacacgggatggatgtgaaaacgctttcggcaaccatcggtcatgtgtcttcagcaaccacgctggatatctacagccacatcaccgataccatgcagcggcaggcggcggtgcatattgaccgcaaaatcggcggcacagacgcccaaatgccgacggctgagccgtcgacaaggaaagataccgccccggtcgaattcacgccgtacaagcccaaaatacgcaaaccggggacgggctgtgtcaccatgataaacgaccacctgtatgagggacggtacacgccgaccaacgcctacggcaagcgggaaagccacaatatctatgcgaaaacgcgcgaggaatgcgaagaaaagctcgcggaaatgattgcagaggttaaggcgcaaatcaaggcggaaaaagagaaaatgacagggtgaccgaaaaagtcactctgtcaaaatttgcgtcgctgtaaacaaagaaaagtcttacctgcgatatccgtttttctggcacatttcatttattgattcggcaaaaatcgaacgggagtgtttatcagggttatcattgcagtttttcttgtatatgtaataatcctgcaactcgccccaaaggttctccctttttaaccaatccattttcttttctaatcctacaaaacccttcccctgatattcccaaaagtaataattgttgtctttgttaaaccgaatatactgctgccttccgtcgccgcaattatatactattgcaaagtcgcaactatgaataatgcgagaatgagaagtgtcaacctttttaatcgtaagaacgcgagtggaatcctcgcaatttttgtatccatagcgaggtgcaacacggtcgatagcagtacgtattattgtccgtatttctttaggttcaaaatcctcattatcgtcattgacctcgatgttgatatcgaagtcaaaaccgatgttagattttgcatcgcaagtaatcatattacggcttgaactgccgatcggtgtgaagctaaaagtgaaattgtcacgcaccaaatcctgtaccatgtaaagaatttgatatagctcatcctttataggctgagcttgttttttggttacatacctaaagtcatgcattatggtttctccttaagattatctccctaaccgaccatctaacctgagttaaatcgttatattatactacaataatatcatttgtcaaggattatttctgggggttatcttttgctaattttatctgattattatactccaaacctaacaaaatttgtatcgcaataggcagagaaaaaggctggaacggtatgaaaaatcctctgaaacgctcggtttcagaggatttttggtcggagtggcgaggctcaaactcgcggcctccgcatcccaaatgcggcgcgctatcaactgcgctacaccccgatagttattaaattgtggtcatgtaagtggtcaaatctgtggtcaaacacatttttgaccgccattttttgttttccataccgtccaaaaatcgcacggttaaagggctttcggcggttggcaccgataaacgtcagaaatgccgtctatgctcccaaagcaggcgcgctaccacctgcgctacacctcgatatttttatatcaacttttttcttgtatttctgttttcttccctgctttgtccgccctcttgcggttcccgtaatctcttcggctcaatagtgagcctcgacattccgaccgctgcgcctaaaaacgctcgctttttctgccaccggcagcgctcacgttttttgcccaaagcaggcgcgctaccacctgcgctacacctcgatactgctattatccgaatacagctttaatattatagcataataaattcctcttgtcaactgctttcaatttcgttttataacctaagaattcgtacgatgcgattatcctccgaacacgtagtaaaaaacgctctggggctattatggcttcaggacgtttttgtcgaaaagtgttgatttttccaaatttgatggtataataatcataaataattgggattttaagggaggtcatatcatatgaatttattgataaaaaatcttgtgacagcaacaacgatacccgaaaagccatcaattaccggcattgtctacactggattaactatcttgattggtcttgcgattatagttactctaatcgccgtgttgcaaagcattccgagcttcagagagcaaagtacagcgtttaaatttgttatttttgtgcttgtgattacagcaacaccaatagcaatttttgttgtcccaattgcaaaaatcgtaagcaaagtcaaggctcgtaaagttcctaaagcacaaaagaacaacacacagtcacattcaaaactgacagcagatgacattgtatattgcaaagaatgcggtgcaagctacataaaaggaaatgttcccgatgaatgtaccgaatgcggaaataaacttaaataacaaaagctcccgactttatgccgggagcatcgcttattcgtgtaaatttcggtcattaaaaaattaaaccgcataacaatgcggtttaaacgctatttggctgggatagcgggatttgaacccacgagtgacggagtcaaagtccgttaaaatcactgaaattgtgctatttcacgtttttataacgcctgtaaaattgtcaaaaatcatacaaatggcgtaattattgtccaacaaaaaatcccccgacagagcctttttgctccgccgggggattctgccattttacttctttatgaggtacttaatatcaatcgggctctgaatatcaaaaatatcgtttgtatccttaccgagtacagcacgattgccgacaacttcggtgactatccagatcttttcaaacaaccagtccttaagcggattcgtttcgccgtaccatgtagctccctgctttatctgcacacggtcacccttgcgaatttctgccgcaggcttgctttcagcagtcttaccgcctatatcactaacttttacccagcctgtcactgcgctacagcctttcggtgtggtgatgcggatcctgccgtttaaaacatcatcagcggtgtgtatgtaatatgtgcctgtcagatgatttgcgggctgtgatgtggttgacgagccatacagtgcggtatttgacagctgtacagcctcacctgccttgtatgtctttaccgtgggtgtagcgggttttaccggctcagatggcttgtctgtagcttttgtatgcgtcttataccagtagtcagtctttgcagggtagtcaataaaacatatatccccgtcaacgtccttgcctgcgatactgtcaatgccccactgccacattttctgcccgtagtcataccggcttgcataatccgggctttcggtccagtgtgcaagccatatatcacgctttccaacaatacgttccttctgatagtagctttcaagccacgaaggattagcataaactcccgacggaagccctgccttattcagcctgtcgcagaactcaagtgccatatcggttctttccttgcttgtgaggctgtcgatctgacgctgttcctccatgtcgcagaacacgggatatgacggcttttcgtcacctatcgtcttgatgcacgcatttatctgcctgtcaagctccgctgtgtctgtcgccgtaacataccagtaacagccgaagtctataccgagctttctgcactgctcgatattgcgtctgaagtaagtgtcctcatccgtgcgtatgccggcacggataattacaaacttcacgcctgccgacacagccgccgtaaaatcgaactgctcctgtgccctgctgatgtcaatgcccttgatttttaacatattacttttcctcgctttcgcttttctctgtgctgtcacccttgagcttcagctgctttaacacttcaagcatttttttcggtattggtatgccaagtcctgcagcattttccacaagcgatataccctcattggcgataaagaacatcatgaccgccgactgtagtacgggagtcgaattaagcacataagcgtctaaaacgtgtgcaacgccgacgagcattaaaatcagtattttcttgactatgcctttaaagccgacctcgcttgacacgtcttttctgacaatcgcacacgcaacgccagatatgtaatcaagcaccatgcacacgatcagagcggcaagcaagggcgtaaaatcgccccatatccaccctatcacgccgccgatagtagccactattccgccgaaaatgccgttgattttttccataacttttttcctttctaccgattactcggtatctgttatttcaaccggttcttcaccgatttcttcctgctctgccttcatctctgcctcatactcattcatctcctcatcaaacctagcaatatcctccgccgttatcctgtcacggctgtaatgattgccgagctgcatagccgcccaagccctgtcaaaactgccgcttttaacgccgttcacagcgacctcgactatccatctaccaaaatccaacattatacctcacctcccgatactgccatagcctcaagcgccgctactcttgcttcaaggcttgcgatacgctccgtatcctcttcgactgcaggcgaccagtctgtagccttagtgcctttttcgagcttgatgttgcaagcctcgatcatgccgtttttatcaagcgcaagcgccacgcattcgagctttgctatgtcgctgtcgtctatcgtccaagtcttttcgcagtagagccactcgtcctttttggttttgctgttgacggtcaccctagtccctttggttgtctcccgcgtgaatagcagcaacgttattaaatggaatagcgaacccgagaagtgctgtccgacaaaaagaactatcggtagcctgctatcgtggtctaagctgaatgatataacagaagcacattaaacaaaagactttttctacaatcataccccttgcaaatttactgcaaggggtatgctttcattctccgtcaaatttcaagttccattgtttgcggcaattgtccataatttcaaggacggctcttgtctgccacaacggatttatatcgctctgctttttgttttcgttaagacagcgttcaacttcacgcacctcatattcatagccgttgcaatcgtgagctatcgcaggctctgaaacaaggttgccaagctcatcgtacagctttatagagcaagtgcagaagaaccagttgccgaaaacaattctgcctttgtcgccgattatgcaggcggaattgtctttaagaaaatcaaaaccgatatgtgaatcggcaaattttccgttttcatatcttaacagcagggaagcgtcataatctacgttgctttttccgatatatgcgtttgttactgtctctttcggcttgtatcccagaaagtcgcaggcgaatgtcagcggatatacgccaagatcaagcagagaaccgccgccgagtgaatttgtataaaaacggtcatacgggctgtcgggattgtaagggcaaaaagatgacagatcggcacgaatgagctttatgtcaccgattcgtcctgaggctacccattcctttgcctgtctgaacgcaggaataaacttcatccacattgcctccataaagaatacgttgtgtttttgggcaagtgcaataagctcatcaagctgtttgcagttaagggttatcgtcttttcgcacagcacgtttttccctttttcaatacacatttttgcgttttcgtaatgctgagccataggtgtggcaatgtagacaacatcgacattttcatctgccgccagctgttcataactgctgtaatgctttatcgcaccgaatttttcagcgaagtcctttgctttattttcacttcttgacgctaccgcataaagcacggagttttcattgctgtttatggcttcggccagctttgcggcgatagatcccgttgcgatgattccccagtttgttttattcatataacgctcctttaatagaattactgccgtgcagtgaacactgcacggcagtatgttatttatttacgttgatacagctttatgctttatatcgtttacgcttccgaaggctcaagaaccgcataattgccgtcatcacgtttgtaaactacgtttatctctccggtctttgcgtttctgaacatgaagaatgtgtgttcaagcatattcatctgaagtatagcttcttcctccgacataggacggagattgaactttttatgtttaactacctcgaaatcagcctgttcttcaacaacatcgtcaaatccgcccttgaatgagctgtgaagctgtttttcaactcttgtcttattcttgcggatctgtctgatgatacggtctatgcaggcatcaaaagcatcgtttttatctgtcgctttttgctctgaacggaatataagtcctgctgtgcggactgtgacttcgcacgttatcatatttttctgctcggaaagtgttaccttgcagtctgcgtcacctgagaagaaacgatcgagcttagcttcaatcttctttgttgcgtaatccgagaacgcctgagtaacctgaatcttcttcgctgtaatgtttactgtcatataactttcattcctttcggggcgatatacgccttgaactttatttgcaagcgaaaacgtttgcaagggtctgaggggtgatacccttctgacttgagttaattgtatcatatttagctaaaatatacaagccctttttgaaagaaaacttaaattttatctattctgtgcaaaaaaatcgcataaaattcaacgatttatcaattgactgtcacatcgtaaaatggtataattaataagtaaaatggtcgaaaacaaacgtttttttaccgttaaaagacattcagccgatttatacatatacatcaggaggaagtatgaataaaaaactaattagaatctgtgcttcgggtacagcactggcagtgactgcaagcgtgttgtcgctgtccgtttatgccgcacctgctaaatacagtgcggtggagcaaggttatataacatctgtaaaaaatcagggaaactggggtatttgctgggctttttcgtcaacagccataagcgaggcttcactgataaaggagtttccggataagttcaattccggaaatacagacctttcggaaaatctactggcgtatatgctgagtcatccgtcgctttacggtaaactcaacccgtcgggcgattatgcgacatacacagcttcatcggctaccgactatttaacactcggtggtaatgtatgggctgcgggtcttggcctgatgaacggcataggaccttacaatgaaaacagtgattatccttacagcgaggacaatacgccgagtatcgttaataagaattttaccgaatctgagtattatgaggtaagaaattcttctgttgcaaaaatcactggagtgttccaggctcatatcaacaacaacagcgacaacgatgagtttaaacagcttattatggattacggtgccgcttcattgagttacaacgaaaactatacagataataagttcggagaggatggaagcagttactattataatcctaatgaaaatacttcaaatcatgctgtaacggttgttggatgggatgacagtatacctgcgtctgcatttaagacaacccctgccggtgacggtgcatggctcatcaagaacagctggggagaatattcaagagataacggatatttctggctgtcatactatgataagtcgataagcggtgtcggcattgcctatgactttacggtcgatggcgctgatgattactttgatacccgttacagctatgacggtggaaacagcttagcctcattcggctattccagacctgatatatacggtgcgaatgtgttcaccgcagatgaagattcgtatgttacgggagctgcagcctatacttccgcaggaaataatatcgagcttagtgtgtatacaggcttacagaatgcaagcgatcccacatcaggcacaaaatccgccgttgccacaatgagcaacgtcaagtacgaaggttattattcgctgaagtttgatgctcccgtaaaggtcaagaagggtgaaacttttgcgatagtagcaaaaataaccaaggattccggcacggtcagaatttacagcgaatacggctacagcatgaacggccttacatacagccttaaagctaacaagggtgagagcttctatacatataatccttcgtacggatggtatgattgcaccgacagcggaaaaaataatcttatgattaaggcttatgccgtttctgataccgaatgcacagaacacacatacggtgaatggataatcgacagggattcaacctgtaccgcaacaggcgaaaagcacagggtatgctcaaagtgcaatcatattgaaacggcaacaatcgaaaagaaacctcacaattatatcacttcagtggttgcaccgacatatacaactgacggatatacgatacataagtgttcggtttgcaacagctcctatattgataattatgtatcaaagctgactcttgacgctgtcggtaatgtacgcagggtatcaggaacaacatcatctgtcggaatatcgtgggataagaatgcggctgcaagcggatatgagcttgagatatataagggcggaaagtggacgcagatactgagaacgtcaggtaacggcacagtatcgtataatgcagacggtcttgccgcaggcagtgtttatacattccgcataagagcgtacagaaacgagggtagctcggtagtatacagtgattacacaagacttgcggcaggcacagcggttacaaatgtggcaacgtttgcaaagaaatccgccacaagttcttcgctcactttacagtggtccaagaacgcatctgcaagcggctatattgttgaacagtacaagggcggaaaatggacgcagatactgaagaccgctgacaacacaacggttactcatacagtaaacggtcttgcagcgggaacaacctatacgttccgcattaaagcatataagacagtaggttcaaccgttctttacagcgactacacaagacttgcggctgttaccgataagactacgcagccgggcaatgtagcttcatttgcaaggaaatccgctacaagctctacacttactttgcagtgggctaagaatgcgaatgcgaccggttatgctattgaaagatataccggcggcaagtgggttgaaattctgagaaccgctaacaacgcaacggttactcatacggtaaacggtcttgcggcaggcacgacatacaccttcagaatcagagcgttcaacggttctgcatacagtggctatacaagacttgcggcaacaacacttccttcaaacgttacatcgttcataaagaaaagcggtactgcttccacgctgaatttacagtgggctaagaacaattccgctacgggctatgttgttgagcagtataagggcggtaagtggacgcagatactgaatgcgacatccaacgcaacggttacctgtcgtgtatcgggacttaaagcaggcacaacatacacattcagaatagccgcatacaagacagcaggcggcgttaccgaatacagtggttacaccagacttgcggcggctaccgagtgataggtataattaaaacagcaacgggtatcggcacttaccgatacccgttttatatgtttcgatttttcacttttattaaatagcacaaatttacggcaggtatttaatcgggatacctgccgtttggttattgcttatgtgacatctgtcataatttcgtcaagctcggtcaccgtcgagcctttgaaaagtacagcgtcattattacgcagattcagctttaaaaattctgtaagagcctgtcttgtgttcagctttattacgaatttgctttttaaatcggcggttttcataagctctgcggcggtttcaccgtagcaaaccgtaatatctacgcttgccttattgacgatattgccgacctttctgtatatttcaagctcgtgctcgtcaccgtcacctacttcagacaataccgctattcttcttgaatcgggagaaagtggcatagtgcagagttctttaagtgccgtacctacgctttcaacagcctcgttttcaaaatcggatattacataaatacctctttcgttgcgtactgttgtaaggcctgttgaaggacggtatttttcgattgccggtataatctgctttggcggtatgcccataatctcgcccagtgcaaatgttgccagagcctgatatacgctgtgcttatcatcggaataaagctcgatatgataattatccgcaccgtgtattatatcaaatgatattttgttatgagaaagctctatgttatcggcaaaataatcagccattctgttatccacgccgatagtgataatatcctgcggtatggtgaatatgcctgcaagatttttatcgtcaatattgatgatgaccgcacccgattcgttcattccgccgcataccttgagtttttcttcaataagctcaggctttgtcagttccctcggatttttggatacgaccgtgcttgtaagaatagcaacgtcaaagttggctgtctgtgaaacacgttcaacgtttcctccgtttacgcacgaaacattgataacagccgcctcggttttaggtgtagaagcaaacattgcgtggagcattgaattgtagttgttcgtaacggagattgaatgcacggtttccatcttgttcgacagcatctgttctatcatcgaaaggggatttatcttttcgggactgtccataacagctactgtccacattccaagtgccgactttataaatactgcggtcctgctgagagcagtatcaagatttgccacaacaatattcggaatcttctctatcggctgagttgtgataataacggacgcacccttttcaaatgcggcaacagccgtttccttatcggcggcaaaatatgcacagccgggttttattttctgtttaccgaaggcaaatgacgtaatcggaacgtctgcggcattgcgaagctcggcgttaagaatttcacacagctttcctacggtggtaatggtttttcccgcttcggaattctgctgttccgtttttttaccactgagtgcttcataattattgaacgtgaagtcgagcagcgttattgcgtcatagaaaacgtatttcatctgctttgtgttttccgctcccagtattattgcaagcacttcttctccgaatttatttgcgggcggcagggcagagcaggcaaggcacgattttgaacgagccgtatatccgctttttatgccgatagccgtttcatatctgtatcttctgtttccgctgttaataaggagattcgtattctgcagatcccttgatccgtttttattcgttgccgggatcgtatatttatcggtggccgctattgttctgaacatcctgttggtcatgcagtagcggcagatgatggcaaggtcgtatgcgtttgaatactgttccgccgtaaatctgccgtcagcggtagttatagttgtatccgccgcaccgatagatttagccttttcctgcatcattactgcaaacttgtcaaggcttccgcatatgaattccgcaagcgcaaacaaagagtcgttagctgaaaccagcatcatcgaataaatgagatcgagtacagatattttttctcctgcctcaagattgattgacgccgaacccttccagtttgagatctgctttatgacgctgtccgatactgttacggtatcattaggattgcatttttccagagctattatagatgccattattttaataagaaaagcaggtgacagtttcattctggcattcttttcaagcagtatgcgaccccctttgatcgtatttttttttttttttttctcttattttaggtttttgtgacgggtctttatatcttgcatccccatcaagaataaaaattacacgcttgaaatattcatctgcgctatttattttaaatagttcctcacagccgagcaaggtagaaatttgtttggtattatctgaaaactgtagtaatccacccaagctatgtatcatatcatttattcttgcataatctttcacatcagaactgtttcttaaaataggattttcactattattttctttttcaacagtattataaatgtttcgaaaagcgtccataagtaaattaaataaatggtttccaatttcatcttcaaaataaactttcacttttggacgttgaaaacttaggctaccgaacatatccgattttaatagttcgtaggatttcatatccgtaacataaggtgcagacggatttttcaaataaacaaccttgaaatctaaactattccttttttctaattttaatacttccttaattattgttaaagaatgcgtgcttactactaattgaatattaagttcttctgataactgaacaaataaatctaacaatctaatctgagtatctggatgtaaagaaacatctatttcatcaatacataataaagcgccattatactcatcatccatagataacatatatatatctattagagcactaattatatttcccaaattgtcttgtccaatagattgagacaatgttggtgtattattaatatccatatgcaatgaagctcttgcgcaagcacctttttcaacctttgataaaacagcttcactttttatcgagttcggaataaccacattataccactctttgtatttttcatctgctttcctttgataaaatgcattctttttccttatttctgttatttttactgtgtcttttcgttcgccaagaggatacagtcttgacagactaagatatatcgtaggaatctttacccttgctgcaccaccaacatcatactcgtttttggcattaatttcagcttgttttaatgtacaattatctatataaatattagaggttcttgggataattctaattccgcgccctgtttttgtatcgtctttaaaagataatcgcttcgtaagagctggtgtcccatcatcttcgacatatgttaaatacagtttgtaactttcaaaatcctcgtcttcgtctacattaaaaaattcgtaaaattctggttgaaagttactacccaatactgattttttattcaacccagatccggatgctattaatgataataaattagattttccaacaccgttttgaccacttattacagttatttttcttcctaactcaaatgaaacttctttaaaattcctaaaatattcaacgctaaaatgctctggtcttaattttttattaactcccatattacttcctctattatctcagatttatacatacattattcttttctaaacactctttacttggaatcatattattattactaaaaataattatttcgcttgctttgcgttttacacctgcactataatttaaatcaaatctcattaaagtatggtttttatagatgtttgcaatttctttaacatcgtcataagttataacccaatcacaattaacacgactgtttataattctttctattctaatatggtcatcataagaaaagaaattgagatataattgtttgccttttccaaaatatggtggatcgaaatatacaaaagcattttgttgatacttcggtaagtagttttttataaaagaatcgatatctttattatatagatgaatgtgatcttttttatttgcaatttttcggatacgttttgccaaatcatctctattgaatctcgcattcattcgccaaggaccgctttgttctacgccgcctattacgccaccttttataattcctgacctatttgttctatttaaataaaatgttgcgaatccaagttcataactatatttgcgacatttctcaatgattgctctctgattttgccactcttgtatggttaaatctactgtttgaacatcatttataaatctgtctgtttctgtaagaatcgctctccaaaacgaatatatccccttgtctaaatcgttaataacaatatctttaaccacatttttttctaataactctaatgcaattcctgcaccgcccgcaaacggctcaatatatgtaccgccataatgcccagtttgtttgatcagtaattccattaatggctcgagttttccttttccgccaggatatcttaatggagaatagaacatatcacacacctcctaaatcgctattatatatacattcaattatcaaataggttgttaatgcttgcattataccactcgtgtggaggcaatgttgaattaaacgcctcttcaaatatcggatacaactccttataagtcttgctgtttgatataatctttttcagttctgatgtttgaagagggataattttcattccgtttacagactttgaatagtcttgtgaatcataaaacggcgttgtttttctgctacggaaatcagaaataacatttatgttgagatgcattttcaatatagctattctacaaatatattttgcctatggtatctcatattaaccatcatttcgtttgaagggttattaaaatatatcttatttgtgtcaatattgattctagaaacattttcacaacttagtttattagatatcagaatcttcatattatcatcaaaagtaattaacccaatatcaaaaagcttatcatataatggggataataatagtccgttttccgaacttaatcgttcgtaatttgaagctgaacgccaaggcttaatatgacttgctaataacaaacggttatcattaattccggtgattatacaatgctcatatttttgtattatcctatctctgaagattccttgaccaattctagattttattatcatttctttttctgtatttggaatatctaaatttgcaatcattttcagttgtcgatcgattataggattatcatattctgaagaatcaaaatttttgaatttccagtaaccctcacccaacccatacactgagcgaaataaatcttcgcttcctctgtaagatttcgtctggatacaatgtctttgtattgttgcccttacattatctttccaattagggttggaaaaaatataacttaatcgtccttccttctcaataacatcatatatttcatttaacgatcccataccgtttaatttgttaagtgctgatataattgatgaaagatatgttgtttttcccatttatagtatcacttccatcttttcgaaatcttcgtcagtgacttttcgtaaaaccctcatctgtgattcaccattataccactttttttcactatgccttatagcgttaatttgccagccgctggtaattatagtttgatgatcactgttccattttataacatataatgttttgctaaaattgtctttcatacatttatctattaatttttttaaatttttgttttatattgcaacttatatttattacctaagtaacgtctattgtttatcaatgaggttttatatgttgtttcagttgcactcattgtaattcctccgctgatttattctaacttattattcccactcaatcgtagccggcggcttgctcgtaatatcgtaacagattctgttgatattcttgacctcgtttacaattcttacgcttgccttttcaagcacgtcataagggattcttgcaaagtcggcggtcataaagtcgctggttgtaacgcctcttaatgcgagggtgtagtcataagttctgtcgtcgcccataacgcctaccgagcgcatatttgtgagtaccgcaaagtactggtttatactgcggtcaaggcctgcttttgcgatctcctcacggaagatgtagtctgcgtcctgaagggttgccagcttttcacgggtaatttcaccgatgattctgatagcaagaccggggccggggaacggctgacgccatacgaggacatccgataagccaagctcggttccgagctttcttacctcgtccttgaataaaaggcggagcggctcgattatctccttgaagtcaacatagtcgggcagaccgcctacgttgtggtgcgactttataactgcggcatcgcctgtaccgctttcgataacatcggggtaaatcgtaccctgtacaagaaaatcgaccttgcctatcttctttgcttcttcctcaaatacacggatgaattcttcgccgatggtttttctctttgtttcggggtcggatacaccttcgagcttgccgataaaacgatctgcggcatttactctgatgaagtttacatcccagtccttaaatgcctgctcgacctcgtcgccctcgttctttctcataaagccgtgatcaacgaacacgcaggtgagctggttgccgactgccttggaaagcagtgcgcaggctaccgagctgtcaacgccgcccgaaagagccagcagtaccttaccgtcgccgactttttcacggatctgctttatagcttcttccgcatagttcctcattgtccagtcgcccttgcagtgacatactttataaaggaagtttccgagcatatcaaagccctgctcggtgtggtttacttcggggtggaactgtgtagcgtaaaatcccttttcaacattctcgattgcggcgtaggggcatttgtcgctgtgacctacagccttgaagccgtcggggagaacctcgatataatcgttgtggctcatccatactaccgagtttttcttaagaccgtcaaatacggcgcattctgtatcaaattcgcactctgttctgccgaattctgcggcggcgttttcgttagccttgccgatagtaccgccaagaccgtaaaccataaactgcgcaccgtagcagatgccgaatatcggtactccaagctcgaatatttcttttgtcattctgggggagtcgtcaagatatacgcttctcggaccgcccgtgaagatgatgcccttaggattctttgcctttatctgctcgataggtgtcttgtatgagatgacctcgcagtatatgttatgttctctgactctgcgtgcgataagctgattgtactgaccgccgaagtcaatgacgagtacgagctcgtgctcgcttgttgaaaattccgccattttccagtttcctttccttcttgtctttgggaattcaagtgcgaaaaaccgcaccgatggtgatattacatatttcttaaagtataacatatccggacggcttttgcaacggctttttcaaaaaataaaatcagtaacgtttacgaattatcttgacatttccctttaaatatgataaaatcatctacagaataagtgcgataaatttacgcactatattctttggaaagcaataaaccgagaaaatgaaaggaagtatcaattatgagccatatagatgtaacatcggaaaacttcaagcaggaggttttacagtccgataagccggttttagtggatttctgggcatcgtggtgcggtccgtgcagaatgctcggccctgtacttgaggaacttggagaagaacatcccgaaatcaagatatgcaaggtcaatacggacgatgaacgtgagctggcaataagattcggtatagattctataccctgcgtaatatcttttaaagacggtaaacaaatagacaaatcggtaggttttgtcagcaaggacaagttgctcgctttactcgactaaaactgcaaagcaagacggggagcggttttacagttgcttaacgctaacttgaaaatgacgtaaattttcagaaaaaagtgtgatatttcaatataaatttatcaaaaggtcttgattttttttgaaattgtgttacaatataagcaagtcatataactctatgacaaaaaatcacaaggaggatcattccgatggcttataaaatttctgatgattgcatctcttgcggcgcttgcgctgctcagtgccccgttgaggcaatttctgaaggtgacggcaagtacgttatcgacgctgacacatgtgttagctgcggtgcttgcgcaggtgtatgtcctgttggcgctcccgctgaggaataattttaaattaaggacagccatgagttttcaacttatggctgttttctttactgtttgtgaaaacgttaacacgcagaagaattctgcaagttaaaaggagaatctgatatgaagatatattcggtaaacgataaggaatttgccgcatacggcaaggtacataccggttatgacgtaagcgacctgctttcagcacttgataagagcacaccgttacccgacgctgtaggatatgttccgagcgaggcggcgcttgaaaatacaaagctgttcggccttttgcagaacaacgcatacggtggtatgcctattcagctcggctggtgcaacggtcacaacacaaagctcaactgccttgagtatcaccgtgacagcgagttcaacataggcttatacgattttgtcctgctggttgcgaaagaggatgatattgttgacggcaagctcgatacatcaaaggttatggctttcaaggctaaggcaggagatgttgtcgaggtttatgctacaacactgcattacgctccctgcaatgcgactaaggacggatgcttcaaggtggtcatagcgcttcctaagggaacaaacggagcaaagcccaacattactcccgtttatgatgaagataagacgctctgggcatgcaacaagtggttactggctcacgcagaaagcgatgaggcgaagcagggtgcttatgtcggtcttacaggagagaacatcgacattaaggatattatataatctgtttttcataaaatccgtaccggcagctaaccggtacggattttatcttttagaaaaagtcttatatttgatgtacttctgttatgtcattcagcttagattgtgacagcaagctaccgatagttctttttgtcggacagcacttctcgggttcgttattcgagtgggtacacctgtcaatatgaaagagggagaacgttttgttttttcttcctgttttgcccataaaaatatgcacctccaaatgtgtctaacttttggggtgcatatcatatattatgactatttcagaagtcagcaaaaagtacgatatttcaaccgacacgctccgctactatgaacgtatcggcttactgccccctgttccgagaacaaagagcggtctgcgtgactatgacgataattcctgcaaatctgtagagtttatcaagtgtatgcgaaatgcaggacttcccattgaggcacttatagaatatatgacgcttttcaaagagggcgactctaccgcagaagcccgtatggcgatactcatcgaacagcgtgaggcacttataagcaggattgaagaaatgcagagtacgctttcccgccttgacaggaaaatcgaaatgtacaagggtatgtgttcgcccggttgttgcggtaaaaagtaggattataaaaacagcgcccgtgtaaagccgcacggacgctgtttttatatgcatttttaaatcttcgtatcatcaagcacttcctgtatctccttttccgatacggtgagatacccttgaataaatgaattcagtacgtttctgtacgcacccacaggattgtcgaaaaccctcttttccatctgttcggcgctttcctttgtcggagcgtagattttaagctccataagatccgttccgcccatctcgtttataaaccgtatgcaaagctgatagccgccttgctcgacctttactatctcggtcttgacggttttttcgagccgtgaatgtgaagtgattttctttgcgtagtatatcgtgtcctcccttatcgaaagggggatagtgtaagcaagctcgatagcgagatattcgctcttcgccgttggcagacaggtttcgtcattgccggctttttcgcagattataagacccttatcttccatatcgaaaagacagcagataagatcgaaatacattacaaaatcgtggtcgaccgtgcatcgcataagctcgtcttttgtgatactgccgaccttgtacagaatatatgccacaagcacctcaatgtccttgcggtcatagagcgtgtatttagggaccggtatactcatattgctcctcctttcagatatgaacgtcagataacataagataaaatcgcaaggtttgccgccgactcaatgcagggtacagccctcggaacgatgcagggatcgtgcctgcccttgatgctcagcgtttcttccgtcatagtggtataatcaactgttttctgcggacgggcgattgacggggtaggcttcatcgcaacacggaatactataggcataccgctagtgataccgcctaaaatgcctccgtggttattcgtccttgtcctgatttcgccattttcaatgcagaactcgtcattgttgttactgccatacaaattcgcaacatcaaagcctgcgccgaattcaatgcccttgacagcaggcacgccgaataccgcttgtgaaatcctgttttcgatgccgtcgaacataggcgagcctatgcctgcaggaagtccgaccgccgcatattcgataattccgcctaccgaatcgagctttgccgccgcacctgctataacatctctcatctgctgctcaacgttggtgttgataagcggaagatagcggcttctgacctgctttaattgctcggcattcacgttcacagggtcaaagcgttcatcgcctgcgtccattatcgacaggatatgcgctcctgtggttatccccttgctttcgagtatctgcgatgctatcgctcccgcaaaaaccagcggtgcggtaattcttcccgaaaaatgtccgccgccacgcagatcgttactgccgttataacgcacatatcccgtataatcggcgtgaccgggccgtgcaaggtggctcacgctcttataatcagccgaatgctgatctgtattctgtatcacagcgcaaaggggagtgcctgtcagcacaccgtccaccattcccgatactacattcgggaaatccttctcactgcgcattgtgcttgtgccgtctttcttcggcgcacgtcttgccataaagtcaagcacagcgtcaaagtcgattccgattccgcctggaagcccgtctatcacaacaccgatagcctttccgtgcgattcaccgaatattgaaaccgaaagctctccgaatttaaacgctgatgacatctgctatacctccgagcgccctgaaatcgtcaaaaaatcccggataggatttttttgtgcattctgcgccttttataattacctcgcctgttgatctcgtagccgcaacagcgcctgccattgctatcctgtgatcgttataattgcgtaccgtaccgcccttgaacgcttcaacagggaatatttcaatgctgttttccgtagaaattgctttaccgcctaaatcgtttataagctctgtggtggcggaaagacggtcgcattccttgatgcgtaatctctcgcagttgattatcctgcacggctttttccaaaagctcatcatcaccgcaatcgcaggaacaaggtctggaatatccgatgcgtctattaccgacagatcgccgccgtttctgaatttttcggcaatgtcaactattgccttatcgccctgcacgctgttcaggttgagatttgtaagctctatatccgagcctgcacagtttgccgcaagaaaaaacgcactttgcgacatatcggcctccaccgtgcaattatgcggctgatacttctgaccgccttttataaaataaccgttctctgtttcgcaaaccccgaccccgaactgcttcatacaatctattgtaatattgacataaggcttcgactcaagacgggtggtaagaattatctcgctgtcctttgaaagtacagagagtgcgaacagaagccctgttataaactgcgatgaaacacttccgtcaatataatactttccgccgcttaacttgcccttgactttgtacggcatcgaaagcgtttcgaacacagcgccgttttccgtcataggcttgatcagcggcgttataggtctttccgggagttttcctctgcctgtaaattccgcttcacagccgaaagccgagaatatcggtatcataaatcttagcgttgagccgctttcaaagcaatctacagcggctttttttgagggctgagttattcccgtaatgtcataactgccgtctttaccgtttatttttgcgccgagtgccgttaatgcgtttattgttgcgtgcagatccatgcactcaagaaggttatctatatgcgttataccgtcacaaaaagccgcacatattagcatcctgtgagaaatgctctttgacggcggcactatcagctttccgctgagccttgacggtgttatttttatatccattgtgttcacccttgatatacgtttatctaattaataatactataaaacagcccaaaagtcaagaaaatcacacccaggtaacacaaaaccctccccgaaatctcggagagggtagttgtcattaaattgtctcgcatccgatacgagtaaatcttaaagcccacatccgataaaatccgatgtatagggcagtgattatctctttgagaactggggagcacgacgtgcagcctttaagccgtacttctttctttccttcattctggggtcacgagttaagaagcctgccttcttgagtacgggacgaagttcgtcgctgtactgaagtaaagctcttgaaagtccgtggcggatagcgcctgcctgacctgtaacaccgccgcctgcaactgtgcagacaatgtcaaacttctctgttgttcctgtaagagcgagaggctgacgaacgatgagctttaatgtctcaagaccgaaataatcgtcgatgccacgaccgtttacagtaataacaccgctgccgggataaacacgtactctggcaactgagtgctttcttctacctgttccgtagtaataaggctttgattcgtacattgttatccctccttaatatttgaattcttcgggcttctgagcgccgttcttgtgctctgcacctgcataaagacgcattcttgttgcggcctttctgccaagtgtgttgttggggagcataccctcaattgcgagctgcatagccttttcgggcttctcgctcatgagcttgctgtactgtacttccttaagaccgccgatgtagccggtgtgccatctgtagtacttgttctcaagcttgttgcctgttaaaactgcctttgcgcagttaattatgattacatgatcgccacagtcgcagtgaggtgcgtatgtgggcttgtgcttaccacggagaatgtgagcagcctttgcagcaacacggccgaggggctttcctgctgcatcgagaatataccacttacgttcaactgtttcagcattaggcataaatgttgacattctgattcttcctttcaattactcttgaggtttgacctctgtttgattattttcacaacgtttaatattatagccatccgtcagccttttgtcaaacgatttttcatgcaaaatctaaatatatatctatttctctttaaatctctttaaatatcgctgtttctctctatttctctcttacggtttcattttatttctgcctgttgcaaataattacgtttttcttgatatattgcagttatgcttttgtttttgccgtaaggctcttttaccgtttcattatcggatgtcagccagaaaagccggataaagcgctgtaaaaacgcattttcggtaatatgtaatctcgtttatcccggttcatcttgcaattaatgctgttttgtgctattctgaatgtgataatgataaaaggagcgacgcttatgacgcaatatcacaatatcccgcccgtgtacgataaaaacagccgtatacttatattaggctcgtttccgtccgtgaagtcacgggaggcacagtttttctacggacaccctcagaaccgtttctggaaggtgatgtcggcggttcttagttgcgacctgcctgtaacggtacagcagaagaaactgatgctgttaagccataatatagccgtatgggatgttatcggttcgtgtgaaataacaggctcgtccgatgccaccataagctcggtagtccctaacgatatagcgggacttgtagccgaaacttccgttacaagaatttttgcaaacggtgcgacctcctataatatgtataagcgatattgccgtgacaatgtcggaatagaagccgtaaaactgccgtcaaccagcccagcaaacgccgctttctcgcttgaccggctcatatccgaatggaaatctcatatcctgtcgcagtaacttatggtaatattacgctcctttgcgttctttatcagatggtcaagtcttataagtatcgccttttcttcatagacgattgcctcgattttttcggggtctgtttccatatcgaaaagctgacgtgtcttttcaagcctgctttgaagatactccagccgtgaacgcatttcttcggcttcgctgaaagtatgctccttgctttccgttttaaataatctgcaaaaattcaagcacataaaatgcccgtcctttcaaagagtttttacattctatgaaagtgacgggcttaaaattaccgacagagcctttctattgcttttgcgaaaattaccgtgttgtcgagaagctcctcaacaggcacgaattcatccgcaccgtgtatcctgtaatccgtgtcgggatgttcaacgccgaaggcgacaccgccctcgattccgtgtacataagttcctccgccgatagctatacattcgccttttttgccggtatgctcctcgtatacatcaagaagcgtctttacaagaaagctgtcgggagaggcataatgagcgtttgtgcctgtaaactccgctattgaaatacccgtgccgtctacggcattttccagtttgcttttcagttgagataacgtcatactcatcggaaatcttatgtcggtattaaagtcaagtctgccgttttcagcgtttataaggcttaaaacgcaggtaagcgcacccgatttatcctcgcaggctatccctaaggaagagccgtctgtttctccgtatggataacgtttcagaatatcaccgagcagtttttttgtttcgttctttatatcaagcatcacaagcatttcgagcattgccgttattgcattttttgccttttgcggagtagatgcgtgagcagattcgcccttgcagataacttttataccgctctctgtctgttctgcggtaaagcaacagttgttcttgttatttgcgatatatgaacaaacagcctcctcgtgctttgaagcgagaactgcgtaacactcggcaggaacggcgtttatcacctgtccgccgctgatttccaaaatgtcgtcattgctcatttgtgccgtgtactgtgtccttgccatacctttttcgcagtttataagcggataggaagcgtcgggagtaaataccatcgaaggcatttcgtcatttctgagataatattcaatatcggcagagccgttttcctcgtttgtaccgaatatcagccgtacaccctttgaaagctttaccccaagctcttttatgctgtacagagcgtaaagtgcggataccgcaggtcctttatcgtcggtaacacctctgccgtagaggataccgtccttttcggtgaccttgaagggatcatacgtccagccctttccggcaggaacaacgtcaaggtggcacagcaccgcaagagaaggcttgctttcaccatcgggaagatagtcggccgttgcgtaataattgtcatggttatttaccgtaaagcccatttcttcggctttgtcaagtattattccgagtgcttttgcaggctcttttccgaagggaaaatttccttccgcttttccttctatgctcggcacttctacaagcattgacagcagagaaataatatcttccttgtttttctccgcaaaatttctgtatttactgttatccattccgacacttccttttgtttttaatcaatgatttcagcgcaagcgtcagacagggacagaagatagctatagtcggtccgacgggagcaggaaaaacaaccattgtcaaattgcttatgcgcttctatgagcttaacggcggaaggatactgattgacgggtatgacatagcggacttcgacagaagcgagcttagagagcttttcggaatggtgcttcaggatacatggctgttcaagggcagtattatggagaatatccgatacggaaagcttgatgcgacagatgatgaagtcattgccgccgcaaaagcggctcacgttgaccatttcataaggacgcttcccggcggttatgatatggagttaaatgaggaagcatccaacgtatcgcagggtcagaaacagcttctgacaatagcaagagcgattcttgcaaataacaagatactgattcttgacgaggctacaagctcggtcgatacccgtaccgagatacagatacaaaaggctatggataatcttatgaagggcagaacaagctttgtaatagcacatcgcctgtccacgataaaagatgccgaccttatactcgttcttaaggacggagatattatcgagcagggtaaccacgaggagcttattgcaaagaacggtttctatgccgagctttacaattcacagtttgtcagctgataacgctgaggcttggggctttatgaagaatttgcaaaggtgcaaagcagaaatgttttgtgccttttgctttttgcccggagaattaatcgcaaatcgtgctgtttcgctttatacagcaataaaagcaaaacagatattctgccgtaaaataaatttacctgccttattgtttccaaccttgacaatgaatttaaaagggaatatacttatatcaacgacagatttcggaggtgtctatttgttacaggacgttgtatccgtttcactccctgtgaatgagcggatgatgataaaaaagaatcattttgagccgtacaaccttacaggcagcgaaaagcgtatatgtatagttacaggtattcacggcgatgagttggaggggcagtacgtttgctatgagctgataagaaagctcagcgaaaacaggcatttgctcagcggtatagttgatatatatccgtctatgaatccgctcggaatggattcgataaagcgagagatgccgatattcgagcttgatatgaatatgatttttcccggctcggaaaccggtgcggtggctgagcatattgccgccgctattatgaacgatataaagggtgcggatatatgtatcgacatccacgcaagcaatatattcctgcgagaaattccgcaggtgcgtatttcggaagaaacagcgccgaagctgttgccctatgccaaaatgctgaacgttgactttatatgggtacattccagcgtcactgttatggaggctactctctcgcacagccttaacaaagagggaacaccgacacttgttgctgaaatgggtgttggaatgcgtataaccaagtcttatggcgatcagctccttgacggaatattcaacctgatggctgagatgggtatatggacaggcgaaacgaagaaggtttctcatcctattgtttccacagacggaaatgtatcattcatatattcggatacatccggtatttttatgcccgcaataaagcactgggcaggaatatccaagggagatcatataggcgatatactcgatccgctttcgggtgctgtcgaacaggaaatattcgcaccttgcagcggtattgtatttacgttgcgtgagtatcccgttgtatatgaaggctcgttgcttgcaagaatactcggagggtgctgaaatgaataaagaaaacatagttacattgaaatcgccttaccgtgatgattttcagataaacggatacagattcggtaagggtgaaaaaacctgttgtatagtcggtgcaatgcgtggcaacgaggttcagcagttatatgtatgctcacagatcataagagccctttcaaatattgaaaaaaagggcgatttggtttacggtaaacagataatggtcatcccttcgctgaatccgttttcgatgaatatccagcgccgtttctggtctgtagataataccgatctcaacagaatgttccccggtgacgcacacggaaagaccacacagagaatagccgcaggcatattcgattttataaaggaatatcagtacggcattcagtttacctcattctatatttccggtgactttatacctcatgtaagaatgatggataccgagcataagaacataggacttgcgaatttattcggtcttccgtatatacttctcagaaagcctaagccgtttgacacggcaacactgaacttcaactggcagaactgtgatacgagcgcattttccgtatatacaaacgaaacagagcatattgacgaagaatcggcaaatatagcggtaagcgctgtactgcgtttcctgtcgagaatgggcgtcataaagtatcagagccacggcggttatatggcaactacgcttgaagaagaagagcatctgatgtcggtacacgctaaaagcggcggaatatatcgcaggataaaacagcccggcgacgaggtggagcagggagatgtaatggcagagatactcgatccgtttgaaggcacggtcaaggaagaaatcaagtcgcccgcaaacggaattgtgttctttgcacataaatcaccgctcgtgcttgaaaactcggtcgtttataagataatcaaaagattgcatatctgatgctgtttgcaattatttcagaaaacagataaaaatgagccatacagagtaggtattctctgtatggctcttttacagcggccgtgtatgtggatgttggcagataacagggtgtggcattgagggtagttttgatgggaatttgcttttgatttatgccggataacctgtgtatttataagcactgctaaaaaacgacctatatatataacgcagaaagtacgaaaatgtgacgtctgatttgatgataattttgcattttggtgatattttgtacacctgcacaaaaaacaaatttataacgccctgcttttatgcacgataacaacatagaatattacaaaaatgtaaataaagaacaagtaaaaatgtggcacatatttctgcttgtttggcggaaaataaaaaccgggcaaaatacccggttttataatatgattatgattttgcgattgtaatcaaccttgacggttacagtcgggatttgccgcaccgcagtttgaacagaatttctgtcctgcggaatttttgtttccgcatacacagtaccactcgctgttttgagaaacgttgcttgtcggttgagttgccgctcctgtattgctctgtgcgtaagtctgataattctgctgaggattgccgtagttatagtagccgttctgaaaagaagtattgcagttattgtaacagggcatattatatgcttgattgcgtgccgccgtatttgccgctgcggctgccgtaagtgttttatcggccattgttttgaagccgataacggtagcgaatatgccgaatgcggctacaagaatgcacactattattgaaactataaataccgcattaacaacggaaagagcaaaattcattgcttcatttgccgttgcaaaatcctcaaaatcaagttctccgcttgcaatagcgtcatatagcatctgtctgaaagcgtcgcctccgaaaataccgttcataacaccgagagcaacaacgcctgtcaactcgaagaatgtgattaccgctgtaattattgttgttacagttatacctgtacggctgtttgtcatcggctcctgcttatatctggaacagagaacaagcacaattattgaaagtgctataagtaccaatttgcatatctcctttgatgaatttatcttatatgtccgcagtaaatacagaatttgttgtcagattcgttgtacttaccacagcttgtacactgccatgcggtattttcggttgtaaagctctgctgaacatttgcggcagattgtgtgtggtatatctgctgtgctcttgcggcgtttactctctgctgttcgctgtaagccgcagaggtgagctcattgttgctcatacacttgtatcccttgatacaggcgatgacactcagagtgataacgccgcagtagtatatcacggttattgcaaagacacttgaagcgaacactgacagaatggggtaatagttttcgctctccgaaccgtaatacatcggtaatacgccgaacagaaacgacatcagtttaattgatgccagaactgtcagaataatagtcagcaccttgattccggtaagttttgaaacgataggacaactcttataagaactgcataaaacgagtaaagcgatagcaatacctatatggagcatacaggtccctccttactgaccgttagcgttgccggaaggcgcattgtattttggtgcgccgcactgcgaacagaaatctccgcctatatccttgtttattgtaccgcaaatgttacatctccatgtgttgcactggggctgctgcatctgctggggcggaactgcgaagcctgctctgtactgctgctgtaatgcggccgctttatcgaaggctttctttttaagctccttgtcagagagtgttgcatatcctacaatacacattataattcccgcaatgaccgttgcgattataacgatatagtatgacacatatattgcatattcgcttgttcccggtacgaaggaagtgaaattgtagcttgtgaaataatcgtaagggttgcaaagaagcctgaaaaagtcaatcttgaacagcagaagaagtgaatcgaatacagtaagcaatacagttattgcagtaagcgattttctcttgccgagcgtgggattttttctgtatttggcagttataataagcactgttattataaaaacaacaactgccagataaaaaataaatccgtcaaataagctggagagcaatttgtctgtggtcgaattgaaattttctgtgtcactcagaaattggcttgcagatgtaagtaaattgatcattttgaatcctccttaataattaaagcaaatttatgtaaaaacttttactaatgtgattttatcacataattgcctctttgtcaatcaaagtaaaaaatattgacaatccgcccttgcggatatataatataagttagtgcaacggttatattttttcagaaaaccgttttggatacagcgtttctatgctgtggaaaggaacattattatggcagtattggtaacaggcggagcaggatatatcggctctcacacctgcgtggagcttcttaacgcaggcgaggatattattgtaatagacaacttctacaactcaaagccgaaggctatcgaggcaatcaaggaaatcacaggcagagatttcagattctatgagaatgactgctgtgacagagaagctctcgacagaattttcagagagaacttcatcacagaagtaatacattttgccggctacaaggcagtaggcgaaagctgtgtaaagcctataatgtattatgaaaacaacatcaactcaactcttgcacttatcgaaacaatgcagaaatacggctgtaagaagctcgtattcagctcaagtgcaacggtttacggcatacccgataaagtgccggtaacggaggatttcccgctgagtgctatcaatccctacggttctacaaagctgatgattgagaatatgtgcagagaactgtacgcatcagatgatcagtggagcatcatccttttacgttacttcaatcctatcggtgcacacgagagcggtaagcttggtgaagaccccaacggcataccgaataaccttatgccccttatcctccgcacagcctcaggaaaaatggcaacgctcagcgtattcggcaatgattatcccactcccgacggcacttgcgtaagagattacattcacgttgttgaccttgcactcggtcatgttgccgcaataaaggcggcaagagcgcatacaggctgtcccgcatacaacctcggtacaggtaagggatactctgtgcttgatattatcaacgctttcgaaaaggtaaacaaggtcaaggtaccctatgttataacaggcagacgtccgggcgacgcagccgcttgctactcaaatccctcgcttgccaagaaaaagctcggctggacagcaaagagaggtcttgagcagatgtgccgtgacagctggaactatatcaaggcaaattcctgataaaaacagaatatataaaagccgcttggcgcataggctgtgccgtgcggcttttttgtaaaacggagaacgatatgagatttacattctgccccgattgtgcaagcagactggtaagccgcaagacaggcgacgacggtcttgtgccgtattgcgaacagtgcaaacgtttgtggtttgatatgttctataattgcgtgatagtccttgcaagacgaggagataaatacgcccttatccgtcagcacagcggtgacggcagtataagcgaggacagattcgtctgcgtgtccggctacataatgacaaacgaaacagccgaacaggcggcagtgcgtgaggtcacagaagaactcggactaaagccggtcaaggtacgccttgttgcgacatacgcttatcagaaaaagcagatgctgatgacggggtttctggctgagcttcccgagggagatttctcactttcggatgagctgattgcggcacagtggtttgacgaatccgaagtcggcgtaaggcttgcagacagctctgtcgcaaagctgttattcaacgatataaaaggagcaaagctatgaaaaaagaggccgtctgaaggcttcagcaggttctttgcggcaagcataagtgttcttgcctcgttctgtgcttcctcagacagaggcagatgcactgccatctggtcaccgtcaaagtctgcgttgaacgctgtacaaaccagcggatgcagcttgattgcacgaccctcgaccagtaccggcataaatgcctgaattccgagtctgtgcagtgtaggcgcacggttgagcagtacggggtggtccttgataacttcttcaagagcatcccatacagcaggatccttagcctgctctaccatctttcttgcactctttatattgttagcgataccacgcttgtcaagttccttcattacaaagggcttgaacagctcgatagccatttctttgggaagaccgcactgatccatcttaagatcggggcctactacgataacagaacgtcctgaatagtcaacacgcttaccgagaaggttctgacggaaacgtccctgcttacccttaagcatatccgaaagagatttcagaggacggtttgaagggcctgtaaccgctctgccgtgtctgccgttatcgataagtgcgtcaacggcttcctggagcattctcttttcgtttctgatgataatgtcgggtgcgtgaagctccttcatctttgtaagacggttgtttctgttgataacacgtctgtacagatcgttaaggtcggaagtggcgaatctgccgccgtccagcataaccataggacgcagatccggaggaattacgggtatgcagtcgagtatcatccattcgggacggttaccgctgagtctgaatgcctcaacaacatcaagtctttttaataactttactctcttctgaccctgctgagtatcctcaagctctttcttaagctcctcggacagcttgtcaaggtcgatttcgcaaagaagctccttgatagcttcggcgcccatctcggctctgaaatcatcctcataacgctctctcatatcagcatactctttttctgtgagtatctgcttctttgtgagaactgtatcgccgggatcgacaactatatactttgtaaagtaaagaacttcttcaagtctcttgggtgatatatcaagtacctgaccgatacggctgggcgtacctttaaaataccagatatgcgatacgggagccgcaagctctatgtgacccatacgctcacgtcttaccttgttgcgtgttacttcaacgccgcaacgctcacatattttacctttgaaacggattctcttatatttaccgcaggaacactcccagtcctttgtaggaccaaatatcttttcgcagtacagaccgcctctttcgggcttctgtgttctgtagttgattgtttcgggacgctcaacaacgccgtagctccatgcacggatctgatccggagaagcaagaccgatcttcattgaatcaaatgttttatatgccaatttacagacctcaattctttctatagaagtttatgtgtgataacacacgcttttctgtcaatgcctatgcttaaatcatcgtctgattattcgtcaaacgagtcgtcagcgtcattttcgttgaagtcgatgtcaaaatcatcttcatcgtccttatcggcatagaattcgctgtcttcgtctatatccttagttgtgaaaccgtcatcaagagagccgtcctcggctacatactcaaatgtatcctcgcctgctgcctgaccgtattcatcgtcttcttcataagtctgtctgagatcaatctcattcttgtcagcatcaagtaccttgatgtcaagaccaagtgactgaagctccttgaacagaaccttgaagctctcgggaacgcctgccttaggaacgggatcgcccttgacgattgcctcgtaagttttaacacgtcctactatatcgtccgactttacagtaaggatttcctgaagtgtataagccgcaccgtaagcctcaagtgcccaaacttccatctcaccgaaacgctgtccgccgaactgtgccttaccgccgagaggctgctgtgttaccagtgagtaaggaccggttgaacgtgcgtgaatcttatcgtcaacaaggtggtggagctttaggtagtacatataacctactgttacagggctgtcgaacttctcgcctgtacgaccgtctgtaagctgtgtcttgcagtcagaacgcataggaatcttagagaagtctatccttgcggaatccttatccttgtagttttcacgttcagcctcagccttttcaaagcaagctctgatgtcggcctcgtgagcaccgtcaaatacaggggtcattatctgccagtcaagtgccttacaagcataaccgaggtgtacctcgagaacctgaccgatgttcattcgtgaaggaacgccgagggggttcagtacaatatcaagcggtgtaccgtcgggaaggaaaggcatatcctcctgctttaagatacgggaaacgacacccttgttaccgtgacgacccgccatcttatcgccgacagaaatcttacgcttctgtgcgatgtagcatcttaccaccatatttacgccgggtgaaagttcatcacagttctgtcttgtgaacaccttaacgtcaacgatgataccgctttcgccgtgaggtacacgaagtgaattatctcttacttctcttgccttatcaccgaagatagcacggagaagtctttcttctgcggtaagctctgtttcacccttaggtgtaaccttgccgaccataatatcgcccgagtgaacctcggcaccgatacggatgataccacgctcgtcaagatccttaagagcgtcctcagaaacgttggggatctctcttgttatctcctccggtccgagctttgtatcacggcattcgagctcatattcttctatatggattgatgtgtagacatcattataaacgagtttttcatttataagaacggcgtcctcgtagttgtagccttcccatgtcatgaagccgataagagcattcttaccgagtgaaatctcaccctggcttgtagcgggaccgtcagcaagaacatcgccggtctttatctccataccctttgaaacggcaggacgctggtttacgcaggtgccctggtttgaacgcttgaactttatcagcttgtagctgtgttcaacaccgttgttatcggtaacaacgatttcgtcggcactgcactttgttacaacgccgtcttcctttgctactacaaccgcacccgaatcaacggctgccttgtattccatacccgtacctacgataggattctgtgttaccataagcggaactgcctgacgctgcatgtttgcacccataagagcacggtttgcgtcatcgttctcaaggaacggaatcatcgcagtagcgacagaaacgaccatcttaggcgaaacgtccatgtagtctacacggtcacggtcaacttcaagaatttcttcacggaaacgtgcatttacacgctttcttgcgaattttccctgctcgtcaagaggttcgttagcctgtgctacaacgtagttatcctccatatcggcagtcatataggttacttcgtcaagtacaacgcctgtttccttgtcaaccttacggtaaggagcttcaataaagccgtacttgtttatctttgcgaatgaagcaaggtaagagataagaccgatgttaggaccttcgggggtttcgataggacacattcttccgtagtgggaatagtgaacatctcgaacttcgaagctcgcacggtcacgggaaagaccgccggggccgagcgctgaaagtcttctcttatgagtaagctctgcaagagggttgttctgatccatgaactgtgaaagcggcgaagaaccgaagaactccttgatagccgcaacaacgggacggatattgataagggcgttgggagttaccttgtcgccttcctgtgactgaagtcccattctttcacggataactctttccattcttgcaaaaccgattctgaactggttctgtaaaagctcacctacgctacggatacgtctgtttccgaggtggtctatatcgtcaacctcaccgacgccttcgcaaaggttgatgaagtagcttactgttgcaaatatatcgtcaagagtgatgtgcttggggataaggtcttctactctgtttgaaagctcggctgtgagcgcctcaacatcatcgccgcacttgtcgagtatctcacgcagtacgctgaagcataccttctcattgataccgagtgattctgcatctatagattcgggaatgtagccggctatatcgaccattccgtttccgagaacctttgctattttttcctcggagaagattacgcactccttaacgcctgcctgctctacagcctgtgccttttcagcgttgatgaactcgttctcgtcaacaagaatctcgcccgtggtaggatctataatcggctgagcggccttatgaccggcgattctcgaagcaactccgagcttcttgttgtacttgtaacgtccgaatcttgcaaggtcatatctctttgcgtcaaagaacagattgttgatatgagtatttgcggaatcaaccgtaggaggctcaccgggtcttaactttctgtacacttcaagcaaagcctcttcggtgttctttgtagcgtccttttcctgaatcgtctgtactattctggggtcttcaccgaacagatcgatgaggtcgtcatcgctgctgataccgagcgcacggatgaatgttgttgccggtatctttctgtttttatctatacggacatagaagatgtcgtttgagtccatctcatattcgagccatgcacctctgttagggataacagttgacttgaataacttcttacccgttttatcgtagtcaaagccgtaataaacgccgggagagcgaaccaactgagaaacaataacacgctcggcaccgttaatcacgaatgtgccgctttcggtcatcagcgggaaatcgcccatgaatatctcattctcaacaacttctccggtttcgttgttcctaagctgtgcctttacacgaaggggtgccgcatacgttgtatcacgttctttgcactcctctatagaatacttggggtcctcatcaagacgataatcaacgaaactcagcaccagcttgccgttagcatcggtaatagaagaaatatccttgaatacttcttttataccctcgtccaaaaaccacttatatgaatccttctgaatttcgatgaggttcggcatcttctgaacttcattgattttggaaaaactcatacgggtatttctacccagctttacctgcttgacattcaccatgggctttaccactccttaatttattcacggatatttatacgctcgtgttttccgcataataaagggaaaatctacgcttttcgacactgcgggatttcatcctgaacgcatatcaatccattatgatacattttagtattgtaccacatataaagggcaaagtcaatagaaaaatcgcttaacttttgtcttatttctcattttcgtatcgttgttttaaccgaaaatatgtcaaaatgccgattttgccatattaaatttacatatgcacattcctgttttatatgacgataccgcaaacccgtcctgtaagcaaaccggatttgcggtatttaaaataatgttcggaaatacccgatttcaaaccaatcgaaatatatttatgaaacgttggtcggtatctcctgatgctatcttcccttcattgctcaatacaaatcgggtagcgtgtccttagtcacggcatattcgctgttatacacctttttaagctgtttgaaggtattgaacttttcgctgaggcagaacggttttgaccaggtcatatatgacgaccagccgactttttcggatactaccgcttcgggacttggcaatgtgcctgtttcaccgattatcgttattttcttttcagacgttatctcacacaggttatagtacatttcgctctgcgaggtatgctcgtgttcaggcggatacatatccctcgaaattatatccactacatcatcgcccggataacattcgggaatctgtgaattccacacccatataagattgtcgagatgaaatatgtttgtgtatctgtcgtgcataaggcggaacagctttttaacggtatccgctccttttttgccccaccagaaccaatcgccgtcgccctcgtgaaagggtcgccacagaatcggcactcctttttcgcagaagggtcggagtattcctgccattgtatccatatccgaaagcagagctttattttcaggcgtaccgtcaatcacagccttacttgcgtcaaagtcggtattttcgctgaaaaacgattttgatcttccgtaaagcggagaaaaccagtgccagcacatagtgataagcccctttttctctgcccactcccacactcttttaagagtgccgtaattctccgtgacctctgtcatacattcatcgtctgtatcggaataattgatattcggcgaatatgaaagcagttcaaagccgagaagtgcaggctgttttcctgtgaccttttctataagatgaagctcttcctgcgccatagtctgcgtatgctgtccggttatgattttttcataggttatgtcggacagatatttaagcacattgcgtacaccctgctgtgcgttggggtttgaaggggtatataatttatcgctcataagcgttctccttttaggtaaatctttatataatgataccataaataaggacggttggcaataggaagttatggtaagaatgcaaaggcggcaaataatttctattataataacgcaataacagacttttcacggggaaaggggtttcggcaaggatgccgagatagaacgctttgtgggctttgcaggacgcaaagcccacaaagcgttcttaaagggatagagaattcgcactatcttataaaaacagactttttctacaagctggaccgctcttaatgagcggtttatttttatcccctataataatttatcgcataaccgccgtatgacagccgaaaataagacataaagcaaaaaacagttgcaaatgcggcggtaatagtgtataataaaatatgaatatactgccttaatagcggtaattttcaaatgtgaaaggaaaatctatgttacttaatataatgaacagtcttggcgatcagcggagcattatcatcactgtattcgcttatgcggtgatcctgcttattgccataccgatacacgaatgcgcacactgctttgcggcatatcttatgggcgatgatacaggacttcattcgggcagaatcactctgaacccgataaggcactgggatctctggggtacgataggtatgcttactgtcggaataggctggggcaagcccgcacccgtaaaccccgtcagagcaagaaaggtttccgcaagaacgttcatggcgctgactgcggcggcaggacctttatctaatgttatactctcatacattttcgtacttatcggaaagcttgtatggttcttcttcggtgcttcaaatcccgatgttgtagcatatgtttattacgcttttgatatggcggcaagtataaacgtttcgcttgcagtgttcaacctgctccccataccgccctttgacggctcaagaataatgctcgtattcttaaaggaaagaacatatttcaagctgatgcagtacgagcagtatataatgatcgccgtactcgctatctgctggacaggtgtacttaatgcaccgctgaacttccttgacaatgcggttatgagctttcttgatttcacgacctcttacgttcctcttgtacctctcggagtataagaaatgcaggaactgaaattcaagctggaggtctatgaagggccgctcgatcttatgctgagccttatcgcaaagcataagctgaacatttacgatatagaaatctctcttctgcttgagcaattcttactgtatctcgaccgtatgaagcaggccgatatagaaatagcgggcgaatttctcgaaatggcggcaaggcttatctacataaagtcagccgcacttctgccaaagcacgaagcagaagaaatgaagaaagagcttcagggtgtactgatagaatacgctatgtgcaagcagatagcattgcagctacagcaaagctgggtaggcgatgatgtgttcgtgcgtccgcccgtacaggtggaagaaaacaaggcttatctcggcatacacgagccggacgagctttttctggcaatgtcgaacttaaactacaaggatgcggtacgaaaagccgtgcctcatgttaagcctgccattgcaaagagttttgtcagcgtattcacaaagatagtatatgtgttgaagcgtataaatgacggtcataaggttgaagtaaattcgttatataagggtcagtccagatcggactgcgtggctgtgtttctggcacttttagagctgtcgaagaacagccgtataaagtttaccgatgacaacaaatatcttcactttgtgcctaaggataaaatagaagaagaattctctttcggagaaccggatgaaagcgaggcggcggataattgaattacaatgaatcaatctgtataatagaagctctgctgttcgcatcgggtgaaccgatttcgcttgaccgactgagcgaagcaagcggcatcgagccggaaacggtggtaaagctgattgacaggcttgaaaggaaatacaacgtatctgacagtgcgataagggtgctaaggcttgaaaactcatatcagctttcgacaagagaagaatatgcaccttatataaagagtgcaatggaaaacaagcgtcaggcaaggctttcccctgcggcacttgaggtactggctgtagtagcttataatcagccagtcactaaagcgtttgtcgagcaggtcagaggcacagacagctccggtgttataaacacgctggtagaacgtgaactgctgtatgaggcaggcagacttgaactgcccggcagacctattacatacaagacaacggacaacttccttcgctgtttcaagcttgaaagtctggcacagctgccaagccttcccgacgaagacggacagttaaacctgaatgagatcggcacattacagcaagacggcgattttattccggatgacagctttgaggaataatccgattactcctgcggatactcttatcggagtaccgtccgcacaccaaaccgaaacggagggcttatgggctggcttattttcatagatatattgctcatcatcgtacttgctctcatgctgtcggtaacagtaaacgtacatctgaacgatgaaacgagaataaaaatcagatacgcaggcataacaatattctctgtttctcccgaagacgaaaaacataaaaagcaaaagaaaagcaaggaaaaacaaaagaaatcgccggacgataaaagcgataacatttctgcggataacgaaaaaccggtgcagaataccgaaaacactgccgataaagcaaacggcagcagcgatatatccaaagaaagcaagaaaacgcataaagtcggaaaaaaagcagataacaacggcaacaacggtcttttatcaaagctcggtctgagcggcgacatcagcgaaacgatcgaatttgtaaaacagcttgtggaatctgcttcaaaaccgataaagaggcttataagccatatccgtgtaagtaacttttatctgtttataacggcaagcggagaagatgcggcgcaggcggcgatgaactacggaaaaataaactggcttgtacacacagctttagcggtgctttacaataccgttaagctgaatgtgaaaaagatagatattaccgcagactttacatcgggcaaaacggagtacgagctttcatgcaaagtgaaactgaggctcggaacggccataggctgtgtcttgtggtttttattcagaacagcaaaattatatttgaagataaattcaaagaatgcaaataaaactgcaacggctgaacgcaatacaaagccaaaagcagagaaagcgtgagctttcggaaaggaaatcaaaatggcagaacagcatccaatcaacggacttatgggaacttctatggagaagataagagagcttgttgacgttaacactataataggcgaccctatcacctctcccgacggaacaataatcattcccgtttcgaaagtcagcttcggctttgtcgcaggcggctcagacctgcccacaaaagctcccaaggaagtatttgcgggcggaagcggcgcaggcatcacgataaatccgcaggcttttatcgtagtacagcgtgacggcgacgttaaaatgcttgagcttggtgcaaccggcaacagtgctattgacggtataatcagcggcgtacccgaccttatttccaagatcaaggctatcttctctaaggatgacgaagaatctgaagaaaaaacagaagaataagcaataacatctgtccttttcgcataagatataccaaaactatgcggaaaggacaacgttatgcaaagaaaaattctatctgtcgcagctgccgtgatttttgccgttactgcgactgtgacagtttatgccgagagcgcaaaaaagctgtgttatcttgaaaataccgataaaagcggaatcggagtatcggctgtcagtgctattcttattgaggcggatacgggaactgtgcttttttctaaaaacgaaaaagaacacagacagatagcaagcacgaccaagataatgactgctctgttgacccttgaggcaggagaacccgacaaggaattcgaggtagacccgaccgccataaaggtcgaaggaacctcaatgggacttcgggaaggcgatattgtaacacgcagagctttatgctacggtatgcttttgccttcgggaaatgatgcggcaaatgcggcggcggtaaatatatcgggcagcaaatcggcgtttgccgtgctgatgaataaaagagccgaagaaatcggtatgaccgacacgaactttgtcaccccgtcgggacttgacgcagacggtcagtattcctgtgcctatgatctcgccttgcttacacgggaggcgatgaacaataaagactttgcaaaaatatgcggattgccaaaagcaaaggtttctttcggcaatcccaaaagcgaccgcatactcgttaactcgaacaaactgctcacaagctatgacggctgtatcggagttaagacaggatttaccgacagtgcaagaagaactcttgtaagctgtgccgagcgtgacggcgtaaggcttatagcggtaacgcttaatgcgccgaacgactggagcgaccacgcaaaaatgctggactacggcttcgaaaaagtgacgctttgcgaaatgaagtacgactcatcagctctttccttatccgttgtcggctcagaaaaggaaacggtcagtgttgaatgcggtaccgtaaaactgccgctgtgcaacgaacagaaagacaaaataacagcagaaatatatatgccgaaatttatttacgcaggacttgccgcaggcgaaaaggtcggcgaaatacattacctgctaaacggaaatacaatagcaacagcgccgctccaaacggctgaaagctgtgtacaaaaagaacgtaaaacggatttttttaccgtgatatataaattcattgcaggactgctgacacgctgatactgtatggatacggaatttgaaaggaatacggaacaatggaaaaagtgagattacagaaaataatagcagacagcggctactgctcacgcagaaaagccgaggaatatatcgaacaaggctgtgtaaaggtaaacggcagaccggtttctctcggtgacaaggccgatcccaagaacgatattgtaacggtaaacggcgaaaagatagcttccttaggcactcagctgagatacataaagctgtataaaccgagaggctatgtgaccactatggcggatacgcacggcagaaagatagttaccgaccttctcgacgatattgacgagcgtgtttatcccgtaggcagacttgacaaggattctgagggacttctgatactcacaaacgacggtgcgcttgcaaatgccgtaatgcacccgtcacgtcatataaagaagcgctaccgtgtaaccgtaaggggcgaggtaacagatgacaagctgacaacgcttgcttcaggtgttaagattgacacgggcgttacacttccctgcaccgttgcggtacttgccgaagaagaaaacaggactgttcttgaattcacgattgccgagggcaagaacagacagataagaaaaatgtgcgaggctgtaaaattacagatagtgcgtcttaaaagaaacgctgtcggaaatataaaactcggtatgctgaagccgggcgaatgggcagaccttaccgcagaagagttaaagggactgaaagcactggtttcaagcgacaaatcgaccaaaagaacgggtaaaaaatgattacgatacttaaaaacaacattattaccgacaagctggtgttcgaggcgaaggacggcgatacgcctgtaggctcggtcgtctgcacaacagacggcgaaacattgtttgtggaaaagcttgaaacgcagtacataatgcttgttgacgggcttatgagaaccgctatgaactacgcttttaatcactttataaataagtgtaccgtaaatatgcaatccgaaacggtatggaatgaacttttaaaacgtggttttgtgcaaaacaacgataatcacatctctgacattgataattttttcacatctcataaaagttgcaaaaaatagcgaatttcgcttgttattaaagatgaaatgagttataattatacttgaatatgatgtgcccaaaggcataattatacacagcggtcggctcttattttcagcagcttaccgcttcacagaaaagcgagaacggaggaattctggcaatgaagaaaacaattgctgaaatggagcagacagccgcaagcgaagctgcaaacaagctcatctctctgtttgacgaggacagctttgtcgagcttggcaaatttgtcggagcaaacggtgaaaagacaggcgttgtaagcggttacggatatgttgacggagcagtcgtatatgcgtacgctcaggacacaagcgttaacgcaggtgcggtaaacactgcggcagctctcaaaatcaagaaggtttacgagctggcgcttaaaaacggtgctcctgttatcggtatctttgactcaaagggcggagatatcaaggaaggtatgaagacactcggtgcatacggtgagatagccaagatgagtgcggcactttcgggtgctgttccccagatagctgtagtagacggtctttgcgcaggcacagccgctatgatagcttgtatggctgatgtggtcattatgacagaaaaatcagagctgttcatgacagcaccttttacagccgatgataagacggcaggtgcaggtacagccgagaatgccgcaaagtcaggtgtagcggctattcttgcaaaggacatggttttgtgcaaaacaacgataatcacatctctgacattgataattttttcacatctcataaaagttgcaaaaaagggaacttaaaaccgacactggactgcctatgcttttgtgcagtcttcttgtcggcagaggaatatacacagctgagcaggcacagcagtatttcaacggtacggagctttccgaccccttgcttattgcggatatggataaagctgtgcaggcgatagaagcggcggtcgataacgaaataaagataaccgtgtacggcgattacgattgcgacggtgttacatctaccgttatgcttttcacacatcttgatgcaataggtgctgacgtaaactggtacatacccacccgtgaggaaggctacgggctgaacgaaaacgcaatacgcaaactgcacgaggacggtacgggtcttataataacggttgacaacggcgtttcagccgtcaacgaggcagagcttatatatgagcttggaatgaagctggtcgtcaccgaccaccatcagctccctgagattctgcctaaagcggaggctatcgtaaatccgcacagacaagatgacaactctccctataaagaacttgcaggttgcggcgttgcgctaaagctcattatggcactggaacgtgatgttgaaggtgttcttgagcagtatgccgaccttgcggctatcggcactataggcgatgttgttgcactgacaggagaaaaccgcataatagtaaagcgtggacttcttgaaatgcagtacagcgaaaatcagggacttcaggcgcttatcaatgcggcaggacttgacgctgaaagtattacttctacaggcatagcgttcggcttatgcccccgtataaatgccgcaggacgttatgacagtccgaaagcggcggcagagcttcttatggctcagaccggacagatagccgagataaaagcgcaggagctgaatgagctgaacgctaagagaaaacagattgaaagcgatattctcgaaatggcaaaggctcagcttattgccgaccctaaagcgttcaactcccgtgtgcttattgtttgcggcgagggctggaatcacggaattataggtatagtcagtgcaagacttcttgagctttacgaaaagccctgtatcgtcataggaatagagggcgacgaggcaagaggctcagcgagaagcatcgaaggcttttcactttataccgcactcgatgcgtgcagtgagcatcttacacgtttcggaggtcatacgaaggcggcgggcttttcacttccgaaagacaaggtagatgattttatagctcagctgagaagctatgcggacgaaaaattcccttcaatgccggttatgacaacggaggctgatattgagccggagctgtccgaccttgaaatatcttcaatcgagaatcttcgtcatttacagccttacggcgaagaaaacaacgctccgctgtttttgatgagaaactgcacaatcatatcatcaagaccgctcaaagacggtaaatatacatcgtttaccgcagagtacaaaggctcgcagttcaaattcctctgcttcggaacatcgtttgataagttcggatattatcccggagataaggtcgatgtgctgagccatatcgaaataaacgaatataatgataaaaaaagcgtcagcgtaagagtaaaggacatacgcagaagtgattttccgcaggataagtattttgccgcaaggaatttctatgaaaaaatcctcagaggcgaaaaaacagattcaagacttcttaaacgtatcctgcccgataaggagaacatgaagctcccgttcgaccttgcaagaaagctgacctctatagattcagccgctcagattgcaatgtcgcacggtatgaattactgtctttttatgatgtgccttcatgtttttgcggaattcggtcatcttgagctggacagaataaacggtacgatgaatttcataaaaggcggcagacgtatagagcttgaaaactcggcagtgataagaagaataatgaaatcctgcagctgaaaaattaacgataaacggaggctgtaagcatgacatatacaatagatatgcttattgacaagataaaggaagtaggaaagagctacgaccttgataaaatacaggcggcttatgagctggcggaaaaggcgcacgacggtgttttccgctcgtccggagagccttatattacgcaccctgtagcagtagcatatatacttgtagaacagttctgcatggatacagatacaatatgcgccgctctcctgcatgacgtggttgaagacacagatgtgggtcttgatgtgatacagaagaagttcggtgaggatgtcgctcatcttgttgacggcgttaccaagataggtcaggtaccccttaacacccgtgaggaacagcaggcagagaatatccgtaagatacttatcgcaatgtcaaaggatattcgtgttattatcataaagctcgccgacagacttcataatatgagaacgcttgcgagcagaccgcccgaaaagcagctcaagacttctcttgaaacgatgaacttctacgcacctatagctcacaggctcggtatcagtgacgtaaaggaagaaatggaagaccttgctctgcgctatcttgatccttacggcttcaaggagatagagtcgcttcttgatgtccataaggatgaacgtgatacgtttatcgacaagataaaaggtatgataagagagcgtatatcggacattcagccaccgccgataatcgagggcagagtaaaaagcatatacagtatttacaagaaggtttatgtcaagggaaaggatttttcggagatatatgatatatatgccgtgaggattattcttcagacagttgtcgagtgctataacgtactcggtatcattcacgatatgttccgtcctatcccttatcgtttcaaggactatatagcaatgcccaagcccaaccgctaccagtcgcttcatacgaccgttatcggcagggaaggcataccatttgaagtacagataagaacgcaggaaatgcacaacaccgctcagtacggcgttgcggcacactggaaatataaagcaggaatatcgggaaatgttgcaggtgaaaagcgtttcgactggataagacagcttcttgaacagcagcaggaagctgacgatgtagagcagatctcagaggctatcaaggtcgatctcgcccctgacgacgtatatgttttcaccccgaagggcgatgttataacactgcctgcaggctctaacgttatagattttgcctacgctattcatacgcaggtcggcaataaaatgacaggcgcaaaggtcggcggcaggatggtgccgtttgaccacacacttcacacgggcgacatcgttgagatactgaccagcggaagcgataattacggacctaaccgaaactggagcgaaatcgcaaaaaccaacgaagcaaaagcaaaaataagagcgtggttcaagcgtgaacgcagagaagaaaatatcgagtgcggtaaagcggcatttgaaaaagagatacgcagaaacaatattgcggtcgatgatgaaatactcttgcaggcggcacaccgtcagcgtttatcctcgattgacgatttatatgcggctataggctacggcggcgtacagctatctaaaatcattacccgcctgaaagaagagcaggtaaaacagcagagattaaacgctgttcagacacagcctatcgacatagaaaagactatcgctgacaacaacaagagagcacagaagaacggcgttgtgcttgacggaatagaagactgtgcggtaaaatacgctcagtgctgtaatccgcttccgggcgacgatattatgggctttatcacccgtggctacggcgtatctatccataaagccgattgtcagaatgtaaagatcggtttgcagggagaaaacaaagacagatggataaaggcacattgggcagtgaactcaagcagtgcgttcagagcgacgatagatattatcgcagatgacagaactgcgcttatcgccgatattaccactgcaatagcaagcaatcatctgcctatacacgagataaacgcccactatctcaagaacggtaatgcaaatataattctcacaatcgaggtcagcggtatagatcagctcaagagcatcatactcagacttcagaagatacccggagtaatctctgccgaaaggacaggaaaacagtaatggaaattaaaacgctcacattaggcgagcttgcaaccaattgttatatagtaatcagcgccgcaggaaacgccgcagtgatagaccctgcggacgatgcacagcgtatccttgatacactcggaaaggataacgcagaacttaaaatgatacttctcacgcacggacattttgaccatacgggagctgttgcagaccttaaggaacagacaggcgcaaaggtatatatacattcaaaggacgaatgtatgcttgatgatacgataaagaacgtggcatatctctgccccggctattcctacaaaccctttactgccgatgtgcttgtttccgatggggacatcatacgccttgatgagattgaattcagcgttatgcatacccccggacataccgcaggaagcgtggtttactttgcggataactgtatgtttgcaggcgacaccatttttgaaggctctgccggaagaaccgatttctattcgggcgactatatcgcacagcgaaacagccttgcacgaatcgccgcactgcgtgaggattatctcatttatccgggtcacggcagttcgactactcttaaacaggaaaagaagttcaatcagtttctcggacaaagcccggtagatttcttctgatatgataaaatcgctgtattttgataacacggcatatcaatatgcctacgagcttgagcggctgataagaaatttctcattgccgcacaggcttgagttttataccgacaaaactcccgacggcacagattactcatacttctgcgccgataacggcaaattatccgttaccgtatctgataatgataccttgtataaggaatcttcagacgtctgcgagccgtccgattatgaaaatgagctttgcaggcttctttgcagatgtatggaaaggcacggtcacgctccgcttccgtggggaatacttacgggagtacgccccgtgaaatatatccgaagcatttacgaaacccgtgacaatgcggaagaatatcttcgtaactccttgcttgtaagcgataagaagatacagcttgcaaacgatgtaatacgcattcagaaaccggttctggactcacttgacctcaggaagataagcctgtatatttcgattcctttctgcccgtcacgctgcagctattgctcgtttatctccgcttccggcgagggtgcattaaagctgatagacgattatttcgggcttttactgaaagagcttgatatttatgccgatattgtgaaacgtttttcgcttaaagtcgatactgtgtatatcggcggaggtacgcctacaacattgtcggcttctcagcttgaccgccttattgataaactcggtgaatttgatattgcaaatatccgtgaatttaccgccgaggcgggaagacccgataccataacggaagataagctgaggacgcttaaaaacggcggtgtacggcgcatatcaataaatccgcagtcgatgaacgacagcgtacttgaagcggtcggcagacgtcatacggtaaagcaggtgtgtgaagcgtttgatattgcacgaaaggtcggtttcgactgcattaattccgatataatagcaggacttcctgccgaaacagagcatagctttgaagcttctttgcaacagctttgcaaattatctcccgaaaatatcaccgttcatacattgagccttaaacgctcatcagccttgttcagacaattcggaaacaatatcggcaaaggtgcaaaatatatgaccgatacggcatatgatatgctttgcgaaaaaggctatttcccgtattatctttaccgtcagaagaatatagccgacaaccttgaaaacatcggctattgcaaagacggctgtgaaagcatctataatatctgcattatggaagacgtacagacgatactcgccgcaggctgcggagcgtcaacaaagctatatgacggcaagaacgtttcaagagtcatcaattacaaatatccttatgaatatatttcacgttttgctctgatgaatgagcgtaagcgtgatatcgagaatttctttgaggaaaaattaactcttgcataatttttcttattgtgctacaatataaaaaagcatttctgaaaggaaacacggctatggattttaaagacgaaattgattttatatcagaaaaagcaaaacagcttaccgatacgggcatacgtaaggcagacgaggttatcggtatttcaaaactcaagctgagatgtattcagcttgacgcactgataaaggcaaaatacaccgagcttggcagaactatgtacggtatggttaaaaacgacagctcagatgccgacagaatagcacaggctgtaatggatattgaccacctttataagaaaatggcacagtgcaatgccagaatcgagctgatgaaaaaaatcgttacctgcccggtgtgcggtacaaagaacagattcagcaacacatattgcactgcttgtatgcacaagctggtgtcaacagatgaagaacctgaggattattcgtttaatcctgatgatgagatcggaagagcgtcgtgtagggaaagagtgtgtcagtacgtgtagatctcggtggtcgccgtatcattaagagcacggtttcacgggcgcttaacggcagtaatgagataagcgaacagaccaaagaacgcataaacgaggttatccgtaagtataactatacgcctaacggcaatgcacgccgtatgcgcaggagcgcagaaaagaccatactgctcatcgttaacggcagcagtaacctgttcttttcaccgctcatcgagcagatacagatagcggcttcttccgcaggattccagattgcagtgaatcacattgacgagcaggaggacgaggtgcagtttgcgtcaaggctctgcacggagttaagacctgccggggtgatatttctcggcggcgatatgcgaaacttcaaaaggagctttgcacggataaaactgccctgtatactgagtacggcaaacgctgaggagcttggctttgaaaacctttcctccgtcagtgttgacgactatgacggcggcagggcggcggcagaacagctgttcgaccgtggtcacaaaaaagtcgggatactcggcggcgacctcagctcctacggtccttcgggattgcgttacggcggtttttgcagtgtatgctctgagcgtggtgcggatattcccgacagcgaactttgtgcatatacgttcagctctgcttatgaggcggcagtggctctttatcataagtgcaaggatatgacggcggtattcgctatgtcggatattatcgctgtgggcgctgtacgggcatttctcgatatgggaaagcgtgtgccggaggatatttcggtgcttggcttcgacggaatcgaactgtctgaatacagcaaccccagaatagcaacattagctcagccgatccaccagatttcaagtctgtctgtgcgtatgctggtgaatatgatcgaagacggcgccgaggcgagccatgtaacgctcagggcgcagttcagatcgggcggctcaatgggcagaatatagattttgttggaggtcaacatgagaaaaagcggtatcttactgcacattgcgtcactgccgaacaaatacggcatcggcacgatgggcagggaagcctataaattcgttgactggctcagaagcgccggtcagagtctgtggcagatacttccgctgtcacagacgagctttggcgattcgccgtaccagagcttttccatatatgccggaaatccttacttcatcagccttgagacgctggaggaggaggggcttctgaagcataaggaatatgcggatataaactggtgcaaggatccgagatatatcgactacgccacgatgtacgagaacttctataaagtgatgaggctcgcattcgggcgcttttctaaggacaggaatggtaacgtttccgaagaatataaggcattcgttgccgaaaatccgtggcttgagaattacacgctgttcatggcgctgaaggacgcacacggaggaaaaagctggtgcgagtgggaaacgccgcttcgcctgcgtgatgtaacggcggtatattccgcaaagaagaagtacgcaaaggatatggaattctacgcattccttcagttcgagttcttccgtcagtggtacaagctgaagaagtatgcaaatgacaacgggatacagattatcggcgatattccgatatactgcgcccttgacagtgcggatgtctggtgcgaaccgcagctgtttcagcttgaccgtgacagagtgcctaccgtcgttgcgggattccctccggacgcattctctgaggacgggcagttgtggggaaatcccatctatgactgggacagaatgaagcaggaaaactatcgctggtgggtcggcagaatgagcttcgcaaagaagctgtatgatattgtccgtatagatcacttcatcggtttcaacagctactatgccatcccgttcggcagcaagaccgcacacggcggcgagtggcacgatggtccgaaatacgatctgttcaatgtcattaagagagaaaccggaaagggcggtatcatagcggaggatctgggaataatcactccgtctgtaaagaaacttctcaagcaggcggcatatcccggaatgaaggtactgcagtttgctttcgaccctacgggaaagagcgaatatcttccgcagaactacacatcgcagaactgcgttgtgtatacttccactcacgacagcgatacggcactgggttggttcaacaaccttgatcgtacaacaaagcagttcgtgaaggaatatctcggggtgcgccatgcggctgaacttcccgaggcatttatcgacattgcctggaaaagcaccgcagatatggctatgactacaatgcaggaactgtgcggattcggaactgaggcacgcataaacgtaccctccaccatcggaaataactggcgctggaggacgctggagagcgactttaccgctcagagtgcggcgtacctcgacagactgaccgaaataagcaacagaaaacctcccgttaaaaaatcaagaaaaaaacgataattgaaaggagcataatatgaagattgaaaatttcaaggagaagctcgtttccctctgcgagaagaaatatcacgcacagccaagggagctgacggcaaatcaactgcactgcgcagtttcaaaactcgttatggaggagctttctcctgtgtgggacaagagccgtacggctcacgataaagcacgcaaggcaagctatctctctatggagttcctggtgggtcgtgcaatatacaacaacctgctgtgtcttgggatacttgacagcacagctgaggagctgaaagcactcggcgtggatatttcagaattcgaggaggtcgaggacgccgctctcggtaacggcggtctgggcagacttgcggcttgcttcctggacagtgcggcaacgcttaatcttccgctggacggctacggaatacgctataagtacggcctgttcaagcagggcatcaatgacggattccagaccgaaaccgcagacgattggcagagatacggcgacccgtggagcgttcgtcgtgagcaggaaactgttgtgatacacttcgctgacggtgatgtgaacgcagttccctacgactatcccgttatcggatacggcactgagaatgtaggcactctgcgactctggcaggctgaaaccgacgatgagttcgattttgatctgttcaaccgcagtaagttcaccgaagccggcgaaaagaagcgtgccgccgaggacatttcccgtgtactttatcccaatgacgaaacagaagcaggaaagatactcagactgaagcaggaatatttcttcagtgccgccgcagttgccgatcttatcagaaagcataaggcgattttcggcacaatggagaattttgctgattacaattgcattcagatgaacgatactcatcccgttatcgctctgcctgagtttatccgtgtggtaatgcgtgacgagggctggaagtttgacaaggctttcgaagcggcgaagaaggtgttcaactacaccaaccataccattatgcaggaagcgcttgagaagtgggacagcagacttatcgaacgaatagtccccgaagtgtacagcgtgatgataatgctcaacgaggcattcgaatccgaaatgcaccgcaggaatgttccgcaggataagcgtgcggttatgcgtcttataaagaacggcactgtgcatatggcaaatattgcggtattcggttcttcctatgtgaacggcgttgcggctatacacacagagctgttaaagaccaccgtgctgaaggactggtacgagctgtatcccgagagatttcagaacaagactaacggcatcacacagcgcagatggctggctttgtgcaaccgtgagctttccgcactcattaccgaactgctcggctttgacagctgggtaaccgaccttgacaagctaagcggccttaagaagtatgcggacgatgagagtgtgcttcgccgctttatagatataaagcacgctaagaagcggcagcttgccgactttatcaagaaatcggagggaattgaaatcgacccgaaatccgtttttgatattcagatcaagcgtctgcacgaatacaagcgtcagcttttgaacgcattctcgatactgtatctttactatgaaatcaaggacggaaatctcagagatttcacccccactacatttattttcggtgcaaagtccgcacccggatattaccgtgcaaaaggcattatcaagtttattaacgaggtagcaaagctcgtaaactccgacccggatacaaagaatctgctgagagtggtatttgtgagcaattaccgtgtttcctatgcggaaaagctggtggctgcggctgatatttccgagcagatctccacggcgggtacagaagcgtcgggtacaggcaatatgaagtttatgctcaacggcgcagtaacgctcggcacactggacggcgctaacgttgagattgctgaggaagccggtgcagagaacgaatatatcttcggtgcgactgtagaggagctggagaagattatgccgcactacgttccccgtgacattacagagagcgatccgaagatcaagcgtgtggtatctgcgcttattgacggtaccgtttccgacggcggaagcggcgtgttcagagagctttatttcgcacttatggagggcgcaagctggcacgttcccgatcattactaccttttgggcgaccttgacagctatgttaaggcaaagctgacagtaaaccgtgactacagcaacgagcttgcgtttgcaaagaagtgctggctgaatatctgctctgcgggtaagttcagctcagaccgcaccatcgctgaatatgcaaaggatatatggcatatcggcaaggtgtgattcaccgagttttgtatcggattctctttttggtttcgtttgcagtgaaacgtgttatatagattgtaacaacgtttcaccggaaacgttgccattatccacaaaagcgacagatggtaattggctattatgacaaatttacaattgtttttttaatttttaaaaataattgtataaattcgcttgacagagcaaaaaaatctgttataattaaaccagaatttcgaaccaagtaatcaaatttcgaaacatagccgaatctgcagggtagcacagacagcctgcatttgattttaggatttttgtttcgaaacaaggcgaaagtttcgaaatgcaataaaagtaagcaagtgattatattcaggaggaattaattatgaagtacaggaagatcatgacagcgatagcttctatgacaatggcaggcgtaatgctggccggctgctcaagcaacagcacaagcggcacaagcagtacaggcagcggctctgcggcaggcaacagcacagcttcttcgggcggcagcgaatccaccgccggcagcgagaaggttagcctcacggtttggggtccgcaggaggatcaggaactgatcaagaagatgtgtgacgaatttgctgctgcaaatcccgaaaagacctacaccttcacctacggcgttgtcagcgaggcagacgctcagaaggaagttaacaaggacatctcggcggcggctgacgtattcgctttcgcttcggaccagaccgctatactggtgaacgcaggcgcactctacagagtaacaaagaataaggatcagatcgttgctgaaaattctgaagcttctatttcagcggcttcgataaacggcgagctttacggctacccttatgtatccgatacctactttatgtactacgacaagtccaagctgacagaggatgatgtaaagtctatcgaaggcattatgtcgaagaatatcgacggcgttacaacaaacttcgctttcaatacagatgacggctggtatcaggcaggcttcttcttcggcgcaggctgcaagctgttcggtgatgacggaaccgatcccacaaagtgcgatttcaataacgagcgtggctatatggtaggcgaatatctcatcgacctggtagcaaaccccaagttcggctccaacttcgatgactcgcttgtaaaggcaggctttgcagagggtactttggcagctgcagtttccggtgtatggaacgcaggcgaaatccagaaatctctcggcgataactacgcagctacaaagctccccgagttcaaactctcaaacggcgaaaccgttcagatgggcagtatggctaacttcaagatcatgggcgtaaacgctgaaaccaagaacccgcttgacgcaatggctcttgctgagtggctcactaataaggacaaccagaagaccagattcgaggttcgttcatacgctcccacaaacgttgagcttgcaagcgactcagctactatgaactccaacatcgctgtaggcgctcttgcacagcaggctaagtactcaaccgttcagacttctatcggtcaggtccagaactactggacacccgctgaggctttcggtcaggaaattatcgcaggtacctgcacaaagagcaatctccaggataagctgaacgcttatgttgaggcagttctcgcaacactcagctgacaaaaaagcatttaaggtaattcaccaataagtatatatgtttctccaggttccatttcttcgtgggcggcgtgacagccgcccacagaatcggaacgtgctttatgcagtttcaatgcttcctgaatacttgacacagaacaatatcggttgcataatagagcctttcggcatacacgcccggcgtccgtgccggggctgagtgtggggctgccgccctcaccccgcttggggctacgccccaaaccccattttcaaaaatatataggtttttcgacagagtgaaactcccgtaaaccgttttgtcggcttacgggagctttttattcatcgcccttaagataccttaccgctatctgcgtcctgtgttcaagacctgttttttcaagtatcacgctgatataatttctcactgtaccgtttgacaaaaacagcttttcggcaatttctgcgttcgaacagccgtctgcaatcagctttactatatcaagctctctttcggtaagcagaccgaaaacggcgctcttgccgtagcattttactgcagcgtcacggatatacgacagaatatcctgctggaataccgtaccgccgttatataccgtcctcagcgcactgaaaatcccgtctgtctgcgtgtttttgagaatatagccgctgaccccgactttaagcgcacgctgtataagctcctgctcgtcaaacgttgtcagcaaaagcggtttgcagagattttcttcaagcattatctttgcggcttcaatgccgtccataacgggcattcttatatcaagcagcgctatatcggtcttgtatttcctgcaaagctctaccgcttctgcgccgttacaggcaatgcctgtcacctcgaaatcaggctgtgacgagattatcatcttaagcccctcacggattatgctgtcgtcatctgcgataattatcttcatacgttctcctctttcagactgaatatgtttactaccgaaaatccgtccgtctgtgcaggaaatatgcactttccgtccgtaagcaccgtgcgttcctctatcgccgtaagacccgtaccctttttgaagctgtcgcttcctttgccgttatccttgaactcggcacggattaccttgttcataaccgatattttcagcgaaaattcgtccgctcccgaatgcttgagcgtatttgtaagcgtttcgacgagattttcctttatgcagttccatatgcggaatgtgatcttgtctaagtcccccttgatttcaagcgttgtccttatgttatattttgctttatattcaccgagtatctctttaagctcgcttattcctattgttttgctgtcgggacgttcctcacgcagtgcctgccttatatcgtcaacgccgcttctgaggttatcggttactgttgtaatacattgctcggcactgtcggggtttgtcctgatgttcagctttgccgcctcaagcagaattatacttccggaaatgctgtgtccgagcttatcgtgtatccttgctgaaaaccgtctgcgttcttcgacagccgcagatttttttgctgttttagcgtattcttcaaggcttgctatcctgcggttgaggcgaacagtttcctctctgctgtccgcaagctgttcacggcatttgataagctgtcctgcggtaatatggctgacagtgaatgccacgagcattataataagtatcagaacatcaataaacggcggttttactataaaaagaacaagcagtaccgaaacagcgccgatatgtcggaaatactttcccgcaccgaatttatctacagcaaagattacggcaaagcacagcacgaatatcagattgtcgctgtatataagaaatgcgataaaagccgaaacgcacgaacagaccgccgccgctttatccgactttttaagcaccgacagcagatattcagccagagcaaagcaggaaaaggcgagtacggtaagcaccgtatcgcccgaatcacagttattcattatattcatagtgccgaatgcggctgttgccgtgagtttgaatacaagatatataagtgacaattcgtattcctttcgttacgcctttgaaactaccgactttctgccgaaaagtgcggcgcttgcaagcattataagcaatgtgtagagtataagcacgcagatgtttatcacaggctgttcagcctcgcccgacataaaaccgacataccagtattgcggcgtgatatatgacagatatttcagcatacctgccgtttcgtctatcgggaaccacgcaccgccgagcagagcgcctatcgaggtgatacagcccgaaagcgtggcaagagcctgctttgagcttatcagctgtgcgagcattattgataatgccgagttgaacagcgagtagataactaccgccgcaaacacaagcggatagccggcagtcatccgagcgcccgtgataagcaggtacagcggtaaaacgataagtgccgtaaaggatataagcacgcttgccccaagcgttccgacaatgtactgtacgcccgttacagatgaaacagccatcctgctgtatgttccgtactgcctgtcttccattaccgcaagagtgataaatatgccgatagcggtgacaagcattatcataaatccttcggagaacttaaagcctgcagagacatattcgtcctctctgtcggatgttaccgcattttccttagtgagctttgtgtcggcggcatcgctgttcataattctcgaaaacagctctgcatcgccttttgcggcatttgcggcaatgttgacgcttctcataaagccttcgatatataccgagatataagcgccgttttcgtaatcgtcaagagtggtggattttatcttcacgtcttttccgccgataactttcttttcaaagccctgcggtatctctattatagcagaaacgtcacggttaatcaatttatcattgaatttttctttgccgtcctcgataatgttcatatttatcctgttgctgagatagcttttcagcattgcggaaagctccgaattatcgttatcggtaagggcaatgtctatcttgtcgttcaccgagaacacgtttgctattggtctgccgcagtaataaagccctatactgcctgcccctacaagaagtgcaattacaagtgcgtatttaagacgcttcagcataccgaaaaataccgttcttatattattcataatacgctcccctttcagacggatttttttacacggaatattgccgcaccgataagcgataccgcagccgtcacggcaaggcataccgcaattaccgccaacgcactgtcgcattcaccgtaaagagtaagtctgaacgccgcttgctgaacgatataaggcggcagcttgtcgctgaagccttcgacgaatacctgctttgaaaacgagccggagaagaacagcaatgcccatgtaagcggtatcacgatgctctccgcaggtatttttatcagtacccctatcagcatacctacggctatcgacgcaagcgagcagcagaagagcagcaggaacaggataaggtttccgacaaagctgtcgcagtattttgctccgaacacaaacaccgaaaacagcattatcaccgcatttcctataacggcggagggaagcgtaccgatgagctttccgaaaaacagctttactttgccgacaggtgacagataaagacgctgcagggtgaatatcctttcctcgtccttaagagccgtactgcccattatcatatgcgacatgaatatcatcattaccgccatactcaccgcataatagtccatcatactccgtgtaacgccaagtccgtcctgctctacaaatgacttttcgttatctgtatctgtattcataagcagtgacgggtcggtcgatgctattttataatatgtatcggatactgcaatgtaagagttcagcaccgagccgagcgccctgtttgcaatttcgtttctgccgccgtataacagaatttccccgtttttaagctcgatatatgcgtctatatcgcccttgtcggtaaggctcagtgcgtttttttcgttgcttgccttttctgcccttatcatactgatattgtcaaggaactcagcaaatgcctttccgctttgctcgtctgtttgcgtaacgctgtattgcagtttaatttctcctatgtcataatccgctatatcaagattctgaagcatagttccgagaaagaataccagcagtaccgggaataaaagccccatgaatacgtttgcggggcttctgaaatactcccttatctgttttattatcaaactaagcatatttccgctccttaacgtatctcgtgtcctgtaagcgacaggaacacagcgtccatatccggcttttccgtgcttatctcgattacaggcagattttgctttacaagttcgcttataacgtgtgaaatatcgttacagcttatgctcatatcaacgcttataatattgtcgctaaattgcaccctgtttacatctggcaggcaggaaacagcccttgatactctgcttcttgtttcgctgtcgcactgctttgtggtgatatgtaccgtacagctgtcggttatcatcgttataagctcctgctgtgtaccttctgccacaagtctgcctttgtcaattatagcaaccctgtcacagatttcctctacctcatgcatatagtgcgaggtatatattactgtcgcaccgctttcacgcagtttctttatcgaactcattatatgctctcttgactgtgcgtcaactcctacggtaggttcgtccataactatcagcttaggcttatgtgctataccgcaggcaatgttaagtctgcgtttcataccgcccgacattttcttcggcttcatatccgccttatccgcaagccctgcaaattcgagagcggtcattgcattcttatgaagctgttcgcccttgaagccgtacagcgaagcgaaaaattcaacgttttcctttgcggtaagatacgggtacaccgctatctcctgcggaacgcatccgattatccgtcttatctccgctctttgcttcactgtattcataccgtctatcgtcacacttcccgaagtcgcttcgtcaagtgttgtgataatatttatcgttgttgactttcctgccccgttaggacctataagtccgaatatctcgccctcgcttacattgaagctgaggttatctacggcacagtgattgccgtaattcttgacaaggttgttcacgcttgcaaatatcataagtattcccctttcggctgtttatttatcttactgtaacgattatacacctgcaaagcggatttcaccagttacaaacggtatttttccgtatgacatttgtaataaaaaagctccgacggagcattaaccccgtcagagcctttgacttattaagttattgattattcatcgtcggctgagatgctctctgttctgtaaatgaactttacagtgccttctgtcttatccgacttaccgccgaatgtgtcatagtccttgcctaaagcaaccgtagccttcagcttgtcgataagtcctgcaatatcgccgtcaacagcgtctactatcttcttgacagccttctcgttgaactcatccataccgtcgttcagctccttagcaccgtcccttaactgctttacaccgtcaataagagttgctacaccgtcattgagcttatcagcaccgtccttaaggtcgcctgcaccgtcatgaagctgtaatgcaccgctgtgaagtgtgccgactcctgcaacaaggcttgtcgtaccgtcctttaactgtcctgcgccgctgtcaagctgtgttgcaccgtcatagagtgtgccgatgcctgctacaaggcttgctgtaccgtctttcaggtcgcttgcacccttgtcaagctgatttacgcctgagatgagcgttgagccgccgcttgtaagctgctgtgtgccgctcttaagctgtgtagcaccgctgtgaagatccttagtaccgctgtaaagctgtgttgcacctgccgacagcgtctttgagccgtcatatgcgctgtcaacgcccgccgtatactcagtaagtcctgtgtagaactcattgtaggaatcaagctgtgcgataagattctttatcgttgtctgacctgccttagcctttgctacagcttcgtttatctgctttgtgaccttttcgcttttcatattctgatcaataagctgtttcttctgcgcttcaacatttgtgcttatctgagcctttacagcatctgttgccatctgagcggaaactgcggctgtaaccttagcctgtacggcttcgggtatctgtcctgcctttactgccgcattgtactgctctgcggtcatattatagcctgcggctttgagaacaccctcaagcacctttgcctgtacagcttttgtaacgcctgctgttatagcgtcattgttcttttctacctcggcagttaccgttttgagtgccgtattgtaagcaagagtgtagaccttatccttgtcaagagaatctaccagcttgttaagctccttcttgtaattctttatcgtcagttttgaaacggtaagaccggaagcctttatctgcgtttcggctgtggataacagtgtatcgaatacctgctttgcgcctgcgttcagctgttcgctgtttgatgaaagctcaccaagaccttcgttcagctctgaagctcctgcgcttacctgtcctgcgccgctctctacctgagatgcgccgctgtcaagcgatgacgcaccgctgttaagcttatctgcacctttgataagatcatttgcaccgcctgccagtgcagatccgatacccgttttctatgcctattgcctgtcaatcctcacatcataccgcctgagccaatattctatctgcaagagatatgcgaaaatctgcggcgaggtcataagctgaccgtaccagttgccctcaaacagtgtcggatcgtcgcacagccgtaacagcttttcacggctgacaatctcggtaaggcggcaatccttgtcggcaagcaccgccctcatcctgcggataacctcggcaagataggttggattgtgggtctttggatacggcgatttcttgcgccaaagcacatcgtcgggcagtatgcctttcatcgcacggcggacgatgcctttctccctgccgcctgccgcctttatctcccacggaatattgaaagcgtaacgggcaatcctatggtcgcagaacggcactcttacctcaagcccgtgagccatgctcattctgtctttgcggtcaagcaggcattgcataaaccaatagaagttcagcatgaacatctcacgcatacgtctgtccttgcggctgtcggtgtcgagatattcggtgttcttaagcgtttcgttacagcagaagttgacataatcattcgggtcgatgtcacccagtatcccctcgcagagcagatccgcacgggatgcggtcgagcaagcccacgggaagcccggtttgtagagaatttcctcgttgtgataccatggatagccgccgaagatttcatctgcgcactcgccgctgagagcaacggtgaaattacccttgatagccttgcagaacaggtacagagagctgtccacgtctgccattcccggcaggtcacgggcataggttgacagctccagagcgtcggtcagagcgggtgtatcgacctcgacattgatgtgcttagagccgatgaacgctgacattttccgtatccacggtgcgtccatatcgggctggaatttactgctgtggaagttcttgtcgttgtccttgtagtcgattgaataggtggtgagctgtctgccgttttgttcaaattctttggcggcaacggcgcttatgatactgctgtcaagaccgcccgaaagcattgtacaaagcggaacatcgctgacaagctggcgctttatggcatcggtcaggaggtaggctatgtgctgttcggtttcctcggcggtttccttatggggaagggcgtggagcgaccagtaggtgcgctttctgaggccgcatcggcagtacatggcacactcggcggggcgaagctccctgatccctttgaagatgccgcttcccggctttctcgcaggacctaagagcattatctgagcaatgccgtcacggtcgatcaccggctctatcatagggtgggcgaggagcgtttttatctcggacgcaaagataagaccgcctgcgtattcgtagtaaaacagcggcttcacgccgattctgtcacgggcaagaaagagctgtttttccttttcctgccacacggcaaaggcgtatattccgttgagcttgtcgaggcaggcctcgccccaggtgatgtatgcccagagcagtacctccgtgtcgccggaggaggtgaatgaaatgcccgtagattcaagctcagagcggatttcggcggtgttgtaaagctcgccgttatagacgatagtgtagctgtcgagggcggttttacgggtcatcggctgggcgcttcgggcggggtctatgacgctaaggcggcggtgggcgagggcgcagttatcatctgtgtagaagccgccgttgtcggggcctctcggaaccattgtctgagccattctacgcattattgcggcgctgtcgcacagcctgcggcaatctatccaacctgctattccacacattaaaaatcacctcattatgtaaatttatggtatattatggttgatacaagagtagtatatgctttgataataaattccgtgaatggaaatatcaaggtgatgattcgattacgataaaaaactgcgtttttccgcattaccaaggggtttcggcagaacagacagaatatgcacaggttgatgaattgtgatgaatttgagaattgaggggaaggcgggggaatgctgctgtattttaacatatagttttctaaatataatgatattaatatatttaatattttcaacgcaatttgctgttttgcgtgttaattttgtcggagcggactgcaattttgagcagtccgcttttgtatgttgaaataaaatttaatgaatcgtaaaacctgatattagttcacagctttcccagtcaacaccttcatgcattccgtcaacaacaaaaatgtcaccaccgcatttatgacatccgtcattcagctattcagcatgtcaccatcctttgatgctgtacaatcatagtcaacgtatattcttgtaatttaaggtttcttgcagaacagatataacacttctctgaattttggtaagctaatcattaacatctccgatattcaggagtgctgatatagtgtcagcactcccatatctatctgttaataagggaactcaggttcaatcttgaaatcaatatttgctgcttcgagcttttcctttatctccataatgtcgatagctttaccactgaaaatctcagcaggagctttttcaatcatctttttggcttcaatatagttgcaaccggcaatctctgaaaccaatttcaacatattagtattcgccttaaacggagatgaaagcagaatatgatacacggttaaatccgtttcatacggttcaaagcaagttgaagcaacagcctcaccgcaattatcacatatccaactaatggaatgaccgacctgcttaaatctcatctctgctccgcagttttcgcaaatcatattttcttcctccttttgggataaaatgttctgaatgtaccgggcgcactacgatcttggacaagtctcccatttacagtcttacctgctgtaacataatatgttcctcttggtgttgcccataggatatcagtaggtgcttgtacaggaacattcaatttgttggctaagttctgggcaaagccggtatcaagtttaccggtgctacatgataacaaacgtattgcttgtcctttatactgcttatcctgcttaaataatcttgcagcaattctatggtcaatagtaatcgtttgaccattatgctgaatttcgatacttataggattcccgtgagctataatatcatagaagccgtttgcgtcagcatcttttcgccttttaatatatctgctgaaatcatcagtgggcttcatgtaatcggtactaccaaaggcgacacggctccccttagtaccgttgaacataccgctataacccttactcatttcttaaccctccctgcaaacgccttgtttgtcttgctaggataggcaagaatcgttatgccctgttcttcaagctctttgaagcacttgtaattagccgagccgtacacgataatcgtatgaggatgaagccgtcttactaactctttcagcccttcctcaaagcgttcacgatcttcgagcttacggggacttccgccgaccgtaccgattgcaacaacgctgttttcagggattccgtcaaaacaataccaaatcactatcctttctgaaaaattcagccaaaagaaccattatccaagtggtaacatttctcctgctatctattataccttttgggacaacatcaagtcaagccggcaattacatttttgcattacgcacaattcctattcaaaatgaattgtgcgcatatacaaatcagctgtaaagcctacaagttgcaccgggaaaacgtacattgcaagggcggtgacaccgccccgtgttatgcttattttgtcacgatattaagcagggactgatagctgtccacaacatcataaacaacattataattgctgacagccgtaaaatgctctctcgcacagtgtgtcttacctttttcaatatcacgaagctgcatcgtagacatcgagcctttggtttcaggtatgaaatatatgtgctttacctcgctttcatagaagcgatagcccggtcaggattgtacttgcctacgggagttgagatataaaaaccattcggcagttatgtaagagtagtcggaacaactgatataccgaatgttgcaaagtttactggttctgcagtttctgcaagtgaggtaaagcttgactggagcaagaatgacaaggctacaggctacgttatcgagcagtacaagggtggaaagtggactgaaatcaaggctgtggataatgatattaccgaaatcacggttgaggggcttgcaaagggtacggcatatacgttccgcatcaaatctgtcaaaacggttgacggtgcggacaagagcagtgagtatgcaagcgttaaggttaaaacggctgagtaagttttaaatatcaaggcccaccgctatgggattttctgtggcggtgggctaaattttacccttttgggtattgtaactttgccgaaagagttatactctattatatagggaaagtgtagtgcaggggcgcggcagcttttagttattttttacaattcaaggagggttttgatatgaaatacagaaaattagcaagcggatttgtggcggcggcaatggcggtcggcgttttcgctacgccgttcggagaggcgcttcctgtcataagggagagcgttgctgtcaatgcgggggcagaagtgtacggagattttgagtacagcgtttcgggcgatacagccgaaataacaaaatataagggcagtgcaagtacgttggtcataccgtctgaaattgacgggaaaacggtgaccggtataggaagaatggcatttgcaagctgtacaacgcttactgatgtaaccataccggacagcgtgacgagcataggagattgggcgttttcggattgtgacgctatcgtgaacgtaaaaataccggacacagttacatatttgggagaatacgcattcagaagctgtagttcgcttaagagcgtgcatataccgaagggtattaaaacaatcgaaatgagagcgtttctctcatgcagttctctcgaaagcctgactattccggaaaacataacaagcatcggacttggtgcgttcagcttatgtaaaaagctgactgatgtcactatacccggaaatgtgaaaactgtcggggaaggcgcattcagcaattgtaccgagcttttaaacgtgacgatatccgacggtgttacgagcataggcaagagtgcatttgcaagctgttatttgctgaagagtataacgatagctgacagcgttacgagcatcggagatgacgcattctattggtgcagtaatctgacaagcgtcaagctgccgaagaatcttgggaagataaacagttatactttcagattctgtaaagggcttacggatataagcataccgaacggcgttacgagcatagacagatgttcgtttatgggttgtgaagcgctcacaaaagtgataataccgaaaagtgtgacggtaatcgacgagagtgctttttacggctgtaaaacgcttactgacgtaaccataccggagggcgttacaaccatcggcgaagatgcgttttgtggctgtacggctctgcttagcgtaaagatacctaagagcgttacagccataggcagtcatgctttcggatataatgagagttatacgaagaccgccggtttcaaggtatattgctataagaacagtgcgggcgaaaaatacgcaaacgacaacggctttatctgtgaaacggtttcggttacaacgattgacgctgtgacgggttttgacgcagataaggttacgagcggttctgctacgctgaaatgggataaggtttccggtgcggacggatatgcggtcgaactgtacacgggcggaaagtggaacgaggtattcaggacttccgacagcagtgttacaagctgtactgtaggttctctcaagggcaactcgacctacagcctgaggataagagcctttgcgggaacggcctacagtgactacacaagacttgcggtaaagacaaaacttgcaggtgttacggggcttaaggcgcagggcgttacggctacggcagtaaagctggactgggcaagaaatgcaggtgctacgggctacataatcgagcagtacaagggcggtaagtggacgcagatcgcagttacaaaaaacaattacactctcacctttactgtcaagggtcttgcagaatgcacgccgtattcattccgtgtaaaagcatataagaatgacggcggcaagacaaattacagcgactatgtgactgtcaaagcgtcaacgcttttaggtacggtgaagaacgccaaggtcacattggtaacaggctcgtggataactcttgagtgggctaagaatgacaaggctacaggctattctatcgagcagtacaagggtggtaagtggacggtaatcgctaccacgaagaataataccacgcttaagtttactgttaagggacttaagaatgatacaacctattcgttcagaataaggacatataagactgccggtgcttcaaacgtttacagcgattatgtgagaatcgcaggcaagacgaggataccgaatgtggctacattcacaggttctgcggtttctgcaagtgcggtaaaactcgactggagcaagaatgaccctttatgcttagattcaatatcggcgtattgtgactgatattctttttttaacttttctaattcttcataacaaccttcagggtagttctgagcgtttatatgcaattccgagtttttcacaggctcttttaattcttccatgttgttcatctcctaatagtatgaattacggattgtgaaacagaatatcatcaacttcaagccttgcttttaaataaaattgcggtgacagtcgcatcagacatggcagaaaatttcaatccacgccctcgcaaagagggcgacgcataactcagcacatttgtcaaaagactttttatttcaatccacgccctcgcaaagagggcgacctcgcagtggtgggacgcaatcagaatgggacgtgtatttcaatccacgccctcgcaaagagggcgactagcttattgggtacatatcactgcacggggataaccaatctttatttaattttcatatctctcagagcgatatactcctcatcgaccttatcggtatagcggctgtcagcacctgcgaggaaagccgttatatgcttacagcattgactgtagaactcatcttcataatggacgatatgtgcaccgccaagtgcaaagcggtcatcggcataaaaccttttagaaatatcaattacacggcaatcggtaagacgtgcgaattcttcttcaaatccatttataaatgcttttttggttttgaatgtgttgtcgctgtcggataacatttctaacgtattgtcaagcgaaatataacggtctttaaggtcagctttaattaaaataatgttttttccatagcgctcagtgacaaatttgcagaagttttcaagcgctcttttgagatattcacggcttctttcgttaaataaataggtactttggcatttatcggaaattgacttgtaaaaagcggtgcgaagtatgaaatcatccacctcgaaaagcgaatcgccatacttacgcatattgcagataaggtcgtacatatcaataatcagccatttggcattactgtcagatagaatgcgttttccttcgtgcaaaaacgcctctttgacagtgcgtcttcgccacttactgccgcagaatttatcagccgacaaatcgttgtcaaacggtatttcaggctcgtctgcaagcaaaaacggctgcttgaaaatgtacttatcgacatatatgcataaagaattgcggttaacggattcacgggaaatacagctgccccagatgtcaaccaatacaggtttgtgccgtgcttcgtagtcttcaagcaatttgcggtcatttctgataagaaaaatatgttcgcagttatcgggaacagtatatttgtaaacctcagaaagtttacgggataattgctttttcataaggaagttctcatcgaaaacaatctttatatcatcgtaactgcaatcgcaaaggtcgccgtcaatacactcagcggcttttattgccgagataaacctttctgcaccggctttagcagaaagcaggatttttgcatcatcataggtacggatttcattttcacgcagatatacaaaatactcgaaattctcagcgacaaactgttttgacgtaagctctgccattctgtccgatacataatttctgtcaagcagttcagattgataggctcttgccgtcatattgtcataatattttatgacacgcataagctgcagccttatttccggtgcagaaaaatatgtatctttgcggatacgttttaccgctgagttcagtttgattcttacatcatcgtagaaaagcggctcaaaggacatcatattgtcactttttgacgccataaaataatttccggaaacatcaataaccaccggctgtaaaagcgaaatcagataatcctcatactgcctcaaccgcttattcagcgcatttctgtttttaccgtttcttagctgattttcttttacgcagatattactgaattttaaacgcactaatatgattttatccttatcatattttgacaagacaattttcgcatattctttaagtgcagattttacttctttttcgtcaaaaggcggagatattttttcaaacctgtctttattggaattgtaaaaatcggaagaaataaaactgcccgatgccgtatagaagctgtcgccgtacttgtagcacgaaacagccgccgctgtataaagatctattacgatataatcgctgtctgagccgtctaaaaacgatttgaaatttttatttatatcaattttatttctttggctgccggcttttcccgaaagattgctttttttgcttacaagcgataacggcgacaaaataagagcggtatcatcataagaaaaaccgctgtcacggaatatattcctcagcacggctgagccttgcagcaagaatttagggtattttcgtataacgccctcattgccgagtatatctcttatgcgatcttcggaaatctgttctgtatgcgtcagcaacccgtcaagaacgcttaccgtatatccgtcggaggtgtctttacaaagcgtcggaatgcacgatatatcggactttattccgctttcggttcttgtgagaatcagatttacaattacactctcacggttttcacgaagctctttcatagatgacaaaagattgcccagagaatagaagcacatcacctctctgccggcggatgtgtgtattttaccgaccctctgcataacgtgcggatgagaaccgataataagatccacgccgcactgtgccatatattcagccgtctttatctgagaattgcggacagtaacggaattcataacaccccagtgctgatatgcgattatatattctgcgccttcattcttaagcgtttcaacaagctgtctgaagtgttcaggctcatatttcccgataatttcggatggtatatttttctcaagcccgtttgatattgaatttactgcgacaaatcctacttttatgccgtttatatcggcaatatgagtttcatcgtcaagtgtaccgatatttgccataccgctgtttctgatacgttgtacggtagcgttaagtccttcaagccctgtatcacagttatgattatttgcagttaccagtgcattgaatccgcagtttttcactgcgtctatgaaggtggacggagaattgcaattgggacttccgctgtctgtgcgtatcttttcatattcaaacgctgctccgtcaaagcaggtcgtttcaagcaccgctacagcataatcggctgagctgaccgtatctttaagcgttccgaatgcgtttgtaaaatcaagcgaacgcagagcggctttccgctgatgctcaagcgaacacattatatcgccgcagagcatgatccttgccgtagccggataacgtgacatatccctgcctacaactatcttaacagtaaaagtctgaccgtcatcagctgtcagctttatctcagccgtaccgtccgaaacggcagtaacctgtccgccctttgttacggtcgccacatcgctgtcatcgcattcaaaagtaacggcaggcactttatttctgcattcccatactatctgcgacgtttcgcccttgttcatcgtgattacattctgagctttaaggtgatggcacatcggcgtaaattctgacggctgtgacagttcaccgtatacctctttcccgtcacgatagctgaacgcttttacccgtacaacatactttctgccgttgcgaaacccaagtatcagctttgaattattctgtgcatagcgtgttttaatgcacttttccggttcatctgcattatagaactgcaatatatagccgtctgcgccctctaccgtctgccagtcggatcgcaccgatccgtcataagcggtagcgaacaagttttgcggagctttcagcatgatagtttcctccgtagtttactttttgctcaacggttttcttattatcgaatgaggagggaaagaaacgggatagtcaaagtacatcttttctgtcgcacggtttgctatctctgtctgctcgccctttgaatttatcagataaggaatatccagctttaccggcgtttttccgggcgacagcacttcaaggtcatcgtgaacggtaaaatagtttctctgcgtgatattcaccctgccgttctcacagctgtcaattacgccgacaaagtcgcactcacggatgtagccgctgttctcgtaatactggtttgcgtcttccttgttgaaataaaagccggtgcaatactgtctgtgacttaccttataaacttcatcaaccgcccatttcggaaccggttcaccgtttttcactgcatcaagcgcagctctgtaggcatttgtaaccgttgccgtataatatgcggatttcgctctgccttcaatcttgaagctggtaacgcctgcatccttaagttctttaagatgctctatcatacacatatccttagcgttaaggatataagagccgccatcgccctcagacagctcatagtagtcgcccggccgtttttcttccactaagtgatacttccagcgacaaggctgagcgcattcgcccttgttggcatttctgcctgtcataaaagcggaaagcaggcatcttccggaaaatgaaacgcacattgccccgtgaacgaacacttcgatatccatatcctcaggtatgttatcccttatacgctttatattttcaatatctacctcacgggcaagcactactctctttgcacccatcttgtacagctcgtttgcagttacatagtttactactcccgcctgtgtagaaacgtgaatctcaagctctggaacagtacgctttataagagcaatacagccgatgtcgcttactattgcggcatctactccacagtcgtatgcggtttttataaattcaggaagcaactctatctcatcgtttgacggtacggtattgcaggtaagatatactcttacaccctttgcgtgagcgtattcaacgccattcctcaacgtttcgggatcgaattttgccgcaccggctctcataccgaacattgtacttccgagatatacagcgtcacaaccgtaatcaacggctgacataagacattcaagatcgcccgcaggcgataaaagctctaacataaatttaacctttcttttaccttattatgacattccgccgcagagaactctgcggcggaatattgattgtttgattattcggctatcgcatgatccagtccgcacttgcggagattttcctcatgctccgaaatagtttctgcaaaatacatttctgttgtttcgggatctgcacagaagtagtaatagcttgtttcaggcgcataaagtacagcctttatagcgtcaagaccagggttacagataggtcctatcggtataccgtcacacttataagtgttatatgcgtcaaacattttctgatcgtactgcgatgaagtgagatgcggttttatatgctcatcaacataatgcacggtaacgtctgattcgagatgcgggaatgcttccgcatcagccatacggttgaagaataccgatgcgacattgcccatgttggtagtattatccgcctcacgctgtgctattgaagcaagcgttatggtttcgtcaagcgtaagcccaagctcgctcatacggttatagtaacgtgccgtcagcttgttattgaagttctgatatataatatcaagagcatctgcggcatactcgcttgtatcaagctccttattgtcctcaagggcaggaagaatgtagaactcgtatgtatcagggaatatatatccttccatctgataatacttcagctttttattctcgagacgtttctggaatttgtaagtatcaccgagcgtcttgcactgctccatgaaatcttcggcacggcagacacggttatcctccatcatctgagcaatctcatcaatagtcataccctcggttatctgtattgaaaccgtctgatttacagtagacactgtctgcagctcagaaataagcgcactgtacgacatagttgtgtcaacggtgaaagtaccctttatgaacttatcgcccttgccgaacattttggtatagagcttgaacacatccggcatatttataataccgagatttgcgaggtcctgagcgatttcatctgttgtcgaatcctcgtttatatgtatctcagcctggcaataagtttttccgatacccgtaaaatcaagcgccgactttacaatgtatgtagcaagaaacgcagaaatcgatatgatgaaaacagacaacagaacgcctgttagaatatgtgaaaatgttctcctgtggcggttttttgctttgattttcttgttgcgttctttttttgccgcaagatattcctgatattcttcttcggttacctcgtcctccgcaggctcaccgtccccagaatgcgattcttcaccgccgggaacgctttcgtatctgctgtcatcagatgaatcttcgttccgcacttcgcctgtatgaagcgcttttatcgaatccatcataattgtgcgttcttcggtgctttcggtattttcatccttatgagttaaatccataggattattcagatcggaagagcacacgtctgaactccagtcactccgcgaaatctcgtatgccggggatggggttagggtttgagaataagctacatttctaaaaaaacagactttttctacaaactgagaccccgctcaaaagagcggggtctcagactgtcgataaacccacgcaccgcaaaaatgcagatgaatcatctgacacaaaattaaaataggataagtaaaagaatttcgcacagccgctttttacggctgtgcgaaagcatttttgcttactgcgtcaaccgcccctcaacgtacctttgtacgcctgtcggggcggtttccttgtctgcgtgtgtttctcaacgtctgcagcttgttggttttatctgtcttttttgagcattgatatgccgatagcaactgttgctatgccggaaatgatgtatccgatgaccagatcgctgataaaagaacctgtcattgagtccataccttcaagtcccgtcagaaggtcgacctgtttcataaggtcaaacagaccgaagaacacactgaagaaaccttcataacccagtagagaaagagcttcatctattcccggttcgcttactatctgccatgtatatatgaacatattgcttacaaaaaccataataagcactattacaatgctgattataagtcccagtgtatcaaacttttttccgaacaggtgataaccgaatattgtcgagaatgccattgcaatgccgccgagatatgaaatatatccgagcttacctataagtatccatacggcacagcctataagcgagaagatgatagcgccgagtatacccataacagggttcgcaggctgtgatatagcggttggtcttcctgcaacgaatcgtccgtcattgccgaagctgttcatcggccgttgaacaaatcctccgttattcataggctgctgaacaaagccgccgttagaattcatcggtgaatatgcaggctgtgaaaatcctccgctgataggaggaaggttgctgtttgccggaggcttgagttcagccagcgactgagcggttgaatatcccgtgctttcgggtgctgttgcagggtcgacagagtccatagagttgttgcttgtcgcagggggaagaaccgttgtcggcgtaacgatgacctgatcatcggctatcggctgagccgcaggaacgggtattccgtaaattccaacagcactgttcgctgtttgctgcgtctgatttacagcgggctgttgcataggctgctgtacaggttgctgcataggttgttgtacaggctgagaattaataggctttgcactctgcgtcacagccgctttttctgtggcgtcttcttcgctttgaacgcacattttacaaagctgttttacattgccgtcggacgcctttgcaaagctaagaccaatcgaagaattgcatttagcacaggcgttgctgtagtagtttgcggaataatactttaccatatcggtaatgaaacgctttatgtcaagcactgcctgagcgtcatcgtttcctgtgaaaagtacagccgatatatttggctcgcctgccttgtacgcctttacaaagctgttctcgggctttgacatatattccttgaaaaagtcatcggcagtttttgtggtgagggcgctttttcttgcccacgagttgaaaataatgcagtttttatcattgagtgccagaagtgtaaacccgtagcctacatatgtaccgcaggcgtggttgtctgcgtcaagggtcagcgccagttcgggttttaaacgtaatagtacgttgcttaccattatatttcctccaaaattgctttagcgtgattataaggtgaaaccttactaactaattttactataatttagctttcatgtcaatagaaaacacacagcagacaagcaaaacgataataaaaaatgctcccgtattacagggagcaatctttattgcagctttagctataatcagttagcacgctcaaccttacctgaacgaaggcaacgagagcaagcgtgtactctgcaaggagtaccgtttacgatagccttaaccttctgaacgttgggcttaaaagctctgtttgtacgtctgtgtgagtgagaaaccttgatgccgaaagatacgccctttccgcagatatcacattttgccatggggtttgcacctccttcaatacttgcttttatcttgcggcggataacgagtccgccattcactatttaacatatagcgatacaacattaatattttaacagaaaccacaacaaattgcaagtgtttttttataatttctcgaaaaaattttacttatcaacaacttgtacaattatatcagatgttttctgtggcttttgtgcaatcagaacacaaaagtatacacgctgtcgggcagtgtttcaaaggaaactatgccgtcatttgatagcataggtaccgattttccgtcgcagaggatagcctcacagtttgacttgatgcggcagacaccgcctacagtcgattttattgttactgctgtgggattgaagttttcccactttgcgtcgattacaaatccgtgccttgcacagagtcccgtgaacgcaccgttcctccatgcatctggtgccgcaggaagaagctctatgtaaccctcgtggctctgtatcagcatttccgcaattcctgcgcttccgccgaagtttccgtcaagctggaacggaggatggaaatcaaacagattgtcaaacgtacagcctctcagcaatccctgtaagatagagtaggcacggttgccgtcctttactcttgcccagaggttgagcttatatgctcttgaccagcctgtagattcatcgcctctgtcgttgagcgtgtttattgccgcagtcataagctccggtgtatgcgagtttatcgccttgccgggataaagaccgagcaggtgcgagatgtgacggtgattcttctgcgtcttgctgtggtcgaaattatcatcgtcctcctcaaaccattccttgagaagtcctgttttcttgcttacgctgaagggcttgagctgaaccacctgattcttcacgatattacgcagttcttcgtctgtaccgagtgcctcgcttgccgtaataaagtcgttataaagctgttctataaggctctgctcataggtattgcctattgtcacaggtccgtgttcgggtgagtatgtcggtgaagaaacaagacgcttctgcttatcgtcatatataagccactgcgtatagaaacgaacactttcacgcattatcggatagatatgctccgcaaaatatttcttgtcgcctgtgaattcaaaatattcgtatatattctgcataagccatgcgacagccgctgtagaccagccccagtagaaattccagccgggagctgtccagccgaacggagtgctttgcgtgtgagcgcaccagccgttttcgggatgttcttcgtccgactttatgccgtaatacgcctcggcagactttctgccggacggacgcatactgtcaaggaaatcaaccagaggaggaacagtttcgctgagatttgtattatatgctccccagtagttcatctgaaggttcacgtttatatgatagtcacagcaccacggaggacagttgctctcgttccatacaccctgaaggtttgcagggagcgagcctgctcttgaggagcttataagcatatatctgccgaactggaagtacagcgtttcaagacggttcgcaatgctccgtgagccgttttccttatactctcttatcagcttgtcgcaggggatgatatcgtccgtgtcctcgtttattttcagtgtaactctgtcaaaaagtgccttgtagtctgcgaggtgttcctcgtaaagtgcgttaaagcccttacttacggcattttcgatacgctgatttactgcggccgaagggtttacgcctgttctgaacgtcggatatttatttgaatagtcggttgacgctgtgagatagatataaacctcgtctgcgtgttcgaccattatgctgtcttttgcgtcgataagctctccgcccttgtttaccaccttgaaaacggtgcagtagcgaagtccgttatcccataacgcaccctcatatgtgagcgtatcaccgttcgccgtaacgcttccgcactggagattgtcaagcgacagctttacgcatatcctgcgaggcttgtcagagcttagcttaatgcagataacatttgaaggataatttgcaaaagcctctctcttatgaacagcaccctgatatgtaaactgtgttgtgaatatagaattgtcaaggtcgagcgttcttgtataatcggtcgcctgagtttcgtctatgttggagaaagtgagcatcatatcgcataaaagctgataagcaccgtatccgtccgttgcacctgtcagatgggggagaagtgcaaccgcctcgtcatactttccgtcatagagaagctgctgtacctgcttaacatactcatagctaccgtctataataccgccgttgtaatccggacggctttccgaaggaccgcctgcccacagcgttttttcattcagcactattttttcctttgaaatgccgccgaagaaacttgctcccatatagccgtttccgataggctgacattgctgctcccacttgtcaaattcaccgggagctgtaaacagtattttgttttgcataagatttcatacctttctataagcgtttttaacgcttaaaaccgcataggcagaagccatgcggtttataataccactattatacattaacctgacacaaatgtcaacaacacattgccgatcggggtgagttaatcgagtaaatatcttgtttcaagcatttttgtgagaagcccgaaataatctgttccagccgcctgtgccgccataagcatatagtatttctaccgtataagtctgtgtacctttcttctcagccatttttcgtaaacgtaggaaagctggctcaggcacacatcatagcagacaaatgtaaagtttccgataagccagaaagcaagcaccgcaaactgtccgaatcctgcgaaatcttcaataagctgtcccataccaagcacgttcagaagcagtgcgtatatcgcaacaacagggacgttgaaacaaataaaacgcagaaggaatgacagcactgcaggctttacttttgtgagcaggtcacggataacgggataatatccgaagaatcccgtgaacagcagctttgactctatatccggtgtcagaagcagtgcaagtaaagctacagccgcatagcaaagaagcgcccatttcctgcttatttcacggtatattatccatacgacaagacctgccaccgcaggaagtatatatacgcctatcgggataaatccggtgcagaacataagcacgatacatatagcgctcagtattccgctcagtgcaatggcatagcttcttgtcttttttgttgaaggcatattatacttttctccttgcgtgttctgcgtaaagctcattgctcttttctttacgctctctgccgtcacggagtatatcacgaagtctttcggtatcatcgtcgccgatagcgtccctgtactcgcacagattgtcaatgatggtgttcagttcgaacagcagtgcttccttattacaaaggaacagactgctccacatatattcgttcagctttgcgacacgggtaagatccataaaactgcctgccgagaaaccgtctgcattgaatagcgacgggcttttgacataagcgtttgaaacaacgtgcgccagctgtgaagtaaaggctatgtttatatcgtgctgttttggtgttgcggtaacgaccttgccgaagcccatacagcaggcaagcgttgacaagaggtcgatagccattttaggtgtgttttccgagggtgtgattatatagctcgcacctttgaacagatcgtcggtcgaatagtcaaaaccggaaaactcacggcctgccatagggtgactgccgacaaatataactccgagcggttcaagcacctcggtacagcgtgtaaccacatattcctttacaccgcaggagtctgtgacaatagagccgggcttgaatctgtccttgtgctgttttacgaattcaacgatagtttcgggataaaggcagagcatagtcatatcagcgtcattaagtccgtccgctgttattatctcgtctattgcgccgctgtcgagagcctttctgcatacctcgccgtcagcgtcaagtcccattatatgatgaaatgtatttttcttcagtgccttgcagacagagccgcctatcagaccaagacctactattgctattttcatttttgtccttctttcagtgcgttaaacaattatatcaggctgttgataaacctgtaaatttttattagaaatggggtgtttagtgttgcttgctctgctggttttgcatcgtgcaaaacttttggcaagcaaccaaagcatccttgctttgggcgtagccccaatgcggttcgtcagtcgttagtgtcgctgcatcgtgcagcgactgtgagcgactgactgcaagcgtcattgcttggtgagggcggcagccccacattcagcccggcacggacgccgggcgtgtatgcccaaaggctctgcacgatgcagagccaacaaagcatacacagcctttcacaccaccatccctcgccccgcaccaacccttccaaaaacccacactatccctctcgcttttcgtaggggaggggcttgcccctcccgttgcaccgaatactgccaccctcacaaccattgcaaaaggacaataatccctcgccccgcactatcccttgctttgcaccacattcttgccatatgaacgctctgttggttttgcatccatgcctcgtcagccattagtgtcgctgcgtcctgcagcgactaagtgtggctgactttaatcatccttgcttaaaactttgggcgttcaacttcgggcatccatgcccgtcccttgtcaaaggtgaggtgctgtcgcccgaaaaaattcgggcgactaccggagggattgccacaccactatcccactcgcttttcgtagggcgagtgtctgtgtgtgcttatacggtttcgcatccgcactatcacatctcgcttttcgtagggtgagcgtctgtgtgtgcttagttggctttgcgtccttgcaaagcccttgggcacacacgcttaaggcatccttgccttgcttgttcctcccgaaacatcattgtaattataaaaaacaattcaaaagaaatccgatgtaaaaacgtaatctcaatttaatccttgatacttaacagattaaaaacgctgtgaaaatcaaaaacttcgattcagcgggaggggcaagcccactcccctacaaactcaccatacacaaaaatccgctatcccacaccaacccttccaaaaaccgcactatccctcgaaaatcgccaacacacttgcctcttaatgaacgctctgtttgtttcgcatccttgcctcgtcagccattagtgccgttgcaccaaataccgcccttgtccaagacaacaattaacccgaatcggaaagcatcaaaaagaatccccgctgcctgttttggcaatggggattcggtcttgtatatcggttttactttaagtatttacccacatcgacagcaggcgcagaggtttcgggtgcgggattacccgagcagtcaagcgtatatccgccgaccgaaattccggttatttcgccgttgccgtcaagcgtcagcgtatagctgttatcgcctgtcgtgccgcttaaggtcagcttgtcggtacctttacgggcggtgacgttttctgctgttcctgcactgtcaatgcactgcgtgagaagctctgcggctgaggcaaactgcggcgaggaactgccgtattcatactctatcccgtcaaggctgtaccttacggtgttgccgtcatcggtcacggtaagccccttcacgctgtccggagaagtaaagcttacggtccatacacctgcactgcgggtaaactccgcctgtgccgtaacgccgtcgcaggcgaccctgccgctgacgctcatatctcccttcagatcggggatttccgccttttcggcggcagcgcaggatgtgcataaaaggcaggataaaacggctgtcgtgataatcattcttttactcataatacgtcgtcctttgtaaagtaatataggacaacgtgaggagttaagctattccgtagaattcacgcaggatatatgggtaaagctgcggcagctctgacggcagaattccgctcatactgcgttcccgtgcggcatactgtgcggataagccgaaaagatacgctccgagccttaccgcattgcccgtttcaatgccctgtgcaagcagtccgccgatagttcctgcaagcgtatcaccgcttccgcccttggctaaagccgcattaccgctcatatttacggcgatgaatccgtccggggcggcatatacggagtatgcgtccttgagcagaacgtgaacaccgtattttacagagaaatctttggcacagctcagcttgtgacggaggatgtagtcggtgtcaagtccgctcagcctgctgaattccttgatgtgaggggtaagtatgagcctgcctgtgttgtccttcagctcatttatatgcggagcgagggaatttattccatctgcgtcgataactatcgggcaggatgtattgtcaatcaaggcacagagcagacggtaggcttcgtcgctgttgcctaccccgcatccgaacaggattgcagtggcggtacgggcgtttttgcacagcttgtccgcacagtccgaagtaagcgttttactgccgagcggaaggtagatacattcgtgtaacgaggtggcaacgcttgttgtgacctcgctcaccgaggcaagcgtaacaagccctgaaccagttcgcagagctgcattagtggacatccacgccgccccgatacagctctcgctgcccgaaacattcagcagccttccgaacgttcccttgtgggtgatacggcttcggttgacaaagtgggaggcgaggaaatcgccgttcagctcggcatcatattcgctgaagcaggcctcggatatgcctatgtcgagcagtacaatatcgcccgaaaactcactgcaggggacgtaaagctgacccgtttttacggctccgagcgcaaaggtcatatccgcacgaaacgagtattcatcggcattcccgtcggttgcgttacagccggaagcgatgtcggcacagaagcgcagggcggcgctcccgttgcagtaggagaagagccttctgaccgggggagcaagctcgccgtggaagcctgtgccgtagacgcaatcaatgatgatgccgcaggagccaagctcactcagcaccgtttccggttggtcggggtagcttaaaacggcttcgtaatcgggtttgtactcgttaaagcagtctatggcgaggtcggttttcggggcggagccgacgaggactatgaggggggagaagccccgtttacgcagattatgggcaactgcgaagccgtcgccgccgttgtttccgcttccgacaaggacagccgcacggcagggctttacgatacgggagatgtgaagggcgatggcagagcctacattccgcataagaacggcacacgacgtgcctttctgctcacacatcgcttccgcttttttcatctgtgacggagttacaacatactgttttgccataaaaacttcctttcagaaaatggcaggtgagcatttttctccctgccattgatttacaatcacacctgatgattcagaaaacgctaagtggcttacctatcacgaaaagtaaggcaccaatgatgcgtcagggtgatgaataatgtagtttttgaaaacacggtgttttttgactcggtaaaaggcaaataataacattatttcagcttatagaaaaagtctttttttataaaaatagagcaaattctctacccctaaccccaaaccccttccccgtgggaaggggctatattacaggggctaccgcccctagaccctgtcgggggctacgcccctgcgaccccttttttatcaacgatagaggtttttcgacagactgaaataataacattatttctgctttttgtcatccgtgtttttgcagtcggaatttttgttcttgacgaagattttcttaatatctttaagctcgtgcttttccttttcctttttcatataaggggggtgagggaaatagaccggctcgtttgtttcgtcatctatatggtggatgtcacggtacacgtttgagtcggagggaaggtctttattttcgagtcgttttttgaccctgttttttgtgaagctgtatacaacggcgaacaggggtataccgatgataaggccgacaaagccgaacaagccctgaccgacaagcataccgaagatgacccagaagctcgaaagaccggtcgagtcgccgataatcttcggggcgaggacgttaccgtcaatattctggatgataacgaccataatggtgaaatagatgcactggatcgggtcaacgaggacgagcaacaacatacacgggatatatcctataaacggtccgaagtaggggatgatgcagaatatacccataacaacgccgcagagtacggcatagggcatattgaagatgctcataagcagtacatagaccataccgataataaagctgtcgagtatcttacctgtgataaactgaccgaaggacttgttaacctcacgggtgctgttgataatctttgtagcaaccttaggcttgaacaggcagtagaggatctttttgaactgagcggcgaaaagctccttgctgttgaggaagtagatggcaataacgaagccgagcaggagattcataaacacgctgattatgttcatgacgttggacgaaatcagattccatatattgttcatctgaggaagaagctcggttgacagccagttgttgagcatatcggaaataccgccggtgaactggaggacataagcctctacctcggggtagtttctgagggtctgcgatacccagtcgcttatctgcgtaacgtatgtcggcatattgtttacgagcatagtaatagtgtcgataagctgagggagaagtacccagattatacctgtgagtataagcagggcaagaatcatagttatagccacgctcataactcttgcgaccttgcggacggggaaggtcttgggcggcggttcttcgccggggtgttcacgctcgaacttttcacgctttttgtcctgtattgtatagaacaatctgcgcaggcacggcttttcgatgaaagtcgctatcgggcataggatatatgctataacaaagccgtataggacgggtgtcagtatagacaggaacgagaagatgctgtcgagtatttctttaatctgtgacagaccgaggaagaacacgatagcggcggcgataacgaggaatgcggtcactccccagtagagatattttttatcccatttgaagttcattacatcacacctttatgttgatatggaagttactgcttttattatagaattatcggcggaagttgtcaagggtatacagggaggaaatgaatgttggatgatgaataacgggaaaatgaggggtgatggttgtggaagggttggtgtggggtgaaggatggatgtgcttttgagaaggttgtggggatggagaggttggtgggcgatccctcagtcttgcgacagatagggctgagcgaatattaacgttgatgaaatcgcagaatgttgcaatttataataagaaatagccttgtcgcaatccagctccctttggcaagggagccaagcatgtggtgctaagcgtgggacggtgcggttttgggatgattggtaaagcactatcacctttagctcccttgtgtaaaggtgagcttctgttgcagtgcgaagcactgccaactattgagggattgttaacggaggtgtctgagaaacgggaagggtgcggtagaaaagcaatccctccggtagtcgcccgaattttttcgggcgacagcacctcacctttgacaagggaggcaaggatattgtgcggggcgaggggatagtgcggaaaatctcattgatggtgcggatggggagcaatccccaccgtcacggctcggaatagtttcagaattgtaaaggcaggattacctgaatactgtacagcaagccaaaaaattatatcagccgtgccacctcccctttttcgaggggaggcaagagtgatggcgattttcgtgggatagtgcggttttggaagggttggtgaggagagaggggacagtgcggatgcaaaaccaacggaacgttcattaaaaggcaagagtgtggtgcggggagaggcgatggatgtgctttggagaaggttgtggggatggagaggttggtgagcgatccctcagtcttgcgacagatagggctgagcgaatattaacgttgatgaaatcgcagaatgttgcaatttataataagaaatagccttgtcgcaatccagctccctttggcaagggacgggcatggatgcccgaagttgaacgcccagagtttcgctaggatgcgaaactggcagagcgttcatatggcaagaatgtggtgctaagcgtgggatagtgcggttttggaagggttggtaaagcactatcacctttagctcccttgtgtaaaggtgagcttctgttgcagtgcgaagcactgccaactattgagggatcgttaacggaggtgtctgagaaacggaaagggtgcggtagaaaagcaatctctccggtagtcgcccgaatttttttgggcgacagcacatcacctttgacaagggaggcatggatgcccaaagttgaacgcccagagttttaagcatggctgacgaggcaatgtgatgcgaaaccaacagagcgttcatatggcaagaatgtggtgctgagcgaagggtggtatagcaatccctccgtcttgacggcaaaaagtttggtgaataaaaaaggcggatgtatcgcaagcaaaacacaacaaagcgacagtttgtgccttgccgtcaatccacctccctttaacaagggaggcaagtttagtgcgaggcgaggggatagtgcggaaaatctcattgatggtgcggatggggagcaatccccaccgtcacggctcggaatagtttgtcctgatccctttggttgtctccctctttcatattgacaggtgtacccactcgaatagcgaacccgagaagtgctatccgacaaattgcactatcggtagcctattatcatagtcagggctgaatgatacaacagaagtatatcccaatgaaagactttttcgacagactgaagcgggacgcatcgtgtggtgcgtcccgcttttaatatcttagtcaaaataaaatcagttctggttcttgctgattttgtcgattttttctgaggtctgtgcgatttttgagctgagcgattttactgtagagatgttggtttcaatctttcctaccgctaaggtaatctccttatcgatagcggaaattgatgaacggacactgccaagcacatcttcaatgctccgtgtctggttggaggtctgctcggcaagctgtcttacctcctgcgctattacgttgaagcctgcgcctgcctcgccgacgtgctttgcttcaatagacgcattgaagccgagcagggtcatctgtgtagcgacattctgtatgtacttaagtatagagtcggtctgtgcgacagcctttgctgactcggaagccttttcacgaagtgtgtcgaactctgcggtaagaacttcgatagaggaattgagatcgtcaacgtttccgtttatatcctcgtagtcggagcgtacttcatcgaaaagaatatccgcttctttatgctcctcggttatgtggtacttttcgtagccgacctgcgaaagcgcctgagccatcttgtataaaagctcggcggcgttgtttaccttttcttcggaaactatcggcactttctttacagcctctacatattcatcgggatcaacgtcaatctcctttgctattgcacggaacttgtcaagatccggttcttcggtaagcacctgtccgcctataagcgagccgatctgtttgccgtttacgattatcggggaagcaaaatcgacaagtccgccgtggcaataatataccgcaggcttacctgttctgcttgcctgctcgccgcccttaaggtcgcagaggttgcaacgctcacagcctacgctcgattttctcgtatagttcatacagaaatcggtaggacatgaaagctgggtaaccggaccgcttttatctgtagccaatgcagccataccggtagcctttgcaaatgcgtcctgcagtgattgcagctgcgctctgtctataacgtcaagtaaagtaacttctttttcagccattgtaatgacacctttccttttctatgttgtacaaggcggactattgtttatgaaaatctgtgaaaacaactgcctcaattaagattatactccgatttagataaaaatgcaataccaacggagagtgattttgttaaaatgaacaagagaaattgaaatatttagttattatttccgatttttctttcttcgacataaaggcagacaaattttgcttgattttgaaaacgaaatatgatatatttttaaataggaataagaaactataaaaatagccacatactgaaaatcagactgcgtggctgaaaggcggaaaaaacatgaagatcctttatgcagcaagcgaagctcagccggtagcggcttcgggcggacttgcggatgttgcaggctcacttcccaaagcgctcgttgaagaaggccatgaggcttgcgttgtagtacctctctatgtgaatacgataaaacagcagtggcgtgatcagatgacgtatgttactaatttttctgtgccggtaggctggagaaatcagtattgcggactttttacggcaaagataaataatgttacatattattttcttgataacgagtattatttcaagcgtgatttcggactttacggttattatgacgatgcggaaagatatgctttcttctcccgtgccgttcttgaaatgctcaaggtcatcgacttcaagccgcagataataaattctaacgactggcagtgcgctcttatacctgtatactacagcattttctacagaaacgatgaaaagctgtggggcataaagaatgtatttactatacacaacattcagtaccagggcagatacggtatggagatacttgaggatgttctgggtatacccaagcacttcgcttcacttatggaatatgacagggatataaaccttatgaaagccgctattgaggttgcggacaaggtcacaacggtatctccgacatattcgaaggaaatactcgacccgtggttctcgcacggtcttgacagagcactttcagacaagcagtacaagacctgcggtttcctgaacggcatagacactgatatgtataaccctgctacagatccttccatccctgcaaacttcacggtttcgaagaaggcaggcaagaagatatgcacgcagaagctgcttgaagaagtaggacttcctcagggtgacgagccggttctcggtatggtatcaagacttgttgagcataagggctttgatcttgtaaagtgtgtgtttgatgatataataaatctcggctacaaggtagttatattaggctcgggcgaggctcagtacgagcagttcttccacgagatgcgctggaaatatcccgacagagtggcgttcacctgcggatatatccctgaccttgcaaagaaaatctatgccggagcgaatatgttccttatgcccagtaagagcgagccgtgcggacttgcacagatgatctctctgcgttacggcactatcccgatagtacgcaaaacgggcggtcttgctgacagcatagttgactgcggagatgagaacggtacaggctacacctttcagtcatataacgctcacgatatgctctatgcggtaaagagagcgaaggattgctactggaacaagacagagtggaacaagctggttaccagagctatgaaggcggatttcagctggaagcagtcggctaagctgtatatcggtctttacaaggagcttgtaggagagcagtaagcgataaaaatcaatatgtacgggcagtcgcttctatgaaacgtcactgcccgtcattcgtgtaaccggaaaagttaatgtgttaaaagagaaagaggacagaaaatgttaattgcgataatcgctcttgtgataggcgctgcgctgtatgttgtgaacatggtcggcgtgaacatcaatgcaaatgttatatgctcgctcggcgtgctgatagtgggattcgctatgctgataaagggtgcggatctgtttgtcgagggtgcgtcaaaaattgcggctaaatttaaaatcccgcagatagtaataggtcttacgatagtggcgatgggtacttctgcacctgaggcggctatcagtataagtgcggcatttcaggatgcggcggctatttcgataggtaacgtggtgggcagtaatattatgaacatactgctgatactcggcgtcagcgcagtgattacaaaccttaagataaagccgaacacgcttaaatttgagataccgtttgttgtgctaataaccgctgtattactgctgctcggctggataggcggagggcttgacaagatagacggcgtgattatgctggtgctttttgcggcgttcttaggctatctgttctacctttacaagaagggtgacgacagttcggcagatgaagtgccgcaacttaccgaaaaggacaagatacctgttctgatacttatcactcttataggacttgtgagcatcgtactcggaagcgaccttacggttgcgtccgcaaagagcatagcgcaggtaataggagtggacgacagaactatctcgctgaccgttgttgcattcggcacatcgctgccggagcttataacctgcattgcggcttcgctcaagaagaaatccgatattgctataggcaatataatcggcagtaacattttcaatatcttgttcgttgtaggtctggcgtcaatatgctcgccgagcgtactgaccttcggtgaggcatttatcattgatactatagttgcgatagctactgctgtactgctgggtctgctcgttttacgcaaaaaggagcttacaaaagcgggcggtataattatgctcgttgcttacgcaggatattttgcgtatctttttattaacccgttagggcttgcatgataggagaaaatatggtatttgaaaaaataagaaaagctgaccgtgaagaatatctcgctatggagcatgatttctatcattctcccgctgtgcttcaccctatccccgatgaaaatcataagctgacattcgatatgcttatggaaggctcaccgtatacggtctgctttatgttccgcagtgacgataaaaaagagatttacggctttgcactgcttgcacttacttattcaaacgaggcgggcggtattgtggtatggcttgaggagatatatgtaaagccggagcatcgctgtaaaggtataacaggagaattttttaagtttattgaaaaggaatatgccgatgttgcaagaatccgtcttgaaacagagcctgacaacgaaagagcggtaaggctgtacgaaagaaacggattcacaaaactcggttattcgcagatgtataaaggcaattaacttaaaaaacgtgtaaacggtgtgaaaacgcaaaattcgttgttgtttatccacaaaaaagttttcaaagtttggattaactaatggttgattgacggtcgtgaatttggtataatataggagtattaagcggtgttataatgccgtatcggaggtacattatatgaagaaaacgaccaaaaagatttcagcggccgctcttgctcttataatgggtgcgacagcgtttacgggttgctcgggaagtacgaattccacacccggcggaacggacagcgccgcatcaacaagcggcggagcagctaccggcagtcagaagataatgtcttctaacgaaaatgtaaagagtgccgtagacaacgtttctgtagcggaagactacaagaatattaaggttgatacgaaactcaagttcatggcgtggtatgatattcaagaggcatcgcctgcggtagagcttttcaagacgctttacggaactcctaagaacaagcccgagggttatgaatcagtggctgacgaaaatgttttcgtaaatgttaaggtttccaactacaacaacagataccttgaccttgcaaagctggttcagtcggatgaatcacccgatacattcccttttgaaacatccaactatccttacggaatttatcagaaccttttccagacaatcgacggtgttgttgatacaaatactgaggattgggttgattataagccgatcatagacaagttcaactggggcggtaaggtttatacgcctattgttgacgtaaaccccgcaactctgctctggtacagaaagtccatcattgaagaaaacggctttgacgatccttgggagctgtttgaaaagggcgagtggacatggtcaaagtgcatcgaaatggcaagaaagttcacagatcccgacaacgcaaagtatgcgtttgacggttacggccttgaccacgcatttatcgctacaacaggtaagccccttatcggtcttgagaacggtaagctggtaagcaacctctatgatgcaaacatcgaaaagtgcatggatatgctccgtacattcgatgatactcaggaacagctccgttatcccagagagatagaaaacaactggacacccagctataatgaatgggctgacggcaatacgctcttcattgaggacggcacatggagatatgaagaaacctggagaaagttcaagaagaaaaacaagtgggaagatgatgagataaactttgtacccttcccctagatggacggtgcggatacatattatcaggaaatgaaacaggacgcttatatgttcgtttcgggttcaaagaatgctgacggttataaggcgtggatatatgctaacctgttatcatctaaggacgaggaagtaaagaaggccggaagacagcagtctattgatgagttcgactggaatgaaacacttcttgacaggcttgataagctgaaggatcctgctacatttgaatcggtatttgagttcaagaacggtataggtcctgatatagctgactctacaaacggtgaaaacgcagtgggccatctcacatcagacgttataatgggcggtaattcgttcactacagtccgtgaagaaaacaagggcgtaattgaagcaagaatcaaggagcttaacgctactgtttcctaaaccgaaaaatcaatacagatataatgccgacggcttttgccgtcggcatttcagcttgtagaaaaagtcttgtatttgatgtacttctgttatatcattcagttttgactatgataatggctaccggtagttctgtttgtcggacagcacttctcgggttcgctattcgaatgggtacacttgtcaatatgaaagagggagacaaccaaagggatcaggacaagggacttgacagcccctctccctgtcccttaggttttctccctcttgttactggggctaccgcccctagaccaagcaaggatgcttgcagtcagccacacaaagccactgcacgatgcagtggcacaaatggctgacgacctgtacgggggctacgccccaaaccccattttcaaaaattatataggtttatcggcagtctgaagcaccccgacacagcggggtgctttttatttatcatacatcgttttgcaaatcgccggcagacacaccatagatcagagcgtgtatttatcaccgttattcttgattttacctcccgttaccgccttatcgactgcgaactcgactgtagaggtcatcaccgcaccgagccttgtgtatccgaatttctttgcggtctcacggataaggtcggctcttgaaagccctatctgctctgaaagcacctccgtcacagcggagattatttcttccgacgggatttccgtaagctcccttttgttgccctgaatatcggcaggacgataaatgtcataagtatcggggttttgcttgccgagccagaagaaagcattgttctcatcaatcgttatacgcttgtcgatcattctgaacacatcggcaagcaccttgtccgtacggtcgccgcttcttgttatgccccacgcacctatcagcttatgcacaagagcgttacggcttatcggcgcttctgccgacaaaataagcactgcaagtgactgtataacaggaaccgtttcgggaagataaaactgttcgggcgttccgacaggcgctatatctgccgtttcatacagcgttgccttattcggcgcaggtgttttctcgaccgtttcaaataccggtgcctgctttgtctttacttccccgacaggcttttcctgcggatgctgtgcattttcaacagcctgctttatgtgctgtaaaactccgttgctgtcgtcaagccagtcgagcgtccatacacgcattacactccagccaagcccctcaagcacgccgggctgaaccgcaaatctgtcccttgcggttgcgcttctgtggcagttttcaccgtcaagcataataccgagaatatatgtttcgggattttcgggatcaattatacctatatccattctgaactgcgaacagcctatgttgcacctcgtcttatatccgagcgtttcaatgccattcgctatctcgcttacaaggctgtcatccgcttttgcgaacatatccgtgcgtcctgcgattacattcgtacctctcgttgcaaactcaaggaagcccttaagccccgcaacaccctccgagcgtgttctcgtaaggtctatctgctcaggacgcagaacggaataaactatcatttcctttcttgcccttgagattgcaacattaagccttctccatccgccgtcacggttaagcggaccgaagttcatcgaaacctttccgttttcatcaggaccgtagccaaccgagaacagtataacgtcacgctcgtcaccctgtacattttcaaggtttttgataaacacaggctcgtcacactttgcgtcaaaatcagctatatccgggttcttcgcaaatgcgtcaaccagcatatcgtcgataagattctgctgaacagagctgaacgttactacgcctatgctgtcattcctcagcttttcatcgctcagcctgcggataatttcattgactatagcctccgcttcagccttgttctgctttgtcttgcccttgtcatagaagccttccggacggataagccttacctgcgatacaaggtcgttcggtgacgggaacgtatacagcttattgtcataatacttcatattgctgtatgcgataaggctctcgtgccgtgagcggtagtgccacttgagatacatctgcggcatagagattgcaaggcagtcgtccagcaggctctccagatcctcaagctcgctgttgtcctcgtcaatacggttgcttgtaaagaatgacgtaggcggcagctgcttcgggtcgcctactataacgacattctcgccccttgctatagtgccgacagcctcgcttgtcggaagctgtgacgcttcatcaaatatcacaaggtcgaatttcgggaatgacgggtcgatatactgtgccactgagatagggctcataagcatacacgggcagagccttctgagcagtgtcggtatctgatcgaacagctttctgagcggcatcattctgccgttattttttatagccttcttcagtattcccatctcggaggatgcggcgctcgtaccgtctgatacgggtatatttgccgacagccttgccgcaagctcctgcatagtgagcctctgatattcttttatcgttcttctgtattcgtcaatcagagcgtcatactgctttccgttgaaggaggcaagacgcttgtctgcggcgatagtcataagtgccagctgataataaagctcgcagtgataagccggtcttatattatctgccgatacagtgccgtttttataggcacggctcacagccgcaagccctgcgtcacaaagccgcttatccgccaagttgaacgccgccttgctctttacaagcgaaatattgtccgaaatcgccttaaataccgagttgacgcttgtaagccaatcggcgctttcttcaaattccgtgttcaccgaataaagttcagccagtctgtcggatttttccgtatagcttcttaccgcctcaagatttttcgcacatccggcaatttcctgcggtgaacattttacgaacacgttcataatatgctgtttttcgctgtcgctgaatctgtctgaagccgccgccccataaactgcctctgtcttatgcaccgcccttgcaagcatatcccagtcggtcgccataccggacaatattccgcccgttatattaagcgtcgggattatctgccccatctgctccgatttttccgacagttcaatcagcctgtcatacaaagggcatacatcgctctttttaaatgcggcaggatttttactgtagactttaagttccttatacagcctgttctgacctatcagcttcggtaaaaaccacttagcctctgcctgtttccatttcacccttgcgctttgtgcaggatatgaaagcacagccttgtcaaagccgttttcgatttcggcacaaagcgcattgtatgcttttcccgtttcacacagcgttttcagctttgaaacgacagcgtcaaaatccgccgtacccaatatctcgtttattacaggtgcgtcctcgccgcaggcgtctatcagacccgatacggcgttcagcttttcacggctgatatttccgtcaaggccgacagcagatgctataaggttcagtgcctcgtctgccctgccgtattcctctgcaagtctgtcaaggccgtttttgaagctgtcacgcatttctgtggaatattcacatccgccgtatcttataagcggatgctgtgcataaacacctatctcggatattgcgacaacatattccgatataatttcctcaaatcgtgcgatcgtaccttcgtcggcattttgcaaaacatctctgccgatagatatttttcccttttcagccatacactgctcatagcgttcgatagccgtatacagcgattcaccgaaattgcgcttttcgtgcagagcctctatcacaaagttcagctttgccttttcctgtgccagcttctgtgcaactgcggcgtgttgttcgggagattttacccttgccgtttcaagcgacttgttaagttccgctaaaacaacggatttacttgtcttgttggagtgaagctcaaggcagaacgggtcaagcccgatatttgcaagacgcttctgtacaacgctcagcgccgccattttctccgccacaaacagaacgctttttccgtgataaagcgcattcgctatcatattggtgatggtctgcgatttacccgttccgggaggaccgtgaagcacaaagctccttcctgccgatgccgcaaccaccgcactcagctgtgaagaatctgcgtcaacggggacagcaatatccgtaagcgatattttgctgtcaatatcggtatccgcaataaagtcccccgtcagcgcttcacttgtcgcaccttccataaggcaggataccaccttgttgcttttaagttcgtcactgcgatttcttatatcgttccacattacaaactgaccgaagctgaacagcccgataaaactgtgttcgataatattccacgtttttttgcccattatcgcctgtcttacggtattgaaaacaagcggcaggtcaatgccatgctcgtcttcgggcagagggtcaagaccgtttatctcaatgccgtgatcctgccgtaaatattctatcatcgttacgtttatctgagcgtcttcctgacggcttctgattatataacctttgtcacggacatttctgactatatctatcggtataagcacaagaggcgcatatctcgccttttccgacatttcactttcaaaccacctgagcattccgagcgacaggaacagcgtgttcgagccgttctcctccatgctcaccttagccgcacggtacagcttcttaaggctctcctcaagctctgctgcgtccatgaacgtccttatcctcttgtttttcagttcctgctcggctatattccttacaaggtccttatcggtttctatctcaaacgttttagcgtcacgcatagaaaccgtccactctgacggtgcctcaaggatgcggaaatccgttccgtcagacagcttatcttcaagaagcgacagatccgacaccataatttcgaccgtgcttttatttattctgaaattcagcagagaatttctcagagaaaaatcaagcagctttctttcccatattttctgctttgtcataggctcgttactgccctgcgccacttttccgtacagcgacatatcaagctcgctcggtgcgctcattcttatacgccttgcaccgtcgctctccgtgttttcagccgtcagagcctgttcgagtctcagcggtatcggacggataccgcttcctcttgtacgggcaatatcgaccgcacatataaaactgcccggtgtattcatatgatccctgccgtgcttcagcgacttgtcaaagtcaacattctcctttgtcatatccgtgcattccacgagcagaagctcctccgcccctgccgcaatacgcttttctatagccgacacatcatcggtagcacagtccgcaaaggtttcctcctcaagatgacagccgcagaaagcatgaccctctatgaatataatgatagggttaagacctacagcctcaaggcaggatgcatacagcaccgcaagatcaagacaggtgccctgcttctgctccagcacggtatttgcaagacgtatcttctgccctatatattcaaagctggcaggcggcatattgtacgctatccttcttgcacacagcgccgcatataaagccgccatctgctgttttacgaagttcggattctgccgctgatatgcgctgaaggcagtagtatccgcccactttttaaggtagaccgatgcctctgatatgactttcgctatctccgggtgattcggtgtcacaaatgccgcaataagctccgggtcaaacgcaagaccgctccattcgttgaacgcaagcagctgaacgggaatatccttttggtaaagctctttttcgtcttttgaaagcgaaaagctcacggtacccgacactgcctccgtcagtgaaaacagcatttccgtgctgagaattatcctcagcggtgaaatttcaaccgactttcccgacggcacacagcttatatcgtatgtgaaggtctttgcaaaagccgggtcaaaagcgatagtaagccttacatcgcttatatcctcatcgccctcgttgccgacggtaaggtttcttatgaaaggtatgtaattctgttgcattgcgaaattgattttcggtatcatatcgcagcccagtgtcagtacagcgcccatgtaacaccatccttgattcaaaatagtttccgctgttaacggcatcagttaaattatactactatattcaatacctgtcaataaaacatcgaccccgacagaaaactctgtcggggtcgtgctatgccaaaaaacaattattattaaagttgaacatctaaacataccgccaacaccgcttaaaacattttccgtaccgacaaggcatttatattttcgtgagtgtatcagtgcaactgcactgacatttacctttcaaaaaaacgccactagccttagatatatgtactaacctgcggacatgtagcgttaagcgtccatgcacttacaggatatacaatgttccggtggtcatacgagttccgctaacaccccagcggggtacgggtgtaggtaatgaaagagggatgccacgctgagcattgctttagcaatgctcccgctcctcacgtcgctcaagaggaataactgatttgggagaaaacctaaggccatagcggcggaaattcgcgccagcgtgtccattgatacggtttcattcttgcccattttcgcaagtacgcttgtactgatacccgcttttttccgcatttcggttttcgtgatgcctttatcaatcaacagtttccaaagcctgttataactaaccgccattgcgtcaacctcccatagcttataaaagtacaagatatagtatagcacaaaggcggttaaaagtcaacatattatctgcgtttggaaacattccgtctgtttctgtttcaattctgccttgcccgtctgctacaatacagggtcaagtcctctttgtagccctcgaacgtgtcaatgcgggttatatcgtacagaacgcccctgtaccgcacgacgcaggcggttgttaaatccgtgcggtagtttatcgtgaacagcactttttccttgtaattggtcgttgccgccgcaaaaacttctttgccggaaagctgccggaaatacgcccacagcggcgcgtctacaggttcaagggtcgtcgttgcgaacccctcattgtcgcgtaccgtgtgcggagctaatatctcgattttcttgtctttcagtttcatgccgtcgccccctttatattgcggtcgtgtattagttgtaatgctcatatagcccgacgtaacagtcaagcagcgccgttgtattttgtcggagcggtattcttcatctcattttcaaaatcttcatcctttacataaattccgctgttgttgtgatataagaaaaaagtgtacggaacaataaaatcatcggaaagacctattacattaagtacgatgtcgcctttatcatcgggaatgataagcctgtcaccgatatttataccgcagtcgttttcggcaataatagccttgctgtcacccttcaactcatcttccgtgaaaaatctgccgtcggttatgttatagtcggattgtatgaagcggtacagttctttcatgcttttgttaaaagcaactttggctgattctgtacagatgtagttttcggttgagcgatagctgacaaccgcattgtcggcataggcagtgtagacttcaggcaggttttctctgaaaaattcgggtgaatcttcgggcataataccgtcaaagcagtagcctgaacgatccatcatgttgtgatatgccgcattaccgctgttcaatgcacagaacaaagaaataaatgtaaagacagccgaaacagagataagaaaaataagtatattcagcttgatatcacttttgagaaatgttttcagcatactgaaataaagcttttgatatttcaattattcttctccttttcataatatatttccgttaagattgtcagcaagcgacaaactaactgtactatcagaattagtacagatttagtatagcgcagaatgctgaaaatgtcaatagcggttaaaaaaatagcaggcggaaaaccgcctgccttaataatcacagaacatcacagttcaaaatgccgaaaacggatatttttgcaaaatcattatccatactgtcgcaggcggtttcttctgagctttcgctaccggtatcaccgccgctgaaaagcccctgcaacgcttcaaatatcgcaaactttatttcataatcacggctttcttcaacccgcttgctctgttcttcggtaaaaaattcacctgatgcggcaggaaggcacagcggtgggaacattacgcaccaccagtttctaccctctgcatttccgataagcaggcggacggctgtgtattctcctgccggtaaggttacattctcgtactttctggtggtaaaatatgtttttgcgacctcgcattttacattgtagctgtagcctttggaatgtacaaattcgttagccttttcttcgatttcggctctgcgttcgtttgcaacggctaccgattgactgaagctgtcacagtttccgaatacatccgaaaacgttgtcagcatatagtcacgcagatcgtatttcagcgtctggtcgtccttgctgtccgagtttgccagtatatgaagcctcagcacttcctgcggcttttcctcacaatcctccgcaaatgcggtaaaggctgttattacaatacatattaccgcacccagtatcatagccttgtcaagaatattacgtttaaaaaaacctgccataattacctccgtagcgtttagctttgtgaggtaattattgacaggttggtttcatttattcgcagataagactttatttcagattttctatctgacttaaccacagcgttgcacaggcatcgctcggcattctccagtcgcctctgggtgacagcgttaccgatccgaccttaggaccgtcgggcaggcacgaacgcttgaactgctgtgagaagaaacggcggtagaaggttttcagccatttcagtattgtttcacggtcatacgcaccgtcaaaagcgtacagcgcaagcctgaatactttttcgggggtaaatccccatcttatgccgttgtacaggaagaaatcgtgaagctcgtaaggacctacaaggtcttcggttttctgcgatatttctccgttatgtgcaggcagaagctcggggcttacaggcgtatcaagtatatcctcaagcgattctttgagcagcttgttatctgtcgtcttgctgtagtagctgacaagatgtttgataagcgtcttgggtattgagcagttcacaccgtacatagacatatgatcgccgttgtaggtcgcccagccgagagcaagctcggacagatcgcccgtgcctattacaagtccgcccgtctgattggcgatgttcataagcacctttgtgcgttctcttgcctgaccgttttcaaatactaccgatagatcgtttatatcgtgtccgatgtccagaaaatgctgttttacgctgtcggttatgtcgatctcacgcagggtgacgcctattgcctcgcatatcttcacagcgtttgattttgtgcgttttgttgtgccgaagcacggcattgtcaccgctacaatatccgtcataggtctgccgagcagtttcattgcattggcgcatacaagaagtgcaagcgtgctgtcaagcccacccgaaattcctataacggcggtttttgcgtaagtatgggcaagacgctttttgagtccgtgtgcctgcatcgaaagaataagctcgcatctcttgtcggtctcatcggcagagtaggggataaacggcgtgcgtgatacaaaacgtgttatctttgtatcggtgagcggtatatcaaaccatatagtttccgtatcgcatttgtcatttctgaacgatgtgttttttctgcgttcaaatgccagcttgtttacgtctatctcgctgataacataatcgtttgagaaaagctcgctttcggcaagcgttgcaccgttttcggcaattatgttatgtcccgagaaaacaaggtcctgcgtgctttcgccttctcctgcggagcagtagatataacccgaaataagccttgcagattgatttaaaacaagcgaacggcggtattccgactttcctatcatctcgttgcttgcggaaagattaagaatgatatttgcgccttcctgtgcaagatatgtcgagggagggcagggcgaccacagatcttcgcacagctcgattccgaaagaaaaatcgtgcatattgttacagcagaatataagtcccgcaccgaaatacgcactcagcgaatcgtcgcattcgccgtcggcatccgtgtcaaaccggtttaaaaaatattcgcatttactgccgtcccaggcggtaaagtggcgcatctcgtaaaattcgttgtagttcggcaggtactgcttaggcacatagcccagcacttttccgtgataggtcacagccgcacagttatactgcttgctgtcatactgcatcggcagtccgactacagttatcatatcaagctccgacagttcatccagaatcgttatgagcgcattcttagcaccgtcaaggagcgttgtctggtagaacagatcctgacaggtgtaaccagtgatgcacagttccgggaaaactgctagctttacatcttttttagcaagctcttttgccagagagattatctgctttgcgttgtacttgcagtcggcaactttaatctcaggtgttgccgccgctacttttataaatccgtctttcatattgttcttttcggcttaaggcttaaaattcgtaattgcctgtcattccgccgacctttctttctatccaggttaaaatatcgtcaaaaactatttccttcatagtttcgtttacaagctcgtgacgtgcgccggggtacagcttgatatcaacgttgcaaccctcgtcaatcagctttgtgtatacatttcttacgcccttgccgtatccgccgacagggtctgccgttcctgccatgaatataacaggcagctttttcggcaccttttcagcccactgctgacttgatactctgcgaagaagggtagtaaggtcaacaaatccgcttgccgtaaacacaaaattgctcttttcatcgtcgatatacttttttacaacatctctgtcgtgagtgagccagtcatagatagtctggcaatctttgattttgtcgttatacactccgaaaatgagagtgttcagcttatcactgcggaaacgctcgcccttcaaggaaacaacggagcgtgtagcccttactcctatttcggaaagtgccttgtcatcgcccgtacccataattacggcgcaggtaagctcgttaggaaagcgtgtgagatacagccttgcaacaaagctgcccatactgtgacctataagaatatacggcagtgcagggtacttctttttcattatcatcgtcatacggtgcagatcgtttacaaggtggctccagccgtccttttcggcgaaaaagccgagatcatcgtttgatctgacgctgtttccgtgaccgagatggtcgttaccgcagacgatatatccgtgtgaggtaagaaaatccgcaaagtgttcataacgctcaatatattcacacataccgtgcgaaatctgaatgatgcctttatatcccacgttcataggaagaaccggaacatagatgtaatatgcacagttatcagtgccgttcgaggattcaaaagtgcctgtgagcttttcgtatgccatagcgtaccttctcctttcgcaagatgcatcaaatatttctttatacttattataacaaacacagccataaaatacaagtaaaacggggaaaaaggggttaagcggaggaggtcgggacaaaaccggacagcctgtgactgcggataagctgtgtctaaaaacgacttttgaaaagaattattcggtaagaaatgcgatgataacatacttatccggcttatttcgccgatgtgttttatgcttataacagctgttattatacgcagataaacaaaacagtaccgtgactgaatgtgtcattcggtcacggcactgctgttgcaatacaattcagtgaattctcattatcatttctataaacaatataccttgcatggcatatctgcttctttctccgattttctcaatgaaacttaccgtagatttttctatagtaagataccctgcatcataaagcggagcgatgacattgcataattcggcgggaaggttgcctaaattatcctcgttttcatcgatgacagaaaaattgttgtagttgtaatgatttgatttctcacgttttatatgtatactgtcaccgatacggagattttccagcttaagcgttctgccttcatacctcagaccctttatgtcagtctttattcctatcagattattttctttgttatatactccacgatatttatcgagatattccatattgcccggctcaaaataatcttcgggcagattctgtgacagcttgtatttttcttcaagtttatcaatctcggtaataagagaatcccacatatcgctaatttccataataacctctcagatttttctgtttattcgattgcatagatttcatcgattatatcatcatagcagaaattatatcggaagatgaattgttcgaatatgagctaaaagtatctatcaccacagcaaaagcacaaaacgataaattgtggttactggcacttaaaaatttaaaaaaagagcgaaaagctagagataaataataattgttaacaaaaattaaaatgaaaaatttagataagaggtgtgcgttttacatattttaactatgattgtactaattaaatttgattttgaacaatacaaaatttacattcccgatggctatattatgaatcttgaaaatattagatcggatttttttgaatggatatattatcaacccgaatatataatatatgataagtggggaaggggtttggggtttcggcaaggatgccgagatagaacgcccaaaggctttgcaggacgcaaagcccacaaagcgttcttatagggatggagaatttgctctattttataaaaaacagactttttctaaaagctgactccctacgggagaaaaaataaatcagataaagcaaaaatgaaaggaaacgatcatggcaaaaaagacaattcacacccttgaggagatttatccggaaagtgctgtaacggcgcagagagaaagatatgaaaaatctgcggaggaattcaggagcatcttcggcgacagcgatcagcttcgttatttttccgcacccggccgtacagaagtcggaggcaaccacaccgaccacaatcacggcaaggtgcttgcggcaagtgtaaaccttgacgttatcgccgttgtagagcctacagatgacaacatcatcaagataaagagcgagggcttccccgaggattcggttgatatatctgacctttcagttcacgagaatgaaaaaaattcatctgccgctcttataaggggcgttgccggcggttttaagaacaacggtctgaatataggcggtttcagagcttacacaacgtcaaacgttatgaagggatcgggtctttcaagctctgcggcatttgaagtacttataggaaatatactttcgggcatatacaacgcaggcagtatcagtgcagtgaagattgctcagatagcacagtacgccgagaacgaatatttcggcaagcccagcggacttatggatcagatggcaagctcggtaggcggtttcgttgctatcgacttcaagaatacacaggcgcctatcatcgagaatatccccgttgatttctcgtcatacggacacgcactgtgcataattgatacaaaggcagaccatgccgaccttacagacgaatatgccgctatcccccgtgagatgaaagctatagcaggctacttctccgcagaatatctgcgtgagatctcccgtgcggatgtaatactcaatatgggtatcttaaggcagaagtacggcgaccgtgccgttttgcgtgcgctccatttctttgaggaaaacgagcgtgtggacaaactggcacattcgctgaggcatcagcatttcgatgatttcttaagctcgataaacgaaagcggaaactcaagctacaagtacttacagaatatttttgccgtttcggactatacgcatcaggcggtaggcatagcactgaacgttgcggaacacgctcttgcaagaaagggtgcgtgcagagttcacggcggaggctttgccggtactatccaggcatttgttccgcaggatattttaaagagctttatagttgatatagaaaaggtattcggtgcaggaagctgtcacgttctttcgatacgtcccgtcggaggtactgaggtgcagctctgattgtgccgggtaaaacaaaacagccctttcgggctgtaatgtatatcgtcagatgacaaactcctcatactcatacttatgcaacttgtccacaagggcggttacggcgatgccgttttcgaggtactcctcgctcagcacctttccgtgtgagtggagagccgccgcaagtcccgacttgtcatacggtatcagcatttccatacggcttaccttgtcggtaagattatccgatatggctttcagcagttcgtcaaatcccgtgccgttctttgcggaaatcattacggtattttctgcgggcggcagttcataatcgagcttgtcgcatttattgagaacggttattaccggtatttcgccgcatccaagctccgacagcagagaaagcgttgtttgtgccttttctcttgcctcaggatcggacgcatcgcagacgtgcaggataatatccgcactcgccgcttcttcaagcgttgacttgaacgcttctacaaggtggtgaggaagccgtcttataagccctacggtatctacaagcgtaaaacttcttccgtcgggcagttctattgcccttgatgtaagatccagcgttgcgaacagcttgtcctccgcaagaacgcctgcacctgtaagggcgttgagcagggtcgattttccggcattcgtatatcctacgatagcgccgacgcatacgctgtctttcttacggcggcggcgtgacagatcacgacgtttttcaagctctttaagctcatcgctgagtttatctattctgcgtcttatgtgacggcgatcagtttcaagctgagtttcacccggtcctctcgttcctataccgccgccaagacgtgacaatgatgtacctattcccataaggcgtggcagacggtatttaagctgagccagttcaacctgaagttttccctcgtttgtcactgctctgccggcgaatatgtcaaggataagcattgtgcggtcgataacacgcaccgaggttatatcctcgatattgcgtatctggcttgagcttagctccatatcaaatataataagctgtgcgtcaaggtcctttgcggcggcactgagttcttcaatcttgccctcgcccagaattgtcgcactttcgatagcaggacgtttctgaataatacggcatactgtcaccgcacctgcggtttcagccagttcttcaagctcatccatagatatttccgcatcatattcgccggtatctactcctgcgagtatggcacgggttaattcgttttcctttaagatcggattgtttacggctgattcgttcataatgttcctttccgttttataaataatcaataataaagtaaatttatgcggtaatccgcaaaaggtggtaatctttatgaagttcaaagaatacgacgtaataattgtcggcacaggcgtttcaggtctttatgccgcactcaaccttgacagcagtatgcagatacttatgctctcaaagcgtgagctgacgctgtgcaactcggctctcgcacagggcggtgtcgccgctgtaatggacacatcaaacgacaactacgaactgcacatcaaggatactcttatagccggcggctacaagaacaatatcgacaatgtacgcatacttgtcgagcagggtccgaaggacgttaagaatctgctcaattacggagttgactttgacagaaagcaggacggctctatcgaccttacccttgagggcggtcactgccgtcacagaatcgctcaccacaaggacagcaccggctttgagatagttacttcgcttatcgagggagtaaagaagctgtccaatgtcacgattcttgaaaacactcacctgctcggtcttaccaagcgaggcgacgatttcctgtttgatgtgcttcacgaaggaaagcacagttattataccacaaagaacaccatacttgcaacaggcggtataggcagagtttacgattatacaacaaactctgcgatagcaacgggcgacggcatacagtttgcttataatatgggggctgatattcagcatttaagctatgtgcagttccaccccacagcctttgccgaccacgaaaaccgtgagtgcttccttgtatccgaggcagtacgaggcgagggcgcatatctgctcaactgcaacaagaaacgttttatgcacaagtatgagcctgaacgtaaggagcttgctccccgtgacgtagtttcaaaggatatgatgaaagagcagaaggaaacgggcagtgacaaattctatcttgatatttcgtacaaggatcccgaatttatcaaaaaccgcttccctatgatatataacaaggttcttgaaaagggctacgatatgaccaaagagcctatcccgatatacccctgtcagcactatcttatgggcggtatcggcgtaaacggacacggcgccacgaatgtaaagggcttatatgccgcaggagaatgtgcgcataccggcgttcacggcatcaaccgccttgcaagcaattctctgcttgaagcgctggtattcagccgtcttatcgcagaggacataaacaagaacaatacccacagagagcttggaacgcttgaggctgattatccctcgcccgacggcaagccgctccctaagggaatacgcaccgagataagacacataatgcagcgttcttatttcgttgtacctgactatgttgaagcggcaaaggatataaagcgtgtaacggagctgaaggatctgctcgataacggcggtttcgaggtaactcccgactatatcgaagcaaaatcactgacgacagttgcttacataatcctcagcgaagtagttgcagagggaaaggaaaagggctttatataatgaaattattacagttttacgttgacgatctgataaaaagagcgataacagaggatataaactacatagacagcaccaccgacctgctaattgacgaggacgatatttcggaggcatattttgtatcaaaggctgacggcgttcttgcgggaattgatgttgcaatgcgtgttttcacattacttgacgacactatcgagatgaatattcatttcaaggacggcgacgctataaagaagggcgatgttatcgccgagttcaagggtcacacctgcgctatgctgaaggcggagcgtacagcgctcaatcttttacagcatatgagcggtattgcaagctatacaaacaagtgtgtaaaggcagtcgagggtactgatgcttctatcgcagatacgagaaaaacgctccccggcttacgtcctttgcagaaatactccgtagtggcaggcggcggaagaaaccaccgctacaatcttaccgatgcggcaatgctcaaggacaaccacattgacgcatacggcggcataacacaggctgttaccgctctgcgtaaaaaagcgggacatatgcttcagatcgaggtcgaggtacgcaactttgacgagctgaacgaggctcttgcggtaaaggcagacgttattatgcttgacaatatgagctgtgaggatatgaagaaagcggtagaaataaccgcaggcagagcaaagctggaagccagcggaaacgtcacgctcgacaatatccgtgacgttgcgctgacgggcgttgatataatcagcctcggtgcgcttactcacagcgtgacagcttttgatatttcgatgaagtggaagaaaaaggcatgacaaactgtgattgctgcgtaaactatgtttatgatgatgagtacgactgctacacctgccttgtaaatcttgacgaggatgaaatgcgccgttttataacgggcgacaactacaactgcccgtatttcagaaacgatgatgaatacgagcttgcaagaaagcagtaacgctgaaaggaaaagctatgacaaagataccgagaggtgacaaatcatatatcggaaaggctgtcactgtgacggttgaccgaccgataggcacgcatcaccccaagcacccggagatagtatatccgataaactacggctatgtcgaggggcttctcggcggtgacggcgaggaacaggacgtatatattctcggtgttgataagcctgttgacaaggcagagtgcgttatcatcgcaactgttatgcgtacagacgataacgaggacaagtgggtaggagtgccgtctgagcttgtcggctctgagctttgctgtgagtgcaatatagtaaacgccgttcattttcaggagcagttccacacctctgagatatttgccttatacgaaaagacctgcggtgcagtaatgtacacaggggacggcgatgaccgcagatattttcttatcaagaacaacagcggtcatatcggctttccgaagggtcacatcgagtacggcgagaacgagcgtgagaccgctctgcgtgaggttttcgaggaatgcggacttgaagcggaattagatgaagatttccgtgcggagtacacattccacacacttgacaacaccgaaaagacaagcgtattctttgcaggaaggtttgacagggatgccgccgtgaagattcagcaggaagaagtaataggcgactggctgttaagctacggggacgctatgaacaagctgaactgggagcaggacaaggcgattttaaaagcctgcgaggaatatctcaattcaaagcagaattaattatatatctgtaaaaatacccttgcgaaacgttttggagtttgcaagggtatttcagcttaattaaaactatattgtttgatgtgtttctgttatatcatttagcgtttatctatgataacaagctaccgatagttctttttgtcggacagcacttctcgggttcgctattcgaatcaatgcacttgtcaatatgaaagatactcccaagcacacacagcaccagacccaccacacgcaccccaccccccccgccgccccccaaagaactatcggtagcttgctatcatagacaaatactaaaagttataacagaagtacatcaaatacaagactttttataccaaccgaggtgccgcaaaaacggcacctcaattcttaatatttatcgtttgcgtcctatgtaaactcattttccgaatttacagccgtgtcaaaatgcgagattcctatagcattcgttttcttttgtgcaggagcctccgttttgaagtcggcagatatggcttttattgccgattcactgtttttcttcttgttttcggctgtgctttcgtttttctttatctgcgtatttgcaacaggcttgctttcgcttttctttatctgcgtattcgcaaccggcttgctttcggttttctttatctgcgtacttgcaaccggcttgctttcgtttttctttatcggcatacttgcaagcggcttgctttcaggtgcctttttatctgtgattatatcggcaggcttgcttgcgacagcaggcttctcggcttttatttctttagcctccgcagtggttttctttatttcccgcttgctttttaccggtttttccttgtcacgctttggctcggacggctttttagcttccgggctatcggatttttccgattttgccgaagctgttttctcgctttcggcagccttgcctgcggctttcacaggttcttccgcaatcgccttttggcttaatttgaatttgtttaccataccgtcaaggatagtcgcctgtgaagataattcttctgctgatgcggcgcattcttcgcttgtagcggagtttgtctgtacaacggaggaaatctgatcgacacctgctgttatctgagatatagccgttgcctgttcttcacaggctgttgaaatatcctcaatcagatcagccgtctgtgtggtagtttcaacgataagagcgagcgtttgcgccgtatcgtttgcgattgcggtaccgtcctctaccgccttgatagaatctccgataagcgttgtggtatcgcttgccgcctgtgcaaccttgcctgcaagatttcttacctcgtctgcaactacggcaaaacccttgccggcttctcccgctcttgccgcttcaacggcggcattgagtgcaagaatattcgtctggaacgaaatatcgtcgatggcttttatgatatttgctatctgctttgaagtatcgtctatcttgtgcatagcctcaagcagaatattcatcttctcatttcccgaatcaacaagctttgcggcttgttcggaattcttggctgcgtcgccggctcttgcggcattgcggtttaccttttcggatacttccgcaagcgaagcggaaagttcttccacagaagccgcctgccttgtagcaccctccgaaagatttgcggcggcagatgatacctgctccgcaccgttcgatacctgaacgcctgctgtgctgataccgctcatcgtcttgttgagcgagagcattattctttcgtatgaagctctcagctttgcaaaatcaccaatataaacatcggcgggagaatatgtaagatcgccgtttccgagtgcggcgagcatattgtcaaggtctgtgataattgcgtttatctgtgttgttatctgattcgtgctttcgctgagctgacttatttcattgtcgatatttttgccgaagtcgagcggctcggcatgaagatctccctgtgaaagcgtcactatcctgtcagagcagagcttgacgggcttgattaccttcttgactatcgtgaggattaccagtaccgatacgacaaagcagataacggctaccgcagttcctatatacagcgacatctttaagctgtctgtgtattcagacggggtagcgacaacaagacagctccatccttccgtattcgcaataggagcataggttacatatttatccacgccgtcaagcgtaacctccgcaaagcctttttcgccttttatggcattgcttatgcagtccgctatgccctgatatgagctgtccgcctgagcaagcgtcttgtagtttatacgctctgtcagcttggtttcatcgggatacgcaattatcgtacccgtctggtctatcgccatggtatagcctgtttcgcctattttcgtctgacctatcacggctgagaatgtgttcatatcaacacacgccataagtacgcttctgagcgttgtattgtcactgtcgaacataggtatcgcaacgtccataagaacgtgcttcagatcctttgcggcataaggctctccctgtgctgtttttttggtttccacagcttttttgaagctctcgttttccgagtaatcaagcgtttcggaatagaaacacttgccgtctgtattcacgatctttatatcggtcagcatagggttctttgaaagtatcgagaggcacttagtggaaagagcacccgtatccgtcagatcgtcaaatcccgaatcatacgcaatctgctgcagctctgcagtgatggagctaagctgattggaaacagtattcgaagacatatccgcaacctcggtcagctgatttttcagcgactcttgtaaaaagttgtagtttatgcctatattcacaccgccgacgataaggagcgagccgcctaccgcaagacacatccatttgaatatcctgcctgtgagcgatttacgctttttctgcacctgctttgcaccgtcggagattttgtcaaattcttttgatatatcctttttagctgacattagcctgtcctcccggatttgttatgttgtatgttattactaaatcataccacattataagagtaaagtcaaataactgaagcattttccacggcagttttcacaactgcaataaaaatcataccgtgaaattgtttattctgcacatatttatcgttgctcagcttgccgctgttattttgtatgcctgtttatgtacttgctgtgcagttttgagtacattatcttctgacccgtgtaaagtccgtagtagcccgataaaatgtagcttaccgagcaggcggcggcaaagaatattatgccctctccgccgaaaagctcaatgctgagtaaaagcgaggttacagggcagtttaccacgccgcagaacagcgaaacaagtccgagtgcggcagtgaactgaggcggcagaccgaccagtgttccgaacagatttccgaatgtagcgcctatgaaaaatgacggaactatctctccgcccttgtagccgcctgcaatggttatcacggtgaataacagcttcagagcgaatgcttcggggcgtgtagtgccggacatagcgtcagcaatgatattcattcccgcaccgttataatccgttccgaatacagcggtaagtattacgattacacagccgcatacgaaaattctgatatagttgttcttgatttttgccgataacagctttgacagcttatggagcgaatagcagaagacaatgctgagcaatgccgtgcctacgccgagtatcatcgcaaacgctatgttcgtaacggaaatatccggtatcactactttatatgtcaccggcactattccgaacaggtgcgatattccaagcgcaaccgccgcagagaaaaagcacggcacaatagccgagtagtaaaacactcctacgctgataacctccatagcgaagaatgttgcagtgacaggagtaccgaacagtgccgaaaaaagtccgctcattccgcacattaccagaagattgccgttgcgttcatccatcttgagaattctcgctatttccgccgacagccctccgcctatctggagtgccgcaccttcacgtcctgccgaacctccgaacagatgagtgataaaggcggatataaaaataagaggagccattctgaccggtatttttccctcggttctgattgaggtgattattatattggtgcctgggtcgtttttcagaccgcagatactgtagaggaaaactattacaagacctgcgacgggcagaaagtataccataaatgaatgccctgtgcggaattctgtcgcaaactccatgcaaagatggaacagcgagccgataacgccacagcaaatgcccgttatccccgacagcaaaagccacttgaaaaatgttttaagcgttatgtagagcctttcactgcggatacgcagatgattaagcagtttgttcataattatatctgaccctctctgacggaaacttctgcagatgacaacgtgtgcatattcccgttttcatctcttactatcaatcttgcatttttatcaatgtcaacggcgacagcataatattccgcatttgacgatatgacctttatccgctttccaagcacgaccgagtagcttttgtactcttccgtcagcttatctatggacatatgttcgcatatatcgaagaagttgttcagtatttcggcggcaagagcgcatttcagctcgtttcctgccgcttcttcggaataaaggcttgaggcaatatcggaaatttcggacgggaaaccgcctttcggacggctgatattgataccgagtcccattacggcatattgcaggcttccgctttcaaagtcggtgaccgcttcagtgaggataccgcagatttttttgccgttcagcattatatcgtttatccacttgataccggcttttattccgcataccttttcgatggctcttacaaccgatacagccgcacctgcggtaatgaagaacgctttgtcggctttgaaatcggggcggagaagcacagacatataaatgcctgtgtcggcaggcgagtagaagctctttccgtgtctgcctctgccttcggtctgctcgtttgcgataagaacggttttgcttggtgcgccgttttcggcggatatgcggagcagggtatttgtggatgtgacagtatcctttatcgtaatatcggcgtcggcggcagattttttcagcagttgccttatgcgcaaaataccgtagcgtgtgaaatcgtccgtttcgccgcccgaaagcagatagcccttgttttgcgccgcatcaattataaacccgtctgcccttaaagagttgatggctttccagacagcgttacggctgacgtaaagctgctttgatatttcttcgccggaaacgaatttccctttactgctcataagtataagcaggacttgttctttcaatttcataataattttttacctttcgatgtcaccctgcggattttaaggttgacaatacggatgttcaaaaccgcagaatatatctgcggtcagaggtatcaattacagcttttcgagcatatcggttgtttcgtcaagccaatttccgtcataaagctcgataagacccttatcgcaggcggcggctaatttcgggttgataggcattcttgctatattctttatgccgtattttgcggcaacttcgtctatatgactttcaccgaatatgctgtgacgtgacttgcagtcgggacattcgaaatatgacatattttcaactataccgagtacggaaacgtccatcatttcagccattttaacagccttgccgacaatcatcgaaaccagctcctgaggagaggttacaacaataattccgtcaacgggaagtgactggaacacggtaagcggtacatcgcccgttccgggaggcatatcaacaaacatataatcaacatcgttccagattacgtctgtccagaactgctttacggtatttgcgataacaggacctctccatacaacagggtcggtttcatcgggcagaagcaggttaacagacatgacctcaatgccggtctttgtcataacggggtagatgccgttgttgtcgccggtagcttttccgtgaagaccgaacgccttcgggatagacggacctgttatatctgcgtcaagaactgccgtcttgaagccttttctctgcatagctacggcaaggagagatgtgaccatagacttacctacgccgcccttaccgctgacaattcctataaccttctttatatgtgacagctcgtggggcttttcaagaaagctctgaggtgccgttctttcaccgcagtgctgtgaacatgaactgcaatcgtgagtacattcgctcataaaatcgtttcctttcaatcggcgaaagccgtttattctgcgctttatccggctttatttgttatttgatagtataccactatcgcattcaaaaatcaaggcggatatcaaggcaaaaccgcacaattaacggctgtcgcctttgccgcacgctaagcttgcatattttccgccatcttgcacaaatttcgcttgacaggcgtcagcctgcccgcactcaatttatacaatctgacgaaaaatctactaagcaatcgcacgacaatagatccgaacagattataacgccgtttggcaccgctttgctttcgctgaacatctcgcacagcctgttgcactttctgtccgaaagatgctcttgctttataagagaattgctaaacgtgagccttgcggaaatgccgtacttctgtgtaagccgaagcaccttttcagcctcatcatcaccgaatcccacacgtccgccgccccacagacaatccgcaggagcaccgtatatcgagcctatctcgcaccaatcgcaaaaatactccctgtgattatagaataaaggcagaaacaggctgtacagcccgtaaaactcaaacagaccggggaggtggaaatatgccacagcaccgtcacatttttcacaagttttctgtgtcatattcccaccccctttaaaatcgtttctatctttgtaccattcacaaagtccgtaaatatcagctatcacattattttttcgtagagcgagggtctgtgtgtgcttgtatggctttgcatccgtgcctcgtcagccacacactaaggcatccttgcccctcccgttacatcaaccgccttcattaccgcaagccttgcaaacagcctgccaagtgcttaaaatcattcctgcctttaacggattttgtgctttacagtatcacacaaaatcaaatcagcttatccgcaaaaatcgcttttttaaaaaagccaccgcaaaagcggtggctcaaaaaattatttacctaaaacctttttaacggtattagcaatattatccgcacataagccgaattcttcaagcaatgctgccgcaggacccgaatgaccgaatgtatccataacaccgatctttgtaacgggaacgggatagttctcgcaaagaacatcgcaaacggcacttcctaaaccgccgattatgctgtgttcttcaacagtaactatctttcctgtttcctttgccgccttgattataatatccttgtcaatgggctttatcgtgtgtatgttgatcacacgggcattgataccctgacccttgagtgcgtcagccgcttcaagtgcctgagctaccataagacctgtagcaacgattgttatatcatcgccgtcacggagctgtacgcccttgccaagctcaaacttatatgtatccttatcgttgaagataggagtggcaagtctgccgaatctcatataggtaggtcctacatagtcagccatagcgagtacagccgccttagcctcaacatcatcggcggggttgattaccatcataccgggtattgtacgcataagcgcaatatcctcgttgcactggtgtgtcgcaccgtcctcaccgacagaaatacctgcgtgtgttgcgccgatcttaacgttcagatgaggatagcctacgctgtttctgagtatttcataagctctgcctgccgcaaacatagcaaatgtgcttgcgaatacgagcttgcctgtagtagcgatacctgcggcaacacccatcatatttgcttctgctataccgcagtcaaagaagcggtcgggatatgccttcttgaatatacctgtctttgttgcagccgcaaggtctgcgtctaaaactacgagatcgtttctcttttcagcgagcattacaagagcttcgccgtagctttcacgggttgcttttttctccattttaatacgtttcctttccgattacttttcaagctcggcaagatgagccttgagttctgtcatagcctggttgtactgttcttcgttgggagcagtgccgtgccatgatacctgatcctccatgaaggaaacgcccttgccctttatgcttctctgtataattaccgtaggctgtcccgaaatcttttcagcttcagcgaaagccttttcgattgcgtcaaaatcgtgtgcgtcaatagaaataacgtgccagccgaaagccttgaacttctcgtctatcggatagggtgacattacatcgctgattctgccgtctatctgaagtccgttgttgtcaactacggctacaaggttgtcaagctgatagtgtgccgcaaacatagcagcctcccatacctgaccttcttctatctcgccgtcaccgagtatagcgtatactttatagaaatcgtttgacagcttgcccgaaagagccataccgcaagcggctgaaataccctgaccgagtgagcctgtgctcatatcaacgccgggaaccttgttcataacagggtgtccctggagctttgagcctatgtggcggagtgtctttaagtcttccacagggaaaaatccacggttagcaagtaccgagtacagtgcaggggctgtgtgtcccttcgacagtacaagtctgtcacgttcgggcatctgaggatttttcggatctacattcatctttacaaagtagagatatgtcagtacatcggctaccgaaagcgatccgccgggatgtcccgacttagcgttgtaaacgccctcgataacacccattctgaccttggtggcagttatctcaagctgcttttttaaagttgcgtccatttttaaggtcctttccgggcaaagccgctggctttgctttttcgtttgtttgttcctgattattatattacattatcgccgattagtcaagtgcaattaggcgatttataatttcattctttgacctgcggttcagtgcgaagctgtgattcagcacgatatgcaatctgcttatttttgtcttgacacagtgttttattggttgtataattgcaatcggtgcggttttcgcactgtattctcccgtcggggatgtttcaaggatttgattttatgcgtggactcggcactgtaataaatgtcgctctgctgatattcggcggactatgcggattgctgttcggcaaaaagctgaacgaaagaataaaggatactctgctgtcggtcaatgccgttgcaataatgatgcttgcggtaggcggcgttatgcagaatatgctgtcgctgtcagacggcaagctgtcaacgggcggcactgttatgatgatagtcagcctcaccttaggcggtcttatcggtgaaataatcaatataaacgctcttgtggacaagtttggcgaatggctcaggataaaaagccacagcaccggcgacgattcatttgtatcggcatttgtaagcgcatcctgcactgtctgtataggcgcaatggcagtgataggctcgataaacgacggagtaagcggcgattgctcggttcttatcgcaaaagcgatccttgacgcagtgattatctgcgtaatgaccgcctctcagggcaagggctgtatcttctccgccgtacctgtagcaatttttcagggtgtcataacaataatcgcagtatttgtcggaggctttatgaccgaccttgcgctgtcttatctttcttatgtcggcaatgtcctgattttctgcgtaggacttaacctcattcgtaaaaaacagataagagtagcaaacctgctcccctcgcttgtgattgctgttgcgtggggatttgccgcaccgcttatataaatgaagtacataatgaaaaaccgtgatcttaccgtcggcataggaatactgtttatgctctacggctactacagagcagtaaataaaccgttgatgtcggtaatcctgacgattctttcactcggaacaagagtgcttcttgcgtatatcctgcgtgaacgtagccggtaccgaaaataagcaagaacgctgtataaaataaatatcaaataccgaagaatatgccgcaggctgtagaaaaacctctatcgttatcaaaaatgggggtttagcgttgcttgctatgttggttttgcatcgtgcaaaacttttggcaagcaaccaaagcgtccttgctttgggcgtagccccaaggcgggtcgcagggacgccagtccccgtattcactccctttccgggggaaagggggcagggggatagggataataaatcagaagtttatttcaaaaacagattttttcaccaaactgaatttatatatctataataacagaaaatcttacacaattcaacccttttgtgtatattgcacaaattactattttaaaagtcgggaataattcactttctttttttgataaaaaattgtcaaaccacttgataatgagagaaaaattttgtataatagagaagtagaaatttagcggacgctttgcgcctgcaaaaaattcacaaaatttttaggaggaatattccaatgtcagttaaagttgctattaacggtttcggccgtatcggacgtcttgctttcagacagatgttcggcgcagaaggttatgaggtagttgcaatcaacgaccttacaaagccctcaatgctcgctcagcttttaaagtatgatacagcacagggcggttactgtggtaagataggtgagcaccttcacacagttactgctgatgacgaagctaacacaatcacagttgacggcaagacacttaagatctatgctgtaaaggacgctaatgattgtccttggggcgagctcggtgttgacgtagttctcgaatgcacaggtttctactgctcaaaggacaaggcacaggctcacatcaatgctggtgctaagaaggttgttatttctgctcccgcaggtaacgatctgcccacaatcgtttacagcgtaaacgaaaagactcttacagctgatgacaagatcatctctgctgcatcttgcacaacaaactgcctcgctcctatggctaaggctcttaacgattatgctcctatccagagcggtatcatgagcacaatccacgcttacacaggcgaccagatgatcctcgacggtcctcacagaaagggcgacctcagaagagcaagagcaggtgctgctaacatcgttcctaactcaacaggtgctgctaaggctatcggccttgttatccctgagctgaacggtaagctcatcggttctgcacagagagttcctgttcctacaggttctacaacaatccttacagctgttgttaagggtgcagacgtaactaaggaaggcatcaacgctgctatgaaggctgctgcttctgagtctttcggttacaatgaagatgcaatcgtttcttctgacgttatcggtatgagattcggttcactctttgatgctacacagacaatggtagctaagatcgctgatgatctgtacgaagttcaggttgtttcttggtatgacaacgagaactcttacacatcacagatggtaagaacaatcaagtactttgctgaaatataatcggtaaaaactgatacattacggctcgtcttcggacgagcctttttgttgtctgctatttctgaaaattagctgaaagcgattgatttttctttgccgttgtggtaaaatagaggatagtttatgtaagcaaaggagttcataatggttaaaaaaatattagcaggcattttatgtgccgcaacaatgattacattatcggtaggatgctcagacagtgccgctcccggtgcgtcaaccgacccttcggcaaagataacaggcaacacgggtgaggtaaagctcgaaaagggcgataaatatgccgtaatgacaataaaagactacggcgatattacaattaagttatatcccgatgccgcacctaagggtactcagaatttcatcgaccttgcaaacagcggattctacaacggaaaaacgttccacagagtagtagccgactttatggcacagggcggtaaggattttacgggaaagacaaacgttgagagcttcggcatagaaacaaactacaatatgcgccatttctacggtgcgttctgctacgccaacgcactcggcaataattccacagagttctacatcgtaaacaacaagaaatcgcaggattacagcagcttcagcacctcaaaaatagacaacaacattcagggctatgaggactacgcaaagcagtacgacaaggattctcaggaatatacctactatatgttccaggcaaactactacagaaacttaaagcagttcatagagaatatggatgacgctacaaaggcaaagtacaaggaagtcggcggcactccctctcttgacggtaactacaccgtgttcggtcagacggtagacggatttgacgttcttgacaagatttctgccgttgaggttgaaacaaacgacgctatgggcggcaaagaagtaagtaagcccaaaacggaaataataatcgaaaaagtcgagataaaggattacgaataaaaaacagataccgcctgcaaacaggcggtcaggttgtagaaaaagtctgttttttataagatagtatatgaactttgacggtacggcagatatgcttataaagcagggcaatgagtgcggcgtttcgaagtatgttgtacagtctgttgccactgcgccgcaccaggtaaagagaatcaatgattttatcgtaaagtcggtagaaaagtaccccgataagctgataggattcggttcactacaccccgatatgaaaggcatggaagaagaaatcgacaggcttatttctctcggtcttcacgggataaagctccatccggactttcagaaattcgctataaacgatgaaaaggcttgcaggctgtatgatgcggtaggcgataagctgccgtttcttattcataccggtgacaagcgttacaattattccaacccggcgctgatggcggaaatagcgagaaaatatccgcatacacgctttattgccgctcatttcggcggatggtcggagtgggaaaaggcggagcatgagcttgttggacttgacaatatatgggtagataccagcagttctttttatgcgatgacgcccgaaaaagccgcagagcttattactaagttcggttgcgacagggtgttcttcggtaccgattatcctatgtggagagcggacaaggaccttgagtttcttgataggataccgctcggtgaagatgtcaaggaaaaggtgttgtggaagaacataaatgattttcttgaattggggctttgctgatgaactgtgaaaaatctcttatattcgtatcgccgataaagaaaaaatccgtaatcaaatccggctatcacgggtattctcataaatgcggaatattactgcttgaaaaagcgttttctcatatcggacttgatttttcggaaagcgatatagtaacagccgaaaacggaaagccgtatatcaagggcaatcctgtttatttcagcatttctcactgtgacggacttgctgtgtctgttttgtcaacggctcctgtaggggttgactgcgaaagcgtgcgccgtgcaagcggtgctgttatgaaaaggtgctacggcgacagcgaagcgaatcatattctgacttcggcggacagcgacaaggaattttcacggctgtggacgctcaaagagagctatgccaaaatgacaggtgaaggagtaggctctgatctgaagatgaagtgctttgacgaggaaaacggcaggacgctttttgaaagcggtgcggttttttatcattacggcacacgttttaataatgaagattactttataagcgtctgcgtcaagacggacgataaaaagtcggctgatattattaaaaagtcagattttgacattgacaacgaacatattttgttgtacaatatatcagataactgaaaaaagcgaacgggagcttgtttgacaggctgagagggaaattaaatttccgaccgataacttgatttgggtaatgccaacgtaagtaaaacagcgcatacggtggtgttccgtatgcgttttttattgcccgaaaggagtttatatatgaatataacaccaaagcagatgcttttatatgcggtaagcgacagagcatggagcaacagtgacgaggaatttctgtcacaggcaaagcaggcgataaagagcggaattacaatattccagcttcgtgaaaagcacacggaatacgagcatttcagagaaatcgcccttaagctgaagccgatatgcaagcagtacaatgttccgcttattatcaacgataacgtaaatctggcgaaggaaatcaatgcagacggcgttcatctggggcaggacgaccttgacataaaagccgcaagagaatatctcggagcggataagataataggcgtatccgctcataatgtaaaagaggcactggaggcggaaaacggcggtgcggattatctcggaagcggtgcggcatttgtgacctcgacaaagacggacgcaggtgcgatagatcacaaggtgctgtctgatgttgcacattcggtcaaaatacctgtggttgcgataggcggcataaataaggataacatatcacagcttgaggggcttggtcttgacggagtagcggtagtgtcggcaatttttgcggctgacgatatttcgtctgctgtcatagatttaaaggctaaagccgaaaaagtagcggaaagttcggtaaaataagaaaggacctgatattatgaaaaagatacttacaatagccggctcggactgcagcggcggtgcgggaatacaggctgacataaagacaataacgatgcacggaatgtacgcaatgagcgcaatcacggcgctgacggcgcagaatacaacgggcgtatacggtattatgaacagctcggctgattttctgaaaaaccagatagactgcatatttaacgatattcgccccgacgctgttaagataggtatggtaagcgacgttgaaataatcgaggcgatagcgcaaaagctgaaagaatacaaggctgtgaatatagtagccgatcctgtaatggtagcaaccagcggcagccgtcttatcagcgaggacgctaccgacgcacttatgacaaggcttcttcctcttgcggatattatcacgcctaaccttgcagaggctgaggtactgaccggtatgaagataaccacaagagaagaaatggaaaaggcggcaaaggtgctttccgataagctcccttcaaccgtcggaatagtaataaagggcggtcatcttgacgatacagccgacgatctgctttatgtcggcggtgaaaatcactggataaacggcaagcgcatagataatccgaatacgcacggcacaggctgtacattctcatctgccatagcctgcaaccttgctttaacgtcagacaaggtacaggctgtcacaaacgcaaaggaatatcttgcgggagctatcgccgcaaagctggatttaggcaagggcagtggtccgcttatgcacaactataagatagtcgaaaaggatatataagatgtcctttgttgagtttaacaatgtcaccttcggctataaggaggacgattatcttctgcttgaggatctgtcgttttcggctgaaaagaatgatataattaccgttatcggtgcgtccggctgtggaaaaagcacgctgttccgtcttatgacctgtcttgaaacggaatataagggcagtatcacgataaacgggaaaacaccgaaagaggcgaccggcacggcggcattcatgccgcagaaggatctgcttatgccgtggcggaatatacttaagaatgttaccttgccgcttgaggcactgcctatgtcaaaagccgagcgtatctcgcaggcaaaagaggcaatagaaaaagtaggactgtcgggctgtgagaataaacgtccgtcagagctttcgggcggtatgcgtcagagagtatcgtttgcaagaacgcttgtacagctgtggcacggcagggagcttatgctgcttgacgagccgttctcggcactggattcgcttacaaggatctctatgcaggactggcttatcgggcaggtaaagggacttgacgccacagttatgatggtaacgcacgatgtcgaggaagctatgcttgtaggcaataaaatctttctgctcagcggcagacccgtaaagcagataaaggtcatcgatgtaagtcatatcacctgccgtgaggatctgtataccccgtcatctgtcgagcttaaaaacgagcttgtcagggcattccttactgaaaaggcagagaggggagataatatatgaaaaaacaccttcctgcagtgcttaccggaataggtctgcttatattatggcaggtcatcgcaatgtgcataaatgcggcatacattctgccgtcaccgacacagattgcagtgaaaatatgggagcttcgggagccgctgtttacggtacatactcctgcgacaatgcttgtaacgcttatcggacttcttatttccgtggttctcggtgtggggcttgccgttgtgatggagcgttttgagtgcgtagaaagagcgttataccctgtaatcgtcacaacgcagacgataccggtaacggcgatagctccgctctttgtgctgtggctcggatacggtatatggagcaaggtgcttgttgctgtgcttataacattcttcccgataaccatatcggtacacgacggacttaaatccgcaaaaagagaaaacgaggagctgctcaggactatgggaatgagcggtacggcaatatttttcaagctgaaatttcctgccgcattgccgtcattcttttcggcaataaaaatggcaataccgctcagcattcttggagcagcaatgggcgaatggctcggtgcgcagagcggactgggatatttcagtaaacgtatgatgacacagcttgacggtgcgggagtatttgctccggtagttgttcttgcggtgtgtgcaatgttggttgtagctgttatcagtgcaatagaaagaaaactaataacatggagaaaggaaatttaacatgaaaaacaaaagatttacggcggttgccacagcggcggctattatgctgggcgtgtgcggctgtgcaggcaacacggcttcgtctacggtaggaggcagtaccgatgtttcttctgcaagcggtgaagcgaagaatctcgaggaggtttctgttgtactggactggtaccccaacggttcgcacgttttcctctatgacgctatagaggagggctattatgaggaagaaggacttaagataaaggttgagttcccctcaaacacgaatgacgctatttcaatgacctccgcaggcaaggctgatataggattttactatatgcatgatgtaatacaggctaatgccaatcagaatattcccgttgtttctatcggtgcggcagtacagaatcccgtaaatgtgcttatgtcgcttggtgacaagaacataaagactgtagctgatttaaaaggcaagaagataggctacggcggatctgtcctcaatgaagcgtttgtaaagacgatgcttaagaacgcaggtcttaaggaggacgatgcggagcttattgatgtcggatttgagcttatgtcttctatgacaacaggacaggttgacgctacgatcggcggatttgtaagccacgaagtacccgagcttgaaaatcagggctttacagtaaactatatcaagcctaccgaaaacggcgtgcctgattataccgagcttgtattcgtaacatctaaggaaaacgcagagaagaacgccgacaagctgacacgattcctccgtgcgacaaagaagggctatgagcatgtaaaggcaaatcccgaaaagggcgttgagaacctgctcaagaatcagaacaccgaaaacttcccgctcaacaaggatgttgaaacaaagagtgtagctactatcctttctcttgctgaaaaggacggtgcacctttcttatcacagagcgaggaaacatggacaaacaatatcaagtggatgcttgacacaggcattatcactaagtctgttgacgctaaggatatgatagtaaagctcgttgactaagggcgaaaagcgtataagtaaataccggcatcggttcaggatgccggtattttttatattatgattccgcttaggtggtcaacctcgtgctgtattatctgagcagtgaagccctcatacgtttttatctttatcttgaaatttctatcaagataacgcacttttatcttcttgtatcgctttgttttccgtacaccgtcaagcgacagacagccttcttccgtttcataagcaccgtctgactttattatttcggggttgtacataagaaggtaatcgccgttgtcgtttatggcaataatgtttttcagtacacctatcatatttgccgccatgccgacacaacgttcggaatttgcaatcaatgtttcgagcaggtcttcgccggtttgcctgtcattttctgtcgcaggggcggacttctgcgacagcaggaaaatatctctgttaatttcttttatcataatacatctgcctttttctttttattttaccatatttcaagctgttttggcaagtagggaaaatgacgtttgcacaaaatgtaacctatttgtgctgaataagatattgcttattgtgcgtttatgtattataataacctcagacagataatccgcataagcggattattccgtgcataagcacggttggcggttacccgcctgtctgaggacattttatcaccaaatccttttgtcaaaagacaaaagcacggcgtaccgccgtgtcggcttacgtactgacacactctttccctacacgacgctcttccgatctactaaaagaataaagccgcacatcatattgaacgacgagcggcttttattttttggcaccccctgcgagaatcgaactcacaactaacccttaggaggggtttattatatccatttaactaaggaggcgtgcttgcatattaaattgacagataatattatacactatccgcttaggatttgcaagcactttgcgaaaattatttatacagttttccgtcacagacggtcagtatcctgtcggcatattgggcatcggaaaggctgtgtgtgataagaatgacggttttgccgcatttgtggcgggagagaagcaattccattacttcctttccggagcggctgtcaagatttccgcacggctcgtccgcaaggataaggtcggggtctgcggcgattgctcttgcgatagcgacacgctgctgctgtcctcccgaaagctcatacggcttgtgcgacagccttcccgaaagtcctacagcttcaagcgcagaaagtgagcgttcaaggcgtttcgctgtcgggatacctctgtaagtaagaggcaatgctacattttcaaccaccgacagtgtcggtataagattgaacgactgaaaaacaaaacctatcctttcgtttcttatacggctcagctcgttatcagcaagcgttttggtgtcaagtccggaaaacatatatgttccgctgtcgcaggtgtcgagcagaccgagaatattcatcagcgtggattttcccgagccgctcggacctgtaattgctatgaactcgcccacgtttaccgtaaggctgacgttgtccagtgcctgtaccgtaccgtcagccattgtgtagtgccttgatatgtcagcggcgtttatcagagcatttccgtttgcttgattgacattcctgctttctttcataagagccgacctccttcggtgagaaataacggcaaggcgaggcggtcgtgttggttattacgcctgcgccgtgaagtccgcaacagccgtcatgctgatgtatgcaaggctcgccgcatattatcatattcatttttccaccctctttttgtgagattataaagctatttttagccgcaacgactgtaatattcacagcatttcagtaatattttccgtaacggcagataaactaagtaggtaaaaaagaaaaggagaatgagtatgaattaccgcaaaacatacaaaaaaagaaaggcgtttcatattacgattatcgcaatttcggttattgcagggctttatttcaatatgatgctccccggtgttgtaagggataacgttccttgcgtggacgtaatcttccccgaaagaacagaatatatcccgtccgtaacctgcagcggtacggtaggttattcacaggtcaggagcataaaagaagaaataccgcttattataaaggaatatcttgtgaatgtcggcgacagggtagaccagggacagacgatagctgttgttgataagcaggcagtgtgtgataagctgagcaatatatacagcggttcggtatcagatgtgctgacggcggcggagctttccgacaggatacctgaggaaataccggctttggtatccggaacggtatgctatcttgcaaaaagcggagagcttatagatgccggagcggatattgcaagggtaggaggcaagggcgcacttgtgctgaatgttgctgtgcctgaacgcaatctgtcgaaaatcagaaaagggcagaccgcattgcttactctgtcgtctgttgacggaaaatttgcaggacaggtgaaaagcatcggcaaaagtacgagaaagcaatatctcggtgccgtagaggaaaccgtagccgatgttatgataagtatagaaagcccgtcggacaggctcaaaagcggtgacagcggatatgcggaaatacagacaggtcttaagcgtgatatagttaccttgccttacagtgcggttatgcaggatgaaaaaagcgaatatatctacgttatcgaggacggcagaacaacaaggcgtgacgttataacagggctggagcttgcaaaaaggacgcaggttttcggggtaagcgttgaggaggaagttgtaaaaagcacgcagggagtagcggcaaactcgattattatcagaaataagacggaataaaggaatacacaggcacaaaacggtaattatataatggttggatatgaaacataaagcggaggtaggttatgggactgatgtcggttatggctgatatatggagaagcaggagcagaagtgcgctgactatgagtgcagttgcgataggtattttttcggtgacggtaatatcggcagcagggcagataggcacagccaagataaacgacagccttgacgatatgggagtaaactctgtacttgtggaggcacaggaggcgggagttgctctgagcgacagcgatatagatgctttgggcggattgagcggtgtcaacggtgcgatgccgcttatggcgcaggtcaccaagtgtgagcttatcgaaagcaatgtttcgtgtatggtgtggggagtaaacgagaaagcggacgagattatttcgatgaaggcgatacacggcagacttattgacagatcggatcttaaaaaagccgacaatatctgtgttattgatgatgagatagcactcgaaacatacggaaggacaaatatagtaggaaagacggtgagcgtgaatttcggcggtaaatacactgattttacggtaatcggtgttgccgagtcgggactcagccctatacagaatatgatgaacgatgctgtgccgtattttgtatacattccctacaccacagcgcagaatataagcggtaaaagtgaatatgacaagatagccgttcttcttgacaaaaacggtgacggcgaaactgcgatagacagaattaaaacctgtatggcaaatgtcaagggtgaggggagtataaaaataagcgagcttcagagccagaagaaacagcttgacggaatactggctgccgcaacttcggcattgtcgttcacggcaggaatttcgcttgcggttgcgtccgtatcggttatgaccgcaatgcttgtaagcgtcggtgaacgaaaacgtgagataggcataaagaagtcgctcggagcaaggaatgtaagaatagtcggcgagtttttagccgaaagcacgatgatatgtattatcggcagtattgtaggcattgcggcaggctgtgcagtggcgtttgtcataggtcttgcggtcggtgagagctttgttatgcagacggatataatgcttattgcagttgcagtgtcggcggtgataggtatgatttcggggagctatcccgcatataaagcggcaaggatgaagccggtggatgcgctgaagatgtaaagattcaaaaatttcccctacactcttgacggctaacgattattagcttataatatagctaacgatcgttagctttttatatcgaggtgaatatatgaaacaagcctccaaaaaggaagatacaaaacaacgcatacttgacgaagcgttgcggctcttttcacagagcggttatgatgctgtaagtgttgagagaatagcttcggctgtggggataaaagcgccttcactgtacaagcatttcaaaagcaagcaggagatatttgatgctatcgttgcggaaacgtaccgccgttatgatacgttcacggacggcattgatgtgcatgtttccgaaagcaaagccgatgaaaaggtgtttgacggtatttccgaggaaatgcttgcaaaaaaggtaagacagctgatagaatattcactacacgatgagtatgtcagccgattcagacgaatgatgacaatagagcagttcagaaacgctgagtttgcggcgatgtattccgaacggtatctggaaagattggtgcgttatcacgcagaacttttcagagcgcttatcaagtcgggaacgataatcggagaagatccagatacgctggcacttgagtatgttgcgcctgttgtgcttatggttgaaatttgcgacagacagcccgaaagggaagcggagtgcctgaaacggcttgaagcgcacgtcaggagcttttatcgtacatattcgccgcatatggtgaaaacggcagagaaaagaggcggtaattgtcggaataatcgcaacgccgatagctaaaacgcaggcagcccgtgaggtatggttttatgttatgtcgggcggaataacgcttaaaattcttacagtggaaattgcaaggattatagcgacgctcagataaaagaggtatagatatgataataacggtaatacacggagctatgcacaagggcattacatactcaatgacaagggccgtgcttgacaagctggggaatgataacgagatacacgaatttttcatgccggctgacggtcccggttactgtgtcggctgttacaactgctttatgaaaggcgaggaatactgtccggacgcaaaaaaggtacagccgatagtaaaagctatcgaacaaagcagtcttataattcttgacagcccgtgctattgccttgaaatgagcggtgcgcttaaaaatatgatggatcatctggcatacagatgggtaacgcacagacccgacggcagaatgtattcaaaaatagggctgaccgtttctttatcggcaggcgctccgccgaaaaacgtcacaaagtctatggctcgtcagcttaaatggatgggtgttgcaaaacgctatcagttcccgcttgcgagtatggcgggtaatgtgatgatgctttctgaaaaggagtatattcagaacggcggaaacccttgtaaaataaggacttccgccgttttcttatgcccgtttgtcgcttaaatatgcaaaatgatattaaaagatattggtatttattgcgctttgcaaacgcttattaagtcgccacatggaacttttgcaagttctttcggttctattttctttaatccaccgccataaacacgcccttcttcttcaatttctgccccgctaattttctttaacatttcccatattctatatacagaatcagggtctttagaaatggctttctgcaaagcgggtttggggtaaagcattagatacgaatttgtgactattgcttctgataggttcaaaataaacctaatgggcgaaccattgtttttccctctacccatgtatgagcataggaaacgggtagctattctttgttcttgccaataccatttttttctacttttgcataaatactttttgctcgttttctcaattcctgtttgtaagtaatcccatgttgccgggaaattatctttgacttcttgttcgggcaattcgcaatccagcagaaaatattgtggctcgatttgcggtttaccttcgccgtcagtatttactaaatctgttttcaaatatcttgggcttggtagaattggtttgaaaaatgacatgtcaatacccaattcatcaattttttcttgattcaaaataaagaaattgttatcaccagtggcaagccctcttttaatatcgaaaaagtcacctaatgttatttcagaaatatcgtcatttcgtatttctttttcaggaaaccgcgtccattttcgttcttttaacaattcgtattttgttacttgcctgctaattattggattctcatgcgttccgccataagaaaactctacttcataatcatagtctaatacttcatttttgaaccataccacacatgaagaaaccagcgcgtcagaaaacaatgaattttccgggtcataccgatgtattctaagcaaatgaactttattaagcaagtattcttttatggctgttccataattaacgtccataaattcgctcggaattagccaaccgcaaatagctttaggcgcaagccacttgtgcgccaacaagataaaatgacaatacaaaccagctaaacccgataaagatattccagtttctttattccctacttctgctaaatacaacttactctcttgcgatatataatgatggcgtacatagggcggatttgttattacaaagttgtataaaccattcggcgctatctttgcaaaatcggcattgataaggttaataccagaaccgttccataaccggcttgcgcattcaaagtaatctacatcaagttcaatgcccgttatgcattcgtaaagcagtttggaagtatgtttgaataattaaaaatttatatatcatcaaaaacggcggttgcgatactgccgtttttgtaatttataccatcgcatttctgcgtttttacagaatatcgttttttcatacgctcataataataacgccagcatattgattataaatatgccgaacagcaaaacggataatgaaatcctaatgaacagaataaacgaaaggaaaaacggtatgaaaaagacagcagctatattagcttccatagccgctatgagcttatgcggtttatctgcgtctgcggcagacggtgataacatcattgacggtgtgttaaacggcgcagaggagattgttgacggagttgtaagcggtgcagaggaaatcatcactcccggcggctcgacctctattgacgaaagcacaaacgacagcacatctatacccgacacggtttcacaggtaacacccggtgacagcacaagcagtacaggcaacgtaaacacaggtgttcccgctttcgagcttgcagcactcggtgcggcggcagtaggcggtcttgcggctatggctataacggttcgcaagaacaacaagtaaattgctgaaataaaacaaaacgctcctgctttatcggcgggggcattttgattatttacagcgacaggaaaaattcatagaatttgctttaattgccatctttgccgtaaaaacgctgtacaacagataaaaaaagtagtataatataatttaatgtcgtgctgcggggatacctttcattttataacgaaaaatattcggactgtttcaaattcatctgagctattgcttttaccgagtcacattacataccatactaaacgcacttgtgaaaatcatatctccggcactttcgtctgacctcatatttcagattcagccgttcttacggcgaaagtatatctgcaattaaaagaggaaatatacattatctacatcatcaaggagtaaaaatggaaaaacaaaagcataaacgcagttccttttcgggaaagctcggatttgttcttgccgcagcaggtgcatcggtaggactgggcaatatctggaggtttccgtatcttgcggcaaaatacggcggaggaatttttctgctgatatatatcatccttgcgctgacattcggctatacgatgataaccgcagaaaccgcaataggcagaatgacgcagaaaagccctgtcggcgcataccgttctttcggaaaatcaaagtggctgacactcggcggctggataaacgcagtaataccgattctgatagtgccatactactctgttatcggcggctgggtcatcaaatatctttatgaatatataatcggaaacggcggacagctcgcctccgacggatattttacaggctttatttcaagcggcggcagtgccgagatatgtttccttatcttcacagcccttacggttgcggtaattttcggcggggtacgaaacggcattgaacgtgtatcgaagtttatgatgcctgtgcttgttatcctttcgataatgataaccgcatattccgttactatgcccggcgcacttgagggcgtgaaatatttcctgataccgaacttctctaacttctcgtggatgacggtagtatccgctatgggtcagatgttctactcactgtcaatagcaatgggcatactgataacattcggctcatatatgaaaaaggacgtttcaatagaaaagtctaccaccaacgttgaaatattcgacacaggcattgcgattatggcagggcttatgataatacctgccgtatttgcgttctcaggcggcgatcccgatacactgcaggcaggaccatcgctgatgttcattacgcttcctaaggtcttttcgggcctttcggcaggaacgtttgtcggaatacttttcttcttcctcgttttatgtgcggcactgacaagctcaattgcacttacagaaagtgcggtttcgacctttcaggatcagctcggctggggcagaaagaaatcaaccgtaatagtcaccgttattatgatagcactcggaacgctgtcctgtcttggctacggaccgctcggctttgcgcagatactcggaatgcagatgctcgatttctttgacttccttacaaactcggtaatgatgccgatagcggctatcgcaacctgcctgcttgtttcgagagttgtgggcgtgaagaagattgaagaagaaatgactgcggaaaacggcacattcaagcgaaagaagatattcaattttatgataaaatatctgtgtccagtatttgcggcgataattcttataagctcggtcgcaaacgctttcggaataataaagatgtaacaaaaaacctcccgtcgaaaagcgggaggttttgctgtatatatcctattattctctatggtcgataactctctttgccttcttctctgttctcggaagcgttccgacaggaacaacggttatcttcggtgtaacgctgagctttgacttgaacagctctctgatagtatcgcctgtcttgtcgaagctgactctgccctctgcctcgacagttacaaggataacgtcacggtttacgctttcatcgtgtgcaatattgatattgtactcgcttgaaacgccgtcaaccattccgagtatttcttcgacctggctcgggaacatatttacgccgtgtaccttgaacatatcgtcactgcgtccctttaccgtgtcaagtctgggataatgacttccgcacttgcaaggctcaggaataatgcgtgatatatcgtgcgttctgaaacgcaggagcggtgcgccttcctttacaagagtagtaattactacctcgccctctaccccgtcgggaacaggcttttctgttttcgggtcgattatttcaatataaacataatcgtcccagtagtgcataccgtcatcttctgcacagcttatgcctatacctggtccgtatatttctgtaagaccgtaaatatcgtatatttcaacgccaagctcagttcttatgtagttacgcatcttatcgctccaacgctcagagccgaaaatacccttcttaagataaatcttatcacgcatattgcgtttgtttatttcctcagaaagaagtaaggcataagaagatgttgctgtaagaaccgtcgatttaaggtctaccatcatctgaagctgtttatcggtgttacccggtcccatcgggatagccatagcgcccagcttttcacagcctgcctgaaagccgattcctgctgtccacaggccgtatcctgccgtaatctgtatgcggtccttgtcggtaatccctgccatttcatagcaacgtgctatcatcagtgaccagtcatcaacatccttggctgtatatgggataattacgggcttacccgttgtgcctgaggaagaatggatacgcaccacttcttcatcgggtacagcctgtattccgagcggataagcatatctcagatctgccttgctcgaaaaggggagcttttcaaagtcatcctggcttgaaacaccgtcaattccggcatctctgtacatctttccgtaatagctgtccgtcttgataagtctttttatctgagcgtcaaccatcgccagctgtttctcattcagtttcatatttttcaccctcaccgtatcctgcaaaaaatgccgctttattcgtttcgacaaattttgaaggtacacgtttttctatttctttcagtatggtttcctttgatatgccgagcctgcctgtgccgacagctactccgagtatcgcaatattgaaatatcgtgacgagccgaacggttcgcatatcttctttgcatctataacaacgcagccgcatttgcttttaagatattcgagcattgcggttccgtcatagcctgtatcggcaagcgattctgtaacaggctttaccggaacgctgtttacaataacaataccgccctttttgagatatatcagattacgaacagcctcagcaggctcaaaggcaagtatcatatcggctgtgccataaggaatcagaggagaatatgcctcgcctattcttacatggctcgttaccgaaccgccacgctgtgccattcctatggtttcggcagaatgcactgcactgccttcaatcatagctgacgccgctataatttttgacgcaagcacggttccctgtccgccgacaccgcagataagtatgtttttattcatcggctccacctcctatagcgtttacagggcaaatctgagcgcaaagtttgcatcctgtgcagagattgttgtcgattgtcaccttaccgtctgcgacaataagagcgggacagccaatctcacggatacatttcttacactgtatgcacttgtcggaaattctgcattttgcggtaggcttagatattgctatacaaggtgatttgaatattacagccttcacaccgggcatatccgcacattcacagacagcctttacagatgcgtcaaggtcaagcgggtctactgtgattatctttttaacaccgataccctcaagcacctttgcgatatttatcttgtcaactatctgtcccataaggttgttgtcaagaccggggtgcgactgatgacctgtcattgccgttgtggaattatcaagcacgcagagaatcatatctgcgttattatgtaccgcatttacaacgcccgtgatgcccgatgcaaagaacgtggaatcaccgacaaagccgaagcatacaccatcgctgtccgtatggttaaagccctgcgccatagtgatgcccgcacccatacaaagacaggtatcaaccatatcgagaggcattgcgtttccgagagtataacagcctatatcgccgcagaaatacgcctttctgcctttcatagcctgctttaccgcatagaatgacgcacggtggggacaacctgcacaaagcacaggaggacgaacaggaagcgcaggagcgtccgacagatcgtagccctccgctgtgaaatcttttcctaaaaattcaccgagtatagcggcaatcttatctgtgctgttttcaccgcctgcctgaacctttccgtcgagttttccggacactttgagctgtaatccgtgctttcctgccagcttcagaatctgctcctcaataaaggggctaagttcctctatgcagagaacttctttcgcaccctcaagagatgaaagcacaaaatcttcagggaaaggatatgccgtagcaatctttatcagctttacatccggataatccttaaggcattcctttgtatatgcgtagctgatgccagatgtgacaaccgctttttccgagttaacgccttcggctttgtttgcgctgtaggttgaaaaatccttaccgatctcaacgttacgcttttctatcataatgtgatttgcaaaagaaaggcgggggaaaattacccacttctttgaatcctttacaaagccctcgtattttttaggtgaagggctatcgcagttatcaatcgaagcataggcgtgacagacacgggtcgtaggtctgaataaaaccggagtgttgtatttttccgaatactcaaacgcttctcctatcatcttatacgcttcttcgggagatgacggatcaaacacgggtatacggcagaaatcagcgaatcttctggtatcctgctccgtctgtgaagatataggaccggggtcgtcagccgacactatcaccataccgccctttacgcctacataggcgagtgacataagcggatcggcggcaacattgagtcccacctgtttcatagtcaccattgctcttgcgccgctgtatgccgcagccgccgctacttccatagcggctttttcgtttacagaccattcgatatatacgccgtcgtgccggtatttcgaaatggtttcaagtatttcggaggacggtgtacccggataacctgcaacaagatttacacctgccgcaagcgcacccagtgctatcgcaccgtttcccattacatattcttgcatatgaaaatttttcctttcagagattggtatatacacttttattataacatatgtgtcaatagctgataaaacagcctctgcaaaaaaagcagaggcttcagcttgtagaaaaagtatgttttttcaaaaaaagtgcttgttctcaatccctatccccaaacccctttcccctctcccgtatatttatactgccgtctgaaaacggtgttcctgtcttcacaaaatcaaccgttgccaccagcctgccgttatttctgccggccttcatatcgtttttcatcgccgtgagcattttcccgttcagctcgcttttcagcgttcttccgtacagctcgccgtcgttgcgatggatcaaaatatcatgctcggtttttttcacataatcgaaaatcttctgaaagctgtcgctttccgacagcacacactgcatattgtacagctttttcgcatactccgcactgttatcgttgcaaacagtaacacggtacgtccttgtcatatggcttccgtccttcagcttatatctaagactgacggaagaattatccgtacaatccgcttctccgtcagatgcgtcaataataattccgtttcctccggcatatccgtaaccgttatttattataaaagaatgataatcggttatcgcctttattgattcttcatcgtcaaattcaactatattgctttctccgaagcctatattacaaaactcgttgtacacctttgacgaagaaatacctacgctgtcaatgaaaaacgtgggcggcacatagtgctcaactccgaacacatcgtacgacctcagcacaaagcacatcgcaagcgagcctataactgcgcacacatatcttataagcgactgccacatcttcctgaattttcttccgtgcgtcagctccgcaaagaaataaagaataacacttatcacaatgcttgttacaaacgatgtcgtattatgcgaattcagaccggtaacgcctgttatccacgcaaacaaactcataacaagacccagcgttattatatgatacggcagctcgaacacaaacggagaaccggtcttttcagcctttctcagcctcgttgcaagatacgccagccctagatagataacgaatatcaccgcaaccaccgtcacattccgcaggctgaataccgtgaatatatcgtgccggtccaaaacgccgtcaaccgaatacatatcgtatgaattgcccgcaacaaaagaccccacaaacgagaaaacagtaccgagcggcgctgcaagcatagcgagcgagaacatttcttcatttgtaagatagcttgtgactctgcccataacaatgcttatacctgccgttatgaacaaagcagccactatcataccgagcagcgaatatataacgctgtccgccgttcttcccgcacaggcgttcaccataacgcaaaaagcgtacaccagcagcagaacgatcaccgatgcaatcagtatatagcctgccacgccgacaatatccttaaacagaatcttgtttgtagctgcgtgaagctcttgtatattaaagatactgccgcttttatcaagcatttcatctatcttgcttgtgagcgtaactccgctcagagccgccattgccgtgctcacaataccggtcagcagcagcggaaggatgcatatcacagagcctgagataaggtcggcaaaaaacctctgcgtagtagtaagcggaagcggcagatacatatcaccgtcacattttttcaggttgtagctaaacattacgtttgatactacaattgtcagtatgaaaagcaccacagccgatattgccaggataacttcgcccgtcaccttaacaacatccaccgtgcccatggttttagatacgccttcctcagtgatggctccgctgtttataaaatcattgacaaatccggtgcaaaacatcatacatcccgtaaacagaagcatatacatcgcactgaacacaaacgacagaataagcagattcttgtttttaaagattctgtatctgatgtagctcccgaaatagcttttcttacttgtcaagttttgagctgtcatatccctgtccctccatctcataaatgaatatctcgttaagcgtgagcggtatcacatcgcagaacttcgcacccttttcacgcatcacacggcagatctcatcgctgtcgccgtttacaatgaagctctgcacactgcctatcgtattttccgacaggatttcaagctcagggaaatcagcggccgtctttgcgccgtcaaatgctacctgtatcttatggatactgccttttatgctgtcaagctcacggtcgaatatgaccttgcccttatgaacaagacccacgctgtcacaaagctcctctatctcagtcagattgtgcgatgaaattatgaccgtgctgttattctctgccatagcttcaaagagcatttttctgacgcttattctcatagtagggtcaagtccgtcaaaagcctcgtccagcagaagtatatctgtcgatgccgcaagtccgcacacgaccgccgcctgccgtttcatgccttttgaaaatgttgacatacgcttgttctgcggcagatctatagctttcataagccttgcgaacttctcgtttgaaaatgtcggatagaatatctcgtacatttttctcatatcctcaggtgtcatgttcgcatactgctcaacatcatcgctcacatagaacactctctgctttacgcttacattatcgtatatcttctctccgtcaacagtcacatctccgctgtcctgcctgtatattccggcaaggatacgaagcagtgtggattttcccgcaccgttcgagccgagcagaccgtaggcgcttccgctctctaccttaagcgaaaattcatcaagcgcacagaaatcgtcaaaatatttcgtcaccttttcaacatttatcatacttttccctccttgttaacaacagcgtcaacagccgccttcatcatctccccggtaagaccggatttcacaccgtcctcaacagccttgcgaaactcctccgttgccttttcaagcactgcagaggaatattgcgaccgctcagccacataactgccctttccgggaagcgaatatataagccctctctgttcaagctgtctgtaggttttctgcaccgtgttcggattgatagtaagcgcctttgcgacctcacgcacagcaggcagcttttcgttttcagccatttcaccgccgattatcagctccgctattctcgcctcaagctgctcggacaaaggaatgccgccctgcaatcttaaagaaaacatatcacaccgcctttctccttaactgtactatctatgttgatacagttgtatgataacatacatttccgcatttgtcaacagtttaaagcgattttttccgacccgacacgttttaatatcggtcggaagcatacagttgtacaaactgcacaattttcacaatgacatttctacacccgtatttcatttttcacgaaaaatctcttgtaatttttccaaaatccgtatataatgtatttatccgaatttttgatgaaaggataaaaggataaaaccatgaaaacttacacttgcaaaaacatacgaaacatagccctcgcaggacacggcggcagcagtaaaacatccgtagcggaaggcctgctctacaagtgcggcgagattgagagaatgggcagagtatcggacggcaacagcgtctgcgactatgaccccgaagagataaagagaaagatctcactcggtacttcgcttgcttactgccagtggaaagacgttaaaataaatattctcgatactcccggtcagtttgattttgccgcaggactttacgaaggaatcagcgccgcagaaagcgttgtaatagcgcttcccgcaaaggacggcgttcaggtcggcaccataaaggcttacagagaggcaataaagcacggcaaggcgacaatgttcgttgtcacccgtatggaagaagaaaacagcaatttctacaagtgccttgaggagcttaagacgcagttcggtccgtccatatgccccatagtcgttccctttgacaagtacggcaccgttgaaagctacataaacctgcttgaaatgaaagcatatacttatgacaacggcatacctaccgaagtacccatgcctgcgtcggaaaaccgtctgaaaggtctgcgtgccgcaatggctgaggctgtagccgaaacggacgaagagcttatgatgcgctactttgaaaacgagggtgaggatttcaccgaggccgagatagtaaagggacttcacgacggtatacacaagggttacatcacacctgttgtatgctgttctggcgacactctcgcaggcattgatatgatgctcaacaccattatatatatgctcccaagcccagatgaaacaggcggcgagctttgcgacgacggctcaaaagtacagtatgcgagccgtgacacgcttgaagcaaaggtgttcaagacagtagccgacccctttgtcggcaagctcagctatataaagatagtcaacggtactcttgccgcaggaactgaagtagttaaccgcacaacaggcaatcttgaaaagcccggtaagctcctgagtatgcagggcaagaaaacagaggatatgattgaagcctacgcaggcgacatagtagccgcaacaaagctcagtgcaaacacgggcgatacgctcactgcgtcaggcgatgaaacggtattcgccgcagaaaaataccccgttccctgcttcttcaaggctatctccgcaaaggataagaatgacgagggcaagataagcaatgcgataaagcgtatggttgaggaagacaagacattaagctacgaccacaaccacgaaacgcatcagcgtatattaggcggtcttggcgaacagcaccttgatgccgcaatttcaaagatgaaggctaaattcggcgtggatgtaatagtttccgacccgataatcgcctaccgtgaatctatccgcaaaaaagtacaggctgaaggcaagcacaagaagcagtcgggcggtcacggtcagtacggtcatgtaaagatcgaattcgagccttgcgacagcgacgctcttgtatttgaggaaaaggttttcggcggaagcgttccgaagaactatttccctgccgttgaaaagggtcttgtagaatcgacagcacacggtgtactggcaggctatcctgtcgttaatttaaaggctactctgcttgacggctcataccaccctgtagacagctccgagcaggcgttcaaaatggcggctcatatcgcatacaagcagggtcttgcacaggcacagccgtgtctgcttgagcctatctgtcttgtaaaggtaattcttgacgatgcaagcacaggtgatataatgacggtcatcaacaagcgcagaggcactgttctcggtatgaatcccagcgaggaagaacagggtatgaccgagcttgacgctcagatgcctcagtccgagataaccgaccttgcaaccgttgtccgtcagataaccagaggcttaggtcatttcactgctcagttcgaccactacgagcaattaccgcaggctcttgaagccgacgtaatagccaacgctcccaaattctccgaatacgaaggctaggcggcaatgtgccgctccaagttccgcctttaataacgttgtatatctttaaaggacggcaaaacggcgggaatgatttgtagtgctgacggcaaatcaaacgaaaatgcggcaatgtgccgccccaaattccgcctttaataacgctacatatctttaaaggacggcgaaacggcggaagttacacaaagcaataatcaataaaagcggttacagtgatatgctgtgaccgcttttttatattcttgtcgttagctaccctcgctccgcaccaacccttccaaaaaacgcactatccctcgaaaaccgccaacactcttgccatatgaacgctctgttggtttcgcatccttgcgaaactctgggcgttcaacttcgggcatccatgcccgtcccttgtcaaaggtgagcttctgttgctgagctttgctcagccaactattgagaaattttcacaccaacaccactgaaaacattttccgtaccggcaaggtattaatattttcgtaagtgtattagtgcaactgctctaacattgactcttcaaaaaaacgccactaacctgagatatatgtactaatatgcggacgtgtagcgttaagcgtccctgcattgacaagatatacaatgttcagttgacgagaagataaagaatactatcttcaaccgtgaggaaatctatgacggcgagcttttagagcctgaccataaggatttcacctccgaccgtaatctgttcaactacaccgcaaagataataaccgatattgccgacagcggaaaatctgcagtgatagtaggcagatgtgcggactttgtgttaaagggtcgcaaggatgttgtaaagctgttcatctattccgataccgaaaccgccatcaagaatgtatacgacagatacgggcttgacggcaaggacgctatgaggcttatcgaaaaaaaagacaaggaacgcagcgagtattaccgccactatacaggccgtgactggacggacgcaagaaattataacctctgccttgatacaagcagtatgagctatgataagtgcgttgagatagtaaaggcttatatggctgtgcttgacaagtaagcatggataatgtactgcaacttttacagacggttatagttatctgcattgtactttcagctttgttgcttatttctctcggtatattctataaaggcagaaaaaaacagatacgggtgatattcaaacggataacaaagcatggtggacttaattccaaccgttcaaaatggacatacagcaacaattatactgttgactgcaaatatcccgacagtgaaaagctgcacacattcagatgtgaaaaaactgtctttgatttattgaatgaaggcaaaagctactgtgtgagagtaaaactcagacagataataaaaatctataagaagtaaagcaggctgttgcgtttttgcaacagcctcattatttttatctttttcttgcataacccctttcgctgtgatacaataatcataggacgaaaggaaaaggactatgagcaatattacatacgaatatataaggcgcaacaaggacataaggacatatataagcagtgcggacgatgcactgagcagtatcggatataccgaacattcgctcgcccacgttgagcgtgcggcagatacggcatatatgatactaagcactctcggctaccccgaaagagattgtgagctggcacagatagcggcatatatgcacgatataggcaatgtggtaaaccgcaacgaccacgcacacagcggtgcgataatggcatttcgactgctcgacaagctcggaatgcctgcaagtgaaattgcacttataatttccgctattggaaatcacgatgaaagcacggcaagccccgtcaatgcggtagcggcggcacttataatagctgacaagtccgatgtaagacgttcaagagtacgtcctgccgagcaggaaaagcaaagtcacggagaagcgttatccgatattcacgacagagtaaattatgccgttgaaaagtcggaagtatatttttcaaaagacaataaaaatcttatacttgaccttacaatcgacctttcgataagctcggtgatggaatatttcgagatttttctgacacgaatggctctgtgccgaaaagccgcagaagcgcttggtgtcaaattcagcgtagttataaacaaaaacaggattctttaaggagcagatatggcatacgataactcaaatgtaaaaccgccgataattgatctgctttatccgagcgaggaacagcgcagagcctgccttaagcgaaaggcgcagatagaacaactgccgaccgaatttgagaaagatttaatgttagcgcagctgtcagaacagctgaccccgcataatcagtacaagatgacagcgatactcggtgagctgtgcgacgatatttcggttgcagaatacagacttgacataatagacgatctgcttgcggattccgcacttacaaccactttgcgtaaggtcgttgacaagatgctcgtaaacgacaggacaaatatatataagctgacaacaccagacagctttactgtgcttgacactgcccttacagcctttgaatcatattgcgaatgtatggagatactgcataagctgtatgaagaaaaatcatcgggcatcagatccgccggtcttaaaaagctgtttgatttctttgagggtcattacaacagcaagcattataagaagctgaaagccgagtcggaggaactgcgaagtgctatgaccggcaagattcgcagtgcaactatcggcataaactttgatgaaaacctcgttccgatctcaatgggtcttgtcggcttttccgataagatgtacgaggacagcggaactgtgatagacagaattctgagcttcggctcaaaaaacaacgatcataaagttatgcgtgacctgcacgagcgttttgacgatccgcaatcggcaaagcgtgaggagatagtgaacaatcttgacagggcattgtttacagaacttgataaggtaacaaaaaaatacgttaattcgattgacgatatacttaatgaataccgtgcgataggctttgaggatatgtacgccatagagtatcagcttgacttttacagcggtgcggtcatgatgattgaaaatgtacgctcaaagggtcttgaaatgtgccgtccgacgcttctccccgaaagccagaggaaagcggatataaaaggtcttttcgacccgatatatttcaaggaggctaacgtctggaatttatccaacaagccgcaaaagcaggtcgtaacaaacgatataacctttgacgaaaacgcaggcttctatctgcttacaggagcgaataacggcggtaagaccacatttgtccgtgcagtcggaatatgtcaggtaatggctcaggcaggactatatgttcctgcaagcagctgtgaaatatcgcttgtagactgcgtatacacacattttcctaaggaagaacaggtaggtatagacgccagccgtttcactaccgaggtaaaggaattcaaggcgataagcgactgtataacaaatcacagcctgcttttaatgaacgaatcgatacaaagcaccacaccgcaggaatgtaccgacatagccgctcagcttatgcgtattttctgcattatcggtgtaaggggcatatttgcgacccacctcactccgcttgcaaaggctgcacttgagcttaattccgaccctaagctaaacacaagaaccgaaagcataacggtaaccgttgacgaagccacaggcgaacgcaaatataaaataaagaaaggtctgcctggagcaaacagctacgcttcaacgatattcgaaaaatacggccttgatataaaagcgcttgaaaagaaagccgaaaaaatgaatcaatgacgcaaaaagcgtgtgtggcaatccacacacgcttttgttattatatagggaaaattaaagcgtagaaccgaagtcgcttaccagtatctgaccgttgataggctttgcctcgtcagaagccataaacaggataatgcctgcaacctgctctgccgtgcatgagccaactcttaaatcattgtgctttgacattgcagtgatcatatcaacgtcgaggtcatttgaagcgtttgctgtcataggtgtgagaatatttcccgggcaaacagcattgcaacggatatgtttgtcagcatagcgcattgctgtgtgctttgtgatgccgacaatagccgcctttgacgcaacataagccgcaccgccgcagcccattacacccgcaactgacgcaacgtttacgatagatgcccattccttcatgtatttcagagcggcacgcatacaatacatagtgcccttttcatttgtatttatgattctgtcaagatcatcgtcattgaaacggtcgataggctttagtccgctctcaagaacgcctgcgttatttacaagaatatcaatcttgccgaacgcttctacagccttatccataaggttttcacaagccgccttgtcggaaatgtcagtgggaactgcaagaactgtgccgccctcagcctttatcttgtcggcaaccgcattaagaggttcaatacgacgtgcagatataactaccgttgcaccctcttttgcaaatgcaagcgctgttgcctcgccgacaccggagtttgcacctgtgataacggctacttttccttttaaacgatccatattcttatcctcctgagatttatgtatttgcttattgcagtaagcaattatactactattttaacaaaaaatcaagagttttgttaaaaatttcagaaaatttgtacagcaacatttaaaattgtttctatccacaaatattatttcagaaaaataagcgtctgtccgtcattagcaagcacaggctgtatatagtctattcttggcgatttaaactccctgcgcaccatctgctgaagtacgtttccgttattgcacccgtgcgtcacacgaagctccacactgccctgcggcgcatttcttattgtcatgaccagcttgtttcgtgcctcgtcctttgtcatccggtgcaggtcaactgttattatccgcatatttgtccctttcaaaaaggcaatgataaaatcactgcctttttaacgtatttattcggcactgctgtttttcgactgagcaatgtcctttttcagttcatcaaggatagctgtatcggatttaagaccgtctaccgtatattcaccgtttgatgcggaaataagagcgtcctttacaagcgggtatctccattcaagattgcgcctgtcgaacagcccgaacagttcgccgcttcctaaaaacgcaccgttgtcccaccatacacacggaacacctaccgttttcatctttgtaacataatacttagcccactctgcacgatatttttcattatccttacttcttgcaccgaactcgcctataatgacagcctgacctttgtctataaacagagttttcagcatatcggcaagataatcaatatcgtttgtaaatccttccttgcaagctacccacttgttcgacctcttactgtccgcgagtgcaaagttgtacggggtatatgcgtgtacggaaacaatcagtttatcgtcgttttcaggaattttaagtgccttaagcgcaacttcggatgaagatgccgcatatccgggtatcataagatgacggagcttgttgttaccgtcaaggcttcttattgtagatacgaaatcagcgtccagcttgtttacgacctctcttgtcgcatcactgccgccgttccactcctcgcttgtaccgattactctgggttcattaagtccctcaaatataagatgctcgtcataatccttgaagtaattgccgatttgcgtccatacctttttaagcctgtcgcttgccgcctcgtaattgtcctcggtaggatagtgccatgtttcgtgatgtatgttgaggataacatacatatcgttttccatgccgtaatcaactatctcttttacacgggcaaaccattcgtcgcttatcttatactccggagcttcgcctgtgctccagtcccacgttgtgggaacacgcaaaacattgaagcctgctttcttgatctcgtcgatcatttcctttgtagtatcggggttgccccacgatttttcaattgctcccggatcctgtcccctgttgctttcgtttcctgcgtcaagcgtgttgccgaggctccagcctatcttcatatcctttacaagctcaaccgagcttatatccttgatttctccctgatgagccgttgacgagctgttgctcgtattgtctgcggattgcgttcctgatgtattgctgtcactgcatccgctgattacaagtgaaccgagcagcattgtacacgataacactcctgctgccgcctttttaaatgaaaacataataacactccttatgataacttgtcggttgtatggaactgctttaagttgcctatcttttcgttgcgttcgttcagcacttcttcgacctcagaccattcaagccctctgtcagcgcaaagcaccataacgtgatataaaagatcgtttatttcgtttttaagctcgtcattgtctgcgttctttgcggcgatgattgtttctgcggcttcctcgcctaccttcttgcatatcttgtctacgcccttgtcaaaaagatagaggatgcttgcagtcagccacacaaagccactgcacgatgcagtggcacaaatggctgacgacctgtacgggggctctgcccctgcgaccccattttttaataaacaagaattttttcaacagcctgatgtccttaaaacgagatacgctttttactatcgttaatataataacatatttgctgtaccatttccagtacaggaacgattttattcggcagttacggcacattttcaacaaattctttacatcccggcaaaaatgtagtataatataaaggcaaatacaaatcgacagccccgtccgacacggaatttataacggaggcagtatcatcacacgggacagcatatgccgtccctgcatttttgaaaggaaacatcttatgtctgaattaatgttaggtaatcaggcggtcgcaagaggtctttacgaggcaggagtcagcgttatatcaagctaccccggcacacccagcaccgagataaccgaattttcgtcaaaatatcccgaagacgaaatgtactgtgaatgggcgcccaacgagaaggtagcctgcgaggtcgcaataggcgcaagcattgcaggtgcaaggagcttctgcgctatgaagcacgttggtcttaacgtagcggctgacccgcttttcacagcaagctacacaggcgtaaacggcggtatggtgcttgccgtagccgatgaccccggtatgcacagctcacagaacgagcaggactcacgccactatgccatcggcgctaaggttcctatgcttgaaccgtctgactcgcaggagtgcaaggactacgcaaagctcgcttatgagatttcggaaaagttcgatactcccgtgattttaagacttacaacaagagtaagccactctcagtcggctgtaacaacagcagacagaatcccccacgctatccccgaatacaagaagaatatcgcaaagaacgtaatggttcccgcaaatgctataaagaagcacgttgtagttgaacagcgtacacttgaccttatcgaatatgccgaaacatcgggcataaacactgtcgagatgaacagtgacgagataggcgttatcacatcgggtatctgctaccagtacgcaaaggaagcactgggcgacaaagcaagctacttaaagctcggtatggtaaaccctctgcccgtaaagctgataaaggactttgccgctaaggtaaagacgctctatgttatcgaagagcttgacgatgttatcgaaacacactgccgcaagaacggcattgacgtaaagggcaaggagctgttcacccttcagggcgaatacttccagagcaaggtaagacaggtcgttctcggtgaaaatgacgaatggcagactcttgatgccgagatacccgttcgtcctcccgtactctgtgcaggatgtccccacagaggcgtattctacatactcaaaaagctcggcgttatggtaagcggcgatataggctgttacacgctcggtgccgccgctcctctcagtgcgatcgacacgacagtatgtatgggcgcaagcataagcggcctgcacggcttcaacaagggcagaaagggcgaatacgagggcaaggcggtagccgttatcggtgacagcacatttatgcacagcggtatcacgagccttgttgacattgcatacaaccgcagtaattctaccgttatcgtccttgataacagcatcacaggtatgacaggtcaccagaacaaccctgcaaacggcaagaacatatacggcgatcctgcgtctgccgttaaccttgaagcactcgctcacgctatcggcataaacagcgttacagttgtagaccccggcgaccttgccgaaaccgaaagagttataaaggaggagcttgcaaaggctgagccttcgctcataatcgcacgcaagccctgcgcattgctcaagaccgtaaagcacaagcctccgttccatatagatgccgacaagtgcaagaactgcaagtcctgtatgagaataggctgtcccgcactggtttcaggtgacaagtgcatcactatcgacaataccctgtgcgtaggctgcggactgtgcgaacagctctgtaagtttgacgctatcaaggaataagctctgaaaggaatatagctatggaaacaaaatcaataatgatagtcggcgttggcggacagggtacacttcttgcaagccgtatactcggcagtgttctcggcacagcaggctatgaggttaaggtaagcgaagtacacggaatgtcacagcgtggcggttctgtcgtaacatacataagatacggcgaaaaggtatacagccccgttatagaaaagggtcaggctgatatgatagtaagctttgaacagcttgaagccgcacgttatgtatcatacctcaaaaaaggcggtacaataatcacaaacacacagaagataagccctatgcccgttatcacgggtgcggctgaatatcccgacggcattatcgacaagataaaggctatgggtataaacattatcgcagttgacgctctctcagccgcagaaaaagccggcagtgcaagagccgttaacgttgtgcttatgggcgttctttcaaaggtacttcccggcattgagcttgacgcttggaaaaaggcagttgaaaagtgcgtacctgcaaaggttatagagataaacgaaaaggctttcgatctcggcagagatctgtaagcgttcaaaaaggagcttttcttgaagattatttccgactcaacgccgctcattgacggctaccgtatgcctgcggagttttcctcgcacagcggctgtataataatattccccgagcggccggattcgtggcagtacggcggagtaaaggcaaaaaaagcattctgcgaggttgcctgcgccattgcaaaaagcgaaaaggtcaccgttcttgcctcatttgaacagtatgaaaacgcacgcagaatgctcccccctcatatccgtgttgtcgagatgtcctctgacgatgcgtgggcgagagatgtttcacccgagtttgtcgtgaacgataagggcgatatgcgtggtgtggactggtatttcaatgcgtggggcggtcttgttgacgggctttatttcccgtgggacaaggataacaagatagcacgcaaggtctgcgatatgctcgatgtcgatgtttatgacttcagcgacttcgttcttgagggcggaagtataagtgctgacggcgagggtacgattcttaccactgaagcgtgtctgctcagtgcaggaagaaatcctcagctatccaaagcggaaatcgaagaaaatctctgcgagggtctcggtgcaaaaaaagtaatatggcttccgggcggaatactgggcgatgaaacaaacgaacacgttgacaacatctgcgtgttcgccgctccccacaccgtgcttttatcatggtgcgaggacgaaacgagcgaacagtacaagatgtgccgagcctgccttgacgtgcttgaaaacagcacagacgcactcggcagaaagatagacgttgtaaagcttgctatgccaaatccgatatatatgaccgaggaagaagtcgaaggtcttgacctgtttgacggcgagcctacaagagataccgtaagcccgctcagcgcaagctatgtaaatctttatataggcaataagacagtggtaatgcctgctttcggcggcgagaatacagagtatgacctcagagcaaagagtgaagtacagaaggtattccccgaccgtgagataatacagatatacgcccgtgatatacttatcggcggcggcaatatccattgcataacccaccagataccatcatttgtcagaaaggaaactccctatgataagtaatgtcaaggttgcggcagtacagatgagctgcagtgacgaccgtgaagaaaatatagcaaaggcagagcgtatggtaagacaggcggcatcggacggagcgaatgtgatacttctccccgagctgttcgagcttccgtacttttgccaggagaagaattacgattactattatcttgccgacaaaaccgaagaaaatcctgccgtaaagcgttttatgcaggtcgcaaaggaaaccggtacggttatccccgtcagcttctatgaaaagcacggaaacgcatttttcaatacgatagctatgatagactgtgacggctcgcttatgggaatataccgtaagagccacattcccgatgaccatttctatcaggagaagttctacttcacaccgggcgacacaggctttaaggtatggaatacaaagttcggctgtatcggtgtcggcatatgctgggatcagtggtttccggaggcggcacgctgtatggctcttatgggcgcagatatgctcctttaccccaccgctatcggcagtgagcctatactggagtgcgactcgatgccccactggagaagggctatgcagggtcattcggcggcaaaccttgttcccgttatcgccgcaaacaggataggtacagagtacgttcaccccactcccgaaaatcagaatcaggactcatcgctgaccttctacggctcgtcattcataaccgatgctacgggagcgatagttgccgaggctgacagaacggacgaggcggttataacagcggtaatagaccacgagcagaaccgtgacctgcgtcagagctggggcgtgttccgtgaccgccgccccgagttgtacggaaagattatggaacattgacagaagatcttttcttgacaacccccgaccgttatgctaaaataacaatacaaacaatacaataattctgccaccgggtagagatgcgaaagcaccgtcagtacatcgttaggtctttgaagatgtacctgcggtgctttttcggtaaatttacggaggatataatgctcagaaaactaaacaactacttcacaacctttgaaaaaatactatggataggctcgttagtgctgataacaggctctgccgttatgttcggcaaggacgggatactgtccgtcatagcgtcgcttatcggcgctacctcgcttttgctcaatgccaagggcaaccccataggacaggctctcggcgtgattttcagcatactctatgcgataatctccttctcctttgcctattacggcgagatgataacctatctcggactaacaggacctatggcgcttgccgcttttataagctggataagaaatccgtttgcaaagggcaaggctgaggtaaaggtaaatcatatccacaggggcgaggttctctttatgttcatactcaccgccgttgtcaccgtagttttctacttcgtactcgactttttcaacacggcaaatctgattccgagtaccgtttccgtcacaacgagcttcctcgccgtatatctcacattccgccgcaaccgtttcttcgctgtcgcctatgccgcaaatgatatagtgcttataatcctgtggtcgctcgccgccttgaccgatataagctatatctcggtcgtagtctgctttgtgattttctttgtaaatgacatatacggctttgtaagctggagcgcaatgcggaaaaggcaggcggctgaaattcagccgtgaatataaggcataaaaaatgacgtcaccgacaaggtagcgtcatttcagcttgtagaaaagtatgttttttcaaaaaagtgcttgtcctcaatccctatccccaagcccctttccccgggaaaggggctatattactggggctaccgcccctagaccctgtcgggggctacgcccccatttttatgttcgtttgttattgataacatgtaaaccatgtgcttgcacaaagtgtaaaccatgttactcttgacacaagcccactcccctacgaaaagtgggtgggatagtgcggttttggaagggtcaatgtcagtgcagttgcattgataaggtcacgaaaatattaacaccttgtcggttagtataatgttttaagcggtgatggcgatatgtttaacggtgcggattcaataatcggttttttacagaatgattatgttaattttgttgcataagtcttgacggctcgtgataatcagggtcattgataagatgagaatttatggtggagttgtttatgatacagcctttgttcataaagcctatctcgagcgagtaaacgcctgaggatgagcttgattttatatcgctgttctttataagcagagagccttttccttctgcgcttcctatgcctgcgacagcgtcgccttcaacgtgtacggcgatgtctgagtcggatataacggtgtcgcacgctgttttgcggcagcctacggccgagccgcacagcgcattgagcgacagattaagggtggagtttttgatatttatccttgacggagtgctgccgtcaagtgccgccagcgaacctatacagcctgcacgttctccgagcgagcggataaggaacgttgtgccgtctgcttttatatcggtatatccgcaaagagagccgacagcgagtgcgttattgcccgaacagcttatatctatcgtagcgttgccggtttctatgccacagcttccgtcacaggagcctgcaccgatacaatccttgccggttgaggacattttgatattgccgctgagcagctttatgggcgtttcacagggggaaacaccgccgccgatacatatgccgtggtcgccgtttgcctgcagttcaacattgccgttaacatttattgtaatctcgccgaaggtatcgttgtatccgctgccgatacagcagccgtcattacggtaggagtcaatgtagagattgccgttgccggttataagcagttttgatgagccgggaacggatattccgtcatagctgagaaaatcggtcccttttatttcgagcgtggtgtcggaattttcaccaagacgtatgcactggcgcagagcgccttttatgttggcgttttcgagtattatgtgtgactttgagccttctgcggtcttgataacaaacgacataacatcacagccgtttgcgtaaaggtgtgctacggcgttttcgactataactcctgtgtatctgcctgacagcagtttttctatatcgagatgctcctcgcaaccatcgtggacgatgtaatcatgggccttttttatttcggggcggcacatattgagcatacgcatctgctcggcgacagcgtcgggtatatcgggaacgatctccttctgcggctttgcagtatagaagccctgaatgaaatctactcctctgcgtatggtgacgctcatttcgtcataggtttcgacaccctccgcaagcacctttatattgttcagccttgcgaaatcaatgatgcctgtgagaaagtgctgtttctttacgtttgtgttgatgtcggctatgagggagcggtcaacttttatgacatcgggctgaaggctcagcacagcggcagtattggagtatccgcttccgtaatcgtcaatggctatcatacagctctttgacttgaaaaggtaacgcaggcttgctatcttgtcgcctgtaaggtctgcctgctctgtaaactcgataacaagctgtgacatgatatttccgtatttttcgcagagcctgttgaaatcgtactccgtaatcatactatttggtattgagtttatgaatatcttcttttcaccaaaacgggcacggtttgcggagattatctccagaacgttttcgaatgtgagccgttcgatatcataaagcctgccgtgttctcttgctatcctgagcacctcgagaggcgacgaatttttcggccgcataagcgcctcgtaagcgtaaacggagccgtcaacggtagacactatcggctggaagcagtagctgaaattgttatcgtaaataagtcctgtcaggagctttgaatcagaatagctgttgcattcggctacatattcttccgctgagaactctctttttatactgccgagcgcctttgctctgaaaagggcgaaatcggcatagttaatcatcatatctatagtagccgcctgcgagggataccagcagtagcctgcggttatcgtatacgcttcgctccgtgtttcgatggtgttgccgaattcatcggtcagcttgcagcgtgcaacggcatcgtacatctttttcataatgtcggatatttcggactttgtcatctgtctgaaaaatatgaaaaaatccttatagcttttcacgccgattataacgttatcggaaataaagcgttttatcgcatttgccgcagttgcaacgcacagtgcggttttatcgtaattcagctcgctgtctacacgctctatgccgttgatgtgtatcgccgccatacagcactgtgcagtaccgctgatctctgagagcatactgcgtacacgttttatgaagtagtcacgggtatacatacctgtgagcatatcatattcattagcgttatccttgtgtgaacgggcctccattatctgtgttacgtcctgcacaaagccgagcatataatccgtgtcatatacaatcttgatttttatatagcttgtttcgccgcctgcggtatacatatatatgttcttgtagtcttctatctgattctcgttaaggctgtcaagcaatgcgtaaaagctgtccttgctcatattatcgccttctatatggagcatagaggcgacgtttttatcgtaatatgcctcattcgaatcgtgcggcagcttgaaaacacctatagtgggaaagttgtcgagaaatatattccagtcgtgtcggctgtttccgtctttatcaaaaaagctcatataaagtcctccggtttacacagattaccaagttcattatacaagtttttaccacaaaagtcaattagatttaaacaaaatgcacaaaataaacaaattatcaggtcaattttgtacatttttgagaaaagcaaagccgtgcggttgttacagcggttttgctttcagacagtaaaaatctttttcttacaattttgcaagttagcgaaataaggaaataatttgctgtataatcatagtatgaagaactgtcggtttaactgcttgttatggcggttatagcggcaatctgaggaagggtggtatttatatggcatttatgaagaagaaaacaaagcaacgatgcaaaaccatcctgtcgttattctttgcgctgacgctgataatgtcggcggtcacctttgcggtatcagccgcagaagcggcggcgctgtcggtacagctgaaaaccgacaaggaggaatatacggcggatgaggatatagcattaacgcttgagatcagaaacggcagtacgggcaggcttgtcgatattgcttacgatattacggcaccggacggctatgagcttaaaagcggaagtgcaagcggcggtgaaacggagcttcttgcaggtggaacgctgaagtttgacaacgtgtattctgcggtaaaagcgactccggataatccttcgacagacggaaggataaatccgaccgtgccgcttatatcggcggtaatatgcgctgcggcgcttgttgcgcttaacaggaagaaggcaaagaaaatgctcgcctcgctgctgtgcgtatccttgcttttgacggcactgccgcttgatgttgccgcagaggaaatcggcaaagcggcggctgataccgcagatgtgacggttacaaaggatattaccgcaggcggtgcgaaaaagacgtttaccgcacgggtaacggcaggtaaaaccgccgacagcgtaactgttacatatgatacgctgggcggaaataagatagacagcgttacgcttgccgccggagaaactataggcaggctccccgaagcgataaagaaaaacgctgtcaataacggctggtatcttgacaagcagtgctcgacacagttctatgaggacgagccagtaaacagtgatataacgctttatgcgggatatgacgaggataagataaagccggaaacgcctgattacaacgagataaccatatcggacgcacctgaggacttttcattctcacttatctcatcacagagcataacggatgataatttgcaggacgttatcagtattgaaaatcagttcggagaaatgccgctgctcaaagttgaaaatacaggcagcggagtatacactgtaaagcctgttatcaactggacggaaggcggcgcatatgtgctgagccttatagataacggggtgcggtttgacggcatcaattccgacattatgcctgacgagaagataagaaccattacgcttttcatttacagggaagaaacgaacaacgtagttctgaaggacggcatagttactattccgaaaagtcggataagagaagatgacgacaacgagcatatctatatgtcacgcagtgaattcgaggcactctcgatacacgagggtacggtgatattcgctgacgacgctgaagaaccgagctatctgaacgtcgtgtcgtatgagctttttggcgatgaatacaagattctcacggtcggcagtgatgttgacgatatatacaaagaacttgatatttacttcaaggaaaagtatgttgaaaacgatgtgcttgccgaggcgatagataccgaaaagctggtagaacagctttatgcaagcgaaggaacacagcagcttacatatatgcttgccgccgctgtgtatgacagcaagacggtaaggaagcttggcgacggcaatgcgccgtttgagcttatgtccaacacatatatggacggggtaaactggaacgacaagcagataaagctgaatgtaaaggagcttctcgaagggcttacaatcagcgctaaggtcggtacggcgaagaatactaatttcaaatgtataaacggtttcccgaatgagcaggactggacggcgctcaacatcacattcagctatgagatgacgcttaaaaacaaggtaaagctggaggctgaggtaagcatcagcgaataccttatcataggcgtaggcggcactctcagcttaaagcgtgacttcaacgtgaagttcctgcccttgtcgcagacagatgtaacattcaagatactggtctgctcggcagatgaggaagaagacgataagcagcaggataaagaagaaaagagagatgtttccgttgagatagaagccataatgaacggcgaggataaggaaagcggaaatatcataaaagacgtgcgtgaaatgcttgaaaacaagggcggagccataaggctttgcgaggtgaaccttttcagcgcaacgttcatgcctatactgccgctgtctataaagacggagcttaactttgtggttaatgtttcgtttgcggcaggtatcagtatggaagcatcagtgcttcaggcaaagggtcttggcataagaggaaatatcaaggaaccgtcatctataagcgtatacagatttataatggcgggcgacgaccgttacatatttgatatgtacgcttacggctatcttggcgttgaggcgggcatcgagggtaaggtatcggtatcaagctggccgaacagctgaacactttgaagatcaagcgaaagatacttgaattttcgattggtgattactttatccgccagcccgtcagcacagacgaaatagttgccgaaggtcagaagctaagccactgtgtcggcggctacgccgaaaggcacgcaaccggcaagctgacaattatgtttctccgccgaaaatctgcaccggacgagccgtactacacgatggaggtatcaaacgactataaaatagtccagtgcagaggttataaaaacaactgggttacaaacggcggacaggaaaaaccacaggaaataatcaatgtcgaaaagatgtatcagcagtaccttgacagtattgcggcgaaaaaatcaaaaacaaaatcaaggaggaaaacagcatgaccaaacagcttacactgtatcagcaggctcaggcggtgcatcaggatctgatgattcaggaacaggttgtagctcagtctttaacgcagattgccatagaccttaaggaaatcagagataggcggctttatgcagaactcggatattccgattttgccgaatactgcgaaaacgccacaaagacgggaaaaagacaggcttataatctcatatcacttgttgaacagtacaagatagatgatctttccagacttgcgtatctcggcagtaccaaactaatagctcttaaatctctcggcaaagaggaacgtgaggagcttatagagagcggcaaagctgaagaactgtcagtgagagagcttaaggaaaagataaaggagcttaccgataaaaacgaacaattacgctttgagtttacatcagtaactgacagtgacaaggataaagacagcagaatcaattcgttacaagcacggcttgacaatacaggaaatgctatgcggcgaaccgcagaagaaaatgaaaagctgaagttacagatagctgaacttgaaaagcgtcctgtcgaagtggcagttgccgaaccgtcggtcgaggatattgcaaaaataagagcagaagccgaagctgccgcaagagcggaatacgataaaaagcttgctgatgaaaagaaaaaagtgcaatcgattgcacacgaagaagcaagtggtaacggtaaagaaatcttcaagattcatctgaaaaatatacagcgtgaattcaatgaagcgttagagcttgtaagcaatgcgtcagaaaatgaacgcagcagttatataaaggctttccgtgccgctctgaatgcgtgcggggatttgattgctaagttataaggaggaaaaccaaatgtcagtaaaaatcagctcacttgaaattgaaaatgtcaagcgagtaaaagcggtacagttaacgcctgccgagaacggtcttatgataatcggcgggaagaacaaccaggggaagacatcagtgcttgacgctattgcatgggcacttggcggtgacaggctgaaaccgtcacaggctgtgcgggaaggctctgtgattccgccccacatggaagttacgctcagcaacggtataaaggtagtcaggagcggcaataacagtacgctcaaggttattgatccggacggcaacaagggcggtcagcagctgctcaacgaattcgtagaacagtttgcacttgatcttcctaagtttctcgaccggtcgagcaaggaaaaggcggatactctcctcagaataatcggtgtaggcgataagctgtacgaacttgaaaccgaagaacagaagctgtacaatcagcgtcacactatcggtcagatagcggatcagaagaagaaatacgctaaggaaatgacggtattcgcagatgctccgaaagagtttgtgtcagcaaccgagcttatcagacagcagcaggatattcttgcaagaaacggcgaaaatcagcgtaaaagacagctcagagagcagtacgacagagaacttgagttggctcggaaggcatacgaagaagcacaggcaagacttgaaacggcaacggcaaacgcagaaaccgcacatcgtgacgctgaagaccttgcagacgagagcacggcagagcttgaacagagtatagcagacattgagcagataaacgcaaaggtccgtgcaaatcttgaccgtgaaaaagctgaacttgacgctgaagcgtataaaactcagtatatacagcttaccgaagaaatacagtctgtcagaaaagctaaaacagatcttcttgacggtgcagacttaccgcttgagggcttgtcggtagataacggcgagcttacatacaacggttttaaatgggataatatgtccggttcggaacagctcaaggttgcgaccgcaattgtccgcaagcttaatcctaattgcggatttgtgcttatagacaagctggaacagatggataccgatacgctgaacgactttggcagatggcttgaaagcgagggcttacaggcaatcgccacaagagttagcacgggtgacgagtgcagtatcataatcgaggacggctattcaaagccggttgaaaagaaagaaactacaacatggaaggcaggtacattttgatgagtacaacaatgaacatcactaaaggcagaatcgaaaccgccaagaaggtggttatatacggccctgagggaataggcaagtcaacgtttgcatcgcagtttcccaatccgttattcatcgacaccgagggtagtacaaaggaaatggacgttgcccgttttgataaaccgacatcgtgggagctgcttaagagccagattgagtatgtcaagctcaataagccttgtaccacgcttataattgatacgatagactgggcggaacagctttgcatcaagtctatctgcgataagtacgacaaaaagggtatcgaggatttcggttacggcaacggctatgtatacgaaaaggaagagttcggcaggttccttaatctgcttgaagatgttatcgaagccggagttaacgttgtacttacagctcacgctatcctcagaaagtttgaacagcccgatgaactcggaagttatgaccgctgggagctgaagctcggcaagaagacaaccaatcttatatctcctcttgttaaagaatgggctgatatggtgcttttcgcaaactacaagactatttcggtagcggttgacaaggacggcaaaaagcataaggcacagggcggcagacgcataatgtacacgtcacatcatccctgctgggacgcaaagaatcgttacggtttgccggaagaaattccgatggagtacgggcagataaagcacattatcgaaagaaatgttgccgcacagcctgccgctaccgttcagactgcacctgttcaagtggcagctgcagaaaacgcaacaatcgccacgaatgataatgtaacgtcggctcctgctccggcaataacacaggaaagctcaggcatacccaaagctcttgcggaccttatgacagcaaacagcataacggaagagcagataagagcggcagtagcaagcaagggatatttccctgccgatatgccgataaaggactatcccaaggaatttatcgagggcgtgcttatcggggcatgggagcaggtaaaagcaatgataacggaaatgcttatgacagactatgagaacgaggcttacccgttctgataaacgaaaggagaaataacacatgagtgaatttgaaaaagaattaggctgggacgacgtaattgagaaagaaagcgattttacgcttcttcccgcaggtgactacgactttacgataacaggcttcgagcgtgcaaggcatgagggaagcgaaaaacttcccccttgcaacaaggctgtagtatctattcatatagacgctccggaaggctcaaccacaattcaacataatctgtttttgcacagcaagtgtgagggtatgctttcggcattctttatcggcataggtcagaagaaacacggcgaaccgcttcgcatgaactggaacaacgtcatcggtgccaaaggtcgttgcaaggtgtacatagatacttggaagaacaagaatggcgaagaaatgcagtctaacagaataaaaaaattctatgagccgtcaccggcacagactgtttctcaggcacctgcaagctctcaggcgggtgtatttacaccgggtaaattctgatggaattaagaccgtatcagaaagaagccaaaacagcggtactttcacagtgggagcagggcaattcaaaaaccctgctcgtactgcctacgggttgcggtaaaacgatagtttttgcaaaaatcgcagaagaccgtgtccgcaacggagaaagggtacttatacttgcgcacaggggcgaactgcttgaacaggcggcggacaagatactgaatgcctgcgggcttggctgtgctgtagaaaaggcggaagaaagctgtataggctcatggtatcgtataacggtaggctctgtacagtcgcttatgagagaaaagcgacttgcacaattttcaaaagactatttcaatacgatcataattgatgaagcgcatcattccatttcggacagctatcagaagatactcggatattttgatgaagcaaaggtactcggagttacggcaacaccggacagaggagatatgaaaaatctcggacaggtattcgacagcctggcgtatgaatatactttgccgagagctatcaaagaagggtatctgtcaccgataaaggcactcaccattcctctgaaactcgatctgacaggtgtcggtactcaggcaggagattataaggcgagtgacattgacacagctcttgacccttatctgtatcagatagcggatgaaatgctgaaatattgcaaggaacgtaaaacggtagtatttctgccgcttataaaaacgagtcagaaattctgcaagatacttaacgaaaaaggcttccgctcggcagaagtcaacggaaacagcattgacagaggtactgttcttgctgatttcgatagcggtaaatataatgtgctgtgtaattcaatgcttctgacggaaggctgggactgtccaagcgtagattgcgtaatagttctcagacctactaaggtaagagggctgtactgtcagatggtcggcagaggaacaagactttgtgagggtaagaaagacctgttgcttcttgactttttgtggcacacagaaaggcacgagctgtgccgtcctgcacatctgatatgtgaaagccctgaagttgccgaaaagatgaccgaaaatattgcggccgcaggtatgccggttgatattgaacaggcagaagaaaaggcaaaagaagatgtagttgctcagcgtgaggaagcgcttgcaaaacagcttgcggaaatgaaaaaacgcaagagaaaacttgtagatcctctccagtatgaaatgagcattcaggcggaagacttatcttcctatgttccggcattcggctgggagtgttctccgccgtcggacaagcagaaaacaacgcttgaaaagctcggtatattccccgatgagatcgacaacgccggtaaagctcagcttttgctggacaggctcggcaaacggcgcactctcggtcttacaacaccgaagcagatacgttttctcgaaagccggggctttaagcacgtcggcacatggcagtttgaaagtgcaagaaatctgattgacagaatagcggctaacaactggcacgttccgaacggaatgctcttccgatcttcgtttgcggcggctatgagcggaatcgactgtatcagcgcatttgtgggaagtgtggcaggctatattctcggcggaaattataccgacggcgttactgttacatcggctctgctttccgttgttgccatccgtatgatagtttcacgcagaaaatcagccgtgtctgagatagtatcggctgtcacggcggcaggctctgtttttgcggcgaattttctcacatcgtctaccgtaagcgaggtgatgaactgcatcattctttcggtcatggcaggcggaggtgcggttgttgctttacgcttgtcacggcttgccgaaaagcgtgagatagcaaagataaccgtccgcagcgatcctctcagctttatctgcgttctgggcggctgtgctatagtgtccggtatactttcgcactacagcgtcggcatcttcaatataggaataattttcgcatcctgcctttccctttgcagtgctatgaagtacggcagtggagcaggtgctgtgtgcggtgcggtgtctgcgctcgggtgtgcggttgccacagccgactacgcttttcttgcagctgttgttgctcctgcggcgtctgtcggaggtatgttcagcggcggaagaaagctgagtgccgcaggaggctttgtgctgaccgcaacgcttggcactgcgctgttcggaatggataattcaaagctcgccgttgttgcctgcatattcatgtcatcggcggtctttatgctgttaccggcaaagcttacagccgatcagggcgatattgccagagttaaagcgggtgaaaacagcgtcagaaaactgttttcaaaacggctgaaatttgccggaggagcgattgccgaggtaagaagaacggtcggtatcactgccgaaaagctggataataacataggaagcgatataagctgggtgtacaatacggcctgtgacgaaatatgccgtaagtgcaggtataatatgcaatgctggggcaaggagtacggcgacaacattaaacagtttgcgaagattacgaatatggtaaagtcgggagaaagtgccgatccggatgctttttcggtgcctttaagcgaacgatgccctaaaaagcaggagctgattgacaaaatccgcaggctgtgtgatgtttatgtggcgagcagtacggaaaaacgaagaattgcccgtatgcgtaatatcctgacggctcagctgtcggcaacggagcagattctctcgcagttatccgatgagattgaaaacagcggagaaattgagcctcagtacaacaaaaccgcctgcaatgtgttgtcgaagctcggctgtgaagatgcagacgcagtgaatgtggagcttggcgagcagggaagaatgtttgtcgaggcatattccgataccggttttttcgcatcaaagcaggatatatgcgaggctatgacgcttgctttccgccgccgctttgatttgccgaccttgagccgtgtcggaggggcgtgtaagctgagtcttttttcgggaaccacctacacgcttgacgttgaaatatgtcagataagcaagacggagggtacagcctgcggcgattattacgagagcttcatagataagaacggtacagcgtatgttgtattatcggacggtatgggcagcggaggcagggcgagagtggactcatcgtttgcctgcgctatgctaatacgtcttttgcaggcaggtgtcggagtagaggcggcaatcagcgtaatcaatacatcacttgtgtgcaaatcctccgatgagagctttgctactcttgaaatatgcgctgtcgacctttacagcggaaagatagacttatacaaggcaggcagtgccaacacttatatcaagtgcggaaaccgctttgtcaccataggctgtaagggcttgccgataggagtaaaggacgagcctgtatacgacaggagaacgtttacgataggaagcagggatatgatagttatgacaagcgacggtgcagagctgaacgagaaatggctttacagggagatggataaacagcccgaccttaaggaattctctaaagaagttgccaataccgccagattctatgccggtgacgaaaagagcgacgatatatcggtgattgcaatgcggctcagcagataacgccccgataattcggtgcgatgtgcaacgaaatccgcaacgctgtcggaatatcagaaaaaacagtattgaccttgttctttcagagtgataaaatatatagcggtgtgtctgtgcgtttgtgccgaagatacaccgcttattttgtgcatataacgaggtcattatgaaagccgatattctgacaaaaacttggatagccgcaattctcgcaatattctgctctgctttgtggggcagtgcttttccctgcgtaaaaatcggttacgggctttttggcgttgacacttcacaaccaatgtcattgatactttttgcggggatacgttttttcgcagcaggaattatggttattataacaggaagcataatgcacaaaaagccgcttgttccgaaaatcaaggaactgccgaaggtggcggcactgagccttactcagacgattttacagtacctgttcttctatatcggacttgccaatacaagcggcgtgaaatcttccgttatcgagggtatgagcgtgtttgtgtgcatacttatctcatcgcttgtttttcgccttgaaaagctgacaaaattcaagattatcggttgtgtgcttggcactgcgggaatagttgttataaatcttgaccgctcgctgctcagcggattcagccttaccggagatggctttattcttctttccaccattgcctatgcgatttcatccgtgcttataaaacgcttttccaaagacaccgacactatgatgctcagcggctggcagtttctgctcggcggtgcggtcatgactgttatcggcttacttgcaggcggtagcataactctgcccgaatcgcctctgcctgccgtactgatgcttttttatcttgcgtttatttccgcttgtgcctactcgatctggagcctgctgttaaagtacaaccccgtatcgaaaatcgctgttttcggctttatgaacccggtttgcggtgtgcttctttctgcgcttctgctcggagaggcacagcaggcattccgccttgagtcgctgattgctcttgtactggtcagcgcaggaatattcatagtcaacaaaatgggagagaaaaattgacggattgtttaaatcgtttggaatataactataggtaattttaaaaacgggaacaatcgaaaaaaatcaaaaaatatttcaaaaaatgcttgacatcggcttttcagtgtgatataataatttacgttgtcacggcagtgataacttaaagaatattggggtgtcgccaagtggtaaggcatcggactctgactccgccatttcgagggttcaaatccttccaccccagccattaaaaccgcatcgttctgatgcggttttgttttatgccgatattaaaaccttaaaaggcttaaagccattgtcggcatgctcggcaaaacaaaacaccgaaccttttcgcacagtgctaaaggtccggtgtttttattatttgttatgcttatttgccgagtgcaatcttacccatagcgtcagcctgcataatagcgtcatacagctcaacgggctgtacatcgcctgcgaggttgtggatagtttcgccggggatacaagcgttctcggaaatagtctttacctgctcaggagttgtaacgccgatttcttcaagcgttacgggaagaccgacctcaaggcagaagtcctgaacttccttgaattcctctttaggcgcaccctcaagcacaagctgtacaagcgtgccgagcgcaacgcagcagccgtgatctgcgtgctttatgccgagagaagtaacgccgttgtagaatgagtgagcggcggcacagtttacattatcggcgccgacacctgaaaggtaaacgttagcttcaacgatattttcaagtgcgggagtaactgcgtgtaccttgcaagcctcgatagcctgcttgccgtattcacgaagcgtgtcatagcaaaggcgagcaagtgcctgacctgctcttgtgatgcccgtaccctcaaggcttgcggattcggtgcggatagaagcacgaccctcgaaatatgtgccgagcgcatcgcccataccggcgataaggaacttaacgggcgcatttgcgataacggtcgtatcgaccattacagcgtcgggatttgtggggtagaacagatatttatcgaagctgtggtcatcgttgtaaattactgaaagtcccgtgcagggagcgtccgtagccgcaactgtaggcactattacaatgtgctttccgctgtagtatgcagtagcctttgctgtatcaacggcactgccgccgcctacggctacgactgtatcaatgttgtcctgttctacgatagccttcatcttatttatttcgccgttgctggatattccgccgaatatctcgtaacgtctgtagtcgtcaagaccttcaaagctcttttctattttatcgtggcatgccttgtaaccgctgtttgagcatacaaacagccagcgcttgcccatataacccatttcttcgtggaatttaagcagtgcatctctgccctgtacatatttgagcggctcacgcatcgctctcagtcttcccatcataattgaaacacctccgtagaatgatataaaatacagacattattatctgcttttacaactaatttatatcacttttttatgggtatgtcaatatttacgggcattccgatttttgatattggtatgtcaaattttcattgcaataaagaaacaaatagcgttttaaattgaaattgcggggataagtattgtttttatcggcaaacaggagtatattataataaaaatgaaacgggtgattattataactgttatgacgattgaacgtgctgtagataacgcaattgcttccacagaaatggagggttttacgataaccgacgttcagagagggtaatggcagaacggagagagttttctttgcattgcttattagaaatgccggttatgatattgatttttcatcgcttaactccgatctcttgatgattggcagtattcaggcggcaggcggagttatggatacacttattagattttttgaagagaatattaaaatccactgacttttaaggtcggtggattttttgcatagcaacaagttatttcgcagattaaactgcaaagtaactgataaacataagtggtgacgtaaggaaattgaacagaaaatgcggagcaatactaatttgtgatatgataacctcagatataaaatctgctgaaagtggattttaccttgcggaaaaacgccatacgttttaggagacaaaagcgacaaaatacataaaacaaaaacctcgcagatctctctgcgaggttcagcttgtagaaaaagtatgttttttcaaaaaaagtgcttgttctcaatccctatccccaaacccctttccccggaatgctgcttagcgttttctcttacgcttcgataacgggaatgcaagcacaacagccgcactcatcattaccgttgatatgataataaccgccgtctgcataaagccgtcctcgcctgcacctgtcggaggattatcaggtattttatcgttgtgcattttggcaacgagcattgcaccgtcacggtcgatcgtcagctgtttatcttcaggtaatagatagcctgccgaagcagaatccttgacttcgtgaatggtatactcgcctgctctcaggtcagttattcttataataccatccttatcagttgtgtatgttttcttgaaagtctgtccggtgtatgttgtaccggaaacctcaaatttgaagccttcaaccttattgttgtacgatgtctttactatcttgatttcgcccttctgaggtgagttgataaacgtacccttgccaagctcatcgttggaaacttctacggtttcgccgtcatttacaatctggaaatagtagaaattcacatcacggacgaaatattcgggagcctttgtttcctgtacatagtattcgccatatacaagtccctcaaggctgtacacgcctgtttcggtttccttcattgtgccgactacggttttcttgtccgatttataaactgtaaatacagcacctgtcaatttattttcgggatagtcctcatcgacctttgtcaatgttacatttcctacaataaccttattgacaaactctgcacttgcagttgcgtccttagttaccgtgattgtcttgacctgtgtcttaggcagataaccttcagcattgttgatttcggttatcgtatattttccggtcggcagttctgcgattacaaactcaccgtttttcagagcaaattttgtttccgttttctgtgtgccacagtagatgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcagttctgcgattacaaactcaccgtttttcagagcaaattttgtttccgttttctgtgtgccacagtagatgtaactaccgttgctttccttaaccttgagataagcaccgttgctgtcggttacggtaaagtatacatttttttcgatttcagcctgttcagcggctgtcattttatcaaactgcttccatacctttataaccttgcctgtgcctgtgtcacgctcgtttacaaacgttgccgttgctgtctgattttttactacagatatcttcacaggattttccgacttgattgtgtaatcggaaagtgtgctgaattctgtcacggtgtagtcacctgtaggcagttctgcgattacaaactcaccgtttttcagagcaaattttgtttccgttttctgtgtgccacagtagatgtagctaccgttgctttccttaaccttgagataagcaccgttgctgtcggttacggtaaagtatacatttttttcgatttcagcctgttcagcggctgtcattgtatcaaactgcttccatacctttataaccttgcctgtgcctgtgtcacgctcgtttacaaacgttgccgttgctgtctgatttcttgctacagttatcttcacgggattttccgacttgattgtgtaatcggaaagtgtgctgaattctgtcacagtgtagtcacctgtaggcagttctgcaattgcaaatgtgctgttcttcagagtatatctgaattccgatgtgctgtcgccgttatatgtgtatattccgtctgcacctgttgcggtgatatacttgccgtttctgtcctttacagtgaaatacaggctcttttcaagctccgctttcatctgtgcgatttcatcggctgtcatatctgctgtgccgttatcaagtttccattccttgattacagcaccgtgaccgtaaggatattcgttgaagtcggattttccgatttcgttgtttaccgatacagtagcgtttgctgtttgaagtgttactgcgtgtacgtttgtgtcaaggtagtacccttcgggagcaataagctcctttacatagtaagttgtgccgtccttgctctcaatcggcaggaaattgcaagtgtacttgcctgtcgcactttctgtgattacagcgtctgtcagagtatcatctgtagccgatgtatatgcctgtgcaggaatttcacattcagcgtctgtgtaaataccaaatgttgcacctgttaccttttcgccggtctttgcgtcaaccttgttgataacgatattcgcatacggcttgttctcgatattgactgttgttacagtatcggtcttgacttcaatgtctttgctttcctcggtaatgtaaccaaccgttttacctgtcttgacctctgtaaccttgtaatcaccgattcttaaattagaaatcgtgatattaccatttgcatcggtaataaaggtcttgtcataactctgtccggtcttggctgtgcctgtaacacggaactgccagccggaaagaacgccgtctgcactgtgcttaacaatacttattgtgccggtcattgccttgttggtgaacactttctttaccgagcctgcaggtgtgatcgtgaatgtcacaggatcaatgctaaagctgtaacctgttgtaccgcttacttcgtacacagtgtattcttctcttgcaggaagctcatttgcaataaagttatatgtggctttgttcagctttaattcagtacccgtattgttctcgcctttatatgtgtagataccgttgctacctgtaaaggtgagatatttgccgttgtgcttgattttaaaagcaacctcggcaagtttgtcatcggggatattttcaatagcaccgttttcatttaaaaactgcttgtcaatctgcacagagcctgtcttaagctgattgtcaagctcaatgtcttcaaggtcgattacagcattcggatcaccgtcaccaaggtcaatacgctggtcccggttatcaacatcgtaatccgtaccgctgtacgtttcaatgacagacagataatacggagtggtgttagcgccgaacgatatagtcatttcgccgttttcattcagcttgagatttgttgctgatgttttggttgacgaaagccctttgtatgtataattaccgttagaaccggtaaattctacatagtatcctgccggcggattcgaggaaacacttccgctgtagccaagcacctgcagatttacggtaactttagcatactgttctttgagctgtgcttctgtcagattgtcctcatcactgaagtgcttacggataactacaacaggcgttgatttattcgtaaaggatactgactttgtttcgcccttattggcaattgtgaccgtctttgtctgcgttttcggattgtaaccgcttgcgttattgatttcggtcacactgtatgttcccaatggtaacttgcttacattaaacttactgcctctgagtttcatattatttgcggaagtctgagtgccggcataaacatacgctcctgccgagcctgtaaccttgatatacttaccattagcgtccttgacagtaaagtaaacattcttttcgaggtttgctatctgagtagcggtcaatgtagtatcagaaagccatactttctttatctgagccgtaccgctgtcctcgctgtttacgtaagaaacggacgacgttttatcttttgagatggtaattgtctgagatgctttgttgacagaatagccctccggtgagccgtactcatatacggtatacttgcctgtaggcaggtcagaaactgtgaaatcacctgtaccgggattaacatacagcgatgtagctgtagtcgatgttcctgtaaacgtatatgagccgctgtactttgaaccgcttaccgtaatgtacttgttatcagcattcttgatacggaaatatatctgctgattattcgaaatgcagttacttgcttctattgcgttaccgttggtgtctacccaagtttttataaccttgcccgtaccggtatttctcgtgtttttgaaagtaactgttcctgtgccgcctgctgttactgttaccgtcttactaaggttactgcgtgtatagcacggtattcctgctccatcagtaccatactcatagaccgtatatgttcctgcaggtaacgattttactaaaaaagtgttactgctgttgagcttgaacttagttacggaaccgcttgtagagtaggtatacgagcctgccttgccagtagccttgattgtcgtacccgaactattctttatcgtgaaatagatgtcgctgttatcggctttcgtgcttgaagcatcgtgattgtgttcccagactttcttgatctgagctgtgcctaaattggaagttttaaagtttgcgtaaaatcttacagggtcatcaataccgtcagccattgtctgagaatcgccgccgcttgatttccatacaacaagctgttttcctgtagtacgatttgccttgtatgtgcaagccttagtaccgcttatcttgcttgttgtgctgaaagtgtagtcatatccgctctttgtcactgtgacaccgggaatgttgaatgcacttgccggcatattgctcttgttactgtccggcagtgtaatactgtacttcttcgtcgaagaattatattccattgtgtgagtaggagctttagccttattagtcacagtgaagctcggaacaattgaatatgctttcatcttatttaagatgtactcatagcacttttcagcgggtcgtcctttcaactggtcgtaatatgctgttttaggtgtattaggaatttttgaattaacagccaggtcgcttttaccatatcctgtacgcagtccctgttgaatttcccatgatataatttgtgttgcaaatgagaaatcatcaaggtttgtgttggcaacaggagatttagttacttggctgttaaatcctgaaattaactctatttttaaatctctttgtgcttttgtaggcaacataagcatatagtcatcacttgatgctttaccaacataggagcttcctgtgctgtatgacacaccggcttcgatacagattgcctgctgtgtcacgccgttcttgctaacacctaacttagcgtgcgttgaggcatagcgagtggctactcctacactgccgtctgacttatagtagatatagtcgtaattatacttatctgcataagtcttaccgtctgagccgatgtaatttccgagcatagccgcataaacattgtcaccgacaccccaatctgacgcaagcgtctgaataggcatagcaactaatgtcataactgctgcaaggaaaagtccggtcagctttttgaatttgtttttaaacataacctttgtcctttcttggttgattttttaaaaatatatataaaaaagcagtcctacgggtgcggactgctttggatttttatgttcaatttactgtccgaaaaaagaaaagagccttgagaccggaatctccctgtcccttaggttttctccctcttggctccctctttccttacccatacccacaccccgtcggggtgttggcggaactcgtaaaactacctgcacattgtatatcttgtcaatgcagggacgcttaacgctacacgtccgcaggtttgtacatatatctcaggttagtagcgttttttttgaaagattaatgttggtgcagttgcaccgatatactcacgaaattattaataccttgtcggtaaggaaagtgttttaagcggtgttggtgctatattttactgtgtggtttaataacaatcagtttatcgatagtctgtaatgccgacggcaaaagccgtcggcatttttatatatcagaatacgcttgccggcgttatctgctgacgggtgatatacagctcgataaggcgtttaagcacggcgcattcggaataaatatcgtcctcgccgtttttggcaaatacttttattctggcgaggctcatagctatttcgttgtcgcattcggtatcctctacaaagatggtatgctgtgacattttccgccaaagctgttcggcaaggtctgccttttcgatggcttttgcggtgtcgtttttgtcaaccgcctgtgtaatctcgtcggcggcaaggtagattcttcttgcacaggtgcctgaataattgtagccgtaaagggcaaaagccaccatagctatgactattgccgcacaggcggtaattcgacccatttatttatcctccgctttacatatcggctttgtgccgtatttgtcattgctttttagcactgtataaatgcctttgtcggtgctgtctgtgagcaggaaaatatccttaatatcgagcttcatgcttttaatcatttcacgcagttttgcttcatcgccgttccagcggcgaagcccgggatagtttatttcgccgtcctttataagcaggcagggcggatcgcagtttgtcacctgaatcccgacgtcgccgttttcaacgttgcggtaacggcttttctgatagaaatttatcttgccggtggtttctactattgcgtactgcacctgtgaaatatcgaatatcatacattcacgcattgcttccataagctcgtcaacgctgtagcgaaggtgcttcataaccttgcggtcgattatgccgtcggtaatgattatctgaggtgtgcctgtcacaaggcggcggaagcgtgaattcttgagcataataaaagacatgaaaacgtccatgcagactatcatcagtatcgggataactccgtatatcatcgggacggtcgaatcctcgagcgacaacgtggcgatattggatataagtattgtcgttacaagctcggagggctgtaactgagcaagctgttttttgcccataagacgcagggcgaatactataaggatatacaaaagcacggaacggataattattatcagcatattttcctccattgacggaaaagataagttacagattggctacacagctattatctgctgattatctttcaatatgcgaggaacttaaatgagcaattcaaaaaaactgcctgatttatccgaaaaatcggtagagagcataaacagcggcgacagcaggcttgccgcaaatcttaatatcaactgttctgaggtaagaaggctgatgaacaacagctcggatcttataataaagtatttttcgtccgacggtcacaggatggcggttatcacctgcgagggtatgataggaaaggcggagcttgcaaatctgattttccgtccgcttgtatctgcaccgccgaaaatacaggacgataacgaattttttacaaaggtctgctcggatatgccgattgccgaagaacaaaagcaggtgtacgattatgactcgctgtgcctttatataatgtcggggttcgccgtgcttttgtgtgacggggcagggtttggcatagcgataggcatacagggctttgcacaccgaagcgtagacgagccttcaacgcacataaatctgagagcgtcaagagagggctttatcgaggtggtaagaaccaacgttgctatggtaaggcggagaatgaaatccccgacgctgaaaacgataatgatgaccgtaggagaacgcagcaagaccgatgtttcggtttgctatcttaccgacaaggcggatatgaatatcgtaaacgccgtgacggataagctgaagaatattccgcttaacactattgcagggggtgagtatttacagagctttcttgaagatgatgattctgtccttttctcacagatatatacaaccgaacgtcccgatgtatttgtatcgaagctgtatgagggcagagtggggataatcgtggacggaacgccttttgcacttgttcttccgtgtctgtttgcggagaactttgtaacgatggacgattatacgcataagccgtacttttcggcatttcttcgtatcatacgtttctttgcgtttattgcaggggctgttctgccgggtctttatgtcgcactgtgcaacttccacccggaaatgttccgctcggcgcttttgctgaatatttattcatcggagcagactgccgcctatcccgtattcggagagtgtcttataatgtatatcctgtatgagataatgagggaggcggggctgaggctgccgcagagcataggtcacgcagtaagcatagtcggtggtcttgtgataggagaaatctcggtatcggcaggtcttatgagcgcacctgtggtgcttatcatagcggcaaccggattatgctcatttgccgtaccggatctatacgacagctgtatgatactgaggctggtatttatagtcgcaggaggtacgtttggcttattcggaatcacagccgtcggtgttgttatatttttcagaatgtgttcaaaaaacacatacggagtgccgtataccgcaccgtttgcgcctgtgacgctgaaaagcattatccgtgatacgttttgcagggaaagctggaagaagctgtctgatacggatatgacggtacagcagttatcgggcaaggctaagagcggtcacggcgcagaaaggacgggagacaatgagcaggataagtaacagacagcttgttatcacgtttcttgcctgcaggctgtcggcggaaatgatgactctgtctgccgaaaccgtattatacggaccggatcgcttcgcggcgatatttcttgcaaaaattattgcggcactgctttatatccctcttatccttgtgacgctgaggttcaagggagacagccctataacctgtgctttcagaagaaacaaggtcttcggggcagctgtgggggttattctggctgttaccctgacggcagccgccgtgcagacggtcataagcatagagcattatataaccgatacgctgctcaataacattcttacaatatcgggtattgctgtgcttgtcgctgtgtcggtatacggtgcgttgaaggggcttagtgcggttacgagaagctctgtgtttgcggcggcggtattcggtctgttgatttttcttatcggagtcactatgtgggacaaggtcaacccggatttcatatatcccgcctttattgaggacgggcggtattttgtgaaatgtacactttctgagataagtatgaacagcgaaattctgatttttgcggtgataaccgatgaaatacgcagtaaaccgcataaaacggtgctttattatctgccgctgctgcttgtgatactggaatttcttaacctgctctacaaccttatattaggtccttatatgagtaaagtcgaataccctctgtatattatcgcagctttatccgatattgtaatattccgcaggcttgacggaatagacgctatagtgtggctgatgtgcggaattattaaaacggcgcttattatatattgcgtagggcggatatattctgtgtgcagtaagaggcccgacacgaaaaaggcggttgtggtatacggagcgtttatatttatgctgtgcatggtgcttggcagtgacagaacggtatacgagcatttcaggagcgttatgtcgggcggaatacacatattgctcggcggtgttgcagttccgctgacggtgcttgttgcaggcaggaaaaagcagagcggaggagaaaagaaatgagaatgataagagcggttgctataatgcttgcgctgacggtgacaataacccttgccggctgtgtcagctatgttgacctgtccgacagggcgatagtgcaggcgatagggatagactatcttcctgacaaaaaggtatatcgtataagtatgcagtatttcaatcaatcgagcgagggcggacagaatcagatagacaagacgcaggacaatgtgctgaaaagcgtaggggagggcgaaagcatatttgcggcggcgaaaaacgcttcgatgctgacgggaaaggatcttctgctgagcgaaaacaggctgataatcatcggaaaagaactgaggaagtataagctgtgcgacacgcttgaattcttcgtgggtaattaccattcgcatccgcaggcatatgttgccgccgcagaggatacggcagaggaactgctcgatatacgcttcaaggaaggctcgacctcttcgcagagattggcgaaccttatacacaacgcatcggtcgaaagcaggaacaaaagcacatatccctaccaggtgatgactatgctatgcacatctacagagagcgcatttcttccgctgctcagaaccgcaacacttaagacagatgtaactattccgaaggaaaccggaggcggtaagggcaacggaggcggagaagaacagagcgaggacggagaaaagacgataatacttgacggcggagtggttttcaagggcggcaaagagctttgcagagttgacgatgacgtggcaatggctatattctttatgaatgatatgccttcggaatattcgtttaccgtgcctttgggacaaaacgcaaagccgagtgttacgcttattggggttacaaggagtataaaagctacagaatataacggtaaggtgaaatttgatgtatcattcagcgcatcgggaaagatagggtcgaagggcggaataaaggaagatgataaaaaagccgccgaaaaggtagccgagcctgccgaaatggagctgaagcggaaaatagaaagctcggtgataccgattgcagaaaaaggctgtgatgtgttcgggcttgagaatacgctaagaagatgctgtaacagattttacagagagaatatggacagggtaggggaaataatagcggaaagtgaaattgaggtcaatgtgaatattgatattttttcgcaggggataggcggtgcgtgactggtgacagaaaagctccctcactgtttgtgagggagccgcagcttgtagaaaaagtatgttttttcaaaaaaagtgcttgttctcaatccctatccccaaacccctttccccgggagttaccgccgattattactacgctcatatcctgtcctttctgatgaaatatgttagtctacactaaccatatccgtttaaataaacggcgaaatgccgttcattcgtaaagttgtcttatgtaaactgcgttagcctaagctaactgtatatagtttatcatacggttttcgttttgtcaatagggtatcggtaatttttatagaatttttttgcctctgtaacaaattcaaaagcaggctcgccttttatcagtttctttgaatacagccccaataacaccggtgccaatccgtcgatgcggatatattcaagttcgctgtcattcatatacggcatcatcggaaaagctgttactccaagccctgccttcgccatagctaaagccgcctcgcagccgtccgcaagcagtacgttgctgttattcggcaggccgagcttcatatacccttccattgccgcatcgggacacttgtgccttttaataagtataacacgtctgccgtttatatcgtttatatttatgctttttcttccgctcagttcatcgtctttacggcatatcagcataacaggacactcacacagtgcagtaaagcactctgcttttgcggtttcgttttcagacttgatagcgaatataatctgcagcttgttttcctcaagcagattatcaagcgatttgaacggcatcatagtaatctccggctcaaaattcggatacatctttccgataatgttcatcaccggtacagccgcatcaagctcgtactgattatgaacaccgatagctactgtccgctttttctccttaacattggtactcaggcgatggatagaattcatcgctgtcctgactatcgtttccgcatcgcctataaaaatcagtccctcttttgtaagctgaacgcttttattcgttctcagaaacagccgcactccaagctccgcctcaagcgatgaaatctgatggctgacggcaggctgacttatattcaccatttctgccgcttttgaaaaattgagggtttccgcaaccgcaagaaagcattcaagctgagtagtattcataacaaactccttttttaattaacgataaatattctttattgattataacatatttgtattttacattcaagaccgtttggtgtattattatcaaggagataaactgttagcatattaccggtaaggaggttaaccgttatgaatgaaaccgacattcaggcgataatgattgataacaagaccataaatcagcgtatcgaaaacagcctgaacgtgatttttgccgatattgatattactgcggcgcagggcagagtgcttatgtatatcgcaaattccccagaaaaagatatattcgccgccgacttgcataaacatctttgcatttctaagccttcggtttccgcacttattaaaaagctgagaaaatcgggatatataagctgtacaggctgtgaaagcgatgaacgctacaaaaatcttaccgcaacaaataagggcagacagacagcagggcttatatcccgtcatatgaggaatatagagcaggcggcattccgcagctttaccgattccgagctgaatgaattcatgcggcttcagaaaacgctgctgaacaatatagacaacataaatacagataacttgaaacagaaaggatgactgattaagtgaaagagcttcttaaacaggtaaagcagtacaagaaagattctgtcttagctcccgtctattcggcacttgaggttgttatggaggtaataatccctttcgtaatggcgttgctgattgacgaaggcgtagagaaaggtaatatgaacaagatactgctttacggaataattatgatagtcctcgctatgataagtctttttgcgggaatgatggcaggcaaatatgccgcaagcgcatcgtcgggctttgcctgtaatttaagagaggcgatgtaccgtaacatacagcgcttctcattttcaaacatagacaagttcagtacagcaggacttgttacccgtatgacgaccgacgtaacaaacgttcagaacgcatatcagatgataataagaatagccgttagagcgcctcttatgctgataagcagtatggctatgtgctttgtggtaaatgcggatatgagctttatattcctcggcgctatagttttccttgcggtagttcttgtgataattatgctcagggcaatgaagattttcaatgtggcattcacaaaatatgacgaccttaacgcaagcgtacaggagaatatctcaggcatcagagtggtgaaatcgtacgtccgtgaggattatgagaacgaaaagttcaagaaatcctccggcaatctttacaatatgttcaaaaaagccgaaagcacccttgctttcaataaccctgtgatgatgcttgtgatttatgccagtattatggcaatctgctggttcggagctaagtttatcgttgttgacaagaccttgcagataggcgagcttacatcgctgttcagctatgtaatgggttcactgatgtcacttatgatgctctcgacgatattcgttatgattacaatgagcgttgcaagtatgcgccgtataaccgaggttctgcgtgaacagcccgatcttgccgagcctttcgctcccgtagagttaatgtcaaacggcagcatagacttcgacaatgtgcatttcagataccataagacaagcgaggaggaggtcctcaccgacataaacctgcacataaagtcaggtgaaaccatcggaataatcggcggaacgggctgcggaaagaccagtcttgtaaatcttatcagccgtctttatgatgtacagcagggaagtgtaaaggtaggcggcgttgatgtaaaggactacgatatgaagttcctgcgtgatcaggtatcggtagtgttgcagaaaaatgtcctgttctcaggcactatacttgataatctacgctggggcaacgaaaacgccacagaggaagaatgcatcgaggcttgtaagtgggcttgcgctgatgaattcatcgagcgttttcccgataagtacaatacggttatcgaacgtggcggtactaacgtatccggcggtcagaaacagcgtatatgtatagcaagagcacttctcaaaaagcctgccgtgcttatacttgacgattccacaagcgcagtggatacagctacagacgcaaagataagagcggcattccagaagtgcatacccggtacaaccaagataattattgcgcagcgtgtatcaagcgttcaggatgcggatcgcatagtcgttcttgacgacggcagaataaacggtgtcggaacgcacgatgagcttgttgcaaataatgagatatacagagatatatacgaatctcagacaaaggacggcggcgactttgaccgcccccagaattaaggaaaggagcgtaacgtaatggataaaagaaaaatgggaccccgtcccgatgtttcaccgaaggaacaggtaaaactgctcggcagaattatcaaatacacattcagccgttataaattctcgtgtatctgtgttgttgtatgtattcttgtgcaggcggtcacaacacttgccggaatgcttttcatacagtcgcttatcgacgattatatcaagcctatgattgcagccaaaagcacagacttcacacctcttgcgtttgcaatgctcagacttgcgatagtttacgttgtcggtcttgcggcatcttatgcgtataacaggataatggtaaacgtaggacaaggtacgctcagaaacttccgtaatgaccttttcaccaatatggaaaagctcccgataaagtatttcgacacacatcagcacggcgatataatgtcggtttatacaaatgatatcgatacattcagacagtttatatgtcagagtatcccacaagtgataaactgcggcacaacagttataatctcgcttgtttctatgcttattatgagcataccgatgacgatacttgccgtaggtatggcggctgtgatgcttgttgtaactaagaagatcgccgcaaaatcaggtaaatatttcggtaaacagcagcacgatctgggcgaggtcgatggctttattgaagaaatgcttgacggtcagaaggtagtaaaggtgttctgtcacgagcaggaggcaatagacgattttgtaaagataaacgataacctcagaaacagcgcatataaggcaaacaagtatgcgaatatcctgatgccgataaacgccaatataggcaacatcagttatgttttatgtgcgttgctcggcgcagtgcttgcaacaaacggctttggcggtcttactctcggtactattgtttcattctgtacgctcaacaagaattttacaaacccgatttcacagctaagtcagcagatgacattcgtgataatggcttcagcaggtgcaatgcgtctgttcgatcttatggatcagaagcctgaacacgatgacggttatgtcgagcttgtcaatgcggaaattgacgaaaacggcaatattacggaggttgatcaccgcacaggtaaatgggcgtggaagcatcctcataaagcggacggaacggtgtcgtataaaaggcaggagggcggtattgtctttgacggcgtagactttggctacactgacgaaaaaatggtacttcacgacataaagctctatgcaaagcccggtcagaagattgcttttgtaggctcgaccggtgcaggaaaaactaccataaccaatcttataaaccgtttctacgatattcaggacggtaagataagatatgacgaaatcaatataaataagataaagaagcccgaactgcgtaagtcgctcggcatcgttttacaggaaaccaatctgttcacaggcacggtaatggataatatccgctacggcaagctggacgctacggatgaagaatgtatagctgccgcaaagcttgctaatgccgacagctttataagaagacttcccgacggttatcagactatgcttacaggtgacggtgctaatttaagccagggtcagcgtcagctgttatcaatagcaagagcggcggtcgcagatcctcctgtactgattcttgacgaggctacctcgtcaatagatacccgtaccgaaaagctcgtgcaggcgggaatggacgcacttatgcacggcagaacaacgttcgttatcgctcacaggctttcaaccgtgcgcaactccgattgtattatggtgcttgagcagggcagaattatcgagcgtggcacgcacgacgagcttatagcaaagaagggcaagtattacagcctgtacaccggtaacttctctgaagaaaccgcctgaggcggtaagcaccctgttcgcctttctcgaggcaggcagtttgttaacatctgcacagaatccgctgtttttataacggcggattttctgcatcaacatatcaaaacgggtcaaggcgatgttaggaaaataccaatctgaattaagttgtccagagttatgtacacagcttcacctcctttcaaagtgctttcgcacttcgggagatgaatttgaccgcctatcgtccaaggtttccctcagcgaatattttagcataatatagccaaaaatgcaatccccgacgatttgaaaagttcgtcggggattgcattgctatatgatcagatcggtatcttcaagacgtttattgaagaacttcattattctaatacacggttttctcagcactatgccgataaagagggctatcgcaacataaatcagcaggtagagcaggtcttctatatagctttgcgcatatacgcctgcgaccgcttcacgcattgcgttgatgctgtatctgaagggcagatagggaagaatgctgcggaaaaattcggggagaacttcgggagggaatgtaccgcccgagcctgcaacctgaagtacaaggataattaccgcaagagcctttcctattacgctgaatgtgatcgtcagcgagtagatgagcagtgagaatacaatagaagatacaacggcggcgatgatgaacaacagcgggtcttcacactgtattttcaggaataaaaggtcgccgagtgcgattattatcgcctgaattattgataccataaggtaaatcatatatctgccgaaataagcctgtatcggtcttacattactgccgagcttttcgatgtcacggcggctgatctctgctttcagtacggcgacaagtacgatcgagcctacccagatagcgagtatcgtgtagaacggcgtcatggctgagccgtaattttctacaggataaaccttgacggtgttaatttcaacgggtgagctcataaattcgccgagagatgacgggtcacttgaaatctcttcgataaaagctataagcgcctgatcgttgcttatatcatcgacctttttctgcatatcggtgagcttatcctttgcgttgccgattattttatcgaggtcggtaaggcaggatttaaggcttgcaagcgagttctgagcatcggtaagagccgtttcgatattcggaacagatgttcctgcgtcagaaagcagtgcggaaattccgtcaagcgtcttgaacacttcatttacggcggtatccatagcagttttgacagaagtgttccaagtggtttttatgccgtcaaaatctttctttgaatcggttatcagcttgtttacatcactttcaaaattatcgggggcgtgacctgttgcgttgacagtgtctgcaccgttatttaatatgtcgatgattgcgttctgcttttcgatattcctgtcgattgcatcggtcataatgctgacatcaattccgagtttttcaccgactgttacaacatgggtgcggatattattcagtgcatcaattgtttttctgtttatctccgctgttgctcttatcttttcggtggctttgtcggcatcggcggcgatttcacccgtgatgcccgaaatactgctttccgtattgctgtaaagcgtgtcgattgaattaaggacggtatctgtagcggcggttatctgtgttgataccgcctgtactgccgtaatgctatcctttgccgatgtggtaagcgttcctgactgagcaagaagctgttcaagatccgggatagactttttggtgtttgcaatcattgtatctgcactgtcaagtgttgtgcttatcagcgaaattgagctttggaaagcggaaagattgtcgataacgtcgcctatggctgattttatattgtctgttatctcggtgaatttcttgttgccctgctcggaggtgtagttcaatattcctgcaagctcggtggtaatcgtgtcaataaagctctcgtttacctgattttttatcgcctctgcacctttgtcggtgattttcggagcgatagcgtttttcttttcgttgagcgtgtaggttatctgcggacgtgtcagcttgcccgaaagtatgcttgtgaagctctcactgaaattttcggggataacaacgcaggcataatattcgcctgttactactccgttttccgcctgctccttatctacgaacgtccagcacatctgcgtgttctttttaagattatccactatctgattgccgatgttgatttcctttgaagcaagcttagtgccattatcgcagtttgcgaccgcaatcttgatattgcctgtgtttgagtacggatcccagtttgccgcaatgttgaaccacgcatacagcgccggcagtatacaaatacctatcattaccgcaaaagccataagatttgtgcgtatcttttttatatcgcttaaaaatatcctgaatattgtcttcatttgttttcctgctccctcgttttcattccggaaagacggctgatgtcctttttagccgattctattgtggtttctatgttagcctttgcgttttcaagctcagtttttgcgttgcttatcgtcttgtcgatatcgttcttcatcttttcaaggtcgtcttccttgtcggtgtttttaatgccgagtatcttttcgtacttgtagcaacggtaatctatccgtgtcattaccgcaatacccgaaataatgaagattatccacagcgtcaagaagaatgttttgctgtcaaggctgaacatcagggcgagaaatacaactgcactgatgataatgagcagtatcccgaccttgatacatttttcacgttttgcgtattctgccttgtattcgtgcataaggcgcagatatgcgttatgctccttgtcctgcgttgtggcaggatcttttataagcccgtctataagatcaagctcgtccggctcttcctcatgtccctcttcaaaaaggtctatatcggaaaacttcgttttctttatctgctctttttcctttttatctttattcttcaaaccgacaccccactttttaagtgtattttttcttgccacaatatgattatactattaaaaaagcggtttgtctattgacattctgacaaaagcagtaaacttaaatatgcggaaattgggagaaataagagatttaagagcggaaaagaaaattctgaaatgagaatttattttgagaaattcggaaaaagtgctgaaatgagaatttttattgactttctgagcattttgtgctaatatgagcatataatataatagtacagaacgataagagggtgattttttggttgaaagaaaagaatatcttgaaaagctgaagctctggaaggacgaacaggtcataaaggtagtgacgggaatacgcagatgcggaaaatcaacattgcttatgcagtatcaggactatcttaaacaaagcggagttgacgctgacagaataattgcgataaactttgaagaactggaatacgaagaactgtgcgactataaaaagctgtatgaatatataaaggctcggctaagcagtgataaaacgacttacatttttcttgacgagatacagaaagtgccgtattttgaaaaggtgatagacagtctttatgtaaaacaaggaactgatatttatatcaccggctcaaacgcatatatgctgtcgggcgatcttgctacacttctcagcggtcgttatgtggaaatatcaatgcttccgctgtcgtttgcagagtatttgcaggtaaacagcaaggacaaggacagtgcatttgctgattatatgagatacggcggtatgcctttcattgctacggcagaaaagacggaagaaaagataaccacctatcttgagggtatctacaatacggttatcgttaaggatattgaggacaggcagaagcgtaaggaatgggataacagcgatacaggcaggataacggatatatcgcttcttaaaactatcgcaaagtacctttcaagcgttatcggaagtcttgtgacagtaaggagcattgcaaattatcttgtttcatcgggacggaaaatttctccgaatacggtgagcgattatgttaatgcactgaccgaatcattcatattctacccagcggaacgctttgacattgtgggaaagcaacttcttaaaaccaacacgaagtattatatggttgacctcggcatacgaaatcttatactgcctaagaaaagctatgaccttggcttttcggttgagaatgtagtgtattttgaactgctcagacgtgggtacaaggtgagcgtgggcaagtacggaaataccgagatagattttgtggcagagagaaacggagaacttgagtatattcaggtaactgccgatatgaccgctaaggaaactttcgacagggaacttgcaccgcttacaactataaaggataactaccgcaagagagttctgacacttgataaattcactgtcggaaattatgacggcattgaggtgaagaatgttgtagagtggctgacggataaatgataattgaatagggagaataaagccgcccgtttgcatagtcagacgggcggcgttttatattcagttgttttcgatttcggtgataagctgtatcataccgctgataagccttttgtgttcatctgtcattggggttatctttgaggcgatgtcattgtcataaagctctgcggaagcagtgccgagcaggaaatagtcgggtgtcgcattcagcacagagcaaaggctcattataagttcaaggctcggtgcgctcctgccggtttcaatattcgagagatatttatagttcacgtctatcagttcgcagacctcgtactgcttcaagccgagttcttttctgcgctttgctatgcgttttccgagagcggtatagtcaattttcatagtatcacctcaagacaataataacagtttttgaggaaaataaaaaccgcctgttaaatagaaattcttattgacagatagaaaattctgtgttatactaagaaaaatgatgaatttctacaaaatatgtggaaatttgagttataatgaggtgattttgttggagtttatgggcacattacaggcagcaaaaaaatggggaataccaagagatactatagctaaatattgtcgtgaggggaaaatcaaatctgctgaacacgataaagcgggtagtccgtggagaataagcatagacgagccaagaccgaattataggggaagaaagcaaaaggagtgataagcatggaaaatattcaagaaagtcaaaacgcaaccgtaataacggaaaacactaaattgatgatgagaattgccggagtgctgtttgcgttgttggcagtggtacaactcataaatggattcgaatggcgcaattccggttattatatttattatcataactacatatttttgtatagatatatcgatatagctttattagtagttgaaataatcttctccatagcgtgcataattcagaagaaaatctttttttcgatatgactgattcttatcatctgcacagtatgtttctttacctataatattataaacgacaagaataatacttcatccgaaccgccgttcacagcggtgacatccgaaccgcccgaaacttccgctcccgctactaccgcaggcagtacgaaaaagcccgacagcaactcatccgttgccacatcggataatgagccgacacttgactttgataaggactatttctcctcatcgctgttcataggcgacagtatctccacaggccttagcctttacggcttcctcgatcagcaaaacgtattcgctcagcagggtcttgcaccctctacggcgcttgacgctgacatcgacggagtgacgctttcggataagattgcttcattcaagcctaaaaagatattcgtaatgctcggcacaaacagcgtcggctacgccgataacgaaacgcttgcaggcaatatgaaggagcttgtggaaaagatttcttctcttacaaaggctaagatatacgttgtatcaatcccgcccgtaacagcagaagcggagaagtcggacgagaatgcacttacccttaaggacatcaccgattataatacaaaactcaaatctgcaatttcaggcacttcggcaacattcatcgaccttaacagcatcctttcagacaaggatggatatttcaatgccgattatgcagaaatggacggaattcactttatgggaaaaacctacgaggtaatgctcagctatctgcagaagcattcttcgtaaatatcaaaaggggcaatatattagaatgaaacatatagctgattgtaaaacaatagcaatatcgttaatctgtatattttcaatagttctttgcagctgttcggacgtaacagtgtcgcaggatagttcgttgtcaaaaaatgacgcaacaacccctgtaaaaacatcattaaccgacacaaaaacatcaactgtagcgacaaccgttaaaatcgtaactacatcggctactacagccgctacaacgaccgaaacgacactgcctgaaactacagctgtagcaacagagccaaagcctgctccgaccgattcgccaaagacctctgaaaccgctccacaagccaaaccgacagcgccaacggacttcgatacctcattttttgacgatgcgctgttcataggcgacagcattactaccggtctttacctttacggttatcttgacgagtcccttgtctacgcaaagctcgggcttgccccctcaaccgcattggaaagcgaaatagacggtgtaaccataaacagtaaaataaaagcaaataatcccaaaaagatatatattatgctcggcaccaacagcgtaggctattcagacggcaattaccttgcaaattgtatgggcgaacttgtacaacatatttcacaaatcacaaaagcaaaggtatatgttctgtctatcccgccgataacatattatgccgaatctgactatgataacgcactcacaacatctgcgataaacgagtataataccgcattaaaaagcgtaattaaaggcacaaaggcgaaatttctcgactttcattctgtgctgaccgctcccgacggatattattacgaggaatatcacgagatggacggaattcactttatgggttcaacgtatcaggttatgctaagtttccttgagaaacattcttaatattaaatgtgcataaaagaaaggaattatgaacaatgaaaagcagtatcaaaaagagaataatggcaggaattgtctgcgctatggtcgcagtttcaatatgcggatgctccgaaaaacccgctcagtcatcggcttcggaaagctccgtatcatccgatgcaggctcggtttccgaggcttctgacagcagtacggcgaccggtaccgccgccgaaatcacagctaagatacaggaagatgtcaagttccccggtatggctgaaataggctcagaccgcatggcaggctactatgacgttgccgccgacaagatagacagctacagtgcctatatctgcggctctggcgcttatcccgatgagattgcggttttcaagatgaaatctgcagacgatgtaaatgctgtaaagtctgttctcgaaaagcgtgtagagagccagagtgccacattcaaggactatacgcccgatgaaatgtacaagatagacggcaacaacgtagttacaagcggtaactatgtagcgcttatcatctgtgccgacaacgcaaaggcaatcgaagatttcaaggcaatggctaagtaaatcagtaaaatgaaaggagaaccgtatggctatagagtgtcttgttataacgtttatacttggggctatagtgttctcatttgccagagccgacagaatccgttgggtcatagcgaccgttccgcttgggatactgccgcttgcaaactgcgtgtcctgctttgtctgtactgcgtttttggggtgcgagctgcctaagaatatcgctgcggtgatacttcttcttgcggtgatggcatcgtgcgtgtggataggcatagcgtcgggttttctgcgtacaaaccgtatgcggataccttatattagcgcgggcatcggcttcaatgtggttcttgggcttattctactgaatttctatatcggattggtataatccggatataaaacggagattcacagctataaacaaataccgcaccgccgtaaatttctacggcggtatttttatctttacgttatatccgcatccgtcaatcgtcaatagacaaattgtataaaaatgaacccggatttttagttacttattcctaaaagacatattgacaaatcggagataacactatataatattaaatgtatttcgctcaccactacatattgtggttttacgactaaagcttaaacgagagggagaaattaatgctgactaaaattcaaaagagagacggacgtacagtaccgttcaacattgaaaagatagccgatgctatatataaggctgcgagagctgtcggtggcaacgattatcaggaagccggtgaaatggctgaaaaggtttgcgattatcttgaggcaaacgtaaataagacaggggagcttcccactgtagaagaagttcaggacgctgtagaaaaggtgcttgtagaaagcggccacgcaaagaccgccaaggcatatatcctttacagagccgacagaacaagggtaagagaaatgaacaccagccttatgaagatctatgaggatcttacattcaaggctgcaagagattgcgatattaagcgtgaaaacgccaacattgacggagataccgcaatgggcacaatgctcaaatacggctctgagggtgcaaagcagttcaacgagatgtatgttcttgctcccgagcattcaaaggcgcacagggacggcgatattcatatccacgaccttgactttttaacgcttaccacgacctgctgtcagattgaccttatcaagctgttcaagaacggcttctcgacaggtcacggcttcctcagagagcctaacgaaatcagcagctattctgcacttgcctgcattgctatccagtcaaaccagaacgatcagcacggcggacagtctatccccaactttgactattctatggctgacggcgtaagaaagacatataagcaccgctatgctcagaatatcgtaagaggacttgagcttataggcggcattgaagaccttgcaacagcggaagccgatgtaaaggcatatacaaagaagctcgaagaagaaaagcagctttgtcctgttctcgctaacgataacggctatcaggacgcagagcgtgaatgcctcagggagatttgccccgatatcagcgatgaaataatcgaaaagatacagaaatttgcactgaagcaggctgaagtagaaaccgacagagccacatatcaggctatggaggcacttgtacacaacctcaacacaatgaacagccgtgcaggcgcacagataccgttctcatcaataaactacggtacagacacctctcccgaaggcagaatggtaataaagaacgttctgcttgctaccgaggcaggtcttggcaacggcgaaacacccatcttcccgatacatatcttcaaggtaaaggacggtcttaactataacgagggcgatcctaactacgatcttttcaagcttgcttgcagagtatcggcaaaaagactgttcccgaacttctcatttatcgacgctccctacaaccttcagtattacaagcccggcgactataatacggaaatcgcatatatgggatgccgtacccgtgtaataggaaatgtttatgatcccacaagagaaatagtaacaggacgaggaaacctttcgttcacatctataaatctgcccagactcggcatacttgcaggcggagatattgtaaagttctttgagatgctcgaggacagaatgaatcttgtcgtagatcagcttctctacagattcaagatacagtcgcaaaagaaagtaaagaactatccgttccttatgggacagggaatatggattgactccgaaaagctcaaccccaacgatactatcggagaggtattaaagcacggtacgctttctgtaggctttataggtcttgctgaatgcctcaaggcgcttatcggcgttcatcacggcgaaagcaaggaggctcaggagcttggtctgcgtattataggcagaatgagagcaagaatggacgaagaaagcaagaagaccggtcttaacttctcgctcctcgcaacacccgcagaaggtctttcgggaagatttgtaaagatcgaccgcaagaagttcggcaaaatcgagggcgtaaccgacagagaatactacacgaactcattccatatacctgtttacttccccatcaacgcattcagaaaaatcaagctggaagcgccttatcacgcactcacaaacgcaggtcatatcagctatgtagagcttgacggcgacccgcttcagaaccttgaggcatttgagcagattatcagatgcatgaaggaatcgggtatcggctacggctcgataaaccaccccgtagatagagatccctgctgcggatacacgggtataatcggtgacgtatgccccaagtgcggaagaagcgatcacggcgacaacacaagatttgagcgtatccgccgtataacaggctatcttgtaggcactgttgaccgattcaacaacggcaagagagccgaagaaagagatagagtaaagcacagcgtttctgacgatgacgcagaaatctgacgatttataaagactgcaaaagaatccggcacatcctgccggattttttgcgttcagggcttgaaatcgatattataagtagaacaaaggagaagaaaagatgaaggtactaaggtacttgaagccctattggctttttgccttgctttgtccgctcgctatgatacttgaggtaagtatggacctgttacagcctacgcttatgtcagacatagtggataacggtatattgggcgatgcggctgccgacgaaaacctgcgatatgttctgataacgggacttaaaatgctggtgttctcgcttatcggatgcttcggcggtatagcgtcggcggcattcggcacggcggcggctcagaaaatgggcaatgatttaagaaaagacgcttttgcaaaggtaatgcatatgtcttttcagcagacggacaagtttactacaggctcgctcgtcacaagacttacaaacgatataacagcgatacaggagtttgtagcaatgtcgctgagaatgtttgtaaggacgggaatgcagtttataggcggcattgcggtaattctcactcttaacgtaaatttcggcattgtgctggtaatctcactgcctgttcagcttattgcagtggcaataattatgaagaaagcctcgccgcttttcagtatcgttcagtcaagacttgacaaggtgaacagcgtggtacaggaaaacgtttcgggagcgagagtagtaaaggctttcacccgtgaggaatatgagataaacaggttcgacaacgcaaacaccgaccttatgacgaccaacctcaaggtgcagaaattacttgccacactgaacccgatactgatgataataatgaacgcttctgtcatcgctattattatgataggcggttttcaggttgaagcaaaggcaatgcaggtcggagaagtaatggccgcagtaacctatataacacagatacttatgtcggttatgatggtaggtatgatgtttcagcaggtttcacgttctgccgcatcaatgaagcgtgtaaacgaagtgctttcaacaaaccccgttatcagcgacggaaataaaagtgccgacagcgacaacagcggtaccgttgaattcagaaacgtcggattttcgtatcccggttcatcgggaaagcccgtgctttccggaattgatttaaaagtcggtaagggtcagatgatagctatactcggctctacaggctgtggcaagacctctcttgtaaatcttgttccgagattttacgatgcgactaatggcgatgtgcttgttgacggcgtaaacgttaaggattacgatgttgacacattgagaagcaaaataggcgtagtactgcagaaaagcgagcttttttctggaactgttgcggaaaatatccgctggggctgtgaaacggctacggacgaagaagtaaagacagccgccaaaatagcacaggcagaggaattcatagacggcttcaatgacggatatgatactatgataagcgaaaagggtgcgtcgctgtcgggcggtcagaaacagcgtatggcgatagcaagagccataatcaaaaagcccgagatactgatatttgacgatagcacctcggcgctcgatcttagcacagaggcaaaactgcacaaggctctgcgtgaaaacttaagcggtgttaccgttataatgatagctcagagaatagcgagcgttatgagagcggataagatagcggtgcttgaaaacggctcaatatgcgctttcggcactcataaagagcttatggaatcaagcagcgtctatagggatatttactattcgcagatgaagcagggagaggaggaagcggtaaatggctaatgaacgtcctcctatgagaatgatgggcagaggaggccctccgccccacgaaagaatgcttatggctgaaaagccaaagaacacaaaaggcacgctgaaaaggcttgtcggctatatcggaaagaacagataccttatgatactgcttttatccgttatgctgataatcactgtgctgaaccttgtcgcaccctatcttcagggtcttgctattgataagataaccgtttcaaatcagagattaaacgtagatataagcggtatgctatactgccttatagcactcggatgtgtgtatcttgtaaattcactgctcacatattttcagggtatatttgcggcaaagctgtcgcagacgaccgtcaaggcaatgcgtaaggacctgtttgacaagatctcatacctgccgataaagtataccgatactcatcagcacggtgatattatgagccgtatgacaaacgatgtagagaatatctcaaacaccgtttctcagtcgatagcctcgctgttttcaggcgttctgacgcttgtcggctgtcttgtgtttatgctttattattcgcctatgctgacgcttgtcagccttacatctgtcgttctgacgcttgttgttacaaagaatctcacaaagtttatgagaaaatacttcccgttacagcagacgcttttaggcagacttaacggacatatagaagaaatggtatccggttacagaacggtagcggcatattcaaaggaaaagaaagcctgcgaggaattcggtgaaatcagcgacgagcttcagaaggcggcgataaaggcgcagatatgcggcggcataatgggaccgtgtatgaatgtcatatcgaatatcagctttttgcttgttgcgggcttcggcgcatatttccttataatcgacttcaacccccttgcactgaaaggcgttatgacggtcggcacgattcaggcattcttgcagtatacaaagaacttcacccgccccataaacgagatagcacagcagtattcttcaatacagacggctattgcaggtgcggagcgtgtatttgagataatggatacagagcctgaaagcgacgaaggcacggataaggatttctcgatagataacgtaaggggcgaccttatgttcaagaatatcgacttctcttatgtacccggcgaaaaggtactgcacgacttcgatctgtggataaagagcggtcagaagctggctattgtcggcgctaccggctcgggcaaaaccactgtcgtaaatctgctcacaaggttttatgatatagacggcggaagcataactcttgatggtgaaagcatatatgatattccgaaaaagaaactgcgtggctctataggtatcgtacttcaggatacggttattttcaacgatacgataatgcagaatatccgttatggcaggcttgacgctacagatgaagaagtaattgcggcggcaaagacagcaaaggtagccgactttgcggaaaagatggctgacggctacgatactatgctgaccgaaggcggcggcaacttaagtcagggacagcgacagcttatcgctatcgcaagagcggtgcttgccgacccgaagatacttattcttgacgaggcaacatcgagcatcgacacccgcacggaagtacatatacaggaggcaatgcttgcacttatgaaaggcagaacaagccttatcatagcgcacagactgtctactatccgtgacgcagataagattgtcgtaatagacggcggcaaggtagttgaggcaggaaaccacgaaaagctgctcagcgagaacggcgcttatgcaagactttacaacacccagtttgcaggtataaagacataacagcgtaccgcacagtttctgctgtgcggtattatgctattaaggagtttgctatgcactttgtagacgcaaaatcaatactatcggccaaaaacggaatgaatatctatcggggctgtactcacggctgtatttattgcgattcacgttctgactgctataatatgcggcatgattttgaagatgttgaagtaaagcggaacgctccggaacttcttgaaaaagcacttgcttcaaagcgcaggctgtgtatgattggcacaggtgcgatgagcgacccgtatatgcattgtgaggaaaagctaaggcttacaaggcggtgtcttgaggtcatcgacaggcacggctttggcgttactgtgcttacaaagtcggatatgattttgcgtgatgccgatctgctttgcagtattaacagcaaggcaaaggcggttgtacagatgacgcttacaacttacgatgaggatttatgccgaattttagagccgaatgtatgcactacaaaacggcggtatgaggtgcttgaagctatgcagaaaaacggtatacccactgtcgtatggttcacccccgttctgccgtttatcaatgatacggaagaaaatctcagaggcatcctgtcatactgctttgacacaggggtaaagggcataatctgtatgggaataggcactacgatgcgtgacggcgacagggaatatttctactctgcgcttgacaggcatttccccggtatgaaacagcggtatatatcgcagtacggcaatgagtatatctgcaacagcgttaacaatggcagacttatgagcatattctgtaatgagtgcgaaaagcacggcgttatgtatgaacctgctaaggtgttttcgtatctttatgagtttcccgaaaagaatgaacagttatcgtttttctgatatgatttttgttaaaataaggttaatatttgttctttataatgctgatacagaaaattgaaagggtgaacagtatgactatcagaaaaatggcaaatgaggagctttcgcagtgcgttgatgtcattcgcaaaagctatgaaacggaggctgtcgcattcggcattacagaaatgaattgcccgcagcacgccgcctttattacgcttgaccgtttacagatgtcagcggagtggggttatgttttttacggagcatttgaggaagatgagctgatagcctgctttgccattgagaataaagacgacagcgtttatgaactgcacttgttctcggtgcttcccgacaagcgatatggcggtgtcggagcaaagtgccttgaatttgccaaaaacgaggtattctcgatgggcggtacggtgcttaatgccggtgcgatacatcagagtgtaagagtgcgtaactggtacgagaagaatggcttcaggcaaaaagagatacacagggcggcatatctgccttttgcactcggaataatgagctgtaatgtcggagagtaattacaaggatacataagcataattaaagcctgagaggaattttcttctcaggcttcattttgtagaaaaagtatgttttttcaaaaaaagtgcttgttctctatccctataagaacgctttgtgggctttgcgtcactgctgctgctgcgagaactgcagggataactgctactgcagcacctgtaggagggttaacgggctcgcctgagcattcgccggggttaacaacatcgcctgaagattcaccgggctcagcaggatcttctgtttcgccgggcttagtaggatcttctgtttcaccgggcttagtaggatcttctgtttcaccggggtttactgcagcttcttcatcgttgattgttaatgtgtactgaacgccattatatgtatcccagcttaagcagtagaaatcaactacagcacccttaacaacggggatagaaatctgaccaccgtcagcgccgacagtgcctacccatgtttcggtgccaacgccgtctttagtttctccaacattatcaccgtctacatcccaagaccagtttacgctggcgccgccccactgatagtacttaactgtaccgtcggggttcttaacagcaacgcctgcagagcaccaatcgttccaacctgatccagctgctgctgcatcagctgaaagtgcaacatcaaccttaagcgtatcaatgtcgcccttaactgtgtatgtgtatgacggagttttcttatcggtaaatgaaatatctgcctttgtctgaataggcttaggctcagcaggctttgtatctgtgtcagcagctgcgggatatgtagcgagtaaatcgccggccttatcatagaaatcaaccttgtcgattgttaatgtagcaggagtctgattgccctcttctcccagagcattcatccaccatacttctaccttgaagtaaccgtttgacttaccgtctgcatccttagtctgaagaccgccgatgctgtcccaaacccattgatgtgtgccggcttcactgctttcgatctggtctgatgaagcccaaccgttattggcaacagtgttaccgcctaaagcaccgttagcataagcctcagttgtaatagtagctactgccttatcaaccttgcctgcccatgcttcaacgctgtcatcaaagggaagttcccataaattaacctgacctgcatcctgaggtttactgttctcaggaacagtcattgaaactaatgcgtctgctgcaaatgcgcttactgcaagtgatgatactgcaagtgaagctgctgcgattgcagctaaagtttttgtaaacttcatttttttgtcctccataaaatatttttttgcatttaagctatttttaatcatactatatcgcaattagatttgcaagtggcattttgcacaaaaatacatttttgttttggtgaaacaatataaacattaatgggattttgtacgtttacagcattaaatctgaaaatacaacaatttgtataacaaaaaacttagcattaagcgaagctccggttctgttattacctgtttttgtaaaatccgtttcatttgtatgtgttgcaaacgttacaaacgacacattttctttattctgctccgtttattatgttccccttgactaaccgccccgtttaatgtacaatataatagaggaaatatgcagacagcacgcacttcgtgccatatattctgcttcccggcagtcaaaaatcaatatatggttatactgcacaaaaaacattcttatttttttacttatccgatacacagaattttcatttcgagtgaaactttttctgaaattcagcctactacaaagtaggtgacaaagtgaggtgagccgatgggcgcagagattcacggaggtcacgagaataacgaagaatatttcaaccgtgtctacaacgaaacctgcagatccgtttcccgttttgtagtcagcaaatgcggaaacagagaagatgcggaagatattattcagaacgtctatacacgtttcttcaagcgcataagcgaaaaaggacacgaggacatcgaaagccccgaggctttccttataaatatagcgaagtttgaatgccgcacctatttttcgggcaggaagaaggatgacaaggtttcctccttttccgactataccgaagaagaaatggtcgctatcgaacgggagatgtccaagcctcagcaacggcttgaggatgttatcagcaacaagattgttgcaaagcagattttcgatgacataatgaagaccgatgaactgacaggtcagatattctatcttcattttgcgtgcgatatgaagctggaggatgtagcgaaggcgcttgacgtcaagctgtctaccgttaaaaacaagctctatcgcacaatagaaagacaaaagaaaaaattcaaattataacgacttacggaagggggctttcagatgaatacaaacgatttttacaaagaactgatgagcgagtattcgtttgattacgagaagataagaaaagccgctatgggtaagtctgtacaggctaaaaagagcaggctgaaaacggtttggctttctgtggcaggtgccgcagccgccgtagctatcacattttcaagcgtcgccctgctgaattccggcagtcctgttgttgtttcaccgacaacctcgataagtgcggaagatcgtttcagaatggctatggaggcatacagcaaggcggaagagaacaccgaagatgttttcctttacgttaccttcagaaattcagtaacgcccgaagaaatgcagagcattttagctaaggcagacagcaagggcaacatccgtgttacagaggtttatctttccgataacacaaaggtaaagggcagcgaggctatcgccgcattattcgaggagaacgctaaggatattacagcagtaaaggtatattgccccggcaacttccttataaagctgacagcgcttgacggtgtttaccttgttgaaacagaagattccttctcaaaagatgatttttctgcgatagatacaagcagcgagtacgattactaccccgactacagcacaaccgagccggtcacaccgcccgatgctgttcccggagatacgactaacgtagccgagtaaaaatttctcctattatattataatagtataccgcccgtaagacttaacggttttacaggcggttttttacattctgcaaacgccgtgtaatcgttttaacaaaattagcggataagtctgtttggctattgactttttccgtgaaaaccattacaatatgattgacacaagaaaaaacggctgtcagcatatcaaaaaaacggcagtcaaggaaagaaaggtatctatgaagaaaagaatgctcgccgcaattttaagcggcataatggtgataacgggaatttccgcttgctcgggaaatgccgcaacatcatctgaaaacagttcggcttcaacaacaacaactaccacaacaaaggcggaaacgacaaccacgaccgccgcaaccactacaaccacaacgaccgcaacacagaatccggaacctgcacctgccgaaacaaaaggtgactctgttcagttctcgcagaacttaatgcccggctggaacctcggtaatcagcttgagtcaaactccgacggaacaccgagcgaaacagcgtggggcaaccccgtaattaccgaaaatctcatcaagcaggtaaaggcacagggattcaagtctatccgtatccccgtatcatatctttcgaatataggtgcaggccccgactacactatcgactcaaagtggctcgacagagtgcaggaagtagtcgatatgtgcattgataacggactttacgctataatcaacgttcacggcgacggctactacagcataaaaggcggctggcttctctgcggcgaacccgcttccgagcaggagactataaaagcaaagtacgaaaaggtctgggagcagatagcaaatcgcttcaagaactatgacgatcacctcgtgttcgagtcaatgaatgaagtgtttgacggatcatacggcaaccccaatcccgaatactacaacaacatcaacgcatacaatcagattttcgttgatacggtaagaaaagcaggcggcaataacaacagccgttatctgcttatccccggctggaacacagatataaacttcacaacaggcgactgcgatacatatacaatggaagcaaagttagttatcccgaatgacagcaggataatggtttccgtccactactacaccccgtgggaattctgcgtagacgaaggcaaagataccttctataaatggggcgactcggtcaagaaatttgtaaagcgcagacagagtgaaacgctcgtaaacagacagttcgataagctctacaatgcgtttatcaagaacggttacggcgttgtaataggcgagtacggcgcaaacgacaagacctcaaaggataagagcaatactacatatcgtgcttatttcgcagagtatgtgaattatgccgctcatcagagaaatatcgttactgtttactgggataacggctataacggtaatcacggcttcggcttattcgaccgcacagagtgcacagtaacccagcccgaaataatcaagggcatcataaacggcgccaaggcgacaacagcacccgccgcacctacagaataaacttagccgaagactgaaaaaatttgtataattttccgcttgctttttcggaagaaatgtagtatagtagtctttgcaaaaagaagaaaggaatgatacttattatgaagaaattaacctctgcggttacagccgcagcaatgtcgatattactgggtattacctgctttgccgaagaaatcggcgcaagcacagtagtcggagcaagcagcggcaacacaaacacaggtgtgacttttgatatgacagcgatcattatctgcgttgtcgcactggtagttttagttgcagtcggtgttattacattcatcatcagcaagaagaaaaagaataagtaatttctttgcgagcctcccacacaggaggctcgttttttctatgtcacatattataatatgtgctgtataaataaattttcgcagacaccgccgaaaacaatttccgtgccgataaggagttaatattttcgtgagtacatcattacaactgcactgacattgacctttcaaaaaaaaccactaacctgagatatatgtactaacctgcggacgtgtagcgttaagcgttcctgcacttacaggatatacaatgttcaggtagttttacgagttacgccaacaccccagcggggtacgggtgtgggtaaggaaagagggagccacgagggagaaaacctaaggaatagggttaggggccaagcagtatgcgaccctcatgctgagtaacaacgattgccgcctgagcatttatctcgggcatttctgttttctgaacagctctgacttctgacattaagattcatccttccgtagttagtttatgtaaatttcagtatccgtaagcgaaattcaacacattaattatagcaccggaaaacaataaatgcaatgacttttgtgattattttaacttaattcataacgcaaaatgacgaaaaatatttgaaggaagttttggttggagtgataaccaaatattattcgcaggagcatgagaattatttacaaatttaacggtaatgcttgacattttcggatttcgggtatataataataatgtataaaagtatacttgtggcaaaaatacacagtagtttacaaaatttgtaagataaacagtaatcattcttgattaatgaaatattaacaggaggtcttttagatgcttcagaacagctacgacaattacacacagaagccgcagctcaacgctaagctgaaagtgctcagaaagataatcgcatttgtatttgcgataaatatgctgatcaccagattcttcggcggacctgcaggcactcagctcagacaagctgaggtgtttacagacagttctgcttcgcagacatatgtgaccgacagtgtttacagcaccgatttgccttcgattttatcggcggaggattttgacacttcggtaaccgccagccagtcttctgtatacaataatctcgtcggagatgtttataacgatgtattcggctatgctgcaggctttactctgtttacagagggagattgcaacgttatgggcgcagacagcggaggacgtattgcggtaggcggagatttcacaggtccgggttggtatgatataaaccatcaggatccgaacagaaatgatcctaacggatgtgcttctcttatagtaggcggcacgctgaataatttctgcaccaataacggtaacgtatgggcaaacaacatcggcgagaattacagcaattcaaattataaaactgtaatcggcggcgtaaacagtgacgagtgcaagtttaattttgccgatacgtttgcatatttacgttcatcatccgcacaccttgcaggattacaggcaaacggagtatataacggtgcatacggaaatattacgcttgacggctatgataaaggcgtgaatattttcaccatcgatatgtatacatggaattcgatggcgggtaacggcggatacgctcttaatatcaatgttcccgaaggctcgacaatacttattaatattacaggtggcgaaggcgacagcagcacaagtcttaaccttgctatgcacagccttattgtaaatggtcatcatttacagaataatgagcagacaggcaacctgctctttaacgttaccaatgcggcaactatcaacataaatggctttaacggttcgatccttgcgcccaattccgatataaacggcggcggttggcaccatgacggtaacatcgtttgtaagtcgttctccggtaatacagagtttggaagtaacccgttcaatccgcctttcgacgatgatgatttcgattacggcgatgatgacacggatactgatactgacacagacactgatactgacacagataccgacacagacactgacaccgatactgacactgacacagacacggatacagatacagataccgacacagataccgatacggatacagacacagacacagataccgacacagatacagatacggacactgacacggatacagataccgatacagacactgatacggacacagatacggataccgatactgacacggataccgacttagacacagatacagatacggatacagatacagatactgatacggatacagatgccgatactgacacagatacagataccgacacagacacagatactgatacagacactgatactgatacagacactgatactgattcagacacggataccgatacggacactgacacggataccgacacagacacagacacggataccgatactgacactgacacagatactgatacagacacagacactgactcggatacagacttagacacagatacggatacagacacagatactgattcagacacagatacggacacggacactgataccgatactgacacggatacagatacagataccgacactgacactgacacagataccgatacagacacagatactgatacggacacagatacagacacagatactgacacagatacagacacagatacagatacagatactgacaccgatactgacactgacacagataccgatacagatactgatacagacacagatacggatactgacactgacttagacacagacacggatactgatacagacacagatactgatacagatacagatacggatacagatacggatactgacacagataccgatacagatactgatacggacaccgatacagacactgacactgataccgacacagatactgacacggatacagataccgacaccgatacagatactgacacggatacagatactgatacggataccgacacagatacggataccgatacagatacggatacagatacagataccgacactgacttggatactgacaccgatactgatacggatgccgatacagatactgacacagatacagacacagacactgattcagatactgacacggataccgatactgactcggatacagacacagataccgatactgacacagacactgatactgacacagacacggataccgacttagacacagatactgatacagatacagacaccgatactgataccgatactgacacggatacagatacggataccgataccgatacggacaccgatacagacacagacacagacacagacacagacactgactcggatactgacacagataccgacactgatacagatacagatatggatacagacaccgacactgacacggatacagatacagacacggatacagataccgacttagacacagatacggacacagatacggacacagatacggacacagatacggacacagatactgacacagatactgacacggatacagatactgacacagatactgatacggacacggatactgacttagacacagatacggacacagatactgacacggatacagatactgatactgatacggacaccgatacagacactgattcagatacggatacggacactgacacggatactgatacggacacagacacagacacagatacagacactgataccgatacagatactgactcggataccgatactgacacggatacggataccgacacagataccgatacagacacagatactgatactgatactgacactgacactgataccgatacagatactgacacagacactgacactgattcagacacagacacggatactgattcagacactgataccgatacggacacagactcggatacagatacggatactgacacggatacagataccgatactgacactgatacagacacggatactgacacagatactgacaccgatacagatacagacacggatactgattcggacacagacacagataccgacactgacactgacacagactcggatactgatactgatactgacacagatactgatactgacactgatacagataccgacactgacacagatacagacactgatacggatactgacacagacacggatactgacttagacacagacacggataccgatacagatactgacacggataccgatacagacactgacacggatacagatactgacactgacacagataccgataccgatacagacactgataccgatacggacacggatactgacactgacacggataccgatactgatactgacacagatacagataccgatacggatacagacacagacacagataccgacacggataccgatacagatactgataccgacactgataccgataccgatacagatactgacacagacaccgataccgataccgatacagacacagacactgataccgatacggataccgataccgatactgacacagataccgatacagacacggatacagacacagacacagacactgattcagataccgataatgatcgtgtaaatggtgatgaagttgacttcgacgacagaacacctcagggtgagcgtgtaaacggcgatgacagcaacggtaaccttgagcgtactgactttgacaacacaaacggcaaccccaataccggcgttggcattgacggaacgcttgcggcaggtgcggcggctacagcggctcttgcggcagcaggacttcttctcggtaagcgtaagaaaaaggatgaatcagaagaataatcggtgaataaccaaacagctgtatggctaaaaaccatacagctgttttcttgtataagggcaaaaaaataacggcaatcaatacgattgccgttattactgctttgtcaggttttcttgaactgactgttgtaaagttccgcatagaatccgttttttgcaagaagctgatcatgattaccgatctcgataatcctgcccttatccattaccagaatggtatcggcattttttatagtcgataatctgtgagctactataaagctcgttttgccctttgtcatctttgcgaaagcgttctggatcttcatttcagtctttgtatcaatgctgctggtcgcttcgtcaagaatcagcataggaggcattgcaagcattacacgggctatgcacaaaagctgtttctgaccttgtgaaataccgtcattgtcgcttattatcgtatcataaccgtctttcatacgctttataaagctatggcagtgagcggcttttgcggcggctacaatttcttcttcagttgcatcctgttttccgtaagctatattttcacggactgtaccatcgaagatccatgtttcctgaagcaccataccgtagctgagtctgagcgaatcacgggtcacgtcctttatattgttgccgtcaacagagataccgcccttatccgtgtcatagaaacgcataagcaggttgattatagtggttttaccgcagccggtatatgtgttgatcagatcctccgggaaggctgcattgaaactgcacaaagcttcaatactactcaaggaggtaactgcaatgacaagtcttgatttttacgctcttccgtggtacaagaaaatacttgttaaaatagcagaattttttgtagccatcggaaaaggcgtcgctaatttcgtgatcggggcgcccggcgccgtatggcgttttataaaaatgatcggcaggggtcttggctggctcggaagcacatttgttcacggtgacgctctcaccaagctctcatatattataatgggtgcaggaaacctgttccgaggtcagataatcaaggggctgatattcattgccgcagaggtagcgtatatcggctttatgattgactcgggactcggctttatagcagggctcagaaatctcggtacggtgcagagaggctggtacttcgatgaaacgctcggcattgatgtaatgcgtgaaaacggcgacaactcaatgcttattctcctttacggaatatttgcactgttcgtaactctggcattcatattcatgtgggtacataacataaagtcggcgtacagcgcacagcagattaaaaaatccggcaagaagctgccgggcttagtggacgatttgaagtcgcttctggacggacagttccacaagacgcttcttttcattcccgtatccggcatcgtggtattcacgatagttccgctggtctatatgatctcgctggcgttcaccaactatgataaggatcatcaggtgcctgcaaatctgttcacctggatagaatttgataacttcaaaactattctcggaagcaattccactatcggcaacactttctggccggtactcggctggacactggtatgggcatttctcgcaacgttccttaactacttctttggaataattctagcgatgctcatcaacaagaagggcgtcaagttcaagtcattctacagaacgctttttgtactcgccattgcagtaccgcagttcgtttcactgctggtaatgaagaatgtttttgctgaagcgggtcctgtgaacgtacttcttcaggatcttggatggatctcggctccgctgccgttcttcaccgatccgatgtgggcgagaatgacgatcatagccgtaaacctgtggataggtattccgtatacgatgcttatcgtttcgggtatccttatgaatatccccgacgatctgtatgaggcggcaaggatagacggtgcttctccgtttgtaacgttcagaaagataactatgccgtatgtgctgttcgttactacaccgtaccttattacacagcttgtcggcaacataaacaacttcaacgttatctacttccttaccggcggtactccggcaacactggattactaccaggcaggaaagaccgatctgctcgttacctggctgtataagctgacggtcaactcgagggattacagctacgccgcaacgataggtattctggtattcattatctgctcgctgctttcgcttataaccttccgcagatccgcatcctataagaatgaggaggcgttccagtaatgagagagataagaaaacaatcctactcctatcacagaaaacagcgcacgattaatatcgttatacagattgtgctgctgatactgggtctgatgtggatactcccgcttttgtggataatcctgacgtcatttcgtgcagagcccggttcatatacaagctacttctggcccaagagcttcacgcttgataactactcgaagctaatcttggtggatcagcagttcaaattcacaaaatggtttatcaacacgtttatcgtggcggtggtatcctgcataggctcaacgttcatagtgcttgcggtgtcctacgctctcagccgactgagattcaagatgcgtaagcctatgatgaacattgcactgattctcggaatgttcccgggattcatgtctatggtcgctatctattatatccttaagggtctcggcctcactgagaatccgcttgtttgtctgacgctggtttacatctgcggttccggacttacctactacatcgcaaagggattcttcgatactatcccgaaatcccttgacgaatctgcgtaccttgacggtgcaaccagatcacaggtgttcttccgcatcactatcccgctttcgaagcctatcatcgtatacacggtgctcactacattcatggctccctgggtcgactacatattcccgagtatgatttgcggtgcaaactacgacagctatactgttgcgcttggtatgttcaagatgcttgagcgtgagttcatcggtacctactatacgcagttcgctgcggcggcagtgctggtatccattcctatcggtgcgctgttcatagttatgcagaagtactatgtcagcggtgttaccggcggtgcggtaaagggctaatatctattataaagcaaaatcacttttccgggggggatcttatggcagtcaagaacgtaactatccaggatattgccgacaggctcggtatggcaaagagtacagtttcgaaggccatctcaggtgctaccgacatcagcgaaaagacccgtgagcgtgtgcttgcctgtgccggcgagatggggtatcaggtaaagacaaaacacgtttcatatactaagtcgatagttgtctttatctacggaagtatccactatgacaaggtggatcagttcggctatgagatcattctcggattacaggccaccgctgcggagcacggtatcggggtaaacatcactgctataagcaatgccgaactaaaaagcggtaactactattctatcgtgtcggggggaaactgcgagggagcggttttcctcggcttcaagccgcaccatgtgttcatcgagcatatacgcagtctgaatattccgcttgtgatacttgataacaatgtcgattatcagctggcggctcgtgtcggctgcgacagcgcagagggaattcgtcagatggtgcagtatctctggatgagaggtcacgacaggatcggatttttaggcggcgaggaggacagtattgtcacgcaggaacgctatcaggcatattccgacgcactgaaagagcttgggcttgaggagaataaagacgctgtcagatacggacatttctctgcgaagggcacacgaaagaggattcttccgattgctcagacaggagtcaccgcagtggtttgtatcagcgacctgttagcttgctctgcagtgcaggagcttgaaaaagcgggatatgtcgtacctgcggatataagcgtgacaggctatgataacctccccgtgtcagaatattcgcaaccccgtattacaacgatgtatcagaaccgaatacatatcggaaagaccgcattcgtaatgcttcagcagatgaacagcggtatctcgatagaagcggtcagccttcgtcccgaactcattgagagagaatccgttaaattgatagccaagagaattttgcccgaggaagacaaatgaaaaatacaagatttttactttcagccgcagccgctgttacggcggcggctattcttttatccgggtgcagtaccccggaggaaactatgtcggaaagctcgcagccgcaggctccgtcataccgttacgaacacgagctgaatatgatagacgataactaccgcaattactaccaggtgttcgtttattcgttctgcgacagcaacggcgacggtataggcgaccttgccggagtcacatcccgactggactatattcaggatatgggcttcaacggtatatggctttcgcctataatgccgtcggattcctaccacaagtacagcgtaaaggattattatgccgttgatgagcagtatggcacgatgcaggattttgaggagcttgccgcagagtgtgaaaagcgtgaaataaagctgttgatagaccttgtgatgaatcacagctccaacgagcacgagtggttcaagcacgcttcaaagagcctgcgcagcgatccgtgcggtgcggctaaagacaagccctgccttaacgataatatctgccctgtgcacgataaatacatcgactattattattttacggacgagaagcctgtcggaacgaactcctggtacagaataggctcaaaccggtggtatcaggcagttttctcagagcagatgccggagctgaatcttgataattctgcggtgcgcagtgagtttgagaagatagctgacttctggctggaaaagggtgcaggcggattccgtctggatgctgtcaaggagtatttcagcggcaaccccgaaaagaatatcgaggtgctgaatcaatttatgaagcactgcaagacggttgacccgaaatgctacgttgtcggagaggtgtgggagagcttcacgaactatactaaatactacagctccgggattgacagcgtattcggcttcactatggcacaggaaagcggaaaaatcgccaagacaatcaatggtaagggtgctgataactcggttaaatcctttgcacaggcaatggtaactgtcgagcagaagctggcttcctacagcgataccgcaattgacgcaccgttcataggaaatcacgataccaaccgtggcgcaggcatactcggatataacgaaacgaagataaaggcggcggcaggattactgctcacaatgtccggttcgcctttcgtgtattacggtgacgagataggcctttccggaagcggacgtgacgagaataagcgtgccccgatgatatgggacagcgagggtacgggacttacatacggaccgcctgatatggagcggcaggaaaaccgttttgccgatgtgcagacacagcttgcagacgaaaattccatactgaattactacaagcgtgcgctcaggatacgcaacgaaaacccctgcattgcaagaggtacgaccgaagtgctgacagtgccgggacaggatattgcggcggtgcgccgcacatttgacggcgacagcattgtgattgtttataactactccgatgaaagcaaagaaatcacggagattgacggactttccgaaatgcagatacgaggatatctgactgtggattctgccgaggaggtcctgctggacggcggtcttaaaatgcctgcgtacagcattgcatttcttaccggaaaataactacggtatcaagcagcttgaatcagagttgaacgatgcggcagtaaccgacagcacgcagggttcgcagagcgagtacccctatgtcaaacatagcgtcacgatttccggcgttccggataacgatacacaccttgccaagaaaagaagactgtccgaacttaaagcacagaaagcagaagtagaacgcttcatcagcaatattgcggacaatcagacaagggatatgttctactacaggtacatacaaggctatacaatggtgagaactgccgtagaaatcggcggtgataatacaccggacggagtaagaatgagaataaatcgatatttaggttaatgttgttcgttttaagggtgttataatttaaaatgacaaaatataaaatatttttaatgaaaacggagaacatgtgttgacaaataatgccgaaaaggatataattaacaaaaagaacggaggaatatatatgaaaccacgtgtttttgttagttctactttttatgatttgaaatatgttcgagaagatttagcaagctttattcgcaatcacgattttgaaccaattatgtttgaagatggagatattgggtatgatacaaataaagctttagacgaatcatgctatgaagcaatgcatacggctgatatggcagtacttataattggtggtcaatacggctctaatgcgagttctcaagaatctgaaattgtgaatagctttatatcgattactcaaagagagttcgagacagcggtaaaagataacattccagtgtttgcatttgtcgatgcaaaagtgctttctgaatataatatttataaaagtaacatggaaaagttcgaacgaaatcctaagtatattgaatttcatgcaaccaaagatgtgcgaatttttaaatttattcattctattttttgcccaaacatgataccggtaaatgaatttaccaaaatatcagatattaaagatttcttgtcaaagcaatggtctgatatgtttaaaaagtatttaaaacaatgtaaggaagacaaagaaattgaaaccataaagacttctattgcaaagcttgaaagcattgttaacagtatgacagttatgcttgatgctgtaggtaaaaacgtgcttaaagaaacaccgaatgaatataatgttatcaaagaaaaacagcaagtaactgaaatctgtaacatgataaaagatgctgtttctttcgaggatagagcagataaatcaagtcaatccccgttgccaaatagacttattgactttatttttgatgtgaataagtatatcagcagtgtacgtggtgcagatcaagatgcagaatatgcaagaaatgagacttatggatatagccgttttatagaacatgttcgtaatttgggaatgagaaaagatttgtttgtattttttgtagattctgaagcaataccaaatatatgtgaaaatttaaataatgaacgaattaagaagcttgttgctgaagaattatcaaatactgattttagctttaaaaggaagattagatttcgagcctaattaatgaagcccggcacaacggtgtcgggtattcttatacccaaaagaaaggacggtgtaccgccaatgaccgaaagacagaagaaattcgccgaatactacgctcagtgcggtaacgccgctcagagtgcgatacaggcaggatacagcgagaaatatgcaggtcagaacgctgacaaattactaaaaaatactaacatagcagactatatccgtgaattaaccgaagccgcccagaccgcacgcataatgaccgcccgtgaacggcaggcgatactttccgatatagctaaggacaaacagaacgagctgtcagaccgtatcagagctattgacacgctgaataagatgacgggggagtacacgcagaaggtcagcattgacggtgatgtgggagtgaagatagttgacgactgttaagctaagcgacatcattgcgccgtcattttacgacttgcataaagacataaaggcagacaggcacacgcattactggctaaaaggcggacgaggctcgacaaaatcatcttttgcatcaacggaaattccgctcggtatgatgaaagatcctatggcgaatgcggtcgttatccgcaaagtcggactgtatctgaaagacagcgtttatgaacagctcctgtgggcaatagaaaggctcggcgtgtcgcacttatggcagtgcagacagtcaccgcttgagcttgtctacacgccgacaggccagcgtattttatttcgtggcgcagacaagccgaaaaagctgaaatctaccaaagtcagaaaggggtatatccgctatgtgtggtacgaggaggcggacgagttcggcggtatggaagaaatccgcacgataaatcaatccctgctcagaggcggtgcgacatacaccgttttttacactttcaatccgccaaaaagccaaagaaactggataaacagcgaggtgcttgttcctcgctcggacaagatagtgcatcacagcgactatcgttctgtgccggcagaatggctcggagaacagtttttgattgaagcaaagcaccttgagcagacaaagccggagcagtacaggcatgaatatctcggagaggtgaccggcacgggtgcggaggtatttacgaacattactatccgtcctatcacggacgaggaaataaagtcattcgatcatatcaaacgtggtatagactggggttacggcgcagatccgtttgtatatataacagctcatttcgacagcaagcggaataggctgtttattttttacgaatttttcaggtgcgccgcaaagtatgacgttattgcaaatgcaatccgcaaggagaatacacaaaacggtacaatcattgccgagtctgccgaaccacgctcaaacgatgagcttcgggacaggggttttcgcataaggacggcagtcaaaggtccgggaagcgtcgagcacggtataacgtggcttcagaacctcgaagaaatcgttattgacggcacacgttgcccgaacgccgcccgtgagttcaacgaatatgaacttgatcgtgacagcaggggagaactgaaagcggacttccccgataagaacaatcacaccatagacgctatccgttatgcccttgaggactatatcggcaggaagatagtgaaatcaacgctcagcaagcgaaaattaggaatctattaaggagatcttatgataacatcaccgattttcacaacggacaaaacggcggagatgataacgccgaaaatagcacgggattacatagaaaagcacgataagtacgaaatgccacgccttgcgatgctggataattactactgcggcagacagcgcatctgcgacaggcgtaaaagtgacgatgtgctgagcaacaaccgtgttatgataaatcacgccgcatatatcgcaaagtttacatcttcgtatctgatagctactcctgtttcttacagcggtaaagatgatacggatattacggcaataaccgactgcctttcttatgccgacagcagtacgcaggacgcagatcttgcactcgatgccgcaatattcggcagagcatacgaacttatctatatggacgctgacagccgcccgaagtttgcccgtatcactccgctgtccgcatttgtcgtttatgatgataccgtggagcaaaatcccgtatttgcggtgtattactatccggttttcgagccgggcaacagtacgcctgagtgcttcaagtgtcagcttatgactgatacgataacgcaggattttgagcttacaagcaacttcggacttaaatcggagggcgagatgataccgcactatttcggcaaagtgccgctgaatgagatctataatgacggtcagcgacagggcgattttgagcaggtcataagccttattgacgcatataacacgttgcagtcagaccgggttaacgacaaggagcagttcgttgacagcctgatgtacattaaaggtcagatactcggcgaaaccgacgatgagaaggctgaaacctacagcgatattcagcgcaacagggtcgttgagctgtcgcaggacggcgaaataggctttttgacacggcagtttgatgaagcaagcgtggaagtgctgagaaagagtattgttaccgatattcacaagatttcgggcgtgcccgatatgtcggacgacaattttgcagggaatgcttcgggtgttgctatgaagtacaagcttcttaaccttgagcagattaccaagacgaaagagcggtatttcgcagaaggcttacgttaccgccttgagtgcctttccaacataatcagtataaaaggcggtcatatcgacccgaagctgatagacataacctttacacgttcacttcctcagaacgaatcggaactttctcaggtagtggcaacgcttgacggtaaagtgccgcaggaaactttactctcgcttctgccgtttgttaaagatcctcagagtgccgctgaagaactccgacagcagaagcaggacgctatagcggcacagcagcagatgtttatgaacacaccgcttgtaaggggcgattagcaatgaagaatccgagtaagaaatactgggaggacagagccgcaggacgaatggtgagctacacggcaaaagcggaaagcaccgccgatactctcggcaaggcttattacgcaacagcacggtatctgcaaggggaagcgaatgacgtttttaacgcctttacagataagtttgaactgagtattgccgaagccgaaacaatgctcaaaaacgcaccgggcaagtctatgtttgaacagatgaagaccgctcttgctacctgcaccgatgagcagaagaaacaacagcttgaaacgctgttgtcttcgcctgcatacgcccacagaatagggcggttgaatgatcttgacagcaagataagtgatatgtgctcacgccttgcaaacgccgaaataggcgttgatacagagcatctgggcaatataattcagagtgcgtatatgcagacggttttcgatgtgacgaagggtacggattaccgtgcggcttttgatttaattcccgaaagccgtgtgaaagctattctgtctaccaactggagcggtcaggaaaacgcttgcggcaagctgttgctggcttaatcggtacagcacatacgactgatcctttgcgttgcttgtgccgtctgcgttgatcgctttcttcaaaagccatctgccgcttttttcatcgtaacagctgcgtacataatgacctgtggcgatgtgatttatgccctgctttttcaccgcatcgagcagtgcgccgaactttatggtttcgttgcactctacgcaggggttaggcgttcttcccgaaagatagctctgtacgaaacttttctgtaccgtatcggaaaacaaatccctcatatcaagcagataatgaggtacgccaaattttgccgctatcgcttttgcgtcctcgatgtcgcttgccgaaccgcaaagtccgctgtcgtccgttcctctgctgtcgtgcagtttcagcgtataaccgctgacatcatatttatcctttaacagcacaagagccaccgagctgtccactccgccgctcatcgctatcgctaatttttctgccataatgttatgtcctctgatattataatttaccgccgctgtgttttcacggcggcggtgctgatgcaataatttaattttcttcactgcctgcaagctgtgatggatgctttttgaagaagtcaactctcggctcaaggaacttaagctgatgctcgctttcgcccttgcagaagtagtccattccttcaaacacatgatcccaactccagaagtcctcgccgaatccgagatactctctgagcatctccgtaccctcgggagcaaggggatgcagaagaagtgcggctgttcttatatagtggaacacgttgataagcgtctttttacgaagctcgttatcatctgccgcatcagcctcgcggctgagctttgaccataccttgctcgactttcttacaagcgaatcaagcacataggtcacctggtggaactcaaacttatacatataacgctcatattcaagaatagccttttcgcactctgcgataacgtccgcatcgggtgtgcctacgggcatcttgccgtcaaaatacttctgagcgtaatagaaacaggaacgtatagctctgttgaacacgtttgaaagcaggaagccttcctttacaacagggtcattgtcctcaggctttgcatcggggttatagggcttgggctggaagctgacgctccttgtgccgagtcccagtccgagccagtgcatacggagctgttcggctgtatagtagttcagcagatccgccgccataggaggctttattgagccgctgctgcttgctttcttgtcaaggaacagaatgtggttgtttgcaacgaggataggaagctgcatttcgccgtcctcagggtcggaggttatctcgccatttttcagcgccatgaacattgccatttccgcaacaccgtagaagtagatgttatccgagccgataaactgatatacctgcgaatcctttgaacaccagtaatccttgtaatgctccatatcaatacccttgctcttgagataagcgcaggtaaatgagataggtgcccagagcgactcaggccatacccatacggtaagtcccttttcatcctcaaggtcgggagcctttacgccccactcgatattacctgtaagtctgaacggaacaagcgtcttgcctgttctgaaacgcagaccgtgatgtgccatgatctctgttgccgcatcacgctcgtcaagcgtgtcgaagcatatcgtgaacgaaggctttttcgggtcgtccgtcagcgtatggtgcgcaagcagatcctttatcttctcataatcctcacgcaactctttctttatatgaacaacgggcggttcaaggaactcgccgatagtctttgaaacaagagaacggacattcggcatcttctttattctgtcaacatattcaccgagcagctttgtgtactcggtaaggcggaagtaccagttcacgacgtcacgcattaccggtgtttcgcctgtcagcgtgcttttggggtcgataaggcttgacggcatatactgatgtccgagatcgcactcgtcagcatagcccttttccgactgacagccgagaacggggcatttgcctattacctgtctgccgtttaagaacactcctgccttttcgtcatagaactgcgaggtggtgattttttcaagctgaccgttttcgtacagccttctgataaatttgtcggatactacgttgtgtatctttgcaggctcatccagtgcggacgcaccgaacaggtcaaggcttatatcataatctctgagcgttttttcctggctctcgtgatttttccttacaaaatcctcaatagtaccgtcaaactctccgctttccttcagcttcctgtagctttctgctataggcgagccgtagcagtctgtacccgatacgaaaattacgttatccttaccgatacggtcacgcaggaatcttgcgtatgtatccgcaaatacgaacacaccgccgacatgaccgaaatgaagctgtttattaccgtaaggcataccgcctgtgattaccgctcttttcgggaaggacggtctgttatcctttgacggcttgttgcttttataattattattatttttgttgctgttttccaatttcaacactcctcgatgaagtttatacaatttgatagaatttattgtatcacatatcagcggaaaatgcaataaatttgtgtgattttaggcgtaccgccgaaattcgttgtgctaagaaagacaagtacaggcaggtgcggctcaaaactgagaaaactgtgtcggatatgctcatttttcatcgaatcttcttgatttttgtatacaaatgtggtatactgaatttatattatatccccgaaaaaatattgtgtgatacgttttgatttgagaaaattttcagtattattttaatttgatttataggagggagacttatctgtggaaaataaaagcggcagaaaaaatgttgccttctgtatcggagatcttgaaggcggaaaaatgcttttacaaggcttttgtaaagtactcggcgataatcttataaatgtacatatcttcaactgctgtacctgcttctacgatggagcgccgcataatataggtcagacaaacatcttcactctgcctaactatgatattcttgatatgcttgtcattgttcctttttatcttagcagcagcgaagaagtgatacggcatactatcgaacgtgcggtagaaaagaacgtacccgtgctgacaatcggaaagcaatacgattaccccaactgctactgcataatgcccgactaccgtcgccagatagagatgataacaaatcatcttatagaaagacacggcataagaaagctgaattttctgggaggattcaagaaccactttaccagtgacgaacgtcttgcgggcttccttgatgcactcaaaagccataacataccgatagagccgtcaagaatatattacggcaatctgtggagcgcccctgcaattcagcaggtggaaaagatgaacgaggacggaaatcttgactgcggagcaattgtctgtgcaaacgatacaatggcatcggctgttatgataaagctgtctgaactgggctttgatatgccgggcgaaattgccgttaccggaatggacggtacagacgaggccaacggatatatcacgaccgcaaagatactcgccgacaaagccggcgaggaggccgccaatatcgtggttaatcttcttctcagaggcaagaagcctgcaaagctcggcataactccgcccaacataatttacggtatatcctgccgctgtacgaatatgcagaacgcccttgatattctgccgaagcaaaggcacgatctgttcgaagaactatatgacgcaaggcgtttttcgataagaactgcggctattgcgcaggagcttgcaaactgctctacatttgacgatgcaagcaagaatatttcggcgacgcttttgagaatatggtgcaacaattcctggatatgtatctgcaaggactttatggaaagctcgcttgtgaacgattcgattgacgatgttgaaaacaactgtcccatacacatacacggctactgcgatactatgaagtgcttagcacgatgcacagataagaagccgcagagcgaaaccgaatttcccacttctgaaatgctccccgacttctacgaaatgtccgacaaaagcaagttcattttgtacacgcctattcacataagggataacacgcttggataccttgcgttcaatttctatccatggagcagtatgaactatctgctgaactttctcactatggcaatgtcacagcttttagaatcggtacgcaggcagaacgagctgtacgcatacgcaaagaagatcgatatgctctatatcaccgatccgctcacctcgctgtacaaccgcagaggctttttcagaatatacaacgattatgccgaggacggagttaaggatgactgtatggtcattttggtggatcttgacaatctgaagctgataaacgacaacttcggacacaacgagggcgacaacgctattctcactatggcaaacgcacttaagtccgccgcagacgagaacgatatatgcgcacgcttcggcggcgatgaatatgtcgtattcggcaaaggcaagggtgaatacgagatgaatgcgtatatcgacaaggtcaacaaatatctttcggaatacaacctgacaagcaaaaaaccgtacaatgtacacggtagcttcggcggatgtattgtgccgaaaggctcaaagctccatatagactattatataaataaagccgactcgaagatgtacgttgaaaaggaatcgcataagagaacaagaatgctgcatgactacagcaaggataagcctcagaccgacgagtaacataaaacagcaagaccgcctttccggcggtctttcagcttgtagaaaaagtatgttttttcaaaaaaagtgcttgttctcaatccctatccccaaacccctttccccgtgggaagggctgtgtatgctttgttggctctgcatcgtgcagagcctttgggcatacacgcccggcatccgtgccggggcagtaataatcggcggtaacgagcgcatggaaacacgctatgcggatatatgcaaggcttacggttacgataaggctaaagtctttgtaaaggaaaacagctcgcttaaaaagaaggtcggcactcccgatttactgatactgtttacaaatactgtatcgcacaagatgatgctgagtgcaacacaggaggctaagcgcaacagcgttcctgtggcaagagtacactcaagcagtgtggttgctttatcacagcttttagcggaaagaagtgcgtcattatgaacggatactgttttgaacaatatctgattgacaactgctcccctactcttgcatcgctaaagacggcgaatcttttcaattacagatacagcagtacggatgagcttaacaaggctgtagagcgttggaacaaggaattgtcgggcaagggaattaccgtaacggttctgagaaagcgtgagaacacggcgcttatatatgtatacagggcgaaacgtctcgctaaggatttcagccgaccgggcgttgagcgttttatgaaatgtcacggatacgagaatacagatattgatttgtgccttgaggtacttggcggcaagctggcgaaaagcgaattgtttccgcacgagataggactgttcttaggttatccgcttggagatgttatcggatttattgataacgagggaaaaaacagcagatgcacgggctgttggaaggtatactgcaacgagtgcgaggctatgcgcacctttgcgagattcgacaagtgcagagctgtctaccaaaagatgtgggcaaacggcaggagtatcgtgcagcttacggttgcataatataaaaaatatcagaatgaaaggatttttattatgaaaacagcagtagtatattggagcggaacaggcaacactgaggctatggcaggctcggttgcagagggcgcaaagagcgcaggcgcagaggtaagcgtatttacagcggccgacttctctgcagatatggtagatcagtttgattctatcgctttcggttgtccctcaatgggcagtgaacagcttgaggacagcgagttcgagcctatgttcaacgcttgtgaagcaaagctgtcaggcaagaaggtaggacttttcggttcttacggctggggcgacggcgaatggatgagaaactgggaggaacagtgcatcgctgacggcgcagttatggcgggcgaaggcgttatctgcaacgaagctcccgatgacacagctaccgaacagtgcgttgctctcggtaaggcgcttgcatcataaattcagaatacagcttaaagataaacaaacatactccgtaaaacaccgcagagaaaatgctctgcggtgttcccttttcccccttgacaatcattctcctctgtgctaaaataataccatacagaaaagctatgataagaaacagtagataaatctgcgtcacagagaaagagcggttggtgcaagctcccgacaaggttttatcgaacccgtctttgagctgtacacgatgagtgttaccggtttctcccgttacagagatacaagtgcggttataccgaatttaggtggtaccacggaacaatgtttcgccctaagcaaatttaatgcttcgggctttctttatgcccggaattcaggaggatatgcaatgaaactcgacaagctggtcggcgaccgttttaaagaaagaccttcggactgtcagattgacagccacgcaattatggtgagaggcggctatatcaagtatatggctaacggtatcttctcgtcatacgcacccacaaagagaatcacaaagaagattgaacagatcatcagagaagaaatggacaagatagacggacaggaagtacagttccctgtcgttatgcccgcttcactctggcaggagtcaggcagatacgaaagcatcggcagtgagctgttacgttttacagaccgcaacagaatgcctatggtactcggtatgacacacgaggaagccgctgtacatctcgtgcgtgaatacggcaagagctacacaaagtaccccttcatgatttatcagatacagacaaagttccgtgatgaagctcgtccgagaggcggtcttatcagagtccgtgagttcacaatgaaggacgcttactcattccacacatcgcaggaagatcttgagcagtattacgataagtgccacaaggcttatgaaaacatattcagacgtgcaggtgttcccgaggtaatctcggtcaagtccgattccggtatgatgggcggcagtatttcacacgaattcatgctccttacacctgtaggcgaggatacaatagcaagctgtcacgaatgtggtttcaatgcgaatatggaggccgcagatagcattatcgagaacacaagagatgaagtttccgcacctatggagcttgttcatactccgaatatccatacgatagaagaaatatgcgactttttgcatactcccaaggaaaagagctgcaaggctgtcgtatatcagagaaacgcagatgacagctatgttgtcgtattcacaagaggcgatatagacgtaaacgaaacaaagctccgtaacttcttaggctgtgaaattcaccctgccgtaatcacagaagaatgcggtcttaatgcaggatatatcggacctgtcggtcttcccgaaaatatgaccgttctgtttgatacttcgcttcagaatacaaacaacctttcttgcggcgcaaataaggaagaatatcattacaccggtcttgacattgaccgtgattgtgcaaatgttgaatatcacgactttgcaaagattcttgacggcggcatctgccccaattgccacaagcactcaatttctatttcaagaggtatagaagtcggaaatatattccagcttggcacaaagtacacaaagacaatgaatatgacctaccttgacagcaacggcgaggaaaagacacctatcatgggctgttacggtatcggtgtcggcagacttgcggcttcggtatgcgaggcgcaccacgatgattacggccctatctggcctatgcctatcgctccgtggcaggttcatatctgcgctgtacgttcagatgacgcagatgttaaggcttgtgcagataagctgtatgacacattacagaacgcaggtgctgaggttatctatgatgacagacaggtaagcgcaggtgttatgttctctgacgcagaccttctcggcgtaccgctgagagttgttgtaagccccagaaacctgaaggataactgctgtgagatttctgcaagggataagagcttctcatataaagttcccgttgaggaaaccgcagacaaggttcaggagcttataaaagagcttatggctaaattcaacgattgagattttaagtgaataatctgagggcagtgtttcggcacagccctttttatcgtaatatttctttacttacaggggaaaatgtagtagaataataacagaaacttaaaaaacacggaggtaataatatgtgtacagccgcaacatacaagacagaagatttctattttggaagaacgcttgattacgaatgttcatacggcgaggaaattgtaatcatgccgagaaatttcagattgcaatttctgaatatgggagtttgcgaaagtcactatgcagtgatcggtacggctcatattgccaaaggttacccgttgttctatgatgcagtgaacgaaaaggggctttgtatggcagggcttaactttgtcggcaatgcccgttattttaaagatattcccgataaggacaacgtagcacagtatgaatttattccgtatattcttgcaaagtgtgcagatgtaaatgatgcgaaagagctgatttcaagaatcaatataaccgatacgccctttgacgagcagatgcctgcaggtcagctccactggataattgcggacaggaacagcgcaataaccgttgaatcggtatcggacggaataaaggtttatgataatccgataggtgtgcttaccaacaatccgccctttgacgagcagatgttcagattgaacgattatatgcatttatcaagaaaacagcctcagaacaatttctcggataagctggagctgaaaacctacagcagaggaatgggagctatcggacttccgggcgatttatcgtcacaatcaagatttgtgcgtgtggcttttgtaaaggctaactccgtttccggcaaaggcgaaaccgaaagcgtaagccagtttttccatatactcggctcggttgaccagcagagaggctgctgtgaggtaaaagacggagagtacgagattactatctatacctcttgctgtaatgcggataaaggcatttattattacacaacttacgataatcaccgcatttccgctgttgatatgagaaaagaaaaccttgacggtaatgagcttatctcttatcctatgataacagaagaaaaaatcaactatcagaactgagagtctgtattattataaattatcgcaaacagaatacccctgtgaaatttgacacaggggtattcgtatatgggaaatggattaagaggatagcataataatgataataatatcgagatttgcgattttgagcaatctcgtgctgtttttacgaaagtattataaaccattttttcctgattgtaaacagttttttcaaaattaacgcattttatgcaaaaatagcacaaaagaggtacaatttttttattctgtctacgatgatttcaaggtgaagttcgcccattccggcgatgattgtctgacctgtttcctcatttgtataggttctgaaagtggggtcttcctctgcgagcttcgcaagagcaatagccatcttttcctgacctgccttggtcttgggttcaatagcgagcgagataacaggctcggggaattccatagactcaaggattacgggattgttctcatcacacagcgtatcacctgttgtagtgttcttaacacctacagcagctgcaatatcgccgcagtagcaaacttcgaggtctgctctgtggttagcgtgcatctgaagaatacgtcccatacgctccttcttgtccttagttgcattaagaacagtagaaccggctgctacgatacctgaataaactctgaagaagcagagcttaccaacgaaggggtctgtagcaatcttgaaagcaagtgcagagaacggctgatcgtcgcctgcgtgtctttcaacttcttcgcctgtttcggggttaacacccttgatagaaggaacatcaagaggtgagggcatatagtcaacgattgcatcgaggagcttctgtacgcccttattcttataagatgtaccgcaggttacaggaacgatctcattgtcaatcgttgcctttctgagtacagccttgatttcttcaacggtgatttcttcaccttcgaggtacttgttcataagttcctcgtcctgctcagcaacagcctcgatgagtgcatcgtgatattcctgagccttctccttcatgtcgtccggaatttcttccacacgcatgtccttaccgagatcatcatagtagatgtcagctttcatttcgataaggtctacgatacctctgaatgtatcttcggcaccgatagggagctgtatcggaacagcattacatttaagtctgtccttcatcatgcttacaacattatagaagtctgcacccatgatgtccatcttgttgatgtatgccattctcggaacatgatacttgtctgcctgacgccatacagtttctgactggggctcaacaccgcccttagcacataaaactgtaacagatccgtcaagaactcgcagcgaacgctcaacttcaacagtaaagtcaacgtgtccgggagtatcgataatattgattctgtgcttcttccagtatgcagtagtagcagcagaagtaattgtgatacctctttcctgctcctgctccatccagtccatcgtagcagaaccgtcgtgggtctcaccgatcttgtggttgataccggtgtagaacaggatacgctcggtcgtagttgtcttacctgcgtcgatgtgagccatgataccaatattacgggtcatttcaagagttacgtctctagccatatttcctccgttttattgattaccacttgtaatgtgcgaaagctctgttagcttcagccattctgtgtgtatcatcgcgcttcttgcaagctccgccctgaccgttcatagcgtcgaggatctcgtttgcaagtctttccttcattgtcttttcatttctctgtcttgcgtacagagtaatccatctcagacctaaagttcttcttctttcgggacgaacttccataggaacctgatatgtggcaccgccgacacggcgcgcctttacctctaactgaggcatgatattttccatagcttcttcaaaagcttcaagtgcgcccttacctgacttctcggctacgatgtcaaatgcaccgtatacgatcttctgagcaacacccttcttgccgtcgagcatgatattgtttacgagtcttgttacgagctctgagccgtacataggatcgggtaatacatcacgcttaggaacattacctcttcttggcactttacttccctccttcataaataatgaaaatcatcggtactcgaaagcgattaactcccgccgtccaattgcagaggtaatataatatattactccacaaaagtggctaaaagtcatcagttacgcttttttcgcaccagccttcggacgcttagctccgtactttgatctgccctgcattcttccgtcaacaccctgagcatcaagtgtgcctctgacgatgtggtaacgtacaccggggagatccttaacacggccgccacggatcagtacaacgctgtgttcctgcagtttgtgtccgatacccggaatataagcagtaacttcataaccgttggaaagtcttactctggcaatctttctcatagcagagttaggcttcttaggggtagcagtacgaacagctgtgcatacgcctctcttctggggagaagacatatctactgtttccttcttcagagtgttcatgctcttctgcagtgcaggagccttagacttcttttctgcaactgctctgcccttacgaacgagctggttaaaggttggcaaatgttacacctccttgcaaaattattaaaaatttatgccacagaataacgcttttacgcatttattctgcacacatttaaatattatatacaaaaaggcggcgattgtcaagccttttcgttttaccgaaaaaactttgtaacaatcgtcgcctttggactgaattacaacttaattttgtgcagtttcgccaacttcttcgctgcctgattcgttttcatccgattcagcaacagcttcggcagccttttctctttcttctttttccttctccattgcctcaagacctgtgcctgcgggaataagcttacctatgataacattttccttcagaccgagcagcggatctaccttgccgtgaattgcagcatcggtaagaactcttgtggtttcctggaatgaagcggcagacataaagctgtctgttgcaagtgcagcctttgtgataccgagaagaacagcttcgcactctaccggttcaatctgttcgccggcttccttacgctgttcaagctcattgtttaccttgacaagctcattcttgtcaataaccgagccgggaagcagataactgctaccagggttggttacacgagcctttctcatcatctgacgaacaataacttcgatatgcttatcgttgatatcaacaccctgtaagcgatataccttctgtacctcggcgataatgtagttctgaactgcttcctcgccctttacctcgagtacatcgtgaggatttacgcttccttctgtaagtgtttcaccggcttcgatgaaatcaccatcctgtattttcagcttgtagccgaaaggtacgggataaggatgctcctcgccgtcagctgttgtaattataacgtgtctggttttctttatctcgtcgattcttgtcttaccggaatgcttagccataattgcggcattcttgggacgacgtgactcgaacagttcttctactctgggaagaccctgtgtaatatcttcagccgatgcaataccaccggtatggaatgttctcatagtaagctgtgtaccgggctcaccgatagactgtgcggcaatgataccaactgcttcgccgattgtaatcttcttgccgtttgcaagtgaagaaccatagcactttgcgcagacgccgtgttctgcgtgacaggtaagaactgaacgaattttaacggtctttacgcccgatgcaactatcatcttggcatcggcttccgttatcagcttatcctttgaaacgaggacttcaccgttgtcatcagtgaaatcttcggcaaggtatctgcctgtaagacgttcttcaagcgactcgataagctccttgccttcacggatctcgtaaatgtcgataccgtctgtagtaccgcagtcatcagttcttacgataacttcctgtgatacgtcaacaagacgtcttgtaaggtaacctgagtcggctgttcttaacgccgtatcggcaagaccctttctcgcacctcttgaagaaatgaagtattcgaggatgttaagaccttcacggtagttagctctgatcgggatttcaatcgtttcacccgatgtatttgcgataagtccacgcatacctgcaagctgtcttatctggtttgtactaccacgggctcctgagtctgccatcatatagatggggttataatcgtcaagaccctttgtcagtgcaactgtaacatctgttgtagcctggttccatactgaaagcactgcagattttctttcggcattcgaaatgaaaccgttgttgaaatactcgttgatttcctgaacctgtgcatccgcatttgcaagaatatcctttttctcgggcggtattgtagcatcgcatacagctactgtgattgccgcctttgtcgagtatttgtaacccattgcttttattttatcaagaacctgtgctgtcataggtgttccgtgaaccttaaggcacttgtcgatgatttttccaagctctttctttcttaccttgaagccgatttcgagatcaaacttcttttcaggatcgtttctgtcaacgaagccaagatcctgaggaatatgctcgttgaaaagaatacgtcctacagtagcatcgattatctttgtttcgggatgatctccgcctacatccttggtaactctaaccttgatagccgagtggatcgtaatatcgccttcattgtaagccataatagcctcgttgaagtcacggaatactttaccctcgcccttttcgccgggcttgtcgatagtaagataataagaaccgagtaccttcatatacagatcgtagaagctgccgatattgtctgtcgctttctgtgcgatcttatcgggaaaaatatgagcgtgtgcgtctattatatatttactgtaacttaacatatcattctccttaataatatgccggaatgtgataaacggcggtgtacctcttaacgtacaccgccgtttacaacgaaaaatcaattattcttcgtcttcaggaacataactcataatggcatcgatacctgcgctggtaagctcatattccttctccagcttgtccagatactcaagacccttaggctcaatgtgataataaacacgagtacgtcttctgcctacaagttcaagacgatcagcaataagctccttgtccagaagtctgtaaagcgtaggatacatagaaccttcagtgattctgaatgtaccgttgcttctcttgccgatttcctgagtcagctgatagccgtacatttcctcaccctttaagagatgaagaatgagcatctcgagtgtgcctcttttaaagttttccttaattcccatcataagataactacctccttatctttagctaatattattgcacatctcaacaaaaaagtcaatattaatcgttgcattttcatagaaataacacattattttatttaaaaataaagaaaagcagaacaattgatgtgctttcctatcatcagcacgatttattattaatttctcttacgatttatcaaaatacaagactaaatataatcgaacacttgataaaaacccaccgaaagccgatgataaattaagctggattgttttactattcaaaaatatatcaaacagtgaattaggtttattttatttagcaacacttttatatgattttgaatgatataattacatcaaaatacagtctatgaccatttcggaaaggttcaactaatgcttttttcctcacttttaaaaccgatgtaccgcttttgaggatatgtgattataaatgaaaacgccttcacttaagttcaaaaggcttaagcgaaggcatttaatatctgatttatcctactgcgatttcaattcttaaaatgatccgcctgcagcgatgatttcgctgaacgcatagcaaactatatcgggagtctttacattctgaatctttgtaattaactgaggaatgtttgctgagatttcagtgctgaactgttcaagagcagcgctgtcattgatatcaaccgtatttgaatcatttacttcgggaatcgcctcgtcagcataagctatttccttgctttcagccttgatagaaagcacatctgcgccgtttgaagcaaccgcaatgtcaaaagtaccgttgttgccgtccatagcaacgtttaaccttacctcaaagctctcgttgtcatctgtcgtgacctttaaattatatgtaccgttgccgtttgttgcgtcaaacgagtagtcagccgtgatagctgtttcgccgttaaatgtaacagaacctgtaccggtgtagttattgccgtttacagtaccctttgcacctgcgtacagcatatcgcctgagattgacgctgtcagcgaataatcaaactgcgcattgtccgagtatgttacgagaaggatttctatctcgccggaaattgttatcttcctgccgatgatattgttatccttgacataaacgatcattgtagccattacggacttgagctcgtcctctgtcgcatcctttgtagcatcgtctacaagcgtcttgagatactggaatgaagcgttattgattccgagctgtgaaaggatatccattatcttgctttccttttcaaccgcatcgagcacgtccttgcagaaagcgactaccttttcggctgtaaaatcaattgtgtatgatgtgcagtttacagtgccgtccgaaacctttaatgaatccgacttattctccgttgcagtgaaattcttgaagtaagcgtctgatatgatatcaataaccttgttgatggtttcttcgtcgatattctttaaaatatcctcatatcccgatgatgacgagggcatttcttccgtagcatccgaaagagtaagtatatttccgatatcggattttcccgaagaaatatccttcattgaagaagcaagctccttgacatccattactatgtacttttcggtaagatcgggaacagtgaaatacagcttatctcccgacatccagtattttaccgtaagatactcatcactgccggcactgagcgaagctgtacccgagcctttttctgcagaagcatccgcatagcttgtcgccttgattacggtaggagcaacatcggcattaatacccagcacatccttagatgcggatattgtaaaggtctgctcgatacctgtctttatgttcttagctccgccgaaaatttcatcggctttcttttctgccgcagcaaaatagttcttttcaatagtttcatatccgccgccggactttccgaaaactcctgcaaaatacaaagcgagaggtattccgccgactacgataacagccgcaagaacaataaggattatcttaagcgcactgtttttcttaggcggaacaaccgcaaaactgcctgcatcataagccggcataccgggctgtacctgctgtgtaaactgtccgtcagcctgtgcaaactgcgcctgctgtgcatactgctgaggctgcgcctgctgtgcatactgctgaggctgtgcctgctgtgcatactgattgaactgaggctgaccctgctgtgcatactgctggggctgtgcctgctgtgcatactgattgaactggggctgaccctgctgtgcaaactgctgaggctgtgcctgctgcgcaaactgctgaggctgtgcctgctgtgcatactgctggggctgtgcctgcgaaacaggctgctgaggctgaccctgctgtgtatactgctggggctgtgcctgcgaaacaggctgctgaggctgatcgctgaattcattcagtgcctgctgccagtttgtctgctgttcattcatgttgttattttccatgatgtgtcctttcgagatgtgaattgatatatttcctataataatcaaatacggctacccgcatttttcgattacattttaccacaaatatggcttaaaagcaagtcagcaatataaaaattatatggcaatgacagtattttcagccgataacagaatattttcctccgcaaacccgaagatttagtaaatatagacaaaacaaaactgctgtaaccgtcagttacagcagtcaatataccattacactttactcttcacttctgtgccatacacagcttgtaatagtcgcccttcttcgccataagttcatcgtgcgtgccggcttcggtaatgcccttattgctgatgaacattatcttgtcgcagttcttgattgtcgaaagtctgtgggcgataataaagctcgttctgcctttcaacagctcctgaagtcccttctgtaattccttttcggtctttgcgtcgatagatgaagtcgcctcgtcaagaatcagtatcttcggatcggatataagcgttcttgcaaatgatacaagctgacgctgaccgcccgaaagctgtgagcctccctcatacatctcggtcttatatccgttttcaagccccatgataaattcatctgcacataccgtttttgccgccgcccttatttcttcctcggtggcgtcaagcttgccgtagcggatattatcctctatagtgcctgagaatatgaagctgtcctgcatcataatacccatcttttcacgcagtgagtgaagcgtgaccttgcttatatcgtttccgtctatgtacaccgcaccgcccgtaaggtcgtagaaacgtgacagcagatttacaatagtagtcttgcctgcacccgtaggtcctacaagcgcaatgctttctccgggctttaccgtaaagctgacattttcgagaatgttctttccttcttcatatgcaaacgtaacgtcacggtattccacctcgcccttaatatcaggcatttcataagcgtcctcagcgtcctttacatctacaggctcgtccattgtttcgaatatacgctcaagataagccaccgcatttacaaagttgttgtaaaggcttgcgatattgattatcggctgccagaagcgtgaggaatagttgctcatcgcaagtatcgagccgagcgataccgccggatagcctataacgagcagtccgacaaagtacagtgccgaatcgaccaccgcccttatattatcgaccgagaagctgacaaagttgtttaccgtgaccgccttcatccacgcttttctgtaggcagtagacagtctgcggaatatgccgaggttttcgttctccctcgcaaagctctgcgttacacgcatacagttaatgctctccgcaagatatgccgtctggttggagttcttgtttgaaactccctgccacgcccttctctgcttgtttttcagtattatcatcacaacgatgaacacgggaacgcccgcaaatataacaagcgccagccttgcgtcaaccgagaacatgaatatcgttatgaatataaggttgaatatttcaagaatgaagttgattatgccgtttgtcagcatatccgatacattattcacatagtttacgacacgaacaagtatcttaccctgcggtctgtcgtcataatactggaacaatgattgctgggtgcgatccttcgacatagtagatcggcgctttcttgccgtcgtttttctgtcggtactttgtgagcacgtctggtttgaacgtcttgccgagtagcgcattgcctgtatatttctcattcgtgaggatgctctcgatgacattgtgccgccagttttccttgccgagcttggttttgactccatccgcctgtagccgctttgcgatctgcgtaatagagtacccggcgatgaactcccggtatatccttctgacgatttccgcctcttcttcgttgatctcatatacatcgtggccttcatcatcttttccgatctttcggtatccgagcatgagtcctgtattcagtatgacgtcgcctttctggaacttccgctgccatgcccacttaatgttgctactgatcgtgcggctttcctgttcggccatagccgcgaggattgtcaggagtacttcgcctccgggtgtcagcgtgtcaatgttctcactctcgaagtacacgctgattccgagatccttgagctctctgatgtattgcaacgcatcgacagtattccgagcgaagcggctaatgctcttaaccagcactttctgtattttccccgcgcgacagtcctcaatcatgcggaggaagtccggtcttttttctgctcgcgtcccgctgatgccgggatccgcatagacatcaacgaactgccactctggttttgagtagatcagctgtttgtagtgctcgacctgccgctcgaagctgtcctcctgttcttctttttcggtggacactcgggcgtatgccgccacctgcagccgctcagattggttatccgccacatcgataaacatctgcggcatggttcgtactactcttcttgtcgccgttgccattatgactcctccttctttttgttccacccgactttgttcccgggctgcccattatcgtagctgcgcgttattttcgctccgttatagaacacgaaggtcaccgtgaacattgtcacgacgaccttcgatagaaatcgttttgctttttcttcgctgaattctgtaatcggcacatactcgctttcgggcacacgttttgccctgcgttcagatatcttttcactgatgtcagtgatctgcatttttacgcttttgcgttcttcctcgtatgccgccttcgggatcagcctctgcatcatgagctctgcgagctcctgctcctgctgccgcaggtcttcgagcacttcctgcagtgctaccattgaatcgccctgcggcctgcgctcgataaattcattgtaggcggatatgaatttctccttgagcacagtgtccttgattcggctgttgccgcaggctttttttccatctctcagatatgtgcggcatgcccagatgtctgtctgccatttgcactggctgttattgaccttgtgcagataattttttccgcagcagccgcattctatcattccggtgaagctgtgtgcgattcttgtccggcagtggtttctgctgcgttcttccaatatgcgctgtgcggcttcccacgtatctctatcaacgattgcctcgtgtgtgccttccatgtagtagcgaggtgcatattcggcgtttgggttcttatggtattccccgaagtgcctgaccgatttccccatgatcacatcgcccttgtatttttcgtttcgcagtaagccgatgatgtgcttcgcatcccacggatacccattccggctttggacgcctgctgcattgagcgtatccgcaattttctttgacccaatgccgccgtccacgtaggattcgtagatgtatcgaattactgccgcctcttctggcacaatctccaattcattatccgctgtcagcttcaggccgaagagcccgctgccgacgctgatccagccattttcgcagcgatgctgaattgaccagcgctgtcgtgccgaatctacctccagatcgttttctgcaatcgtcgctgcgatcgtcaagaagatttcgcttgtcggctggaatgtgtggatgttttcgttttcaaataccacctcgataccgaggtcacggagttctctgacagcttccagcagctgcgttgtattccgtgcgaagcgggatacggatttcgtatagattttgtcgaacttgtgctcccgtgcatcctgcatcatcacaaggaactttgggcgcttttgtacgctgtgtccgctgatgcccttgtctgcatagataccgatgaggtctgtattcgggtcatcttcgaatgcactctgccagtagtgctcttggaattcgtagctatgcagctgtgcatctcgctccgtcgatacacggatatatgcgactgcccgtgtttttttcatgtcgttctttctcctttctatgtgctggactcgaaccaacgtatttttttacccccgccattggaggcgggggtaaagataccagaggactcttagaaagtccagcccaaaagcgaaagaacacaaagaattatcaacttgcctttctaagggctttctggctgatgttattgattttttcgcgctgtttctgcgtgatcagtccttttacccagagctgtgtagtgattgcttcagctaacgcgattttcacctttgtcctatcactcatagctgcacctcacttacttctgcgggatcttaagtttctgccccgtatagatgacagatgattttaggccgttgagcttaacgatctctgtgtagcgggctccgcttgcgaggtaggtctttgcaattccccagagcgtgtcaccatgtaccacggtatgaatgcggtagtcctcggcgggtttcgtgccagccacggcaagtgcagaggtcttgaccggcgacatgatggcgtacctgccggattcatccttgttgatgacggcacggtcgccgctgacctcgaccacataccagcggagtttcttcacccagccgggaatggctttgccgttatagtaggtgctgcccgtgatggtcacgaggtcaccggacttaattgtgccgatgggcttggccggttcgaccggcttcacctcgctgccgagagctgccgtgaccttggatgccaaatcacccatacgggcatacatccagttgccgggacagctcttgttcgcaaaccatctgtggacggtcagtaccatctcgtcggatttcggggtgtagttgagtgtcttggtcttatcgcccagccagagcagcttggttttgccgttgcgcttgcagatgtcggtgcaaagctcgatgagtctcttgtacaccacatccttaaaagcgtaaggctcggtgttgtcgctggcacactcgatggtgatagctctctggtcgttggctgcggaggaggagcaccaggagcggtttttctcttccacatacatcccgacccgaccgtccacgccgatgccatagttactgcttgcctgccgtgaggtcggcaaaaagatgttgcccagcgtttccacactgcactgacccaccacgcagtgcggcgtgatgcggtcaatgctgtgggtgcgctgaccggagtggttcgggctgagtttggtgtaggacaccaaagaactgttcgtgtaagccatattattcgtcctccttttcggcacggtcatgaagctgctccagcacggatttcagcttctgcggaatgggcagtcccaggtatgcggcgttctccaacagggacacaccctcattcgacaggtagaagaaaatgacggcggtacgcatcaccgagccgctgccgatgacacgggtgtcgagaatatgcccgatgccgaccagagcgaagatgagcacctttttgaaaatgcccttgaagccgacttcgctggacagcttcttgtctaccacagcgcacatgatgccggtgatgtagtcgatgactacgaaagccagaagcgcataaagcaagccgtcacatcctcccaagaaccacccgagccagccgccgataccggcgaataccacctgaatggtcgtccagaattctttcatgttgtttgtcctcctttgaaatttgaaaatgagtatgaaaaaaggcactccgcagagcgccttgattccgaaaaatattctttatgttactgtggtcagcgacaccgtgtgccacgaagaccatgtgccgccatagtttccccgaatatacatccttgagccgttatagacggtgtaccgctgctgaataaagtagctctccggcagaaagacctccagcataccgattgtggtggtcggaaagtgcttttccgtggaagcggaatacgcaaaatagtagccgggagtctttacattgttgaggtcggtggtcgagccgtccactctgcccattttgccgtggacattgacgccattcatgtgaatattgccgtccacatccagcgtggcctgcgggtccggcgtgttgatgccgaccttctttttacgcagcgcaatgagcggcgtgccttgcggaacagtaaaatacagatccagactgctcagagaatagagcttgtcttggatctgcaaatggaagtcgtaggaactgttggcatccagattgcacagttccaaattggagtagctgaaagaggttccgctttttgtcgtgccggaagtacgtttaggcaaaaatgaatctttagatacagctctcaagcgtttcaagagatcgtgtgccagagacggcgtcctcgcagaggttcgtaaaagagaacactacgaaaaaccttcggtaaagcgtaagaagaaatccgaggctgctcgtaagcgcaagtttaagtaattaattacttacggtaataaaaggcggacaaggttagcctcatgctgacgctttgttcgccttttaatttttttattaaaggatacggtatgatttttaaaccgcagatatggataaattcagttctcgacatagacgaggactttcttgataaatataatataaaggcgctggtgcttgaccttgacaacacgctttcgatgcacgggaatcctgccgccgaaaacggcatacccgagtggctccagcatatgaaaaacataggagtgccgatgcgcatagtgtcgaataacacaaacaagcgtgtagcaccgcttgcgaagaagctggggcttccgtttacggcaaacggctgtaaaccgcttacattcggcatatcaaaggctataaagataatgggcgtgccgaaaaaacaggtggctgtcgtgggcgatcagatattcacggatgttatcgcagggaatatcaagggtgcggtgtcggtgcttgttgagcctttccatatggaaagtgcgtggacgttcaaactgaaaagaaaagcggagagtttgtttttccacagggactactcgaagctggaaactaaggagaaaaagtaatggctgttaaattcgggccgggcggcaattcgctgagcttcggcaagagaaaatttcccgacgagcttccgtcatatctttcatctatggggcttgactgctatgagattgagtgcggcaggggagtcagaattgcggcggcgacctatgaaaagctgcctgcgcttgcaagcgggaacaatataaccgtaacgctccacgctccgtatttcatctcgctgtcaagcgttgaggcggaaaagcgtgacaacagcgtgaattatatcgccgaatcgctcagggcggcggataagctgggtgcgacaaaggtcgtggtacactccggctcgtgcgctaagattacgagagcggaggcgctgtatcttgcgaagcagacgcttgcaaaggcggtggctttaagacagagcgagggcttgaaggcgattatatgcccggaaactatgggcaagataaatcagctcggaacgcttgatgaggtactggagctgtgcactcttgacgatgaaatgctcccgtgtgttgacttcggacatctgaacgcaagaacgcacggcgaaataaagacaatagatgattatgctgcgatgctcgacaaaatcgagaatacactcggacacgacaggctttcgcagatgcacatacatttctcgaagatagaatatacaaacagcggagaaagacggcacctgacgtttgcagacgagatttacggtccgcagtatgaaccgctgtgcgagcttctggcaaagagaaatctaaactgtacggttatatgcgaatctgacggaacacaggctgaggatgcaagccttatgaaaaaggcatatctcggctatttgaaataaggacggaaaaagaaaatgaagatacttgtaatgaacggaccgaatttaaacctgctcggtgagcgtgagccgtctgtttacggcgaccattcgcttgcggcgataaacgaaaggctgaaggaatgtgccgagaaaaacggtgcagagatagatttcttccagtctaaccacgagggcgcattgatagacgcacttcacggggcaagagcaaaatataactgcattatcttcaatgcaggcgcatatacgcattacagctatgcgataagggacgctattgcggcgataaagatacctgtgatagaggtgcatatgtcgaatgtacacgcaagagaggaattcaggcatcattcggtaatctctccggtatgcaagggtactgttgcgggatttggcgaaaagagttatatgatggcgcttttctatgcgctgaatatggactgataaaggcaatcaggcaatacagttgattttcggttaatatttaagggctaaaattattatttggataaatgcggtcataatcgcagcggaggggaaatatggttaataatggcggtaatatagcaaagctggcagacgaactttcggatgaaagacacgccgctctgataacatcggatataagcaggagatatttctgcggattcacatcatcggcgggaattatacttgtcacaaaggaagcaagctatcttctgattgatttccgctactttgacaaagcaaaggaacgtgtcagcgattgcgaggtaatattgctcgaaaacgcaaagacacagcttatgaacctgcttataaagcacggtataaccactgtcagcgtggagagtgacgctatgacggtgaccgaacttgaaaaatacaaggcaaactatacgtttgtcaccttcgacagctcgtgcgggttatcggagatgatcgggaagatgagaataataaagacacccgaagaaatcgagaagatagtaaaggcacagcggatagccgaaagagctttttcaaggctgctgcgtgacataaagccgggacagaccgaaaagcacgttgcggcactgcttgaatattatatggctgaatacggctcggacggaaaatcgtttgataccattgcggcatctggcgttaattctgcttcacctcacgctgtacctacggataagaagctggaaaacggagattttctgacgcttgacttcggtgcgacctatgacggataccattcggatatgacaagaaccatcgctataggcaaggtgacggatgatatgaagaagatgtatgacgctgttctttttgcaaatcttgacgctatgaaggcgataagggctgatataagcggaaaggtggcagacagtgttgcgagaagcactcttgatgcatggggattcggcaagtatttcggtcacgggcttggacacggtgtaggtcttgagatacacgaggcaccgtcggcatcgccttcgtcacagtatacgctcaaggagggtatgatactgacagttgagccgggtgcgtatatttcgggcaaatacggagtgagaactgaggatatggtggttgtcacgaatgacggctgtcgtaaccttacaaatacaacaaaggatttaatcattatagactgatacggagggatacatatgcttacaggcttgttttttgcggtttcgggctatctgctcggaagtatattgtttgcaagcattatttcaaagctgtttcacaaggacataatatcgaaaagccccgacaagaactacggaacggctaatgcgttccgttacggcggagtgttatgcggtgcgctgacgctgctttgcgatatgggaaagggctttctgcctgtgtttatttatatgcacacggaaaatccttcggaggtcatgctccctatcgtgcttgttgcgcctgtgataggacatatactgccgatattctcgaagtttaaaggcggaaaggctattgcggtcacgttcggctctcttgcgggtatgtggcccaactggactaccgtactgacgctgtgcttcttctttattctgtttatgacgctgataaagataacccctcactgctactgcactattatttcatactgctgtacaacgcttgtatcgttctttatagagcctgtgaaggcggtgtcgataggtatgcttatgataactattgcctgctcgataaagatgctcagcgttcccgaagaacgtgagaagttcgatgtgagatggctgtggaagcactgattttatcgtgcggtaaaagaagaactgctcgggagaggtcataatgccgtgaaatgataagaaatcagcacaggtttatttcttcatcggcaataatgacggcaaaaaggtatcgtgatatgaatatacagattttcggtaaagctaagtgttttgacacaaaaaaggcggagcgttatttcaaggaacgcagaataaagtttcagtcgatagatctattatccaaaggtatgtcgaagggcgagttcaacagcgtgtcggcggctgtcggcggctatgaaaagctcatcgacacttcttcaaaggcatataaggacagcacgctgcaatatctggcgtatgaggacgataaaatagaaaagctgctagaaaatcctgcgatgttcaaaacgccgatagtgcgaaacggaaggcaagcaacggtaggatattgtccggacgtgtggaaaacgtgggaataagcgagggctatacgtcccgaaaaccgcataacaaagccgtttgaaaaaataacgaaacttttttcaaaaaaattataaaaaacgcttgacaaatcactctaaagcgtgtataatataatagtcgcttgaagagagcacaaaaaacttcggcaaacggagtaaggaaacaaggtaatcttgaggtgataacctcaggatgcaacatggaagcttagctcagctgggagagcatctgccttacaagcagagggtcataggttcgagccctatagtttccaccaaagacggagggattgcctcacctccgccctttgccccacaccaacccttccaaaaccgcactatcccttgctttgcaatatcacacttgcctcccttgtcaaagggaggtggattgacggcaaggcacaagccttgatattattgctttctgcttgcgatatgtcaaacatttttatgttgcaaactttttgccgtcaagacggagggattgcctcacctccgccctttgccccacaccaacccttccaaaaccgcactatcccttgctttgcactatcacccttgcctttaaatgaacgctttgttggctttgcgtccatgcaaagcctttgggcgttcaacttcgggcatccatgcccgccctcgaaaaaggggaggtggcacggctgaaaaaattttttggattgctgtacagtattcagatagtcctgcctttacgattctgaaactattccgagccgtgacggtggggattgggtagattataatatcaagtgcaacacaaaaaatatggacatcatactcactttcgtgtaaaatgtaattaccacaaaacaaaaggcacggaggtagagtatgaagtcctatacacattttacactatctgaacgaaattgtctacaacaatttttgtcagaaggaaaaggagtacgagaaattggaaggttgatgggcagaagtgcttcatcaataagcagagaaataaaaagaaactgtaaaaataaaaagagatataatgcgtggtgggcaacgtcactttacatatacagaagaaagaagtgtgtaaggaaacacgtcatccgaccggacaccaaactttatatttacattcttgaatgtttcaaatgcttttggtcgcctgaaattatagcgcataagtgcaaacaacaaggttttagcgtatgttgtgcatctatataccgggcattaaaggaaaacaggcttcaaggtttgtcaaggaaaactgctctgcgacgtcacggaaaaaagtatatcggcaatcgcaagaaatgcaatacaattcacccggttcacactattcacgacagaccggcaattgtagaaacaaaatcccgtataggcgattttgaaggcgatacggtttatggcggtatcggtaaaggttgcgctgttacttttgttgaccgaaaaagtaagctacttgttggttcaatagcaatcagtcgagaaagaaatacaatcagaaaagctatctccagagcttttgaacttatggaagttcctatgccgattgaaacaatcacgttggataacggttctgaatttgctgattttctcaatatcgaaaaagatttaggcacaacaatctattttgctgatttgcactctccttggcaacgaggtttaaacgaaaatacaaatgatcttttacgtttcttctatcctaagggcactgattttttaagtgtttccgaaaaagaattccaaaaagttattcatttaatcaatagtcgtcctcgtaaatgtcttggctatctttcccctctcgaatttttgtctaaaaagtgttgcacttgacttgacactctaccctgctccccatccgcaccatcattgagattttccgcactatcccacgaaaaccgccaacaccctttccttaaaatgaacgctctgtttgttttgcatccctgcgattgtggtcgcaaagccaacaaagcattcttgtagggatagagaaccggcatttttgaaaaaacagactttttctacaaactaaagcggtcacggcggcaagctgtgaccgcttttgcataatatcaaaattcgatattgaagggcttactatggaacgcagtcatatagacgtgagatttgcttatgaatatggcgataaatcgcttccgaaaataaaagagcttgtttgcgaaaaaccggacagccaaaagaaaataataccggaatatctgagagagcattgtgtaatctgctgtcccggtacagagcgtgacattataaatcccgacgaaattatcggttacggaaacatctattcggatgggctgtactactggactgatgtttttataaattatgtagacaaatacaatgttcctgttccggctgaattcagaaagcgtataatgagcaattacgagtcaagacgtaaacgtcatatgttactcagaatggtgaaccgtctcgaaatatacaatgaggcggcttatgacaaacggtacagagtgtgtattcacagaaacggccttattgaatacagagatttgttccaaagcaatgatgacattctgtttcggataaataaagaaacggcaggtcatattattaacccggcggcttctgaattgttttgctatgattccgataatcacggtaaagcacttattgacggataccactggaaactgacttttatgcaaaacgaaagaatcattgatataatcgagggaacaaacggagaggataaccggagatataatcaaataaagtcggtaatagaatttgcggaacggtttattccatatgacttaggttcagcttatatgtgtataaattaaaagcactttagacttcataatatatcaacaaagttcggtaagcatccggcaatcactctcactatagttgaaatcttctcaacaaacgagctatagacaaatctgctgaaatcgaatattattatagcaggagctccaaatgaacagtacggaggaaaacactatgctaaatctagggcttaaacttggcgaaaacctaaagaaattccgattacagcgtgagcttacacaggaacagcttgctgatgttctaggtgtgtcggcacaggcagtgagccgctgggagaacggaacgacttatcccgatataacgctattgccgactattgtgagctactttgaaattactcttgacgagcttatgggaatggagaattggaggagcgaggaacagctaaaagaattgctcggacagcttgaagagaatggctcaaagggcttgatctatgagaatattctgctactgcgtgatgcggtaaaaacctatcctacaaattatgagcttcaattcaggcttgtcaatcaactggcattctgtgaatacaaagacggtcggggattgtccgaagaagaaaaaatcagcttcaatcgtgaggctgccgaaataggaaatcgtattttatcgcattgcacagacggtgcgattattaaccaaacaactcagcagctttgctatatctattcaagtctcggagaaaaggaaaaggcgattgaatacgctaagaagcttccaaatataggatgtaccgatacagtagttctcggggatttatatgagggagaacagcagaaaacacatctgaaacgtgcaataaagtggtatacaagtatattttggtgtgcgttaataaatctggctgacctcggatacaggaatgaaactatgtccgatgcggaaagaatagaaataatgaaaaaggcgcttgctattcttgaacttgtatttgatgacggcgattatcttaattacagcggtacagtgtcaattacgcataggtatattgctgatctggctatgtctgagggcgattatgagctcgcattatcaagtcttgaaaaagcggctcaatttgctgtaatgtcagatacgctacccgaaaatgcacggcacacatctctgcttgtaaataatctcgaatatggtccgttcaatactatcaagaattacgatttcacggactgcaaggaattgtacgataaaatgcaggcggacagatataacgctatccgtgatgacaagcggtttagtgccgttcttgagaaaatcggcagatattgttgacagtccgaacaaagaagtaaaatataacgggtatcggcattttaccgatacccgttttctatgcctattgcctgtcaatcctcacatcataccgcctgagccaatattctatctgcaagaggtaggcgaaaatctgcggcgaggtcataagctgaccgtaccagttgccctcaaacagtgtcggatcgtcgcaccgaatatagcccttctcacaaccattgtaaaaggacaataatccctcgccccgcaccaaccctcccaaaaccgcactatcccttgctttgcaccatcacacttgcctcccttgtcaaagggaggtggatttacggcaaggcacaagccttgatattattgctttctgcttgcaatatgccaaccgtttttatgttgcaaacttttttgccgtcaagacggagggattgctttacacccaccaacctctccattcccacaaccctctcaaaaagcacatcaaccgcctcgcctcgcactatcacccttgcctttaaatgaacgctctgtttgttttgcttccctgcaattgtggtcgcaaagccaacaaagcattcttatagtgatatggaatccactctattttataaaaaacagacttctaactcactacccctatccccctgccccctttccccaggaaagggggattttactggggctaccgcccctagaccctgtcaggggctacgcccctgcgaccccattttcaaaaaccggcacggatgccgagcgtgtatgcccaaaggctctgcacgatgcagagccagcaaagcatacacagcccttcaccacggggaaggggtttggggattcggcaaggatgccgagatagaacgcccaaaggctttgcaaggacgcaaagcccacaaagcgttcttaaagggattagagaatttgcactgtcttataaaaacagactttttctacaagctgaagccacagtaaataactgtgacttttattatttacgttaatactcaagcggttcaagctttgtgagatcgaacggggtttcctgatatacgcagaagttgagccagtttgaatacataaggcttgcgtgaccacgccaagtaaaatgcggcgtcagcttagggttatcatctgggaaatagttatacggcacttctatcggtatgcccttttccacgtcacgcatatactcatccttgagcgtgttcctgtcgtactcggcgtgacctgtgataaaaatctgtctgttcgtgcggtctgcaacgatatatgctcctgcaatgtccgaataggcaagcagtgcaagattaggattggtttcaatatcttccatctttacacccgtataacgtgaatggggtaccataaaaatatcgtcaaaacccttgagaagcgggtggttgattgcatttatcttatgggggaagatgccgaacatcttcttgtcaagcacctgcttctgaataccgtaatgatagtacagccctgcaaatgccgcccagcagatatgcaccgtgctgaatgcgtgagttttactccactccattatatcgcacagctccttccagtaatggacggagttgaagtcgagcaattcaacgggcgcacccgttataataagtgcgtcaaaatactgctcctttatctgattgaaggtagtgtagaagttcacaagatgctcctgagaggtgtttttcggattgtgggtttccgttttcacaagagtaatatccacctgcaagggagtgttactgagcagccttaaaagctgtgtttcggtaactatctttgtaggcataaggtttactatagcgaccttgagcggtcttatgtcctgtcgtgatgctttttcatcagccataacgaaaatgttctcgttgacaagcgtgctgaaagccggcagattattcggtattttaatcggcatttacatcatccttttcatttcgtcataatatttgattataccacacgaaacgtataaatgcaagcaaaacagataatatcaccgaatttgcgtgattattccgataactcccgataaatcgtcgcaacttgcaaaaaccttttcggtaatttccgacggcacatctactatatcctttatgaacaccgtccgtatacctgacgctatgcctgccctgaggccgtttgaactgtcctcgacaataagacattccgacttgtcaaagcccgtcttttcggcggctgttataaatatttccgggtcgggttttcctcttgttatctcatcgccgccgactattccgtcaaaatatccgagtatgcccgaatgctcaagttccttagccgcagaagcgtgatatgtagaggtggcaacgtacattccgactttatttgctttaagatatgtgcaaagctcatcaaagccttgctttacgggtatgccgttcttatcttcgtattctgcaaaatactgctttgcgtatccccagtatttatcaaatgggtaatcctcgccaagctcggaaagaaagagggtcttcatcgaatcataattcagtccgatagaacggtacggaagcgaaaggtcaaacggcaggctgtacttatcaatcacatactgccacgccttaagccctatcctttcgctgtcaagcagtgtaccgtccatatcgaatattaccgctttaatcatttattcaccgctactacggcactgcatccgtcaagatgaacactgcccgataaatctatcttctttcctgtaagcacatctgtgaattcaccggaaataccgggattgaaatcaaacggattatcgtctatattaagaagcgttacaactgtttcgccgtcacagtcacgtctgaacgagaactgtctgtttaaaagctgtaaaggcgtataatcgccgtgagcaagcgcctttgaggaggtacgcagattacacagcgcagtgatctcggctgtgagatcggctataccctcagccctgaacttttcctcgttatattcgacacgcagagcgtcatcgccgttgtgcttgtcgccctctatgccgtactcactgccgtaataaacgccgggtatgccgggcattgtgaacaggagaggataaatcacgggaagctggcgcttattgttaagcattgtggctattcgtgaaacatcgtgattgtcaacaaagctgtaaaggagctttcctgtataaagacaccactgctcttttccgaactggcggttgagcgaatgcgcaatctcgaacatattaaggtcgttgaagctggagaacaagcccttatagcattcataattggtcacgctgtcaagcatttcgggattcatccagcggttgtaatcgccgtggagcgtttcgcccatcagccagaaatcgtttttcagccacttgcaatggccgtgcaattccttcaggaaattaaggtcgaggcagtacgcaacatcaaggcgaagtccgtcaatgtcgaactcctttacccaccctgtgatgacctcctttaagtattcctttactgcggggttgtacagatttagctttacaagctcgtaatgtccttcccagccctcgtaccagaagccgtcattatagcaggaatttccgtcattgatatgaaaccagtcacgataaccgttgttgccgtttctgacctcaacgaattttgtgaaatctctgccgacgtggttgaacacgccgtcaagtattaccttgatgccgttttcgtgcagctttttgcaaagtgcggcaaaatcagcgtttgtgccgagtctgctgtctatttttgtatagtcaacggtatcatatccgtgcgctaccgactggaacacaggtccgaaatatatagcgttgaaacccatttcctttatatgaggaatagcgtcctctatctttttaagtctgttttcggtgttctccgaataatcgtttgtcttgggacaaccgcagaatcctaaaggataaatgtgatataccgcaaagtttgtgaaatcgctcattttgaaatctcccttatttattttacaaatccgtaatggcataaagctccgccgccgaatcgaaaaccggtttatccgaaacgaacagagcaatattatgctcctgcgcttttagcaaagcgtcggcatccggttttaccttttcgcaaagcacaacacaggacgcacccgtgtgtgccgctacggctattgtgtttacgtttcctataacggtaaaccaagcacagccgtcaaggtctttggtcattgcaaggcttaacaggtcgcacgaaaacacattatttataacactgtcttcgttaccgctgttaagcactccgaacaatccttttcttataagctgtccgaccgtcatttgtgaaacctgcctttaccgattgttgcgattcatgccgtgttatatgcaatatgcacaaatccattagatattataccacattttgcgacctgtgtaaagttgaaaaacaggtgttgaatttgtagaaaatgacggtttttaggtaaaaattgagtaaatttatccgatataaaaataccgattagtgcaacatacacaaagagttgtgcaaattttggttactaatatatagtgaaatttacatagcaaatatgttataattatcatattcccgtgagtctgcaagaattgcgggtcaaatccaaggaggttatataatgggttccaaagaaaaaaataccgtaccgttcaacggcacgcccgaacaagaaaaggcactgcgtgaaatgatcggtaatcacaaaggtcagcagggcgcacttatgcctgtactgcaacaggctcaggaaatctacggctatcttcctattgaggttcagtcaataatagccgaagaaatgggaataccgcttgaaaaggtatatggtgtttctacattctactcgcagttctcactttatcccaagggtaagtacaaaatctcggtatgtctgggtacagcctgctatgttaaaggctccggcgacatattcgcaaagctctccgaaaagctcggaatttcagatggaaaatgcacacaggacggcatattctcacttgacgcatgtcgttgcataggagcgtgcggacttgctcccgtaatgacagtaaacgacgatgtatacggaaagctgaccgttgacgaaatcgacggtattctggctaaatatacagaataatgtttccggaaatttctcttaacattccctagtccctttggttgtctcccgcgtgaatagcagcaacgttattaaatggaatagcgaacccgagaagtgctatctcgcaaaaagaactatcggtagcttgctatcatagtcagagccgaacgatgcaacaagaagcacatcaatcaaaagactttttatataaaacatcgaccccgacagaaaactctgtcggggtcgcttgttcgtttatttacccgagaatcttatctcatttataagcgccgtaccgttcttctccttaagaagccagtagaaatccttcgtcagctcaaattccttatcaggcaccgtagtttgcggataggaaactaccttgttttcccctccctcaaagtcaaacgcctgaattgccgaatttcctgccgataccgtaaacagtacggagcatcccttgtcaagtgccaccgtcagcagtccgcttgccgtttccgaccagccctttgtcttgcactttaccataaccgccccaccatatccggaggtaactattccgtctgtagcacccgaaatatcgatcgtttcaccgaatattccggttcttatgtctaagctgcagtcaacgatcgaaaggtcgttgctgtatatgccggttgacgattctatgttcgttcccgcaagccctgttgttgttatactgcatctgtcgaagcggattgtttctgcatgtacgccgtaatattcagctgctgcggtaaatatcatatcgctgaaatcaacactgccaatactctgtatagcgtatgtatttcccgttactgtgagattcgggctgtcgccgccgataaactccatactcataggagttacatcgtcgtagtcaaggtgtgcctgatctatcgcaagcaggttttctgtagtcgccgtgttacgtttagaaagcgtaacatttccgtttatgttcaccttaaggctgtttgagcttacaaacatcagatatgtgtcagctgaaccctgtccgtcgcctatacttccactgttgctgaaatcgtcgggcttcacgccgttcatatctcctgccgtaagcgtaagattttcaaaagtaatatccgaaacgctttgcttaatatacagcattatattctttccgacgcccgacagcttaagaccgtttccggtcactgtcagtataccggtagctgtatcatactcaaagccgcttgccttgccactgatgaacgtcttgctttcggtatctattatcgtgcttgcactgccgtttgaaactgtcagataaccgctcatatccttttcggctgtgaacgatacattcttcgacggcatcgtgaactttccgccttcaacagtcacatcgtccgttgtccactcaagataaccgtcggctttttcctttactgtgacctcagcgccgattttagccttttcccttgagctttcaacaccgtcaagcgagtagatgacataaacaggagtaatagtacccgtcagtgtcatatcggacttgatttcttttccgatgactgaatagccgttttcgccaagccagccgccgaacagacagccgtctgtatcaggagatgcctcaagcatatcagccgtgaacaccgttccgtagtcaaattcggctgttttatagctttcgtaaaccttgttggtatcaagatttacaagacggtaggttatcgtcatctttttcagcttgtatgttgctttgatctcggtctttataataccgtcgtcattgccgaacgtcgtcggtacagctttatcccagcctgcaaactcatagccctctgtacctgtcggcacaggaatatccgacagtgagattgcgtcgccgtatttacccgttatctcataacgcaccgtaccgtcatcaaactcaccgctcatagcatagaacaccacgctgtagattttgtcggtagctttccataccgccttcagcgtcatattgcccgttactctgaacgattcacccggcttcacatccgctgtgccgttaccgtcaaggtcaaatccgacaagctcataatcgttgtacttatcatcctttaaagcacctactgttgcacgatacagatagccgtactttacctttaccgtttcgttttccgtgccgttgtcatagtcaaacgttacatcaaactccttcggcgttctgttccaccttacaattacagtcttgtaggtcttgccgtcaatcgttgtgttttcttcgtttatcggctcttccttaagagtatatgtgtaatactcgtcatcatactgtgcaagcgcctcaacttcggcatcatactttttacaaagctcgtcatattcgggcctgtagccgtcaaactcggactttaccttgtgtgaaacctcagctccgttctcgttgtaaatataaacgtcatagtttatataacagcgtctgtcgttggtattccacttcatatagtaggtaccgggcttcttcacattatcgttactgccgattctgtttccgtctgcgtccacaaaatacgacagcagatattcggtagtatatgtgtcctcaggtgcgaatgcggaatatccgtaaagcgccgttgcaaaacggtaaccgtcctgtacaaccgtccttatcctgtcagtttctatttcagcgccgttttcatcggtatatctgaagccgccgccatcgtttgcgataagcgttatgtagtgatacagcttcgcaggaactatctcaaagtacacattgctttccggcattatgcttatatcgccgttgtaccttacagttttgcctgccgtataaccgcctaccgtaacatcgctctttataagcacatatgacggctcgtagaacgaatcctcgctgtccggcttcggactgtcgggaatgctgtttataagctgttccagctcctgcggtaaaggcttgccgtaaataacgtcaaactttctttcggtataatccgcaagtcttaccgttaccgtgtacagctttcgcttcattacaggcttcagcctcatatcgcccataacggttatcttttcatctggagcaagatccgccttgccgtcaccgtcaatatcccagccgataagttcgttttccttactgctgttgatgttgtcgataaatgtatccggcactctgaactcagtgccgtattcaacatatcttgcgcccgcataaccgctctcgttataaatatcgactatgcatcttcttacaagataatttgctttgagcataatgctgtaggccgtcgggtacagcttttcgtattctgccctgaacgactgcagatcttcttcactgccgtagttcaccgcaagcggcttagtcgtatcaagaccgtgtacactgccgctgtaactgctgtcatagtatctgtatgccagagcgtccttcatgtacatctggtatctcataccatccgctctgtcgataccgaagcttgcaaaatgagtaacactgttcacagactgtttatatctgtcgaacatttttatatcgtcaagataatctaccgcccacagttcgcttacccatctgtcattttcagtgtcaaagtattccaccgagtacagcttctgtgcggtgtatgtgttaagcgtgatggtcatatcattgctgagccagtagtacggctgtatctctgtatcaaacagcgacttatcatagatatagccgtttttatcgcagtaggtcgaaaccgcaagcgaatagccgcttacatatccgcccttgcttacagttaccgtatctacaatttccgtcctgccgtcagccgataccgcaaacttcagcgttgcggtcttatccttgtcttcaagagggaagtcaacccccttgcggtaataatatacaccaatgtcgccgatatgctttctgctgatataagtgcccttgtctgcgtcatagtacaggttttcggtgtcggatgtgaacagcagattctgtccgcccgtatagtaaaggcgcagcatacagctaagcaagccgcttgtatatctgctcggagcgtcgggagataccgtgagcgttatcttgccgtcgtcgctcttgctcaccttgaaatacttgctgtagcaggcagccttgaactcactgctgctcatctgccgtgttacaatatctcctgttgttatatcaagatatgtgccttgtgcagggataagtccgtctatctcgtagacattcgtatccgtttcccgcagtattatgtctgtattgccttcaagcgtcggcttatccgcatagatatatttgtcgcctacgctgaatatcgggaatttgaactgctttgcaagctccgcctttttcttaaacagcttgctttccgcaaatatcgagatttttatatacacgcccatttcgaagtatattccgccttgcagctcgtggtaagcacagcgtcagggaaagaacgattataccgcatgggacgaggcaggaaagatacagaacaatcttgtcaataccatactgtcggtcaactgccacacaatcattacactgcgtaccaagatgggctatgctatggaaatcaacgacaggggcaagaccgttcccgtcaagataggacttgcgccggtgcagcgtgataacaccgagtatgaatttgacatagcatttcagataaaccgtgagcatatcgcaagtctttcaaaagacacaacattcctcgataagtggtcgggtgttatcaccgaagatttaggtgctcagctcggcgcatggctcagcgagggtgcagagcccaacagatgtgaagaatgcggcgctgtcattatgccgacacctaagcatacggtagcggaaatggttgaaagctcggttgcaaaattcggcagaaagctgtgcatagcgtgtgcaaagaaggaggtcgaaaagcagaatgccgctaagaccgtatcagagtgagcttgtcgagcagacaaggcaggcgtggcgtgagggttatcacgctccctgcattgttctcgggtgcggcggcggtaagtcggtgatagtagcggagatagcacggcggactacattcaacgggaaaaaggtaatgtttcttgtacacaggcaggagcttgttcagcagataataaggacgttcatacgctggggcgttgatatgaactactgtgacgtgatgatggtgcagaccgcagcacggcggataaaaaaactgtcaaagcctgcgcttatcattacagacgaaaatcaccacagccttgcgctgtcgtacaagaaaatctatgacgctttccccgatgtgcttcgtgtgggggtaacagcaacgcctgtccgcctgaacggtgacggtctgggtgatgtcaacgacaagctgataatcgggccgtctaccaaatggcttattgatcacaactgccttgcgccgtatgactactatgcgccgtccgtagccgacttatcagggcttcatatcaaaatgggcgagtttgttacggcggacgttgaaaaggcaatgatcaaaaaggctgtattcggtgatgttatcggatactacagacagcttgcagacggtaagaaagccgtctgctactgctcaagcgttaagcactcgcttgctaccgccgaagcgttccgagaagcaggcataaacgccgtacacattgacggtacaactcccgatgcagagcgtaatcgtattatttcggatttcagagcaggacggataacgatactttgcaatgtcgatttaatatcggagggctttgacgttcccgactgcgaatgtgcgatattgctccgtcccactcaatctcttacgctgtacattcagcagtcaatgagatgtatgcgctatcgaccgggcaagcgcgcgataattcttgatcatgtcggcaattacgcacgcttcggaatgcccgatgatgaccgcctgtggtcgcttgaaaagcgcaagcgcaacataaagaaagaagctgcggagaatgccgaaaaggtgaaacagtgtcccgaatgttactatacattcggagcgccgtcgcccggtcagccctgtatctgccctcactgcggatatgttttcccggtaaagagccgtgagatagaaacaagcgaaagcaccgagcttattcatatcgagggcttcaggctggatttcagcagtcccgatgattgttcgtcctattccgatctgcttgcatacgcaaagaagaaagggtatcagaggggctgggcgttttacgaagcaagaaagagaggttttatctattgacagaagaacacagtatccagaatgctgtcagacgtgcgctgtccgagaacggttgtgtgatattccgcattaacgtcggcaagggcagaacatttgacggcagatatttcgacacgggcgtaccggtcggattttcagacctgttcggcgtaaggcagtcggacggaaaggcaatattcatagagataaagacaaaaacgggacgtattcgccccgaacagaagaattttattgaaaaaatgcgtcgttcgggtgctgttgcaggtatatgcagaagcacagaagacgcaataagacttataacggaggataaataatatggcattttcacagaacaattcagcggctacgagtgcactcaagcccgaaggcagatatgaaacgataatcacaagcgtagacgagaaaacatataagagcggaagtacatcgctgagcttcagactgacgataaggaatgatattccggagcagaaatacggcaacgcctgcttgttttatcagatatggaaggctaaagagcctacaaaggaagaccttgcggtaaacggttatacgttcggcagacttatggcagtaggcaaggccgcaaagctcactgacggcaaggaatacaaggatcttgcggaatactgcgacgatcttgtcggcaagtgtgtgatagctgtagtaaagcacgaaacggacgataagggcaccacaagagaaaaggtaagctatcttgaaccgacacagcaccccgactgcaagcataagttcaagaccgccgtgaccgtcgataccgtatcagcgccgaaaaatgagagctttgcggcaaccgcagcaacggaagcagttacggaagatgacggtgactatccgttctgatgggggaaataatgtacgaatatattcccgatgagcttaaaaagctctcaaactgggtgtgctggcaggctgtacccgatgaggcaggcggtaagataaaaaaacttccgatcaatcctcatacgggcgaacttgctcgctccaatgatccatccacatggtcggatttcaatacggctgtagcggcttcggcaggtttcgcaggcgtcggattcatgttcggaaactgcgagtatttcggtgttgacattgacggagtgggtgacgagatagccgcattcaaaaccggcgaaaacaacattatcaccgaatttataacaactctccagtcatataccgagctgtcgcagtctggcaaaggcattcacataatctgcaaaggaaacctgccgaagcaggggcgcagacgaggcaatgtcgaaatgtacgaaacaggcagatttttcgttatgacgggcaatccgtgcgccgaatatatggatataaacgaatgcacagaggctattaaggcgttgcacgaaaagtacataggcggagggcgtgagccttccgctgtgccccgtgcttatgcgccggcacttccggcaaccgcaaatgatattataactctcgccggaaaagcaaagaacgcaccacgcttcaatgcacttatgcagggcgattattcaggatatgtgtcacagtctgaggctgatatggcgctttgcaatatgcttgcgttctggtgcaggtgtgatgcggatatgatggactgtatatacagacagtcggggcttatgcgtgaaaaatgggacagacggcagtcgggcagtacctacggtgcaataacgatacaaaaagccatagccgactgtgagaaggtatacgaaccggcacagaaattgccgcagtttacggcaaggttcacaggtgaaagctctgttgtacacgcaaagctcgatacggcacaggacgagcctgtaaagctgtacacatttgacgatacagggaacgcagaacggcttatagacttattcggcagtgagatccgctacagttatacagacaagcgctggctgtattatgacggcaggaagtggtgctacgacaacagcggaacaatagagcgcatagccgataaggctgtacttgcgatgaaggcagaggctaaggcatatgagcagatggacgctgaggacggcggagatatggcaaagagctttgaaaaacacctgaaatcaagccgaagcaacaagtcaaaatcggcaatgcttaaagaagcacagcaccacgttccaatcgtgccggcacagatggataagtacaagatggtgcttaatactccgagcggcgttcttgacctgaaaagcggtacgctgagtgagcataagccggaagcatacttcacccgtatcacgtcggcagagtacacgagcaacgccgactgtccgcagtggctgaaatttcttgacgagatattcggcggcgacaaggaccttatacgatatgttcagaaggcggtcggctattcgctgacaggctcaacggcggagcagtgcgtattcttcttgttcggcacgggcagaaacggtaaatcaacgtttcttgatattatccgtgcaattatgggcgactacgcaagcaatatccagccggaaacaatacccctagaccctgtcgggggctacgcccctgcgaccccatttttatataatcaagaggtttatcgacagtctgaagctccctcactgtttgcgagggagccggactgtatatcacttacttcaggagaaatcttgttagttaaatcagaagattgcaacaactgcaccgttgtacttttcattgatgaagttctttacatcgtctgacttgagagcctttataagagcctgaatcttggggaggttttcgttaccgctctttacagctacaatgtttgcgtaggtctgagccgcatcgcccgaagcgtcttcaactgcgagagccttgcttatgtcaagacctgcggcaagagcatagttaccgttgatgactgctaaagaacctgcatcgctgtttgcaaactgagcggcaaccgtatcagcctgtaccgttgttatcttgtagccgtggtcattctttatgtcaagcgttgtaacgccgtccttggcatttgcaccctcgggaagctcgataagaccttcctgctgtaagagaagaagcgctcttgtttcgttgctgtcatcggcagggattataattgatgcgccttccttgacgtctgccagcttttcaacgccgttgccgtaaaggccgaacggctcatagtgaatgggcgcggcgggaactatgtctgttccgttcttctcgttgtagttgttgaggtagggtgtgtgctggtggtagtttgcatcaagctctccgcttgcaactgcgttgttgggcagtacataatcatcgtaaatggtaatctgaagatcgtagccttccttagcaagcttgtcttttacaaattcgagtatctcgccgtgaggtgtagctgttgcaccgatcttgataacgttgtctgtgtctgctgtgctttctgcggcgcttgatgctgcagaagatgtatctgccgaagaagcatcgtttgaagaagctgtcgagcttgtgccgtttgaactgcacgctgtgagcgttacacctgcaagagccgctgtaagtattaatgataaaatctttttcatgtcaattctccgtttctgcggttttaccgcctgtcaatgttgtattttgtttatcgtttatctttctttgttctgcaccgttagtttacgggttttatctctttatatacaacatcggcgcattcgtccgaaacggaaattctgtcgcaacagctttatgaaaagcagtgacatattatatctctccttacttgtttatacgtttgtctgccttgcgtgctatcagcataccaaactcctgaataagctgtactatgataaccgtgagcagaacgcatatccacacaatatcgttattgaaacgctgataaccgaatgagatagctatcataccaagtccgccgccgccgatcgttcctgccattgccgagtagccgagaatggttacaagtgaaatgactgcgccgaccatgagtgcgggctttgcttcggggataagcaccttgtatattatcttgagtgttgagctgcccattgcctgagccgcttcaacaacgcctttgtcaacctctttgaaagaggattctgtcattcttgccacataaggtatagccgctataacgagcattactatcatcgccttattgccaagacttgttccgacaataaactttgccgccggtaagcaggcaaccatcagaatgatgaacgggatactgcggaaaatattaactaaaataccgattattttgttgagccacgggatagggtggattccgtccttatcggtcactgtaagcagtacgcctatcggaagtccgaaaacgtaagctacgaatgacgagatgaacgttaagtatatcgtttcccatataccctgtaaaagtacgcctttatcccacagctgtataagatcgcctgacatttttcttcccccttacacctgtgaataggtaacgttgttggcactcagatatgctgttattttttctgccgatgtatcatcatcgggcagctgtaccagaatctgaccgtatgccttgccgtcaatgtcctttgtatctgcgtgaaggatattgacgggagtgctgcattttaatatcatatcggctaacagcgactttgaagaattttcaccgttgtagataatccttatcttctttccgtgttcgcttgttaccggaagctcgccctgcggcattatgagctttttggcaatatccgacttgggatttgcgaataccgttcttacatcgcctatctcagcgaccgtgctgttatcaagcactgcgaccctgtcgcatatactgtctattaccttcatctcgtgagttatcacaattatggtaactccgagtgtgcggttgattttcttaagaagctcaagcaccgaccttgttgtgtcggggtcaagtgcgcttgttgcctcgtcgcacagaagatagtgcgtttttgcggcgagcgctcttgctattgctactctctgcttctgtcctcccgaaagctgtgacggatacgcctttgctttatcggaaagtcctacaagctcgagcaggctttcggctctttttacggcgtctgcctttttcatacctgcgatttcaagcggatagcagatgttctttattacgtttcgctgtgcgagaagattaaagccctgaaacaccattccgatgttttgccttgttttaagaagctcttttgttttgaggcttccaagctccttgccgtctattattacctgtcccgaggttgggcactcaaggtaatttatacagcggacgagtgtgcttttgccggctcccgaaagtccgatgatgccgaatatctctccgtcgtttattgttatgttgatgtcttttatcgcagtaacgctgccttttgaggtgcggtacgtcttttcaaggtttttaagctctatcatatatcctcccataaaaataacggacgtttattttacgttcgtgcgtttgaatatccgacaggctcagactttctttcgggacagacgtattatattgtttgcacacattcgcattttattgtttgcggttgtcggtttcatccggtcagcccctttcgttttcgttgttatgagtataacacactaaacctatgttgtcaataggtttagtggatttagcttgtcgaaaataattacacaatccttatcgcttttgtaggttttgtataaacgaggctgaaataaataatgcgctgattattgacttttaagaagcgatgtgttataattgagtaaactcaaaattaaactgttgattataatgataagagtgataaggaggacacaaattgaagggattacagccaaagggcatagcaagacgaaacaagatgctgcttgcggctattcagctatttttagatcaggggtacgaaaagacgaccactgcacagatagcaagagcggcaggaatgtcaccgacatcgttctttgcggcatttgaaaataaggaagcgctgcttctgacgctgacgcagattatgtttgaaaatcagtttgcaaaggcgagggcatttgcaaaggatatggagccgctcatggtgtactgccttgaaacgtcattgcagatatatataaccgagctgtccgagccgctgagggagatatatgtaatggcgtataccttgccaagcactacggaatatatcttaaaaagtacggctgtgcagataaaggctatattctcgccgtttatgccggatgcggaggataaggatttctacgagatggatatagcgtcgggaagtataatgcgtggctttatggcgagaaagtgcgatatgtacttcacggtgcggaagaagatagagcgttttcttgagtgctgtcttaagctgtatgatgtgcctaaggaaaaacgtgcaagccttatagaagcagtacttgcgtttgatctgcactcggtagcaaaaagacttatagatgagataatcgcaaaagcggaaacggggcttgaaaaagcaatcgaaagttcaataaacgaaaaaagccaaaacggataattacggaggtgggttatgttcaaaaagatgaaaacaaggaaaaggctggcggcgttaataacgcttatcacgctgtttgcgttttcgagcgtgatgacggttatgacggcggcacaggaagcgtcgcttatatccgcaacgcttactacggacaaggagagttatgaagaaggagaaaacgttaatattgctcttacggtgaagaacggcaatatttacgggatcgataaggtaaaaagtgcttgttctcaatccctatccccaaacccctttccccgggaaaggggctatattactggggctaccgccccagaccaagcaaggatgcttgcagtcagccacacaaagccactgcacgatgcggtggcacaaatggctgacgacatgtacgggggctacacccctgcgaccccatttttatataatcaagaggtttatcgacagtctgtcggccctgccgttatagcagggctgttcctatttcagaacataatatcctgtattttctttctgcccatccactgtctgcttgttacctcataaccgagcttattgtaccacgctacacgctcgacatataaaagctgaatatccttgcagttcttttcataaagcgacagactgccctcggctgtcatagcaagccctattcctcgtctgcggtatttatgagtaacgccgacacagcctatcatactgtgcttttcattgtcggaaaagaacattccgccgtactcctcgaccatctcaaagcctgcaatctcgtcaccgcagacggcaagcaggacgggagcgtcactattctcctcgaataccggtaaccattctgcctgagcatcttttacggcggctaagagcttttctctgtcgttatcatctgcaaagcggtatgtaactccgttcgggcggggaatttctttcagcttttcaacagctttatcattaagctcaagccccatattgaccgatataaagtctgcactgtagcctcttttttcaaagaacggaacactgctctcttcgtcattgtcacacggcacaccctgtaacaagccgctcccgccgagaataacttcatcgtaatttgcggaaataaatccctctgccattataagcagatgttttccgtaaccgctgtgtctgtactcttttttcacgcacaggataactacggaattaccgttcactacgacaaaaccgataatcgttttgctgctttccgcagtgaatatctgtgagttatctttgtgcagaatatccctgaaacgctcatatgccagcggatagcggggcatcgcttcacagtaaatctcgtacagatcacggatcgtgtattctttgttcatggtatcacctcgccttttgtagtattttaacataaattccgctgtaaagcaaccctgccccggttgcaatcctccttcataaatgctataattaattatccataaaaaaacggacgaaaggactttatatgaatacattatttaaagggataaccgcaattcttccggacgaagaaagcggattttccgcaaaggtatgcgatattgcggtaagcgacagcgttatctcctatatcggtgacgatgcagtaaaaaacggctttgttccggacaggactattgacggcagggacaagctcattacagcagggcttgtaaacagccacacgcacagctatatgtcgctgttcaggaacagtgcggacgaccttatgttccacacctggctgttcgacaggataatgccgatggaggacaaactgaccgccgaggatatgtactacggcacacagcttgcctgccttgagatgataaagacgggtacaacggcttttctcgatatgaatatcgcccgtgactgcattacaagagcgataagcgaaagcggtctgaaagcgacaatatcaagaggtcttgtaggaaacggcagagatgacgagggcggaaagacaagaattgaggatacgctgtacgatatgcgtacctacggcgacaacaagcgtctaaaattcatgatgggccctcacgctatctatactaccgacaggggctatcttgagcttgtaatggagaaagccgcagaatacggcctcggcataaacattcacctttccgaatcggtgaaggaaattgaggacagcatagcgcagaacggctgttcgcctgtcaagtatcttgatgatatgggaatgttcaagttccatacggttgccgctcactgcgtacagctatccgacgaggatattgatattctcgctgaaagaggcgtatatgccgctaccaatcctatcagcaatgcaaagctcggaaacggctttgcaagaataccagatatgctcgacaagggtgtaaagctgtgtatcggcactgacagcgcaggaagcaacaatacgctgaatatgttcagcgatatgaactttatctgccttgcgcacaagggcaactgccgcagtgctacagcggtttctgcacgtcaggcgctgaaaatggctaccgaaacgggcgcaaaggctttaggctttgacaacacgggaatacttaaagaagactatgcggctgaccttaccgtaatggatatgaaatatccctcgctccagcctgtaaacgatcctgttgcggctatgtgctacagtgcgagcggatatgaggtcgaaagcgttatggttgacggtgagttcttaatggaaaaccgtgagataaagggaatggacgaggaacgcatttactttgaatgcaataaagcgatgaaaagaatagacggttaacggaaaggaaaacgaaatgagcattataagagatgagagcctgtgggaaagcggcgaaacaaagataaactgggtaaaggcgaatatgccgttactgcgtggaattgaagaagaatttgcggtatcaaagccgtttgcgggactgaaagtagcgctttcggtacaccttgaagctaaaacggcttacctttgccgtgtaatggcggcaggcggcgcagagatgtatatcacgggcagtaacccactgtcaacgcaggacgatgttgcggcggcgcttgtacacagcggacttaacgtatttgcatggcacggtgctactgcggaggaatatcacgcacatacggcggaggttatcaagattgctcccaatgtcatcattgatgacggcggcgaccttgtaaaccttatccacaacgaatatcccgaccttatcccgaacgttatcggcggctgtgaagaaaccacaacgggaattatccgccttgtagctatggataaggctaaacagctcaagttcccgatgatgcttgtaaatgacgcagactgcaagcatctgttcgataaccgctacggcacgggtcagtcggtttgggacggcataaaccgcacaacgaatctgattgttgcgggaaagaacgttgtagtagcaggctacggctggtgcggcaagggcgttgctatgagggctaagggacttggcgcatcggtaatagtaaccgagataaatccgataaaggcgatggaagccgttatggacggatttaaggttatgccgatggttgaggcggctaagataggcgatttctttgtaacggtaacaggctgtaacgatgttatcggagaaaaggcattccttaatatgaaggacggggctatcctttctaacgcaggtcactttgacgttgaggtaaacgttgcgaagctgaaggaaatggctgtagaaacaggcgttgcaagaaacaacattcagtactacaagctggcaaacggcaacaggataaatgttatcgcagagggcagacttgtaaaccttgccgcaggcgacggtcacccggcagaaataatggatatgagctttgctatacaggctctgtcagccgcatatcttgtcaagaacaaggacaagctgaaagccagcgaaaagatgacggtaaacgttcctgccgaggttgacaaggaggttgccgagagaaagctcaaatactggggcattacaattgataagctgactgaggaacaggaaaagtatcttggcagctgggaagtgtaaaatgtaaatcaaaatacaaaaagctaccgcaatgaactttacggtagcttcagactgtcgataaacctatataatttttgaaaattggtgtttagcgttgcttgctatgttggttttgcatcgtgcaaaacttttggcaagcaaccaaagcgtccttgctttgggtgtagccccaatgcgggttgtcagtcgttggtgtcgctgcgtcgtgcagcgactatgtgcgactgacttcaagcgtccttgcttggtgagggcggcagccccacactcagccccttcccgaggggaaggggcttggggtttcggcaaggatgccgggatagaacgcccaaaggctttgcaggacgcaaagcccacaaagcgttcttatagggatagagaatttgctctattttacatttaaacgacagagctcactctaaaaacatatgttttttgccagaccactttgctccagaatcatttctatttgctatgatttacgaattatctactaaacctatggagcatatgtcattttggcgtggacttgattctaatgaagcgacagcattatatacctcagagaaaattcttgctatgttttcgggattgatagatgaatataataatgatgacttaaaaaagatatttacagattctcttgataatggagtgtggcagttcattaataaatccgacttggtaacctattattactctgattataaaacggtagaagaactactatcgtttttagaaaaggttaagattgcatatgatatggcattaccaataacattatcaaataagtatagctaagtaatatcgtaggatttaataattataatgattttggcaacagaatggcaacaaaaaatcggatagcgtatgctttaccgataattcaaataatataaatactctctgataaatctcataaacaaaagtgtttaagattggtttacagagagcgagttgcaataacctccacccccgaaaccgttttacatcacggtttcgggggtttgttgtatggccggcacagaaacggcatctctttttccgcctcccccactccaaaaccgccggctgttcgccctatatttcgcagtatcgaaaaacatcacagttatgcagtttataaattgacatacaggctcggatatagtataattatactgattagggtctgcctcaaatcaggcagacgaaaaatcacagatactaaaagctgcaaaagaaaggacgatacagttgatattcgccgatttattttttctgtacttctttatggctctgtgctttatagcatatttcatctgccgtaaaacagtatatcgaaactgggtgcttatcgtattctcaatgatattctacgcatggggcgagccggtgtgggtattcctgcttataggaagcgttaccgtaaactatgtcggcggacttctgatagataagttccgtgacactaaaaaagctacgatagtgaccgcctgtacgcttgtgttcgatataggacttcttgtgttcttcaagtatacaggcttccttgtcgaaaacttcaatgcaataagccctgtggatttgcccgttccgcatattgaaatgccgataggcatcagcttcttcacattccagattatctcttatatcctcgactgctactggggcaagataaaggtgcagagaagctggtacaaactgcttatgtacatttcgatgttcccgcagctcgttgcaggtcccattgtccgctatgccgtaatcgaaaacgagatagacaacagagttataacctctgccgatgtaagcgagggtattacacgaatctgcatgggtcttggtaaaaaggtaatccttgcaaacaacctcagcactatcgttgatacgttcttcaagaccggcgatcttgcgtctttgtccgttgtcggaacgtggtacacggtaatagtctacgctatgcaggtttacttcgacttctccggatattccgatatagccataggtcttggacgtatattcggtttccactttgacgaaaacttccgttatccgtttgtcagcaagaatatcactgagttctggcagagatggcacatctcgcttggcacattcttccgtgactacctgctgtatgttcctatcttcggtaagagaagaaaatacctcaacctctttctcgtatggttctgcacaggcttctggcacggtgcaaactggaactatataatctggggtctttacttcggactgttcattctgatagaacgtaccataggcaacaagaatatgagaaagatgcctaaggctgttgctcatatttacaatacgatagtagttgttgtcggcttcggtatattctactttaccgatttaggcaagctcggcacgttcctcggaaaccttgtcggacttaacggcaactcgttcacagacaagatttcgatgcagaatatgacagctaacgcttggcttttcatcgtcagcgtagtgctgtgtatgcctgttatccccgcactcaagaaaaaattagaaagcaaaaatctttaccttgcaacctctgtaggtcagacggtgcttaatgttgcggtatttgcactgagcagtatcctgcttgtaaacgccaccaacaacccgtttatctactggcagttctgagaaaggagtgagtaacattgtcagaccatattgatgataaggagcttgaggagcttaacgagatataccgtcggaagatggaatcccagaaaagccacgagcctaagaaagcaaaacacgaaaagcctgtcagagccgcaaaaagcgaagatactcattccgtaaaagccccgaaaggcaaaaaatcctcagaaagcacaaagcagatcagagtaaagcccgaaaaacaggacaaggaagataagacacagcccgaaagcagttccgattccgagcgtaaaaagaagcttgcagtcagaataaacatcggtgtatgcgccgccttctttgcggctgtggcaatcggtctgcttgtattgccgcgccctaccatatccgaagccgaaaagcgtaaccttgccaccttccctgagtttacatgggacgcttactggagcggtaaatacacagaggatataagctatttcttcaatgataccgtaccgttcagggataccttcaaatctatcggcgcaggcttccgctcgcttttcggattctcgctgaacggcgcagagattaaaggcaatgtcacacaggtaaacagcggttcatctcagaccgaggttacaactgcgtcaacaaagcctatcgctatcgttacccctgcaccgtcggacacttcaagtgacgctccctcaagcacccccgaaaccgaaagcaagaatgattcttcttcaggaaatcagcaaagcgaaaccggttcaaagtccgatgaaagcagtagttcgcctaagcccgaaaacacatatacagagccctccgacccgaatgcacaggtgcttttcgaagaaagctcacagcttgtttatcaaagcggcgacaccatatacggtgcacagatttacagtggcaaacgtgaaaatgcggaggactatgccaacacggtaaattcgcttgcaaaagcacttcccgatgcaaacgtctacagcctgctcgctttgacgcagaatacattcataaccccatctcagcttcagaaggctcagtataccgagcttagcgactccgtatatatttcaaatatgctgagcaaggacgtcaaggtcataaacgctatggatgctcttttgcctcaccagaaggagaatattttcttcctgcgtgactgccactggcagcagctcggcgcatattatgttgctcagagctttgccaaagccgcagatgtaaaattcgcaaagctgtccgattacgataaatacgagaaggattgcttaggctccgtatatgccgcaacaaattatgacggacttatgtacgagggcgaaacattcacttattatgtgcccaagaacgactttaccaccgagtattacaatgcagattatgagtatcagttcgaatatccgctgatgcccgcctccgactacagcgcaagctcgttctacagtctttatatggttgccgacagctatataaagcatatcaccaccgatgtaaagaacgacagagttcttgttgtgcttaaagacgattaccccagcgcaatgataccctgcctcacgtcatcgttcagtgaaatatatgtcatagatgtgcgctattgcaacttcaacgttgcttccttctgcgttgaacacggagccaccgatgttcttgtcggtatgacgcctgaaaacgcactcggagaaataggcgatacactgtcatatctgctgaatatctgatttataaatcagcctgtagataaatctatacaattttaaaatggggtttggggcgaagccccaagcggggtgagggcggcagccccacactcagccctggcacggacgccgggcgtgtatgcccaaaggatctgcacgatgcagagccaaccaagcatacacagcctttatcgagcttatcaactcggtagccgacaaggaaagcgttattgagctttacaaacagttcggtacatctgcggttaccgcaataggaagccttaactggagaacagcaggctttgttgctacaaacaacggtgcaaagctgacagcagacgacagtgcaaagattgcacgtttcgttactctttgtgacgcttattcaatccccgttgttacattcgttgacagcgaaggctttgagaagtcaagtgcggctgagcttgcaggaagcatccgtgacagtgcaaagctcgcacaggcatacgcttccgctacaacagcaaagattgcagttgtaacaggcaaggcttacggcagtgcttatgttgcactcgcaagcacagcggcaggaagcgacttcacattcgcatgggaaggtgcggttatcgctcccacaactcccgaagcggcagttgtattcttaaacggtgtttcggaagacaatgcaaagcaggctcaggaatatgcagacaacgaagcagacgcattcacagctgcagctaacggctacgttgacagagttatcacagccgaggatactaaatccgcactgacatctgcaattgaagcaacatcttcaaagagagttgttactcctgctaaaaagcacgttaacttcgtatattaatcgacataagaaaggatttttgttatgaaaagatacaatatcacagtaaacggtaccgcttatgatgtaaccgttgaagaaacagacggcagtgcagcacctgttgccgcacccgcagcagctcccgctcccaagaaggcagcagctcccgctgctcccgcaggcgcacagggcggcgttaagattaacgctcctatgcccggtactatcgtagacgttaagctcgcagtaggcgctaaggttacaaacggtacagtaatcgcagttctcgaagctatgaagatggaaaacgacgttgtagcaagctgtgacggtacaattgcaagcatcaatgttacaaagggtcagtctgttgaaacaggcacactgattgcaacaatcaatgcgtaactcttgattgaaaggaataataaaggttatggcaaaagtaggaattaccgaaaccgtactgcgtgacgctcatcagtcgcttatcgcaaccagaatgactacagaggaaatgctccctatcctttccacaatggacaaggtaggctatcattcggttgaatgctggggcggtgctacatttgacgcatgcttacgtttcttgaacgaagacccctgggacagactgcgtatattaagacgtgaaatgcctcacacaaagttacagatgcttttcagaggacagaatatgctcggttaccgtcactatgctgacgatgtactggaatatttcgttcagaagtctgtagcaaacggtattgatataatcagaattttcgatgcgctcaacgatataagaaacctcgaaacagccgttaaggctgcaaagaaggagggcgcacacgctcagatagctatctcttacacactcggtgaagtatttacagaacagtattacatcgactacgcaaagagaattgaagaagcaggcgctgattctatctgcatcaaggatatggcggctctgcttactccttatgaaacagaaagacttgtaaaggcgctcaagagtgctgttaatatcccgatccagcttcacacacactacacatcaggacttgcttcaatgtgtctgttaaagggtatcgaatcgggcgttgacgttatcgacacagcaatgtcacccttagcgctcggcacatcgcacgctcccacagagtcaatggttgccgcattacagggtacagagtatgatacaggacttgacttaaagctcctcacagagataagagaatactttatgacgctccgcaagaagtacatcgacagcggtctgctcgatcccaagctccttgcagttgacgctaatgctcttatatatcaggttcccggcggtatgctttcaaacctcctttctcagcttaagcaggcaggcaagtctgacaagttcgaggaggttcttaaggaagttccccgtgtaagagcagacgcaggcttccctccccttgttacacctacatcacagattgttggtacacaggctgtattcaatgtaattctcggtgagcgttacaagactgtaacaaaggaattcaagggtcttgtaaagggcagctacggtaagacacccgctcccattgaccccgagttcagaaagaagattctcggtgacgaacagcctatcgactgccgtcccgcagaccttatcgagcctgagcttgaaaagctgaaggctgaatgcgctaagtggtcacagcaggacgaggacgtattaagctacgctatgttcggtcaggtagctgaaaagttctttgaaaagcgtaaggacaaacagcttggcattgatgctgaacacgctgataaagctaacaaggtaatgcccgtataatttaatttaactgcggcaggttgaaatacacctgccgtttttaataatctgaaaaggacggaaatatgaacagacgcagacgcacagacgaacccgtaaagaatatacacaaagaaaccgaatatcacactgtagtaaccgatgacggaacgcaggacgagggctttaactgcaaagcctgcggaaaattcattacgctcagggattgcggaacaaacaaccgtaatcactgccctcactgcttatcaagcatacatcttgacaacatacccggcgaccgctcagccgattgcggagggataatggagcctatcagcatttatgtccgtcccgacggtgaatgggcgctgatacaccgctgtaagaaatgcggagagcttaaaataaacaggatagccgcagacgataacgaatatctgctgttatcgcttgcctgcaagccgcttgcaaatccgcctttcccgctcagtgctttatcaacacctttcggcaaagaagacaaataagcatacagacaccaaaacgagccgttgcacaaataaagtgcaacggctcaattttattcacggcattggctcaatcaagaacagcgcctccccattcaataaccgtaaagcctttacgaacgattggcgtaatttcgggcggcattatttcatcaccgctgtattcggcaaagccgaaccatatacggtatatgctgtcaggctttaccgagaaagtcagcggcatctgcgtttgttctgtggtatactgtcacattaccatttgtatcaacctttgcatttttgtcataaatgctcaataattctaataaatcttcgtttactttgataccttgttttattttgtatccgtaaatatcattaatatttttgacatatctgtcggtttcggggatagatttttttctattttccttgacagtttcgggaatttgtgatatattgttattagaagcagatttgtttaccgtatctacgcttaattgcggtgcggtcattgaaggcaagtctgcttcttttattattgttacttcgtgtaaatagaatttactatttttttcgtagcaggataagattttactataacgcccataatagcgtctgcattatctatttttcctcttgccgctattatatatctatccacacttgttttctcgtagttaggcgtgtatgttataatatttccgttttctattactgctttaatcgctttaactgctgacaacttagttttgccatatccatgagcaattgtgctttttgcccctgatttgaccaattctattaagccaaaatcgttcctataagcaatgtttttttgttcgtcaaacacacttaaaacataatcagatttgtgtttataggtttcgactgccgaatcatattcaacatcaaatacctcttcttttgagattttatctatgttgtctttaatagcaccaacaacaacctttgtttccagcttttcaccaatagacattttcacaccgctactctctgtatcggtgttttcttttgcgttcgagatctcagcatgattattaaccgacgccttcaagttctgtgccgatgataaattcttttgcgtcactttttttggcatagttcattatgcccgttgtactgcctgcatagtcagcaagagctgttaccgccggagcgcattcgggatgaacaagaagaagtgcgtcagggtgctgtgcctttgctttttcaacgtcctttacggtcatacgcagatgggtaggacagccgccgctcaccagcttgaatgtcttgtcggggcattgcttctgaacataatcgccaaggttgcaatcgggtatgaaaagtatcttgtcgctgtccagctttttcactatctttactgcacttgacgaggtcacgcatacatcgcataccgttttaagctccgaggtcgtattgatataagccacgaccttatagtcagggtacatctccttaagctgcaggataaggtccttatccatctgctcagccataggacagcctgcattgctgtctgaaagtaaaaccttcttttgaggtgaaagtatctttaccgtttcagccataaagcgtactccgcacataagaacagtgctttgaggcgcttttgccgtcatctgactcaatgcaaacgaatcaccgacaaaatcggctatatccagtatatcctgtctttgatatgcgtgagccagtatgcagatgtctttttctttctttattctcaggatttcatcctgcatttctctaactgtcattgcttgtccctttcttaaaaccggcgggttgatttatttgcacaagattattataccgttttttacggttatcgtcaagtgaaaagccacgaacggcaataaaagtatgcagaaattcacagcacgacactcctgtgacctttaaaatccgtttcggcaattctgcgtgatataattattcgcagagccgtttacagccctgcgaatatatcggcttacctgcggcaaaaaccgcatattaaagctgctgtattgcgaggatcgagctgttgtagcttgatttcagctcgtccagcatttccggagtggtttcgtccgttttctgccgcagagcctcagtgaccttatatgcggctttgtagagattttcaagcccgagattaaggcagatacctttaagcgtatgtgccgcacgaaaagccgtttcatagtcattgttttcaagtgcggcgaaaatatccctgtagcttgtgtcctttgtgaacttgttgagatattttgttatcatcttgtcgtcaaccagccttgcaagaacgtccgaataacttcctccaagcgccctgtaacattcttcgagagtcattttccctcctttgaagcgttcttatctaaatacataagtctgtctgcttctgtcaatgcgttttctatcggttggattccgtacacaccgccgatagcggcggcacatttaatatcagggtaatcaggcagctttatttccgagattctttgctttatctccgtaattttctgataaaacacaatttcaggaatattagccatgagaagcacaaactcatcgccgccaagccttataagaatatcactgcttcttatacattcctttatgctttcgcataccgccttcagcaagcaatctcctgcggcgtgtccgtaatgatcgtttatgcccttgaaattgttagcgtcaagcattgccacagcgtctatataacgcatggacttagcctgttcttcgtaataacggcggttgtaagcgcctgtcagcgcatcgtgatacagctgtctgttatagtttacgatattgtccataaaatcggttttaccgtaagcgccgagcagaacaccgtcattatccttgtatatcatctcaagcacatacggctttccgctgatttcaacatattttgaaattatctggaatatgctgtcgtcggcaaattccagcttgctgacctgcccatgcttttcaaaagcctttgacgatacgcagttcttgcaacgctgtgtcttgccccatatcgcatagcatttatccccacggcaagcgtttattatttcttcgttgccgggcttacagccgcttctgatgatttcgttgtcggttatatcaaccagtcttaccacatcgaatacctgagtcagcttgcttatcgtttgccttatttctgcgtcgtcgttttctgaaatgcggtattcgggacgaacaatagcaagctcgctgtcatttatatcaattattctgccgagtatacccgtatatttcggcttttcctcgttgctccacagcgtccttatccttatttcgtaccagcggcgtggcccgtttagcgaaatctgcttctttatttttacgacaggcttttctaaagaagcctcgctttgcatagcatccagtatattctgtatattctgtgcgccgagataaccctgcttaagacctctcggatgcatagtcagctcctgaagtcccagtaccttagcgccgtatttggtcaatcgcagtacatcaagtattgcgtcatactcaaactgtatttctcccaagccgtcagagaagaaattccagcgatctcttgcggcgataggcaggtgagcggagaagtcgattttgtccgaagaaatcttgttttctacaagctcctcggtcgcacggatgagcagtctgtcgtcctgagttgtgtcaatagagtctgaaaactccgcaaggatctgcttttcacagtccttaaggcactgaagaagcacagggttgaaagcgccgcattgcccgtcgagtatcatttccatcgctttttcgtgcgaaaacgcctttttatagcatcggttgcttgtcagtgcgtcatatacatccgcaagagaagtgacctgagccgagataggtatctcctcgcctttcagcccgtcgggatagccttttccgtcatatctctcgtggtgccagcggcatatctcataggctttgtcaaaaaggggatagttgtgcgtgttatgcagatcttgaagcatttccgcaccgattaccgagtgagtttttataacctcaaattcttccgccgtcagccttccgggcttgttgagtatcttgtcgtctatcgagatttttccaatatcgtgcagggaggatgctgtgctgataagcagtatatcattttctgtaaggcggtacttgtccgtcttttcaatcagattctgtaaaagtatagatgtaagctgttttatgtgatgaacgtgcattccgctctcgccgtttctgaattcgacaatatgagcaagaacgtttatcatcatactgttgttcttttcgttctcgtaaacctgctcctcaagggcacttagtagttttttctgcttgcggtagagcataagcgtattggaaacacgtttatgtataataaagctgtcaaacggtctgataatatagtcggtaacaccgagttcgaacgcttttcggatgtagctctgcgatatttcggaggagatcattattaccggggtgttatctatccagtggtagcgtttcataacatcaagcacaccgaatccgtcaacagcaggcattattatatcaagcagaacaagatctatatcatatacctgctctttgaggataccaagtgcttcttctccgtttgccgcttcgacaatatcataatcatcgctcagcatatcgctcagcatatcacggttcatctcagagtcgtcaacaataagtatacgggcgttcttttccgccgcattattcacattattcctcctttgcagattatagttcagaattctattatcattatatttaagtataaccttttttggcttttaagtcaatagaaatcatataattagtactatttcgggtatcttgcttcttacctcacgcagacgtttttccgccttcacagaattttcaaaacgtcttttgtcgattatctcctgcgcttttgtatagtattcggaaggatatgccatcggtcgtttctcctttattcgtaatcctgtaacaacagctcatctattttattaacgtcaaatgaggagttactgctctgctgttcctgtcgcttgatattttcgtcatttacctgttctgctgtagctatgccctttgaatgccagttttcaagtatcttgctgatatacgggaatgcaaactgcccctttgcgttgacatttatttcgtaggcgagctttaccatttcagagtcgaaattccacacgttgaaccaaagattcacgaagtctttttctttctgcgtcagcgccctgtttatcccgaacattgacttgaccgagctttcggcaacatttttcgcttgcagcattgaaatctgtctttcagcagaggcaaggtcggttatgccgttttccatccagttcatcgccgtttctttgagatatgcaggcgatgatttgtttatcgaaaagcagtaatcgaccatcataagtacaacctcggcaggaagcccgatatgctccgttatcgtgataattgcattctgctccgtgtgtttcagcggtctgccgtaaagtgtttcgcaagtcttgaaaagaaagtcgatcttatcgtcactttttatcgtatccgcaatttcggcaggtgaaaattccggagaacgaagtgctgccgccttgactgcggcaaattcggcatctttcgccgtaacgcccgccagcactgttacgcttgcagatacaccgctcgtaacaggctctttttcctgcggtcttgcggcttcgggtacagcctgcataggggagtaaacaccgtcactcattgtaagaagccccacctgcacccagaacgaaagtgcgtccttgacatcttccccgttcatagaaagcgccgttgctataatttcatcgttgagtaattcaccgcagtgccttaaaaaatacaaaagcaccttgatgttacttccgcttgctatctttatgtatttatccaccacatcggacggtacagcaaaaatgctgttccagccgccgagattaatattataattcatatctgctccgtttttatctgtattatttgttttaaattattctttataattataccacaattgaaacagaattgcactacttttataaaaaaaactctcgatttcggataaccttatatatcagtgataaatacacagaaaaacgggcatcggctttttaccgatacccgtttaaatattgacttctttgccttaaccgtcagcgtaccgctccacgagccgtacactgctttgctaaacttaacaatgatataaatagcggccacagcttgccgccgtagccgctttatattgattattgctttgtgtaatcacgccgtttcaatattctgagaattgctcagacaattccaaaggcggaatttacagtggctttcagccacagtcggaatttgaaacggtacattgccgccgtaactgacctatcatattgccccttgctttgtgtaaccccgccgtttcgccgtcctgcgaataactcagacaatttcaaaggcggaatttgcggtgccgcatcggcaccttaggggtggggtttgccttctctgtaggcatccattatatcacggaatacctcgccgtttgtgggcggcgtccaggtgatagcattcgcaccggcttcaatagtcgcaaggatcgactcgcttgtaggtcctcctgttgcgattatcggaatgtctgggtgacgcttgcgtatttctcttaccacatttgttgtcttgcttgcggcggatacgttgaatatctttgcacctgcctcaagcctgctttcaatatcctcgtgttccgaaataaccgtaacaactacgggaatatcaatagtgtcgcatacctgacgcacaacatcattcgatgtcggtgcatttactacaacaccgatagcaccctgaaactctgcgtgcatcgagagattgactactctcttgccctgcgtcagccctccgccgacacccgtaaaaacaggtatatcagcggcactcataattgtctgcgtgattatcggctgtggcgtaaacggataaaccgctattaccgcatcggcatttacatttctgattatacatatatctgttgtaaatactatagattttatcagcttgcccattactcttataccgcttgcctgctgaatttcctcgggaaccttcagcataaagctcctgagcggaccgctgatctcgggtatgtacaaattttctgccatataaactcctttcggttaagcgtcagacgtattcacctccgacacctctcactctgacaagacccgagttgactgtaaattcaccgttctcgttctcgcagataagacaaccgtcaggggcgatagccttagcaaatgcagttgtttctgtattgttctgcaccagtttcactgtttttccgagcgttacgcatctttgcgaatactcgtttataactgtagaaaaatcctcgtcaatgagccgtgtcagctcgtccactatatactccgccgcaagcattttatcgtatttattgcccgtcagcgtgtaaagggatgccgcattcacaagaccgcttttttcaaaaaaatcctcatcctgatttacgttcagccccattccgcagatgacattgttgtaaattgctccgttacaggaactttttaaggtgctttcgcataaaataccacataccttgcgttcagagcagattatatcgtttgtccactttatgcctgctttgataccgctcagccgttcaatcgcacggcagaccgctaccgcacatataaccgtaaggtcgtgggcgttatccggtgcctttataagcatggaaacagggagcatatcacgggtagcaagccatgtgttgccgatcctgcccttaccgcagctttgcaggtctgctgtcactaccgttctgtcgggaagctcgtcggcgtgttccttaagataggtgttggttgacggtaaggtgtcaaacgtcaataaaggacagccggctatattactgcttatctgcatggtaatcaagcgcaactatgttcattgtgattttcttgttatcatctatggtgattataccgtatgacggcggacgtttatctctcggagaatcaatgcttccgggattcataacgtatataccgtcgataagctcggtacggtaaaggtgagtatgaccgtaaagagctatcttacagccgttctgcttggcaacagcgacaagcgtatcaagtccctgatgcacatgatgctcgtggccgtgcacgcaaagtatcttgatgccctttgcatttgcgattcttatcgttttgttgtcggcaaaatcacagtttccctttacgaataaaaagctcttttcggggtgaagattccttacatcgttgaattcgtgttcgccgtcacccagatgtataaaagcgtcggcgtcaagattattctcaaccaccgaattcagcttatgaaattccttgtgcgaatcggatactactacaattttcataatttctatcctttcagtcgggcaagccagatacggcttttattgcccactaggttattataacacataatgtgtaaaaagaaaagattagtatccttttaatgatacggcgaccaccgagatctacacgtactgacacactctttccctacacgacgctcttccgatctagctgcttgtcatcaactaccgacgggcactgcgacataagctcgcttgcgtcctttaccttcgggaaagcaactacatctctcaggctgtctgcaccgcaaaggagcatcgaaagcctgtcaagacctatgccaagaccgccgtgcggaggtgcggcatacttgtatgcgtcaacaaggaagccgaacttttcttcgatttccttatcggtaagaccgagaagtctgaacattctctcctgaagctcggggtctgtgatacggatagaaccactgcaaagctcgatgccgttgagtacaaggtcataagccttcgctcttaccttgcccttgtcggtatcaagatactcaaggcactcctccataggcatcgtgaacggatggtgcatagcaagccagctttccgactcatcgtcccactcgaagaacgggaactcggtaatccataagaagttgtatccgctgtcgggtactatgcctatctgcttgccgaccttaagacgcagagcaccaagtacggggagcgtaaccttgttcttgtccgcaacgataagcacaacgtcacccttttcacagccaagctcggaaagtatagcgtcaagctcgccttctttaaggaactttgcaaacgagcagttaggtgcgtcatcgtgccagcggatatatgcaagaccctttgcgccgattccctttgagaactcggtcagcttgtcgatttcctttcttgtaagaacacctgcggcattctttgcaacaatcgctcttacactgccgcctgcggcaatagccgaagaaaataccgaaaactctgtatcctttacaatatcggacagatcctgtatctccataccgaagcgtgtatcgggcttatccgagccgtaacgtgacatagcgtcgttatatgtcagtctggggagcggaattgtaatatcaacatcaagcacatccttcatcagctttttgatgaagccctctgtaagctcaagtatctcgtcaacatccataaatgacatttcaaggtctatctgtgtgaattcgggctgtctgtcagcacgcaggtcctcatctctgaagcatctcgcaagctgaatatagcggtcaaagcccgaaatcataagtaactgcttgtatatctggggcgactgcggaagcgcatagaacttgccctcgtgaactcttgacggtacaagataatctcttgctccctcaggagttgatttcatcatcataggtgtttctatttcaagaaatccgttgtcatagaaatattcacgggctgtctttgcaatcctgtgacgcattataaggttatcctgcaacttctttctgcgaagatcgaggtatctgtacttaagacgaagctcctcgtttgtctttgtatcgttaactatctcaaacggcgttgtctgagccatcgaaagtatacgaaggtcggtaacgagaatttcaacgttgcctgtctttatatcgttattcttgctctctctttcacgcagaagtccctgcgccataagcacatattcgctctttatctgctttgccttttcaaatacggcaggctctgttgtatcatcgaatacaagctgaacaattcctgtgcggtcacgcaggtcaacgaacataaggctgcccttatctcttactctctgtacaaatccggcaacggtaacagtactgccgataccctcgacctcgccgcaataatgtgtgcgcttaagacctttcattgtgtctaacataaaatctatacctttcctacggttctacccgtttatttccaaccgacagacataagcgtctgacgataaacctttacaattatatcatttttctgtcggcttttcaagtagtgaggcgaaaaaaagcaaccgcagaaaactgcggtcattatatatttctgctttttactttgcttcagtccgctttttttaatcccccgaatcaacagagtttgcgctgattttgtccgatattgctttctctgccttcttaggctcttccgacgctataagaaagcacagattgcccttttggaataccaccgtcttgcttacgattttttcctgctcgggatatgttccgaactgctttataaggctgtctttcctgctttgcagtgcggctttcacgccgtctgtgtcatctgcacgcacagcaattatctccgacagctcaacgcttatcgcctgctgatatacgcagtaatctgtgataccgtatttgctgaaatccattatcgtatcaagcagcgtgctgtccgttgcttttaccatttcgggaaaatcgccgctgttaagcgctgtgagtacaagaccctcgcaggaaatatcatcgtcagccaccttagttaccgtccattttgtagatgaacgggaggagctgtcctcctgctgtacagaagaaatatcatcggcacagccgcagagcgttgcggcaatgattacggctgataatacagcgagtgctttcctcatttgctttttatcctctcaagatttgccgaaagcgcatcggggagcttgtgcttatccttgtcgtaccacggcagatcctcacgcattataacgtcgggatgagccataacacgcttcataaagtcctctgtcatatatttttcgtttatcacagtatagccgtctttgtcaaaaacaggcttgtacccttccctcttgtagacaaactcgccccaccacgggagccaccacagccacatagcgttgtcctttttcatctcatcgggatcgggaatataaccgcattcggacaaggttatcatcttgccgtgtgcaagctcggtcatatattcgaatctctgcttctgggaagaatgatcgtattcctttaccgaataaatatcatctccgcagatgtcaaacgtgtccgggcttacctccatacacttgtcctgaccgttccatacccatataagattggtcagcttgtgataattttccatacggtcaaaaatcatataccacagcttcttatacgcttcacggtgctgttcgtcgtggtttccccaccagaaccagttgccgtttgcctcatgcagaggccgccacagcacaggtatatcaagctgtgccatacgcttaagctcggctgataccatatctatctcacggataataaattcatattccgcagtgccttcggttacacccttgcacagatcgaagcaggtcttgtgatcgtagccggtcgtcttgtagtagaacgatgagcctttggagtaatcgttcatatcgttcggagcgtaccagtgccagcacattgtgacaatgccgccgcactgagtagcccattttatcgctctgtcaacctgatcgtccgttttcttgcaggagcttacccccataaagtcatatcctctcacggcagggagctttcctgtcagatgatagtacacaagatcctcgacttcttcactttgcagatactgctgacctgccagatgttttttgccgtaaatgcttttaaggtattcaaaaagcatttttgtgtttttgcttgcctgctttgaaacaagctcagcgtttaaatctgtagtatacgccatagttcctcacattatatctttatttgttcttctgctcctgtaacgttcttaccgttctgagaaggaattttgtcggacagggtttggcgcagcggtcggctttttgcgagaatacgagcagaaaaagacgggaaccgcaagtggaagcgtgactgttaatcacgatgccgttggttcaagcggggcagggggatccaagcaaattttaaggcgaactaaaatcgaggacagagagtaatgtttgtttcactcttttccttggcgttaggtcgccttaaatcgttatttagggcttttcatcgctgttacaattaagagtagtttatattgcagggaagcctttttttgttgccactaaatccaaatgaggtgtgatctatatgcccaaaactgaatttgactattattacggcgttgaagccgagcaatttacctttgtccgagtgccgaaggtgcttttcactgacaaggaacatttcggtggtttatccaatgaagcaaagctgctgtacggactgttgcttgaacgaatgagccttagcaggaagaacaactggatagataagcacaatagggtgtatatcattttcctccctgttgaagaaattgaggaaagccttgatgtaggacacgaaaaggctctcaatcttctcaaagagcttgatgaccagtcaggcatcgggcttgttaaaaagaaatgccgaggtttgggactgccatcaattttgtatgtgaagaacttcattgttaaaggtgagcagaataccgatcgtgttccgacatcaagaagtacggaaaacgaatttcaagaattcggaaaaacagatttcaagaagtccgaaaatcagacttctgaaaatccgaaaaacagacttcttgaagtccgaaaatcggactctaataatattgatataaataatactgatatgagttatacttacgatcaatctatcgatcggtcacaggcaggcattcaaaatttctcgcccggagctgacggattgattgacgcgatagaaagaagtacggttgaggaaaaagttaagaaacagatcgactatgactgccttatctctcaccccgacagctctgttgtccaaatggcagaagaaattaaagatctcatggtcgatgttctctacggagagcgaagtgtggtatcggagggaaaacgtgtttcggaagaaacggcaaaggcagcttataggaaaattactttcgatcacgttcagtatgtgatgaaaagtcttgtcagctattccgacaaaatcagcaggattgaccgtttcctgacagcttctttgttcaactcggtttacacgctgaaaaattcaacgtttgcagggtttgaatatgattgcgtatgaagatgctttaggcagaaaaaattcacagcacttgttggcgtactgtgaatatatgcccccgataaattggaagtagtcaatgccttttaaataatcgctctttaaaagctcttattctatgcccataacgacttgtaaagatgataccgcataaaatcattccgattgcggcaccttcggcaaatgctgacactgcatttagagctgtatcattacttagctctgtatggctaatcaaacttgccacaaaccaaaatactgcacctgtctgtaaaagtaagcgtacacgctttgtatattgttctgttcccatattcatgtactctgctgcttttattactgtttcttttgtttttttatccatattctcgctcttcctttctccatcaatgagttctcgaatatctacctcatagaaatctgcaagttcaatgagaatatctatatccggcatattgtttccgttttcccatcgtgaaacagtgcgtgaagaaacacagaaatgctctgccagttgttcttgagtcaaccctttgttcttgcgaagatatttaagaaattcacctattttttgctgattcattaacgtttctcctttcacaataattataacagagcttcataataaataccatgacacaaagcgagaattgttgcaatttatgggtagacatatcatgtctgctggaatttaattggtaaattccgatttgtagggcaggttaaccacccttataaatccattatatcacgcaataccactttttttcaaccacttttcctatcaaattgccattgggctgacatcgtaaccgcataaaaaagggccttgcggctcgggggtatatgaaaaaggggcagcctgggtgggtgctccttttgtggtaaactgctcgataaacgggaagttgttatttattcatattctcaactaagcttgtagcttttacagtcatctccacccaacccggcacaaaaccgtgtttattattctaacattcattataaattctgcaatgtttctatcatttcccgccaatcccttacgctcaaaaattcaaagtcggcattggcattattatttgtatcgctataataaacaggaaaaattcctgcgttatttgcaccgacaacatcatttgagtagctatccccgcaataccacaccttgtcagatgtcaatccggatttcatcaatgcaatttcaaatagacgcttatcgggttttcgtatcatataatcacaagaagatattataaattcaaaccgattgttagggagtaatctatcaaaacgctcctttattgcttcgcctgaccacgcattgttgctgattaccgcagtacgaatacctgcttgattaagataatctatcatttcatctgcataaggcataattgctccttgtgaagcagcagtccaaaaaattatttcgtgatccaaaggcgtcaatgaaaattctatgcccaaatgttcgaatgcaaggcggtttccgactcttgccggaatgtcatatccaagagtattccttacactttcaatttctccgaatatcttatttacttcactctgaatgtcttcaatcgtgcaattatttggatttttcactatgtatttcataagttcgacgtttcctctgtcagaattccaatcaggctcgcaaagcaaagtatgtccatagtcaaaaataatcatttcgggttttgttattttcatttgaaattacctcagtattatttgatatagtattccaatagcttctcatcaataggagcaatcggctctttatccttaatatccttgtaaaacgccaacttgactatttcagcacgatcgtttatttgatgatagatttcttcaatggtcatattttcaagggtaacaccatacagaccaccatattcaatgcgttccttggaagaaaaatagtctggcatcataagaaatttcatcaagccaaggtatttaaaagcagtaccttcaattcctaattcttcgtagcactcacgaataatgcaatccctcggtgtttcgtctttttcaatacagccgccgaaaagctcccatctgttacgccatttgttccagccgaggagataatctttgtcaaccttgacaacagcaagacaatgagtgagctgttcatactgcgtcagcgtattttcatctttattggttatagagatgaaataattgccgtccaaatcttttaaaatgtaatcggtcatttaagttcctccctaaacccattcctgctccacagccagagcagtgtgcgaatatcaatggggacgtgaaactgtatagtgtgataacatagtttacagaatgtgcaaggacatagtttacatatttatgataaaatagaggcataaaaaataggtaagctcgtcgccgtccttgaagtgcatcacaaacctgtatccgtcctcatacggctcaagctcagcgttttcatcaatgttcttttttatatattctgccgtttctggcgaaataacaggtatctcccatatatcgtccttgtcgaacacgcaacagacacggcactttgcgcaggcttcacggctgagaatttcagtaagcatttaaaatcattcctttcggttatatcttatcacaactgtgagcaatgtgcaaccgtaaaattttgctttaaattactgtaattatgtcaatttggttacaatttgcaaaaactattgattttaacacgttgttttggtataattaataataactcatactgtgtattcagtgagaaattctaatgttgcatctgtgcagctgttgaacaaaggatattatatggaaaataataactcagtaaattttgcagattacgaatttataccgaagcttttaactcagatcgaaaaagtcattataggcaagcatgacgtagtgaaaatgcttgttgccgccttgctttccggcggtcatgtgctgatagaggacgtgccgggtacgggaaaaacaacgctcgcaatgacgctcgctaaggcgacctcgctttcgtgcagacgtgttcagttcacccccgatgtcatggcgtccgatataacaggctttactatgtacaataaggaaagcgaacgctttgaataccgcaacggacttgttatgagcaatatttttattgccgatgaaataaacagaacctccccgaaaacccagtcggctctgcttgaggctatggaggagaagaaggtaacggtagacggtgtcgcacataagctccccgatccgtttatggtaattgccacagagaatgaattcggctatgtcggaacatatcctctgccggaggctcagcttgaccgttttcttataaagctctccgtaggctatcccacggctgaggacgaggcaatgattctttacagaagaaaaaacggcgaccctatcgaaaccgttgagccggtatgcagttccgatgatatttcacgttgcatttctgccgtaagagatacgcatatagatgcggctatatataagtacatcgttgatatagtttctgctacgagaaaccatccgtttgtggcgctcggcgcaagcccccgtgcgtctatcgctcttatgagagcgtcgcagagcatcgcttttatggacggtcgtaattatgttacccccgaggacgtagcacttatggtgaattatgtccttccgcacagaatacatctcactcaggaggcaaaggtcaagcgtgtaagcgttggacttgttatttccgaaataatgaaagcagtaagaccgccctttaaaagcaacgaataaggcgaaaggtcggtttgtatggctaaatacagattttattatatattgttcgccgttgtcagcaccgtgcttatgttttcgtacaagagcaagctgacctcggtgcttttccttatagcgattgcaattccagctatatcattcgttcttcttgttttttcaaggcttcttgtcaaaatcagaatcgaataccgctcgctcacagcggaaaagtttgaaaataccgatatttcggtaacggttaccaaccgttttatcatacccttgtcgcctgcggagcttataggctgttttccgtacagaaacagtgaaaagtttgaatatcacaagctgatgataagcgtaccgcctttttcttccgttacggttaatttcaattcaccgataaggttcagaggcgtttataagtcgggtattgagaagttggtgatatatgaccttttcaagctatttcgtatgaacaaaacgatgaaatgctacgaggattttatcgtacttcccagaaagctcgttatcgaccccataatcgacacaggcgacggcgacagtgaaacgctttcgcagaataatttttcgcttgataagaacgctttcgcaagtataagggaatacagggcagaggattccatcaaaaacgttcactggacaatgtccgcaaagcacgacaagctgatggtaaagcagatggaacgcagtattggcggaagctgtgtgattattcccgaccttaacgaatatttcccgtttgacgaggataattacgaagctgcagacagcataatagaggtaatgcttgcacttaacctgtcgcttatctcaatgaaacagcgttgcctcaatgcgtggtattctcctgcggacaagcagtgcgagcagttttccgtcaagaatgaagaagacaatatgctgctgtttgatataatcagcagacttcctcgtcagacggataccttccttccagaaaccattgcgagaagctgtatggaagcctcagccgatatatctgccgtttactttgtcacatcgcagttaagacgtgattttatcggcaaaatgaccgatattgagctgttccgcaacaagagagttaaaattctgttggtcagcggagccatagaaaccgatgagcaggcagagcttgcagatgccgttgcggtaacgcagggctttgaactttggaagatagataaggataatatcgttcagtcgctcaatgcggcgatagaattgcataaaaagcaatgacaacacatccggaatcttaaaaaacataacggagaatagatttgaaacgtaataacagtaaaaagggcagctccgctaaacagcagacgattgttcttgtcggaaatacttaccgcaggaacgtgaatccgatacctgtcatagcggtcaagctggttcttgcctatatgctcactgtcggcactgtaatgagctttatcaatatatacgccataccgtttgaattcggctctgccatagcgcaggtgcttcttttcgtgacggcttttatgcctgtattcatattcataaaaaaacgctacgctttgcctgcgtttgcggtcggtgccgccatagtgtattttttctttcacaaatcaataaacgaatcgcttattttattcaaggattacatttttattcagcttgacagcaggttgctttccacgttgcagtatgttcccgtcaattcccatgcgttccttacaagaacgcaggattttgtcagcggaatgaatacggctatgcttattctgacgtgcataatcagctttatatgcgtgctgtgctgttataaaaaattccaccctatagctgtaataattacatggagcgtgatgttcataccttcgtttatgtcggaggatgcagattattccgtgtacattctgcttgcggcaaccgcatttttcggacttcttgcgataaactcggcaaacggtttctattcgaaggtgcctgtaaataatgcgaacggtgcaaaaaataaaccatccaacgatgaaaaaacgttcagaaaaaatctccgtaagaaaaatccgctacagacggcaaaatccgagctttcacgctacagcaggaactgcctttgcggtatacttcttcaagcggtggtttatttttgctaaagctgcaataaaaaacaagccgtatttctacgacttgcaaaatctccgcagtcagaaagataaggcgatggcactgaggctgaatcgttaaaatgaaaatcggagcgtacctgatttttactctgcactgtggcaatgattcctgtaatatatcggtgtaacgccgtacagctttttgaatctgcggcagaaatagccgatgttctcaaatcctgtttcatgcgctatggtgcaaacgctgttttcagtatcaacaaggagctttgacgcacgtttcagtctgtattctacaacgtaatttatcggcgatgtatgcaggtatgtcctgaaaatattgagaacactgcttttgcttataagaaccgttcgggcaatatcgtccagtgttatctgaccgctgtaattatcgtgaatatactgcatcattatctgaagcttagcctgcgtctgtgcggaatgcactgacatagaaccgcaatctgttatcagtatgctttcatataaaagacgccatagtttcagcagcagctctgctgttttcatttcagacgctgtgcctgaaccctgcacggcaaataccgccctcattgtttcgataatgctgcggtgtgctgtttcttcggcggaaaaaatcacacattcagtagttgattcgattatcggtctgatgtatctgctgtatatcagactgccctgcggcgcaagcaaaacaggtgaaaaaacaatgttaggaatgatggcgctgtctttggcttcaaacctgtgtatcacctgagagtttataaagattccatcgccggaactgagaacatacctgtttccgcccaccagaaaatcagccttgccctgctgtacataaacaaattcgacctccggatgccagtgccagtcgatacagtgaaagtcgaaatcccagatgtcctcataatagtagcagaagggatattcttcgctgccgtgacttgcagtttcacgcaaggtttcgtccgttatgatcctgtcctttttgatttcatcactcatattctcacctgatttacgatattgtgtaataaaaatgtgattttgtgcattgaaatgttatgatgtttgctatataatctgattatatcaatcgtcaaggagtttgtcaatatggctgtgaattacagaaaaacacttatatcctgctatcttggattcatcacgcaggcaatagcggctaatttcgccccgcttctatttctcacatttcacaacggctatggtatcccgcttggaaaaatcgcccttatctcgtcggtattttttgttactcagcttatcatagatgtgctgtgcgcacgtttcgccgacaaaatcggttatcggaaatgcgttatcgggtcgcaggctttttcggcactgggacttatcggacttgcctttttgcctgaactgcttcccgacccgttcacaggaataatcgtaagcacaatcatatatgcaatgggaagcggtcttaccgaggtgcttgtaagtccgatagttgaagcctgcccgtttgagcacaaagaagccgcaatgagcctgctacattcattctactgctggggttcggtcggagtcatactcatttcaacactgttttttactgttttcggcatagaaaactggaagtggctctcttgtatctgggcgataattccacttgtgaacatatacaatttttcagtatgtcccattgaacatcctgtcgaggacggcaagggaatgcgtatccgtgacctgttcagagtaccgctgttctggcttgcgatactgcttatggtatgtgcgggagcctcggagctttcaatggcgcagtgggcatcggcatttgcagaatccgctctcggactgaccaaatcagtcggagatattgcaggaccgtgtatgtttgcggtgacaatgggcataagccgtacactctacgggaagtacggtgaaaagctcgatcttatgaaattcatgataggctcggcgctgctgtgtctgatctgttatatcaccgcctccctgtcgggaatacctgtaatcggacttctcggctgcataatgtgcggattctcggtaggtattatgtggcccggatctataagcatctgctcaggcaaaatatccaccggcggaactgcaatgtttgcacttctcgctatggcaggcgacctcggcggagcactcggtcctgctattgtaggaaatatcacccagaatgcaggtaatgatatgcagaaaggtatgctgtcaggctgtgcatttcccttgatacttttggtatcgctcctgctgctgaacagagccggacgcagaaacaactgattgtatccggcaggtttatacaaagctacaatagaaaaaaggcaccatgtattaaaacgtgatgcctttttattttccataagatgccggcagtcaatttacggatttcatagaacctgttctgcatttctgaactgcgacggggtaatactctcgaaccttttaaaaatcttgcaaaaataactgctgtcacagaagcctgtttcttcagctatctgctcgacagttttctgcgtttccgccagaagcattttagccgcctgtatcttgcgctttgtgatgtattccatcggtcggcagttcagggtctgtctgaataatctgcacaaatgctgcgaagaaacgcctgcggctttacttatggattcaagaccgggctgtttcatataattctcgtcaatataagcgatcgccttcgttactgcaggggcgatttgtacactgccttttcctttcgctgcaagacggctcaattcaatgaaaaagctgtacagatagcccgacgctctgaaatttccgtcaaccttgtcagacaggagtgcctcgtgcatacatctgaaacagtggtcaagatatgtaatttcttcctttggaagagggaagattttcggcttgtcaaagccgagcgctttaagcatatcggcgcaggattttcctgacggttttatccaatgcgtatcccaggattcgtccgttgaataatactcatgcggacagccggcagggataaagaatgcggtgtacggatttattatatgtttctctccgttcattataagtacgccgcttccttttgtacaataaagggccttggcataattgtcaccattgccgcagattacatgatactgccattcgttcagccctacgctcaccaaaaagacaggaagactgccttctttactgattatcggataatcgtagaatttcaaaattaattcaccgcctgtgctaaaatcgttatatcttaataatatcattcattgacttgtttgtcaataagcgttataatttgttaaaatatgaaggggtgatttttttgagaacagtcagggaactaaacgatttctggagagatcggaagagcacacgtctgaactcccgtcactccgcgaaatctcgtatgccgttttttttttcaagcagaagacggcatacgagatttcgcggagtgactggagttcagacgtgtgctcttccgatctagacactgaacgtgagcgcagggcggagaacattgcttcaactccgcttattggcggcattgtaccaaactcctcgaaatatatcattatacgtttatctaaatgaccgccgttttcatcggcaatatggtatatttctcggctgatttgttctataatcagattagcaattacatactttgttctgtcttcttcgggaagtacaataaatacagcacatttttctttacagagtgtttcagtatcgattgctgtgttaaagcataaaatctgttcggtttctgtgtcaatgagtgaatttaaacgtgacagggcagtagagatgaccgagagtgctgcttgatctgcattgttaatcgccgcacctgataaccatcttgctttatgttccggcggtagcaatttaatcagatcagcaaagtatgtttccgatttaagttgtgactttttctgtggttttgcttctaacaactctatcatcagtttcagcacggacactatatgacattctttgtcatttccgtattcggcaataatcagaatcagggctgctattaatccctttgcagcatcatagaagtatgtgtttgctccgtatttgtcaccatcggcggcaattatactgtcggcaacgatttttgcgtatcgctctgatttggcttttgcgctgatattcaaaggattatttttgtgttcatccatatatttttttacaagatgtaacagattaaatccatctgatttaagcggattccgcagatctatcactgatattttataaccgtaacgttttgcggctacataaccgcaatttctgtatatatctccttttgtatcagtacttataaaactcatacctgccgcacagcagtattcaatgttaggttcaagaaagaatgtggttttacctgttcctgcagctgcaatcatcaatgtatgtacatcacttgtatcaatcaatgcgtatgtatctttcccctttttttcaaaaccgactattgttccgtcaattgttggtctgcaagcacccatacgccataattgcggctcatattttagaattgaaaagttttgtgaaatttccttgtgttccgcccagtgagcggttccgtgctgtccgttaccgaccttgcgagccttgattttgtcaaggctgtaattcttccctataacagcgaatattatcatagccaaaaagacaattgctataataactataaatacatactgttgcatattatcaacctcccatcgtcataacggcagtttcagcaatgatttccgattgtgcctgttgcatttcaagagtcatgcttgcttcaatcgatactgctgtttgcgctatttcatagaaacgttttgcaacgcttttacacgtgtcggtttctcctattttaaatgcacatttaatttgttcggtcaattgctcgatttttgtttgcggcttacctttttctctatatgctctgaaatctttattgatacgattggctagtttttcatacatagcggtatagtcaatcgtcgaatcatcaagtttcagtgtttgaacactatgatccagtgcaagagcggctatatcggtatacagtccttctgcaagcaaatcttcaaatccgggtgataatgtatcattttgcggctcgatttcatctacaacattagcaacagcatttttcagcgggtgaacatttgccggaatatattcttcgccataattatgtttaaggtcttcgttccagtcttttgcctgtgaagttgcccgtccgatatgctgatagccttttgaataaagtatatctcgtattcgttcggcagcgtctattccgccttcatcgttgtccgtacataaaactacatgctgaagatgaggatagtctgacaacgcctgaagaagcgaacgctctgaaataccgtcaagagctatatagctatgcttttgccaatcagccggatataacgttataaatgacaacatatctatcggtgcttcgaagactaatatcatatcatcagtgccgatatggcaaaaactgaaattagtatcagatccggagactgtcatgcgaaaacttttgccgtatgtggcaatcgagcgtttattagcctgcttggcagtaccctccttatctctgccgagaaacacaacattgtgcgcttctttttgttcacctgtagttttatcgttgtaatattcaagactttcatagatcatcttcttatgagcaaaaaaagaaacaatgtcgcctgatatgtgccgggtttttgttaggtatgcaaaaactcgtttcatatcgctgttggctttcggtaacttaaattcctttctaatcggtaattgcgtattaacatttgatactcgtgttatatttgatgaaggaactgatgaaaaccctaatagcatttctacggcttcaggataagaagaaccgtaataattctcgacaaattttatagcaccgccaccaatctgatttttatgatcataccactgatttccgttaatggttatactgtcatgcttctgtccgttttcagtatatacaagcttatatccgctgccatgtctttgtaattgttcgccatgtgacgtgagaaaactgtacagatccgttgaatttgcggttgttcgctgttcttcggtaatacgtctgtattttgccatttctgactcctttctgtttcaaaaaggaaaaaggcttgtgagctattatacccaaaagccttttttcaatattgaattatttaatactgctgcaagcattaccacggaatgatgttccaaatataaaggggtgcagtaagaacaaatagcaatccacccaggcatacagccggtgctattatatcaaattcgccgttacgcttataggaaatagcactttttgtaatgaatacaattaacaaaataccgagtacgccatcgagtatagggaacaccacatcatttacgattgtcttaatctgacctttcatgccgtcccatgtacttgtaatggcaccagctacgtcggcacttccggcagcaaagcatacagttgagagagctgttacggttataagcgcaacaagaaatgttgcaagcacttttgcttttttcataataatattcctttcagataaaaaaataagagcggttaacgctctgacaaatatgttgatttttattgtcgccagtggcgacaatttatatctgcatgggaatcacatcctttcgttataattctgtacttgaagaaaaatgaaaatcatattataagcggcagagcttttctgccgcccggtgacaataaaattttaatgctgcttataaggttgcggtcaaccgaaagtgcgatgaattcgcctgtcgtgctgtcgaactcgtacttatcgtcaggtacgttcaggtcatcgggatctacccatacgccgttaatagcagaacctgcatcggtcagctcattatactcatcgctgtctttttttaccagtgcgcaggaagaaaccatatcgccgtaagaaaaaataaatatcagtttatcgccgtcaagccttgcgtatgtctcactgccgtccgattcgaataacgagttgcgtagctttacgccctcaagtccgacggtaatcttatcgccggagaaatcgtttccgagcgatgtcagaaaggtgaattttctgatttctaccgtttgcgcatagccgtattcgcacattgaccaatctcccgaagcggcggtcaggagattttcgcaaagctctgcgcctttctcgctgtcggcgtggtatgcggtataattcttatcctcgcaggaaatgcttatcgtatctttgtcctgtgccgtaattttaacggattttcgggtctgctcgtctgtctgctcgtcaaataccgctgtcctgccgttttctgaaaagctcgccacaaagccgttttcatcgacccatatacctttcagaaattcgtctttatccgatatttcgcctgacggcacagatgccacggtgcgcaaggaactgttcaagttgcctgcggatgatgacgctgagctgttttgcaaagaggcgtctgaatttgctctgcctgctgtgcaggaggacagtaatatcgctgtgattaatgctgttgctgttattgaaaataaaaaccgattctttctcatattgattcctttctgatatttgtctgatatttacagtaatgcagtgtcttgatttcattaaccgccgtgaagcttttctgtacataattttaccataaaattatgattattacaataggacaagcaacataaaaacgaaattacagtctgtcgaaaaatctctgtcgttgataaaaatggggtcgcaggggcaaagcccccgacagggtctaggggcggtagccccacgctcagccccggcatggatgccgggcgtgtatgccaaagggctttgcaaggacgcaaagccaaccaagcatacacagcctttcacgggggaaaggggtttggggattcggcaaggatgccgagatagaacgcccaaaggctttatgcaaggacgcatacaagtggtcgaacaaagtcggtgcaggacgcaccgacaacaaacgaccacgattgcagagacgcaaagcccactaagcgttcttatagggatagagaattcgcactatcttataaaaaacagactttttctacaagctaacgaaataattcattttgaaaatatgtttacatatcatcttaaaaatttctgaataaagcaatttatttcacttaatttattagcctgcaaaaaataaataaatatttttcaaaacccccttgacagcctgttggcattgtgctaaaatacccaaagcaaaaccgatttttccgtgtaatatcggctttgtaaaaagaaagagagcttgtgcggagcgtttattgcaaggcttagcacaaaatatgaaaacgattaccgaatttggtctgccgttaggtaaattttttatctttatttcggcatttcggcggataacaggaaaggtgtggtgaaatgttccagttcaaatggatgctcggaaagatgaagggctaccgtgcggtgtatgccgttgcgctgtgtctgtctgtagtgatacagtcattcttccttacaggaccgatgatcgtagaacagataatcagtatatttatatcctcgcccgacgctttaaagaacattgaaaatcagcgtgatttgctgatactgctttgcgttgcgatgattttattcgtgttcgttcgtacctgccttcagttccttgcgaaaactctgtatgagatagtatcgcagggagtgctgcagaaggtacgaaacgagctttttgagcgtattcagaatcaggatatgcacttctttgacactcatacaaagggcgacctcgtaacaaggcttacgggcgaccttgatatgatacgtcattctatcgcctggataataatgatggtggttgaaagcagtgcgttgttcttattcacggtaatttacttctttacgcttgactggctgatgacgctttttatacttgcgcttaccccgatactgtttattgtgacccgtatgttctcgaaaaaagtaggtcctaagtatgtggtactgcgtgaaaagctgtcacggctcaacacgaaggcacaggagaatatagcggcaaaccgtgtcgtaaaggcttttgcccgtgaggaatacgaaaaggaagatttcgataagtacaacagggattactgcgagtataatcagcaggcggctatggtgtggctcacattccagccttacatagaaacgcttgcacaggcactctgggctgtacagatgcttgtcggcggtatctttgtcataaacggcaggataaccatagctcagtacaccgtattctccggactgttatggacaatagcaaacgctatgagaaatatcggtatgctgataaacgatttacagcgtttctttgcaagtatatcaaagataatagatatttactacgcacgtccgcatatagagaataatcataacagcaaggaacgtccccgtcttaacggcgatatagagttcagaaacgtaactgcaaaattcggagatgttaccgtgcttcacgatataaatcttcatataaggcacggagaaaccgttgtaataatgggttctaccggttcgggaaaaacaacgctgatgaaccttatagcgagattttacgatgcgtcggagggcggagtatatgttgacggaaagaacgtcaaggattatgagcctgatgtacttcgtgcaaatatcggtatgactactcaggaggtattgctgttctcggatacggttgacggcaatatagcatacggcaaatccgacctgccttttgaagatgtaaagaactttgctcatcttgcttcggcatattttatcgagaagatgcccgaacagtatgataccataataggcgagaggggcgtcggtctgtccggcggtcagaagcagagaatagcccttgcaagagccatggctatccgtccgccgatactgatacttgacgataccacctctgcacttgatatggaaacagaggcggagatacaggaaaacctcaataatcttgactttgagtgtacgaagctgattatagctcagcgtacatcctccgcaagatatgcagacaggatcgttatccttgaggacggtcgcataaaggaatgcggtactcacgatgagctgatgaagcagcgtggatattactatgaaatatataccctccagaacggtaatgaagaggaggcggtttaaatggcaagaaataaattcgacgttgtcatcatttttgtatatttctttaaagaagcaggtatagcttcctgtgtggcaggcaggacctgcaggttttactctcacaagcagtgtatcatcgtcgcagtctgcgtgaatgtcgattaccttctgcaaattgcccgatgtagcgcccttgttccagagttcttttcttgaacggctccagaaccatgtatagccggtttcaagcgtcagcttaaggctctccttgttcatatatgcgagcataagcactgcccccgtatcaatgtcggtgacaattgcaggtataagctcggccttcttgaaatatttatcaagatccatctgatttctcctttgatagtaataatcttattataataccgattgatgtaaaaagcaatagtaaacagaaaaaacgggaggttataagcctccctgaattgcttttaatctacacggcggacaggtatattgttttcttcaagatgctcctttacctgagataccgtgagttctttatagtggaacagcgatgccgccagtgccgcagacgcttttgtcttttggaacacctccgagaaatgctcaagcgtaccgcagccgccgcttgcgataacaggtatctttaccacatcgcatacagcgttcagaagttctatatcaaagcctgttttcataccgtctgtatccatagacgtgagtagtatttcgcctgcaccgagttcttcggctttctttgcccactcgatagcgtctatgttcatatctatcctgccgccgtttacaactaccgtccagctgtcgccctttttcttagcgtcaattgccactaccacgcactgactgccgaatatctcggcggcatcgtggataagctgaggatttcttacagccgcagagtttacagataccttgtccgcaccgcttctgagcaactctctgaaatcgtcaacgcttgaaattcctccgccgaccgtcagcggaacgaatacacgctgtgccgtgcggcgcaccacgtcaaccatagtgcctctgccctcgtgcgtagcggttatatcaagaaagcatatctcatctgcaccctgtgcgttgtactcctctgcacattcaacagggtcgccgacttcctttattcctacaaagttgattccctttaccaccttgccgtcacgaacatcaaggcagggtataattctttttgcgagcatatattctccttatttttgagcttcctctaaagcctgctttaaatcaagcgttccctgatacagcgactttccgcatatcgtaccgtaaagtccgagctttctgcaggtgataatgtcatctatcgtatgcacgccgccgcttgctatgatattcgcactgcaagccttgtttatttcgtcaagctgaacggcattcacacccgacagcgttccgtcctttgaaatatcggtaaagataatgtactttacgccctcgtcggacatacgctttgcaagctcggtgaagtaaacgtccgaggtttcaagccagccctcagtcgcaacataaccgttcttagcgtctattcctaccgctatcctgtcgccgtattcctttacagcgtcctttacaagctgaggattcttgacagccgcagagccgattataactcttgacacaccgcccgaaaggtacatttcaacggtatcaaggtttcttatgcctccgccgacctctactttaagccttgtatttttcgctacatcaaggaatatctccttgtttgcggtgcttgcgtcctttgctccgtcaagatcaaccatatgtatccactgtgagcctgcctgttcaaagctcctcgctgtatccatatagctttccgctaccttgtgtgctgtaccgtaatcgccttttacaagacgcacacagttgccgtcctttatatcaattgcaggtagaattatcattcgccttcgttttcctttccttgctctgcggggtcgcagacaacagttttatctgcgtacagctcaacctttccgcactttgtgcagacataagccgtgaccggacttacagctactccgtagccctcaaattcgaccgacacctgagcctgcagcggaagtaatccgcccgagaaaaatccctgcttcagcttgcctccacatgaacatatcagcttatccataagtagctcctttctcacttgccgcttaaagcgacgcaaaagttttaagtattccgagtcccgtcttaccgctcttttccgggtggaactgacagccgtacacatttccgctcataacaagcgcaggcactttcataccgtagtcgcagtatgccgcaacattcttgctgtcggtcacagccgcataagagtgtacaaaatatacataatcaccgtcgtttacgctttcgagcagcttgcacggctcgttcttttcaagcgagttccagccgatgtgcggtattacaagattgtttgcagggtgcataagctccaccgtacccggtataagcccaagcccctcggtttcaccgaactcatagctcttgtcaaacagcatctgcattccaaggcagatacccataagtgcttttttcttcgcctgctcttttatcacttcggtaagccctgcctcgtctagcatcttcatagcatcaggaaacgctcccacaccgggcagtatcagcttatccgccgaaataatatcctcgaccttactcgatatattgttttccacaccgagaaaattcagtgcgttctgcacgctgaaaagatttcctgcaccatagtcgattatcgttatcattataatgttcctttcgtggaaactacagagccgtccgaatttttccttacggctgttttaagtgcataagccaccgccttgaacatcgactctatcttgtggtggtcgttcctgccgtaaacatttttaacgtgaagcgtaattcccgcattgaaagcaaacgcacggaaaaattcttccgtaaggcagttatcgaacgtacccgttctgtcatcggtaaattctgcgtcaaacaccagatagggtctgccgcttatatcgaccgcacagaatgaaagtgcctcgtccataggaacatatgcgcttccgaaacgcactataccgctcttgtcgccgagtgcctcagacagcgccttgccaagcactattccgcagtcctcaaccgtgtggtgtccgtcaacgtataaatctccgtcacacttgagttttaaatcaaatccgccgtgaacggtaagtgccgtcagcatgatacttcgtacaaagaaatttgcaaaaaataaaatgacaatcaatgcaaagtaagtttatcaataacaaaataaacccctctgtaaagatgcagagggacagttatttacctgtacttgttaacaatatttacaatttcattgccgtatttttgtatttttccctcgccgaatcctcttatacttttgagttgttcaggggcagttggcatcagcttgataatttctatcagttcatcattcttaaatacataatatgccttgatgttttcggctttgctcttttcgtaacggtattgtttaagcgccttgtataaaggcaggttttcatagttggctgtattttcatcagccatatttgccaataaggtagcatcgaatccgcttatatcggcagtacataagggtgtggcaacgcattgcgggatagaagcgttatctttcgcaaaagagcaggaaacgggcttatcaggcgtttctttcgctgtttcttgatttatcatattctgatatttagccgtataatttttcttgttaagagtatgatgagccataaagaaatcagccagttctttcatctgcttatccgacatttcgctgatattgttatcggaacagatctcattgatttttcttacaagtccgtccgctctgacgattttatcctttatgtctttcggagcatatctgtaatctataatacttttagtgttagccattacaataagtgaacggtaattgttatcaaaattgttttcaaacaatcctcttgtcaaaaagtttttggtgcctttgcgcatttcttttataagagccagatgtctttcattctgcgttatcgggctgtacatgccttcttgtctgaacgtttttccgtttcctgttctgcgtatgaaattgccattgctgtcaacaaaaatattaccgtaaagatttttgctttcaattagtattgttacttttctggttataataagaaaatcaatctgagcggtacagccgttatgttccaagtacaaatcatgaattatatacataggaatatgactgtttttcagttcatacataatagcattttcccctgctataccgtattttacgaattgcttgtcacgctctataatttgctttgtggcttcgggagcaacgagcagataatattccatctgtcttaactgttcttcggcattgctgtcttctttcagaactatcggtgccgaaagtttgttaaatattccaagtcccattttttctccttttatgtacttgatatatttaaattatatcataattatccgaaacggtcaataaaagctgtaaaaaagccgtccgcaaattaatgcgaacagcttttaaatatcgatttttttgaattactcgccgtatttttccttcagcatttcttcaattctgaatgcgaccttatacacatcgccgcaacccagcgtgattatcatatcgccgctttcggcgttatctgcaacataacgtgccacttcttcaaaggtggggaaccacttgcaaccgggaatcttagccgcaaggtcggcagaatagacgttgtatgtgttcttttcacggctgcccattatctcggtaagcacgactttatctgctatttcaagcgctgaggcgaaatcatccatcagagtataggttctcgaataggtgaacggctgatgtacagcccatacacgcttgaaatcctgcatagcctttgccgtctttaatgttgcggctacttcggcagggtgatgagcgtaatcgtcaacaacggttatgcctccgatagtcgcaagacgttcaaatcgtcttcccgcaccccagaatgtgctgagtcctttattgatgttttcgggggtaactcccgtagcaagtgcggcggcacaggcggctaccgcattaagcacattatgcgcaccgggaacgtgtattgaaatacgttcgattttgttaccgttttccataaggtcaaagtcggtctgaaaatcggatatacgcttgatattttccgggtaatatctgttcttatcggtctttccgaatgtgataatctgcttgtcaaagcccgatgcctttaccgctctcatcgtgttttcatcatcgccgtttacgacaagaatgtcagttgtattatcgcagaacttcgtgaatgacgctctgagattatccatcgtcttgaagaaatcaaggtggtctgcgtcaatgttcagtattatagaaatattggggaacaggtgcaggaacgtatttgagaattcgcacgcctcgcataccataacatcgcttgagcctgcccttccgctgccgcctatagctttcagctttccgccgataacggtagaaaggtctatgttctgtgcaagatacatatgcgtcagcatcgaagatgttgttgtcttgccgtgtgtgcctgatacgcatacagccttattataccagcttgtaacaagtccgagcagttcacagcgttctacggtctttacaccgcttgcctttgcggcgataagctcaggattatcgctcattatagccgcagtgtatactataaggtcagcgccctctatattttcggctctctgtcccatatatacgggtattcccatattgcgtaccgctttgagcgtttctgtttcgttattgtccgagcctgtaagataaaagcccttgctgtgaagtatctgcgccagcggatacataccgcttccgcctatgccgataaaatgaacgtgcttctttcctgtaaggaaatcttccattgtgctcctgtcctttcagtcaatagagttaattatatgcggtcgctcagccgagtatcatctttgctttaagtaaagcgagctgtgtctttccgtcctcgatttcgccgttcataaccatttcaacggctttatcaagcggtatcttcacgacctcaagaaattcgtcatcgtcgaggttctgctttccgccctcaagtcctgtcgcaaggtacatatgcgttatctcctggcagtaggccggtgtaggaatcatatatcccatatatctgaactgcttgcaggtgcagcctgtttcctcctgcagctctctcctgccggcttctgcgtgatcttcgcctgcgttgagctttcctgcgggaatttccataagtaccttctggaacgggtatctgaactgccttacaaacaggacatctccctcatcacagcttgagtatgatctcagctgcaagggtttgattcggattttatttttcgcaataggctctgcattctcggcaggaaaactgtcgccggtggcgacaataaaagcagctttcgacaagtaaaggaatggtgatttcaatgactgctgcatttgttcagctccgttaaggagctcatggaggatctttatgctgataattaaatacggaactacaaaaatcgagttactctatgtagcttgtttttcctttttattccacaagctgttgaaatattatcatcaatttatcaacaacctcgactgcaaatccaaacgttcctgctatccatctaaaatgcaagttaaagagtgcctacaagcactcatacaaaaacaacgggcaatgcccgttgtatcgcatattaaagccgtttactgtcctacaaaaatttgtgcaattttttcagagagatgaaaaaactcatatatgaaaacgaaaaaaccgcataacagagcggtttcagttatatatgagcataaaaaaagagaaatttatgtaaatttcccttgacatgatttatgctttgtgatagaatgtatataaataaaaaacaccacacacaggctgtacagttccggaaagaacgatacagcccctcatcagctcgatgtccgaacatctgactgacttagtgcaatagtgcctttagtgtgctttattatagcacatttaatacaattttgcaagagctttcagaagtttactagacgctggaggctcttgtgtttttaaatttgatatacaaggcgtaaatccgcagtgtatatccccacctgccgcatcaccaaggcagtacaaattgaatagccaactttgtaataacaagactttgcgatgacagccggttctccggtatgggatacattgtatctgctgaatatcagcgagcgaagaaagggcggataccacacgttgctgtagtgctataattcgtgatggatgcgtcaaagtcaaaagtaacaaagcgacggttcaaattgtatatttcacagtggagcagtgcagctgctctgctgtgtgatatatgattttatttacagtttcaaggacacctatagcggtatccttaaaagtgtaaaataaaattttggtgagccacccgggaatcgaacccgggacaccctgcttaaaaggcaggtgctctgccgcctgagctagtggctcaaaagctataaacttttgggttgttttcacaacgtgatttattataacaaatcctgactcctttgtcaagtctttttttaatatttctttacgttaatttgaaaagcgtcataaaaaatagctttaccgaatattcgtcacaagatttttctaaatttattctgctccgattcaggaaagataacgcttcattgttgacacaattgtgattatgtgttacaatatcttctggttagtttcgattaaccctacgatatttttaattaagatgcggtgataatatggaaaacaataaaattaatccactgcttacaggctcagcagaaactatgctacagagtttttacgcaagagccaaatattcaagaaaaaagaatgctaaattttatgacgcaaaggcaatagagcttgtcggaaaaatcgattatgacttttcaaaagcggaaaatgattctacgatgagcaacggagtaatcgcacgaaccatcgtatttgacgaattggtcaaagactttataaacaaaaatcccgattgcacagttgtaaacatagcctgcggtcttgatacaagattttaccgtatggataacggcagaataatatggtacaatgtcgatctgccggaaactatagaggttcgtgacgcaatatatcacgaatcaggcagggtgtctacaataggcatttccgcaaccgatcccgcctgggctgacaaggtaacaaaaagaggaaaaatgctatttataatcgaaggtctttcaatgtatcttacctctgatgaaaacgctcagatgctgtcgattatcagagataaattcgataatgcgacagtgcttatggagtgccttgctaaaaagtgggtaaacaaggaacataccgaaaaatcaattcaggacaccggtgcaaaattcatgtttggtgctgatacctttgatgatttaggtaaagcggcagacggtttcagatgtataaaaaatgacgatatcatccgtggtatgtcagttataatgccggtattgaagccgttcagaaagctaccttttttaaagaaaatcgcacagaagattcttatatttgaaaaagcataaccggatattgtcagccgacctttcagcaggtcggttttattttattgtgaacttaacattcaatcaagaaatgttgattgaatgttaagtttatcgacgtctgaaatttccttaattaagaagttttctattgcattctgtcggattttgtgatattattatcctaataaaatatgccaacaatacggcaaataaaaatttcgcactgcaaaagtgcggtaaggatgagaaatatgccaaaaagacaggacattaacaaaattatgataataggctccggtcctatcatcataggtcaggcttgtgagtttgactattcaggcacacaggcttgtaaagcactcaagaagctcggttacgagatagttcttgtaaactcaaaccccgcaactattatgaccgaccccgatgtagcggacatcacttatattgaaccgctcaacctcgacagacttactcagattatcgagcaggaacgtcccgatgcgcttctgcccaacctcggcggtcagtcaggacttaatctctgctccgagcttgacaaggcaggtgtactgaaaaagttcaacgtacaggtaatcggcgttcaggttgacgctatcgaacgtggtgaagaccgtatcgagttcaagaatgcaatgaaggatctcggtatcggtatgccgagaagtgaagttgcttacacgattgatgaagctgtcaagatagccgaggaactcaagtaccctgttgttcttcgtcctgcctatacaatgggcggtgccggcggcggaatggtttataatgtagatgagcttaaggttgtatgcgaaagaggcttgcaggcatctcttgtaggtcaggttcttgtcagatcggaagagcgtcgtgtagggagcaaggagcaattccaagctgtccacatcatcgacaaacagctttttgattgtccctgtccctttttcctccacaatgccaaggggaagtttctcaaacttctcttgcagagatacccgcagccggaacaatgtgttatatgctgctttatgagaaattgataatccccatccatataaaaccgcctgcaaaacaagacagatcaaaacccctataacacgcaataaaacaaattctgtctcaacagaatcgcccataaccaatggtgaaatgacctgataggccagcacaaaaggcaggacgcccataagaacgctgaccagtacgacaaccgtggccacatacatatttttcttatatggccctgcgtactcaaagatttttttgaacataagccctccttatattgagccgtactgtctgtgcttcaaaaacaagaggccgccaaagtaaagcggcctcttatcattatctttctgtccagtcaaggcggccctgacattcataatttctaaaattcactggcggattcggaaaaaatccaaaacctttttactgccggattcgtccaatggatagctttcttttatttgccctttttccatatggactacatacgaacatcccgccatcaccaactccggatcatgcgtaataacaagaagcgttttgccctgatccgcgagtgacttcaaactccgcgcaacttcccacatatgtttgagatcaagcccgctggttggttcgtcaaacacaatgatctcccggttactcacaatggcagatgcgatcgctacccgctgtttttgcccgccggaaagagaaagcgggtgcctgtctttatattccagcagatcaaactgtttaaggatttcatctgcaacagtttcatcctcgttgtccatgctcagaagcacttcatccatcacgctttcggtaaatagctgatggctggtatcctgcattaccatgtagcaatgtttgagccgggctttccaatcaagggttttcccgtcaacctgcaaaaggccacacttcttttccagtccgcaaatacagcgggccaaagtagattttccagcgccattcaggccgataatggcaatcgtttctccaacaggcagttcagcactcggaatatggaggctttccggttcccgctttttatacgcaaagcagaaattttgaaattccatcagtttagctgtatgcgcctgatactgattcgcgggtttcaacttcgagagagaaaacggccgcagccccatttcttttcgagtgctatccgataaactgtcaaattcagcaggcgtgtattcccgttcaatctccccatcttttacatacagcacacgatctgcaagatcgtgaaggtagtaaaggcggtgttctgcaatcagaattgttttgccctgctttttccagaggctcaagacctgccgcaggtcatcaatagcagccatatccagattagaagatggttcgtcaaggaccataattcccggtagcaatacacttgatgaagcacaggctattttttgcttttcgcccccggacagagcaaacacgcttcgccccatcaaatcttcaatatgataatcggaaactgtacggtcaatccttttcaggatatcttcctggggatagcctaaattttcacaggcaaaggctaattcactatccgtatccacgttgaaaaactgacttttgggattctggaatacagatcccaccatagcagccaagtcataaagcggcgtatctgatacgctttttccgtccagaaggacatcaccctctaaattgccctcgtaataatgaggcaccagcccgtttaccaaacgggtaatcgttgttttcccacagccggattctcccgtgagtaaaacaaattcccctgtgtttatggtgagattgacatttctaatccctccgccgctggattcttcaccataagaaaaagaaacattttgaaaatctatcatggcaaaatccctcctgcggaaattatcggggaagcaatcgcccaaaacactacaaagcaacaaaacaagatcagcaccacatcggcaaaattgaatttaagctggcaaatgtttgtgcgtttgacaggagcaccgaggccacgggtaattgccgcagcggaaagttcctcaccgattttcacggagcaggtaatcatcgggatcagcttatactccaatatttttgaagattttttccctccaagtttaatcccacgcattttcatagcgtcactgattgcttctgactcctgaaagacagttggaaagaagcggaacatgaccgttaaggggatcgtcacttctttaggcatatggattctttccatgccggaaatcaattcactgaccgttgttgttttcactgcataggcagcaatcgcaacactgggaaggattcggcagaagaatcctgttgtaaacagaacgaggaaattcaatattcccgtaaggtgcggtaaaacataaatttgaacagcataaaaagcagaaaacacagcaatatagcccacagcttttgcacattgtttcgaggtaagcagcaatatagccggaaccgtacaaagaacaaggcggatcagccccatagcttctccgcctgttccacccatgacaaaaatgcttatgatgaagatgagcaacagttttgtacgcggatcgagccgtaacccttgttctgtttttttgctgagcagaatttcccgcgccattatgcaataccggcacgctggaagtgctttttgcaaatagctttcccaatcacacctccgacaaggccaaacacaaagcaggcaaccagcagaataggcgcaatccacataggcatatatgtattaagggtagctgcatattcagcgccgtatccttcagtcaacattaccatatagctttcacggttcaggaaaatgggagcaaagttgccaaacacccagatgctgaacacgccgcaggaaagaactgtactctttgcacttttgtagtccgcctttttcaggatcacgtcggccaacaggccgccaacgagaccagttaccatagtaagatatgtttgtgtatgccatattaacgatcgtgacagaggaagatcgtacattatgcagctatgtaacgattgctgcaaagcactttttgttagagcaacaaaaatatctatggaagtgaggataatatgaaaattaaaacgaaaaagaaaaccgttcaacagcttttaggccttgaaactttcggcaaatacggtttgatagccggaaaagccgagtatgtagttttttcgatactaccgtctaacattgccgttatgtctttggaatcagtacaaattaagattgaaaaattaatggatcttcttactgcttttccaaatatacagattttctgcacagatggctgcgaatgttttgacaacaacaaaatatttataagcactcgtatagacgacgaggaaaataacgctgttcgtgaattgctcactaaagatctcgaacatatggaaagtatacaaagcgaattgtcgaactcacgacagttttatcttgtatacagatttcgcaatcaatctaaagatctcgtcggaacgattgtatcccggctggaaaagtgtatgagcgaatacgattttgtttgcaaacggcttgaaaaatcagatttaaaacaatttttagctgtatatttcggcatatcatcatatggtgctgaaattgcagatgtggagggagcaacaaatgaaaatatgtaataaaaaagcggttgagttgacgcctgagcaggaagaagaaatacgcattcaatcatactttgaccgcattacgccgtctgtactcagattttatcccgattattatatatgcggcaataattattgctctgtgtgggcaatcagagaatatgcgccgaaaacgcaggaacaggcaatcttgtcacatattgcagaccacgaaaatgttacgctgaagatatataatcgcccggtttcagcggctgaacaaaatcagattatagaacacgccgacagaaagaataacgctcagaagaacacaacgaccaagcttgctgaagccatagacgctgagagcaatctaagcgatatggtggaaatgctcacagacatacgtcgaaataatgaatcaatggtccatacctcggtgttcattcaattgaaatcttcttcaaaggaacggctgactgagcttcaggctgatatttcaatggaattgatacgttccaaaatcagttacgacaggctgttattacagcaaaaagaaggatttattgcaacccttcctttcggcagagatatgttcggaaacttattcgaacgggttatgccaattagctcagcagctaatctatatccactgaattacagtggtaaaaccgacgagaaggggctgtacatcggaaaagataaatacggcagcagtatatgcgttgattttgatgtcagaagtgacgataaaaccaattccaacattgtaattctcggtaatgcaggtgaaggcaaatcttttctattaaagcttatccttaccaacctgagagaatccggatttgatatactgaacatcgatcccaatgtagaatatgtagagctgacaaataatctcggcggtgtaaatattgatcttatgggcggcaaatatacgataaatcctcttgaacccactccatgggcaactgatgataatcaaactatgcttgaggtcgaggcattcagtaaaacctctgcactgtcacaacatatatcatacctcaaggattttttccgttgttacaaagatttttctgacgcagctatagatacgcttgaaataatgctcggaaaactttatgctaaattcaacatatttgaaaacaccaatcttgataaaatacctcacaacaagtttccgttactcacagacttatatgcggttatcgaagaagaatacaataaatgtgaaaaaggcaaaaaagcattatatcgttccgatacacttcaggatctgctcttaggtttaaattcgttatgccgtggtgctgaaagtaagtattttaacggtcatactaatataaaagacggcaagatgattaactttctgatccgtggtattatggatacaaacgcaaagctccgtgacactatactgttcaatctgctgtcttacattcagaaccggttacttacaaaaggacgtacttttgccggagttgatgaattgcatttatttcttaacaatctgacaacagtaaaatatctgagagccatcatgaagcaggatcgaaaaatggattctggtctgatcattgcttctcaaaatgtcgaggatcttactttgccgggaataaaagaatacaccaaacctttattatcgatacccactcatcaattcttcttctatcccggtatagtatcatccgaaaactttatagatacgcttcagcttgatccggcagaatacaaactgataaacaaaccgtcacgttcacattgtctgtatcgttgcggcaatgaacgttatttgttgaaagtcattgcgccgccgtacaaggcggctcttttcggtactggaggcggtagataatggctgtcagtgtaatcgtcaaagtcggtgtaaaattgctcagcaccaaaaaaggacggcgttttattgtaggaataatttgcgctgtttttatgttattgtttggaattacagcagctgtgtggtttatcattgcttcgtatttcggattaatcggtaatgccatgagcgatgtgttaatcaatcagtcatggtctgatattaataaatatgtagacagtgcgcttaacgatgtcaacaatacaataaacggagaaataaaagaaactacatacagctttatgccggatttttcaatcaatctatcaaaagctgttttgcagcagacgctagaaaaaaacaatgcttcaactatcctgttgtacgacagttcagatatagagaaatacgacaagcttgccgatgaagctgttacaatgttaaaagccgtcaaaagtcagagtgatctcaataaaataaaaaaaaaaaaaaaatataaatatacggatccctttcccggggaaagggggcagggggataggggtagtgagttagaagtttgtttcaaaaacatactttttctacaatctgagcaccacgctgtgtcggggtgcttttgctatgtacgtttactgcatactgtaatagttaagatctatcttgtcatatctctttaccgcagtttcgatggaagttacttcttcgtctatttttacaatcttgccgtccttataaagatacagcgttccgccgtgaaaatcgtctttatacttcataccgcatatcatcgttatattatccttatcaagcacgcagtaacggctgacatcatcttttattgccgtttccttgccgtcttgatttatcgtgagaacgcttgtcggttcttcttcgtccgtgccataggtgtttttgatatagtaaaaactgccgtcaagatatgttatattatcgctgtcggcattttccgaaatcagcttgccgtcaacgtaaatgttacgcatcggtgagccgtactctgtttttgaatatacgacctttttgtcaccggtaagcgttatccgtgttacatttgtatcatcatcgattgccacaggagttttatcagagccgtccgaaaggtcaagtctgtatatctttgagtcgccgtccccgcttgcggtaaagataagggtttttccgtcagcactgatctcacgcatagtaatcaaaacacagcttgcgttaagattgaattttatcttttccgttttatcctttttgacaacgaaaaatccactgccttcggggataaccatcacaggtacatcggtggcacataattcaaagctgtagtattcatagctgtagttatcctgtattttggtgctttctcctttttcgtaatagtaaagtgtgccgtccttagtgtagtacattgaattcttttcggggtaagccctaactatttctgcgttttcaataacgtttttaattttgccgttgtcggaatatatgtaaatatcacttgcaggctcactgtcaatataatagaatttttcgataattattacagaaagattgtccgagcagcttactgtactgtcaccgctgattaactcgcttaagataatttcgttgccttgtgatacgtctgcaagaataaaattgcaatcgtttgtgaaataaccgattctgtcggcactgtcatttataaacagctcatcgctgtcgctacagttttcgccgacctttttcgtcttgccgtctgtcgttcccttgaaaatatcgccgttttccttgatatagactattttactgccgtctgagtttacattgtaggcggtaacatcggtcgctattttatgtggtttgtcgtctttattttcaatatcacgataccacaaatctcctttacttatatatatcagtctgttgctgtcggttgtcagcgtgtatttatcgcaaatgtcctcgctcatacgctcacttgtgccatcgtcatacatatacagcacattgttctttgagtaaataaagcgaggctttgcaggcataatataaccggatgaacctgcggtatcaccgccgtttgtgaacagcagaagaataattgtcacgattgcgacagcgataacggataatgtaatgataatcggtaaagttttaatgcgtttttcggatgatttcataataatgctcctttcgtaaaggcaaaacagtatggcggactgctcttgttatatataatacactacagaagcacgttttgtccatgaaaaagtgaaaaagtgcaaaaaatacgggctgattttcacagcccgtagcagattgtagaaaaagtctgtttttataaatacagactttttctgcaaactaaaaagagccttgccttgcggcaagactcttttgcttttttaccttgaatactatatgcaattaatgcaattattcgcattgttatcaggaatatagaaaaatgtacgaaactcctctgaatagcctgacttaaaacccgaaccgattagtattgccgataaacttagtgctcgtttctcttagcgaagcactcgctgcagtaaacgggtctgtcatcacggggctggaagggaaccttagcctcgccgccgcagcctgcgcatacagctgtgaacatttcacgcttagctccgccgttcttcttagcgtcacggcaagccttgcatctcttaggctcgtttgtaaagccgttctgagcgtagaactcctgttcgcctgctgtgaatacgaaatctgcaccgcagtccttgcacttgagagtcttgtcttcgtacatagtaaaatacctctaaaatttctcacgctttcagcgtgtaataatatgaaaaagacttggtaagtcttatttccccattgattttcttatcttagattttgcacgctgaagtgcattgtctacagatttttcgttcattgaaagctcatttgctatctgctcgtaggagcagtgggcaagatacatttcaaggaccttcatttccttttttgaaagaacgtccgacagcctgttcataagctggctgtcctgaactttatcaataaccgtgtcctcaggcgataacgaatcgtcctttataagatcgaagtcgaagtcttcacagtttgataaagggttatccttgatagcctttgatatacaggttttcatagccgagtctgtgcagagattggcgaaggttacgaaagacgcacccttttcgctgttataaagccgtatagctttaagcagaccgagaagcccctccgagaacaaatcgtccttatcggcagacgggcaacgcattgacatctttgcggattttgccgaaataacgggtatataccgctttataagtacggttgcgtatttttcgccgcctgtctgtgttatccgactgacaagctgttcatcggtcatatcggaaatcgtaagctccgtttctttatccggaaaaggagtaccggtcatattagttgctttttctgccatctgacctccccgataaagctcttactatctttcccatttattttgtttcctttgcacagcagtaaagcaccttttcactgtcctcactgcccttttctgttgtcatataattatatctgtcaagaattctgaagcctgccttatgcagtaattcttcaatttcttcaagcggtaaagcaatctctgaaaaatcctcacaggaacgctcataagagccgtcctcgttttcagtgaaaatatcaagtgcaatatctaccctgctgtctttactgtcactgtcaagataattctgccatacgcaatagacgctttccatatcatacacaaatgtgttatccgcaagcacctctctgtgctttcttaccgtattaatatcaaatacgaaaagtccctcagggtcgcagaaaagcgatacagagctgaagcaacgcagtatatcctctttgctgtcaagatgatttatgctgtcaagcacgcatacggtaacgtcaatagtgccgtacatatcaagctcgcacatatcctgacagagatactctatgtttttgtgcggtttttcctttgctacactgagcatttcggtgcttaagtccactccgataacatcatatccgagagcagaaaactgcatcgacatactacccgtaccgcaggcaaggtcaagaagtatgccccttttaccgccgtgagaagtaattatcctgtcgtaatacccggcaagctccttatagtcgatattggaagtcagcgtatcgtaaacgtccgcaaaacaaccgtatgccgacatattatcaccctttcggtcaatcgttatccttcattctgtcgaaaacgatggagtagccgtcatttccgccctgtaaagacctgtttacacggcttatcgtggcggtgctggctcctgtttcttcgactatatcgctgtacactctgccctctacaagcagctttgcaacgtgcagacgctgagccattgattcaagctctcttatagtgcataaatcctcaaaaaagtcgtagcattcttcaatacttctaagctccattatcgctttgaaaagctcgtctttatcctttgaaacaagttttgtgttcattgcgtttccctttctcaaaagcaaataggtaaaatacctctataataatactactattttatcactctaaagtataaaagtcaacacttatcctttttattacaattctatttcaaaaagccttgccgtgaagcattcgggcagttttacagaaagcgaccttgaaagcggattgaatttatgcccgccctcgtcaaaggacgggtatatgcagttcacctttgcattctccgttgcatatcttatcggtatattacagcactcgttgcttccttgtctgcgccaaaccgcaagataggctttatttcctgctttaagacccagtgttacccattcgtcaccgatatgagataatcccaaaggccaaaacggtaccgatctcttgatatcatcacgaatacttttataacattcaagcgcttcttttacaagtgacattcgctcggggctgagatttgcaaggtgtccgctctgatggatacgctgtgtcatagcgtttaccatattgaacacaacctcttccctatcgccgtctgtcagcggatatgaccatatagcgctctgttcggggcaaagacctgtcggtgcgtttgccgctattgtagcatatcttctgtaatcgtcctgatcgctcgtcgactgtatcgaataacggctgagcatagcatagtctattctcataccgccgcttgagcagttttctatgataagctccggataacgtgcaaacacgccgtcaagccacgcaagatatgccttttcgtgtcgcataagtccttcaccgacactgtcacagttaatctccgtacctatgcccggttctatattgtagtccatttttatgtagcctacaccgtaatcttttacaaggcggtcaattacgctgtcggcataagcactgacttcgggatttgaaaagtcaagctgatagcgtgaacgatcgtatacacgcttgccgtgccgcataaagaaccattcgtcaggcactttctttgccatttcgcagtttatgcccataacttctatctcaagccatacgcccggtatcataccgtatttcctgatttcatcggtcacctttttaagaccgttcgggaagcggcggcggttttcctgccactcgcccacgctgtcccaccagaaaccgtccgcataccagccgcaatcaatgcagtaatactcgcatcctgcttctgcggcggcttttataagcggcatttccttttcttcggtagggtcgccccaaaggcagttcatatagtcgttgaaaataaccgccagcttttcgttatcggtattctttctgcgtatcgcacggcggtatcttgtaagctcgcccataccctcgtcaaagtcacggcatacgccgactgcaacaggaactgacgtaaagctttccccgggagcaaggttcttgaaccagtgagattgctgttcgttaggtccgctgagcgcaaggtaaaaatgtcctctctggtcgcttatctcccagtgccacgagccgttatgctctatctgccagaaaagcccgtttcctgtttcagtgttctgaatataacccataggtagatattcgtttgttgaccagttacctacatttgttacatttatcgccttgccgcagtgttcccagccgtctttctgcgactgcggcataccaagctgttcaaaggtatagtcctgccacagcatttccttctgccacgaattatgcggtatctttataataaacttatcatcacggggaagaatgccctctttttcaaaaccgagatagttgaacgatgaaacataggtcagcgtgtatgtttcggtcgcagacgtatttctgacttccgtataggtgcgtactatgcttatgcctcggtaatatcgtttatagtaatcttggtaagcggttttttcagaagaagatttttaagcgactgctcgagtgcccttttagttacctcagacattttaccctgtttgcaaagtaggtggtaactttttattatttctctaatttgtatccatatacatattttcaaatgccattttcaaacttgtaggataattttcggtcttgtatctgattaattgtgcttctaatttttctatctcaactcttaattcttttttcttagcgaaagataaaaagccaagattttttaattcattacgtttaagttcgattgcatagtattgtttttttatttcagaattgaatgtttgtttagcttcttcaaaggattttttcctttcgttagcttcggaaatatacattccaacgcatttattaatttctttttcatattctttatttatactaggcaaatctgtttctttgctttcttctaatcgtatttgctcgatgcgcaacgctcctatatttattaatttttcaattttttgttcagtgacaattttattaatcgtcatattgattatatcgttaatttcatcttgtgattttcgtattagatcttccgtgttgctagaaattgtttttcgcatccattcatctaaagcttttttatctttcaacttcgtcaaactgctcggtatcgattaagcatcttactcgaagtatcattgcattgatgtctgtcggatccttcagaatattatttctcagctttttaataactgagccatactgatcttgccaaccatccaagttaagatcacgcattgctctcgcttccgtgtaccagccgagttcaaccatagagggctctttgctcttttggagttctaacgcatagtacattatctttcgttgatcatcaagcagtgtatatgcaccaatgtacatacgattgattctgtctctgtcctcagcagaaatatcaaacgtttcatcagtgagtttgtattctccactgtcagattttgattcctcagtcggagtgatatatgtaccgctatttctcattgcttccagttgctcaacactcaactgttcgtagcgataaagattagcgttcatctcatttaagattgagttaggatctatctgttgaggtgtatactctccaaacagaacgccgttgttataggagaacattggtttttctgtcgcagtcaagcactctatgaccttatccgcatcttcaagctgaaggtagagatcggcggcagttaaatagcactcgacaacatcagcaatactcggtttctcttttttcaggaagtgcttaatataagctaattgctcattgacttcaatcataattttatctcctaaaatttatcaatgacttatatttttttcgcattcattaaaccattcttcgactaactcaattacatccttatcataaacatcggttgcattttcataattgtaatttgagtcaaatgacttagagttaacattgtatactaatttgaattcgtgtggacactttgcattataggtatcacaaagctcaacaatgctttctatatcttctattccacaatgaaagaattccttaatttgagcatctgaacaccaatcattggttgtgaacaacttgccatctttctcaaaaaatgcgtcaatatactcttcgtcatcattttgtaatatgtatacatatataacgtctgcactcttttcagaattcttaagtaattcaaggcaaagcgaaataacattagcttgtgcatcaacaaatgcatcttcaaaaccttttaacataacagatctccttattgttagattttaattatttgtttttattattagtttttattattttcataagcgaatactcgtttaatatgtcattgatatctttagaatataaaaacttaatagtctcaatttctgtttcatctcgtaataatgcaagtatttttaacaactccggatttttttctatgttttccaatcgttttttgcacaaatctatgactagtggattaagaaaggtttctaatccgaattcttttgcagtagcaaaagaatcaacatcataaataccaaactcgagcaattttgcataaatatcaggattatatggacaacttttgaaagaaagctctaaaactggaattttatcttctaccatatctaaatttttaagaagttcatttgatctttgaatattaaacattctaactttagaatagtcaaatatccccttagagtcaagctttaatagaaaaatttgaagcaattctgatacatattctccaaatgcttctgcaatttcttcatatgttttagccattacagcaacatcttttttgcctcttacagatgaatttctggtagtcatttcatcaaatgctctttcgaaatctttgtcagcatttttaagctgtttttttaagtattagcttcaagtgccgctaaggtcatatgtgcaactaaactacttgaatacatagaaattcctgttcctgttacttgggagtacgcagaacgttgcacattatcatatccatctataaacgattgtatttcctctgcaagattgctacttaaccctttcatcatatttttgtatgcgtcaacgtattttaagtatcctttattattttcgaatatatcactatcggttatgtcgtatacgccgtattccgatagcatcgatataatctttttgccctcattgtgcattttttcttttaattcattctcaatcgcaccaacctgacagggcttcccatctataatagaagatatttgcattgtttccaatagcgcatttgataaaaactgactaatttgactgaatttatcgcatattttgagatactcttttaactcactgggtagtgcgtattctccgcctataaacttaaccgaaaaatctgacattcaaattttaccttcggcaaggatgccgagatagaacgcccaaaggctttgcaggacgcaaagcccacaaagcgttcttatagggatagagaacaagcacttttttgaaaaagcatactttttctacaagctgagactgccctgcgtataaaaacgcagggcggtcttttgaaataacgcagataaaaacctccgcattgcttaataatgcggaggtcgatttatttacttgttatccttatcgggcttctgatgagtaaacggtttgtgaaactccaaccccgtttcagaaagattatcggtacgcttaaagcttccgtcatttctgacaagcgaggttttagggtcagccgtactctttttgccctgagataaagtaccgtgtttcatataaagccctcctttaagggagtagttttagtgaaatcggattattatacacaaccctgagccttcatagcctcagctacctttaagaagcctgctatgttagcgcctgccatgtagttaccctctaagccgtattccttagcggctgtgtcgcactgcttgaagatttccttcattatatcgtggagcttagcgtcaacttcttcaaatgtccagctgtaacgcattgagttctggctcatttcaagacctgatgtagcaacaccgccggcatttgcagccttagcaggtccgtaaagaagaccgtttgaaaggtaaacctcgatagcttcgggagtagagggcatattagcaccttctgcaactgcgaagcaaccgttgtttacgagagcctgagctgactcgccgttgatttcgttctgtgtagcgcaggggagtgcaatgtcgcacttgattgtccagatgcctgagcagccttctgtatatgtaacattcttgtgtgatgttctgttaacgtattccttgatacgctttctttcaacttccttgatctgctttacaacatcaagctcgatgccgtcgggatcgtggatgtagccgtttgagtcagaaagtgcaactaccttagcaccatactgtgtagccttttctgtagcgtagatagcaacgttgcccgaacctgagataacaactgtcttgccgtcgaagctcttgccgttagccttgagcatttcgtttgtgaagtagcaaagaccgtagcctgtagcttctgttcttgcaagtgaaccgccgtatgtcagacccttacctgtgagaacgcctgagaattcgtttctgagtctcttgtactgaccgaacatataaccgatctcacgtccgcctgtaccgatgtcgcctgcgggaacatcgcagtcaggacctatatgtctgcaaagctctgtcataaagctctggcagaaacgcataatctctccgtcgctcttgcccttggggtcaaagtcagaaccacccttgccgccgcccataggcagtgttgtaaggctgttcttgaagacctgctcaaagccgaggaacttgatgataccgagatatacggaggggtgaagtctgataccgcccttgtaaggtccgattgccgagttgaactgaattctgaaacctctgtttacctgagtcttgccgttgtcatctacccagggtacacggaacatgatctgtctttcaggctcaacgattctctcaaatacgcctgcgtcaacgagatcctgtcttttttcaactacgggctgaaggctctcgaaaacttctgttactgcctgaatgaattcgggctcgcctgcatttcttttcttaactgtttcgagcaggtcgataagatactgattttttaacgccattgttaaatcctcctgatattttcggctcaagtgtgatatacattggttttacggataaacacggtttttctgcgtttcatataataatttgtgagaaaaccgacttcatcggtaagctttactgcattctctgtgactaaagccgttattgcttttaaactgcaagaaaaagtataccacatatacgcaaaatttgcaatagtttttttaaaattttcataaaaaagtttaaaaaactcaaaactacgcatttaaatgtgcatttccgcaagattttattcgtgttattgcaaaatgcaggaattttttacaatgtgaatgtaaattcgcttgcaaaaataccggttttatagtaaaataatatttataccttatttaagaaaacgaatatcggcattttgcactgccgatcatacctttatatataagaaaagagaggtcacaatggagaaaacggcacttaaaacgattgcagacaacagaaaggcaaggcatgattatttcatccttgaaagctacgaggcaggaatagagctgaccggcaccgaggtgaaatctatccgtgacggaggacttaatctgaaggacagttggatttctatcgacaacggcgaattatttatcaagcagatgcacatctcgccttacgaaaagggcaacatattcaacaaggatccgctgagaaccagaaaactgcttatgcacaagcgtgaaataatgaagctgctcggacaggtaaagcaggacggtttgacgcttatccctatatccgtctatttcaagggcagcagagtgaaggttcaggtcggtctttgcaaaggtaaaaaacagcacgacaagcgtgacgctatggctcagcgtgacgcaaaacgcaccatcgaccgtgagctgaaaatgcgtaacagataaacctaaaaacaagtcggtttgtcggagtacaagattttttggaaaaaatcaaaaaagtgcttgacaaaccgattttattctgctataatagattatgctgatttgcggggatgctggaatcggcagacaggcaagcttgaggtgcttgtgtcagtattggcgtgtgggttcaagtcccatttcccgcaccagtgtaaaggacattcaaacgatgccgcaaacggcgatggctttccgagcactgtactcattgaaattaccgccgccgctatcattacagccgtacatcttattaccgaatgttcacggatatctatcttatcctttgttactgtccttgacatttcaaacttcctttcgcaatcagacatcagtcaccgactatgtaattattttacagttgtccgacagcgttttttgtcgcaacgggtaatgatattacgcaaaagaaaggaggtgctgtcgtttacggtataatgcgatttcaagcgattatatccctgttttaacgacagcaaaaagcatttctctgttacgacatatttttccgctaaattttcacgaaagtaatgtcagggcttgattttgtatagcataggtgctaaaatcaagtaataaggaggaattttctatgaaaagaattacaaaaacagcagttctaatcttatcggcacttatgctattcggatgtgccgacagctctgtagatgccaaaccgcctgtaaccgttgcttccccgtcaagcacttccgaagctctgccggaaaagccggcaagctcaattacagatatatcggccgaaggaggcaaccccggaaatccggaatgctttactctgaacattactatctcagaggaaaaatattttgtcgataaccacgaaatcacatttgaagagctgaaaaaggatatagacagccttaaggaaggctcgacagtaaaaatagaagacgaaaactcaacgctcaaagcattcaacgccgtaaagaattaccttaccgaaaaagagattcccttcaaccttgattagaaagcagcataacgcaaagtaaatttcggtagcacaaagtcacactgtgtcataaaatgtaaagggtacccgaataaaaaatactttcaaggaggaaaaacaatggcaacattcacaaacgttgctaccctttcgtataacggcacggtagtaaattcaaacgtaacaacaggcgagatacagcagactcttgccgcaacaaagcattcccttgcaacgacctacaagcaaggcgacactctgacctatatcgtgaatatcgtgaacacgggaaacacagcgtttacaaatcttacgttaaccgataatctcggcggttacacctacggtgcaggaacagtttatcctctggcatacggcggagatatacgctattatatcaacggcgcattgcagacagctcctgccgtaacggcaggtccgcctatgacaataacgggaataaacgttcctgcaaactctgaggcgcagatagtatacagtgccacagcaacggcttatgctccgctcaatattgaaggcagtataaccaacaacatcacaataacgggtgacggcattacagaacctatcaccgccacagaaacagtaaatgccgcatccgctcctgcgcttgatattgaaaaatcgctcagcccgacaatagtaagcgagaacggtcagataacctacaccttcactgttacgaacaagggcaacaccgctgtcacacaggcagacgatattgttctgcgtgatgtattcaacccaatactgaaaaatatcggagtaacctacaacggcaccgttctcagcaatacactctacacttacaatgaggctacaggcgtgtttgaaactaccgcaggcgctatagaagtacctgcggcaacatttgtgacaaacacagacggtacggtttcaattactcccggtacggcagtaattacggttacgggcaatatctgagcaaagcacggataaacacacatcgtccgctgtatgacaatcaaaaagcaatagatatgaggcggtacggcaaatgtcgtgccgcctgcattctgtcgaaaaacctcctgcttatttaaaaaatggggtcgcaggggcggtgcccccgacagggactaggggcggtagccccagtaatatagccccttcccacggggaaggggtttggggttagggatagataatttgctctattttataaaaaaatagactaatctgaggcggtacggcaaatgtcgtgccgcctgttcgttatcaaaacataaaaacaaagaactccggctgttacaccggagtcctttgctttggggaaatatatatgaaaatcgaagatagcaatttaatctgtcagcttgtttacttttctgtttcctcgctgactgtggttatataataatgcttgttcgtgaaattaaaagaatagttttgtgtaaattagatgaaaagtgaagatgaaatttgtcaaactttcacaattctacattattacaccgccgccgagtacaatatcgccgtcatagaacacaacgtgctgtcccggagttaccgctcttatcttttcatcaaacacgaccctgaccgtatttctgtcttgcggatatacggtacacggctgttcagtctgcctgtaacgtgtctttgccttgcatttaaactcgctttcgggatattcaaacgctatccagttaagattatctgcatacagcgtatcggtaaaaagaagctcgttactgccaagcgttacggtattattatcggcattttttccgataacatacatcggtttaccaaatcctgtgcctattcctctcctctgtcctatcgtgtaaaatataacgcccttgtgcctgcctataacgttgccgttttcatcgagaaaatcgccgtcggggtaggtaccgcccgtataacgctcgataaagccggcataatcgccgtccggcacaaagcatatatcctgactgtcgggcttgtcgctgttgataagtccgctgtcagccgcaatatgccttatctcgtcctttgtcatttcaccgagagggaaaacgcttgcggcaagccggactgtttcgtgagcaacaccgcatttttatgcggtaaaatcggctacagacgattttttgtccgaggttgttataccataaaatcaagtcggtgtaaaccgacacggcagtacgccgtattttgccgtcagacaaaatatttaatcattttttatgtcaagaaaagcaaaacggtcggcatctgccgaccgttcctttatattccgttataattacttgcttataactacgttcagaccctctgcactttcaactgtgaagtgcttgtctgtagctgtatgtgtaacagtgattgtatcgccgtttctctcagccataacagtaagctcgagcttagcgtccttatcgtagatcttgcactgagtgttcttgccgtcctcaagctgatagataacgagcttagcaccctctacatagtcatatgcgaagttacgctcaaagttaccgtaagcgattatgctgttgggcttagcatacatacccattgagaagtagtcgtacttcttgtcgtaccagttaccgccctcaagaacttctcctgtctgaatatcggtccacttgcccttaggcagatagaactgagcggttccctcctcgttgaatacgggagcgataagcaggttatcaccgaacatatactgtctgtcaagaggtaagcaggcaggatcgtcgctgtattccataaccatagctctcatcataggaacgcccttttcgtgagcctttactgcgttagcgaacagatacggcatcaggcgacccttgagctttgtgaagtgacgcagaacgtcgcacgcttcctcgtcaaagttccacggtactctgtatgagctgttgccgtgaagtcttgagtgtgaagacataaggccgaatgcagaccatctcttgtataagtcgggtgagcctgtagcctcaaagcccgaaatatcgtggctgaagtagccgaagcctgataagcagagtgaaagtcctccacggagtgtttcagccattgattcgtactggctgaagcagtcgccgccccagtgtacagggaactgctgaccgccgaccgtagcagaacgtgcgaacagacaagccttatccttgccgtagaattcctcaagcacctcaaatacgcacttgttgtagagatatgtgtagtagttgtgcattctgtaaggatcggagccatcgctgtatacaacatcggctgtgggtattctctcaccgaagtccgtcttgaatgcgtcaacgcccatctcgcacagtgttctcagctttgccttgtaccacttgcaagcttcaggattcgtaaagtcaacgatagccataccgggctgccacatatcacactggaacacaccgccgtccgtcttcttgatgaagtagccgttctttacgccctcgtcaaataaggaagactgctgagcaatataggggtttatccatacgcagatttcaattttcttttccttaagacgtgtgagcatagccttgggatcggggaacattctcttatcccaggtgaagtcgcaccagttgaattccttcatccagaagcagtcgaagtggaatacctccagaggaatatcacgtcttgccatttcgtctatgaagaacgaaactgtttcctcgtcatagttcgtagtgaatgatgttgtcagccacagaccgaatgtatatgcaggaggaagtgcaggcttacctgtcagcgttgtgtaaacgccgagtacgtctgcgattgtcttaccgcccattacgaagtattccattctctcgccctgaacggagaaagcaacctttgaaaccgtttcgcttgctacttcaaatgtaacgttctcagggtgatttacaaatacaccgtagtttcttgatgatacatagaaggggattgacttgtatgtctgctcggagcaggtaccgccgtcgttgttccatacttctaccgtctgaccgttctttacgaatgtagagaacttctcgccgaagccgtagatgttctcgcctacggagatgttgagcatctctcttattcttgcaggctcgtctgtagatgcgtgtgcgtagaaacgctccgcctttgtgccttccatacggtagtctgtgagccagggctgttcttcgatataagaagttgttctccagccttcctttgtgagcagctttccgtcatagaagtattttatatcccacgctccgcctgccttgccgattcttaccgaagtcttgttcgaaacaagctcccagtactcgtccttctcgtttataacaggcttgaagtttgtgtcctcatataatgtgaagtccggacccttctttacagcacccttgtaatgctcaatcgtaaccttgattgaatcggcaagcgtagatgtaaaggtgatctcaagaacaggaccgccaagcgtcattcctctgttaccgatccactggttagtggcatatacggttatcgagttgtctgtagcctttacctcatagatctgagttgcatagtttacgtcgtagcccgacttgttcatccagaaaccgtctgaatacttcatagattatacctttcctttcaaaacggcggtcacgcttccgccaaaatttactttccatacgggtattcccccgctgcttctcgctaaacgaccctctgctcacggcgctttgcgcaccgcacgcctcacaaactgttattgcataatttgtaacttgctatgtttttttacaaccgtcacagccttctcagctcatcgcaacctgtcacagcctgccttgattcatcacagcttttcacgacccatttcagcctgccttgatttatcacagcttatcataacttatcacaatccgcaacgttttatcgccgttcgtgcgtttaacggcggatacttatcatctgaattgtaaaggtacaaatccttcagcaacaattcatcatcttcaatcgcatattcacaccaatatccccgccaacaagcagtcgaactggcatgtggctccattccgtaattctttgggtcaaacagcatcacagaagatagagccacgacggtgaactctttctttttatatttatatatatcaccaatttgtgctgtcattcgtaatccctccttacagcaatcgcccccatcctgaagatgcatctccgcccgttataaatccaacaattcccgttttgcctattcattctgatgtcgcttttaaataaacaattaattttgtaattgaaatcacaatgccgtattgcaaagtaatcagcaacgaagccatccacgcagacatagcaggatgagattgttgccagaagccattccattcacccgtaaaaagaaacatatataaggcaggcggagaataaaccgcaaacaacagatacataaccggaattgaaaacaacaactgttttacatttaaatcaaggtactttatcacaattattgtcggtatacatataatcaataattgtatcaacatatgaactataaatccaagccaaaacggattggaaaaagaaagaaacagattcgccaaataatttacgattatgccgttgtataaaactgtcaaaccccatataaaaagagctaataatacaaaattgcattttttcaacaatttcatttaatttgcctcctttgctgtggtgcagcaaattatttgtaagtgcgaagtacataatcggtttctgcaatcaattccaactatacggatttgactatccggattctttgcaccgcatttaaactcaatcaagtatctcaatagaacttatttcatcggtcctataataataaccgtttgtaagccctattgttgctacgccttcgtcgctatcatcttcgctttcgtacagaatagccgtttcgatatgaactgcgccgtttgtttccgtcagcttgactttgtgaaactgagcattgtatagcgttaatgaatcaaccattattttttatttcctttcagtggtgccgcaggtacaagatgtgttccgttttttgagtaatgtatcgttccccaccgttttaccgcccttcaaatctcaaacgaacatacagatgaagctgatttaatgacggttttactaccctataaatttacactactctcaaaccggagcgtgcgcttgctaagctgtttttaagttttactaccctataaatttacactactctcaaacgctattcttcagaaagtatcggaaacgcacgttttactaccctataaatttacactactctcaaacaaagaaagaaatgagaaccgtacagacagtgttttactaccctataaatttacactactctcaaaccggcgatgcaccatattacggatgtagcgagttttactaccctataaatttacactactctcaaacattcgctcagagtttcgtgagccggtcttcgttttactaccctataaatttacactactctcaaacagcagtacaccgaagcccacggcatacgcagttttactaccctataaatttacactactctcaaacacgcctggcggatggaacagacacagcccgagttttactaccctataaatttacactactctcaaaccgctgtcccgtatcttctgtgtatactttagttttactaccctataaatttacactactctcaaactttttcaatttcttcgtctgtccatattatgttttactaccctataaatttacactactctcaaacgtatcatgatctttctgattctgacaaacggttttactaccctataaatttacactactctcaaacaaggacccacctgtcacagtacaatttgtagttttactaccctataaatttacactactctcaaacccgcttacaaagcttatatgcggtatatacgttttactaccctataaatttacactactctcaaacttatcgacatcctttaagtgggtatgatccgttttactaccctataaatttacactactctcaaacgagaatggcgtaaaagtaaaaaatcctaaggttttactaccctataaatttacactactctcaaactgaggaggttgagtctgttttaaatgcaaggttttactaccctataaatttacactactctcaaacgcataacctacggcggagaaactgtgaaaagttttactaccctataaatttacactactctcaaaccgttagccttgttgggcttcggcttttgcagttttactgccctataaatttacactactctcaaacatatcccggtgatatgctgctgtcggaaatgttttactaccctataaatttacactactctcaaactgtgggcgcagatatatctccttgatgaaggttttactaccctataaatttacactactttcaaactatgcaagagaaatggcataaaaaagctaagttttactaccctataaatttacactactctcaaactggtatagtgccaccaccaatattatatcagttttactaccctataaatttacactactctcaaacctcactgacaacgccctcaatctgatatgtgttttactaccctataaatttacactactctcaaacgtgtcgtagtaccccccaagcattttcccagttttgtcaagagtaacatggtttacactttgtgcaagcacatggtttacatgttatcaataacaaacgaacataaaaatgggtccgcaggttagtacatatatctgaggttagcggcgtttttttaagggtaaatgtcagtgcagttgtaacgatacactcacgaaattattaataccttgtcggtactgaaactgttttcggctgtgttggtgatatatttcactgcgtggttttaacaatcagttttcaaaaattatgctttgatattcagaacgtgtcctgttactccggcaggcggaatatcggcgctgttgataagatcaaccacctctgccccgctttgctcgatgctgtcgatgctctttgacagcattgctgtggaaacgctctgtgctacgttggcctgtgccatactgacagacatactcgcaatgtaagaagtaagatccataataagacctcctttaagctatcaatcggtaatgatagtcttttctcttatctctttttctaccatatcgcagaaatcagataccgacattgtaccgatatcgccacgcttgcggcaacggatagaaacgttttctgtttcaacctccttatcgcctataacaagcatataaggaatcttctgaagctgtgcttcacgaatcttgaagcctatcttctcgcttctgccgtcaacctctactcttatgccacgcttcttaagctctgcggcaacctttgatgtaaactcgttgtgacggtcggcaataggcataagctcaacctgtacgggagcaagccatatcgggaacgcacctgcaaaatgttcggtcaggataccgataaatctttcgatagagccgaatacaacacggtgaatcataataggtctgtgcttttcgccatccgcacctgtgtattcaagttcaaatctcataggcagctggaagtcaagctggatagtaccgcactgccacgttctgccgagagagtcttcaagatggaagtcaatcttaggaccgtagaatgcaccgtcgccctcgtttacaacgtaaggaagtccaagactgtcaagagccttacgcagaccctctgtagccatatcccagtcttcctgactgcccatactgtcttcgggctgtgttgaaagctcaacgtgatacttgaatccgaacagcttgtaaacctcgtcaataagtcttacaacgccctttatctcgtccgtaatctgatcgggagtcataaagatatgtgcatcgtcctgtgtgaagcatctaacacgcataaggccgtgaagtgcgcctgacttttcgtgacggtgaacaagtccgagttcgcccattctaataggtaaatctctgtatgaacggggctttgacttgtatacaagtattccgcccgggcagttcataggctttatggcaaactctgtaccgtcaattacagtagtatacatattctctttgtaatgatcccagtgacccgatgtttcccaaagctgacggttgagcattataggagtggaaatctcaacatagccgtcacgggtgtgtatctgacgccagtaatcaataagagtattcttgagcgtcatacccttaggtaagaagaacgggaatccgggaccctcgtccataatagtgaacagctcaagctccttgccgagctttctgtggtcacgcttcttcgcttcttcaatcatattgaggtatgcctcaagctctgatgccttggggaatgctgtggcatagatacgggagagcatcttgttcttttcactgcctctccagtaagcgcctgtgcaacttgtcagcttgaatgcctttacatagcctgttgacataaggtgaggacctgcacataaatctgtgaattcaccctgcttatagaaggatataggttcgttcttgcctgcgtgttcctcgcaaagctcaaccttgtaaggctcgtcaatctccttgagatacttaatagcatctgcaggagccatttcaaactgttcgagctttaaatcttcctttactatcttcttcatctctgcttcgatagcctcgagatcttcgggcataaagggagtatctttatcaaaatcgtaatagaatccgttatctatagcaggacctatcgccagctttacctcagggtaaagtcttttgacagcctgtgccagaatgtgagatgcagtgtgacggaacgctttcttaccgtcttcatcgtcaaatgtaagtatttcaagtgtgcagtcgctgtcaattacagtacgcagatccttgatctcgccgtcaatctttgcaacgcaagccgcctttgcaagacgagagcttatttcctttgcaacgtcaaatacggaacaagcactttcaagttcctttacgctgccgtctttcagtgtaacttttatcattgtttttcctccgttaagccgccatacgagagcggtctttggtagtgtataaaaacacaagttaattataacaccgcaataacaaaatgtcaaacagttttgaaaacaacatcaatatttgccttgcgtgcctgtgagtgctgaaattttctttctatcctgtaaagcctgccgtctttgacaaaccttgcgcccgtctgacgaaaatgaaagtcaacgcctgcatctatgcactgctctctgatgctgagaatccagtcataattacattctctcgcttcgtttccggattcgccgccgacaaccacctcagttatctgcgacttatcgagatacgggcttaaatcaatatgttcgagcaaaggctcgcatataatcgacttgtgttttatcggggctttaagaaaagatcggaagagcacacgtctgaactccagtcactccgcgaaatctcgtatgccgtcttctgcttgaaaaaaaaaggaataacctcacagcttgcaatctcgtcaagccatacgaaaggactcattccgcctatgcttatatcctcgataatccagccgcttgccgcataggaatcgttagcgcacatataaagagagaatttgaacttttcttctctgtcgtccttgaacagaccgacttcaaagctctttataacgtagttgtttataatgcttgattcaaatccgcagcaggagcaggttccgccatagccgaacatcgtgccgttaatatcctttgcaaaatagttgcggtaaacacgcaggtttgaaaggctgcggagcgacttgtatcttgtacgcaggtactgaagctcctcagcggtaattgacggcagaggcttatagtagtacggaatctggtcaagaagtacctgattcggttcttcggtgcttgagtagaactggctgagaacgttgttgttctcgcctaccagcagatattcgacatattttgcaaattcgggtttggtgcagtcgtcacggagtataacatactttgtgatgctctgacgctcctcatcgcttatcgggtcgtttatatctatgatacggataatcttgtctttttcgccgagaagtgcgatacggggaattttaaggtcgcagatataaaggttaggcatagttgccgataccttttcatccgtcagattgctctcacgcagaaggctcataagcgaagccttttcgaacgaatagccggacttcataaacgggaagtcgaatacacgtccgttgaacattccgcagttgataagcgcataaacgtcgccgattatctcaagaaggtcggcgttggtgatactgctcggtatcatgaactgtttgccgtatgcggcaaatctgaacttcttgttaatatcaagctggagcgtgatgtcactgccctgcgatttcatctcacgcaggaaggtcatagtatccttgccctgtgtgaagctgtttatcagcatatttatgacttcgttgtatatctggtgattttcgaagctgttcttgtgcgccacaatgcagtcataagcccgcttgagattatgaactgtcattcttgcaacgtcgaagttatgggtgatgtcacggtagtggacgttgaactggaagtatctcattcctatcttataatcctgaccgtacatcgtatcgaacagaccgagcgctccgataagtgcgtcctcatcggcaacagcgtcatttataacatacttgccgagcttaaggctgactatacttctaaagccgaagctcaaatcgaagtctttgatagcgggattcctctcgctgtcaagaacgtatgtattaccgtcaaaattgaagttgtagcagaactctctgccttcctcgtcactatcctcgtcaacccacttatagcttgccattatgatgttttcgggcatatccgatacatccttacgcatcttgacaagctcgtcttcgatatactctgtaaatgccgagccgttctcatgctcctgctttgaaacgtggtctgtgagcgagaagaagccaagctcttttacttcggaatacggcatagcctcgctttttccgggtaaaagcagtgagatgctgttgtgaaaaacactgcgcagatcgcctaccataacgctggtagaaagataattgctgaagaattcaaacacatagtgcttcggacgcatataatatttgtctgaattcgttctcggcagcagctcgataacgaaatagcgtgaatacttttcaatcatatatttgagatcacggtttatagcttccgaaacctcctcctcacattcgtggcggatgcctgttctgtgagtggtaatatatgagttcggcacactgatgaagaatgccgacagcttttccttgatgaaatcctctcccgttgacttgataagacctgtcagctcataagtggagaagtagttatatttatcaagcaggacttttaccagcgtgtcacgctttgcggaagaaaccgcaaacggaataagatatacaaagccctcgttttcgtgccagataaattcgataacgcttttgccgttctgtaagaaacgcactgtcgggtcatcgtccggtgttttctgataacggataaccttatataccgcaagaggcttgcccatatccataacggcaacattgaacgtgcggttgggattttctgcttcaccgaatctgccaagctgcttctttctgataaatgcaaagcagaattcgacaagatttatatattcgcccttgtggatagtgaggtttacgaggttttccttgatcttagcctgttcttcttcggaaaccttgaaaacgatctctgtacccttgaaaacgggtgcggtaaggttaagctctcttatcttgaggatacctgcatcgtttactattctgaaattgaagttgttcgaacgcagcttcagccactcaacgttcataaatacgctctttgagcctacgccgaaacgtccttcacgggatttgtcgccgtcgcttctgccgatactgagataatagagtatctgctcaagcgtaaagccgtcctcgttgtatgtgagccttacttcgccgtcctgctcaaagttgaaaagaaccttgatgtcggggtcggagtagtaacagccgaatgtgttctgtaacagctctcttattatcgattccttcggatagtcgcttacggacagcgaagtgttatacggtgtgcgtccgccgaataccgagttgaagtagtctttgaacggggtgctgtcggcttcgcctgtgtaaagcaggttctgcatcttcatgaggtgcttgtgtcagtattggcgtgtgggttcaagtcccatttcccgcaccagtgtaaaggacattcgattttcgagtgtcctttatttttattcatagaagatttgaaaatcaatagcattaaagacagccatatcagaatcagaactttccgataatgcggaaggtgaagaaattttcaaaaaacacttgactttgaagctccgctatgatataatatcaacgttgactatttggcaacgcattaaatatgcaggtgtggcggaattgcgccaaatctttgatttggtgtaagcggaacttgttccacaggcagacagcgcccattctaaagttgtcaactattaaatacgcaggtgtggcggaattggcagacgcgctagcttcaggtgctagtgatcgcaaggtcgtgtgggttcaagtcccgtcacctgcaccaaggcaagtcgtagaaatacggcttgttttttattgttgatacgtttaaaaaatgcagtggcggaattgcacgaaatcttcgatttcgtggaagcggaaatgcttggcgtttccgcagacagacacgcgctagcttcaggtgctagtgatcgcatgagtcgtgtgggttcaagtcccgtcacctgcaccatcaaaagaggacgaaaaagatgtcctcacgaaaaaccccgattttatcggggtttttcgctgtctatacgggcgtttttcaagatgcagaatcatagatgtaaaatggcatttttccctttgcggagagttttaaactcaaacccaacttaatattttcactgcaggcgcatggaataaaaaactccatgcgcctttttctttacctgaaaatcaacaggaggtacctatgacaatctatcaacaggaacttttacggaagcttccccatttcggatgtaccggacaatacagcgaaagcgacgaagcgctcgcctttttctatgacggtttcaaaatcggatggcaggacaaggccggatatatttacggagcaattgacaaagagctaaccgatgaaatgcgcgacgctttttacgccgtacaggatcaggcaaagacgattcgtgaatacaccgatctgtatgagacatccccacgcatgggtattcgggatgtggacgaataccgcagatttgccgaatacggtgataccgtccttgccggaatgtacagcgaaaagcacggattcatgttcaccacatggaagcaaagtgcagatcgcagaagcgtttcccacggggactattcacccaattttgaatatgcaaaggagtcctttgccacccgttcagggctgatcgatgcacagcgcctttttaccggggatgaagccgccaacctttatcgctgccttgactttgccaaaggcaactgcgaaacgctgacctacgaacaggaaaaacagcttgatgagctcatgactaaactgcgatatggatatccgcagttagaagaagcgccgccctctttcgagcaggacggcgccccacaaatcaatatgtaacaaacattcctcaagcctccgatttttgactttcccatgaaaacaaaaatcggaggctttttgtatttcaagaaaggaaatcaaaatgtactttatgcaaaacagccgtctgcgtgagatggagaaacttatgcagcgcgtccccaatttccgtccgagaggacgcggcgtgatcgccataagaatcacggaaatccctccgtccacctttgcgggggtgatgatggaaacggcgtccgccatacagtaccgcccatttcaacttcgcctccaacaatatctgaaagaaagtaaggattcacctatgatctacagaaacgataagcacagggcggcatttgaagccgccgtcagaaaagaaaacaaaaagaattatgcgctgctgtccgctctctacctgcttacagcggacggcagactatggagggacacaaaaagatttgtggttaccggctgcatctgctttgagcaggtgcatttgccgaactgtacagaaaccgcatacgcgctattctgcgctgcaaaagacctgtatctcggcacaaagcatctgactgtcagtgatcttaccgatcagagccttataccgccgaaggtgttcggactgatctgcaacgcaatggcaatccgccgattcggactcggcgcaatcgcatctatgaatcgaggtgatgaagcatggctctaatcaacgcagtcattatgaacgaagaaaacacgctcataacggagtttccgaagaattatctggatatttatgaggaactctgctccataggaatccgcaaggcgcttgaaaggattccgcttacggataatgaggacgatcccatccgggtaaagctctatgccgacagcgatatcggcaatcatctgcttttcctgttgacggaaagcagcactttggccgacgccaataccgcatcctttgcagtgcagaatgcagacgaagatatccaacaggaattagagcagaatctgttaaatgaccaatacaccggcattgcggaactgctccgtgacatcaaggatatgacctatcaggccggacaggtgaaaatgtccttcttctgtccgctggatggaaatatcgaggattctgagtacggcggcacaacgcctgtcggcaacctctttctcaaaagctatgaatgggatatccgcgaactgctggaaatggagcagtcatcaccggaagacgaaatggcgcagttctttgatgatgacgagggcatcaagaaaaagctcgtctctgccgtatggactgtagggggaggtggcacggctgatacaattttttcgcttgctgtacagtattcagatattcctgcctttataattcagaaactattccgagccgtgacggtggggattgtgaatgcgtagaagcttttacggtagcactcccatcatttcaatctcttactccctgcaccaacccttccaaaaccgcactatcccactcacttttcgtaatgccaacatctatattcacgatacgctttcacattcgcactatcctattcgcttttcgtagggtgagggtctgtgtgtgcttcttggtttcgcatccatgcgaaactatgggcacacacgctaaggcatccttgccttgcttgcccctcccgttgcaccaatccttgttgttatcgctaatctttgtaaaagaacacctatcacttgccttgcttgcccctcccgaaacatcattgtaattataaaaaacaattcaaaagaaatccaatgtaaagaggcaaagctatcagagtgtcctaagggggatagggataataaatcagaagtttatttcaaaaacagcctttccctacaaaccaaaagaccgcacctcatcacaggtgcggtcttacttattctaaaccttactgcatcgcaggattaccgccaagcagactgaacatatcaatccccgcaaggctcagcagaaagctgacagcaataaacagcacaacagcaacaacagccgctatccataccgttcttttctgctttttcgtccaggtgtgctgaggacaggcttcatcgctcacgctgaatgagattgtttcatcgctttttactgcgtgctgtgcgatcatatcgtcattttcgtggttttcgccgtcttctgcgtttgccaatactttttcttcgctcatatccgtccttattttactatatattccttagccttttcaagaataagctgctcccttttaagcacaaagctcatctgatattccttacactgctcggaaagagccttgaggcggcttacagcctcgtcataaggcatccattctattttatatcccagtctttcctgcgaacgttcaagcatcgcagtatcacacttgtccgatactttctttgccacatagcagtgtgaaaccatgcagaattttctcttgaacttatgctcctctatccatccgagatagcctaaaagctcggcagggtagccggtttcttccgttacttcccttaaaaatgccttgtcgggagtttctgttatctctatacttccgccgggcagcttgtaatatttggagtcttctatcttcatcatggcaatgttgccctcgccgtctgtcatgacgcctcttgtgttataacgtgcgtcgtcatcgatgtactgaggctcaccgccaaagaaatcgctttcggttatctttgcaataagcattaatatgtcgtccctttcatagtgcggagctttccgctgtttttttcatacatataatatcacaaacgcacctgcattgcaatataaaaaggtaattcacttttgtagaaaacacctatatatatgccttaattattggtgattatgcacagtggaacttgacgtgcattagtgatataataactttatccgactaaaaaaatatgaggaaagataaaaatggaaaatactgcaaccgtcagcggcacagaagttaaaaaatacagacgtgcaggctttatggacgaggtaagaggcttctgcatactctgtatggtagtataccacgtctgcttcgaccttaactacacctataatattcacatcccgataatgttcgacggctggtttgacattgtccgtgacatttttgccggagcattcatgttcatatccggtatgagcagccgttattcgcataataacgcaaagcgtggcattcagtgcttttttattggtatgataataaccttcattttcgcattctttgcaccctccgcccccatacttttcggaatactgcactttatgggcgtatctatgatgatatatgcgataggggataagtatttccttaagattcccgcaccggtcggaatagccgtgtgcgccgtgcttttcttattaacaagaggaattatgtacggctatctcggacctgcgcaaggtgtcggaataaagctgcccgaatttatctacaatgcaggacttctttttccgctcggcttcagatcaccgagctttcagtcaatggattattttccgctcctgccgtggtttttcgtgtttctggcaggcgcttacaccggaaaatacgctatcgaggataaaatgccggcattcttctataaaacacattgcaaaccgcttgcgcttgcaggcagatataccctgtggatatacgttctgcaccagcctgtagcaatggtctttttcctgctgattttcggaaaaatataaaatttcaaaaaagtcttgacaaaccgttttcggtttgctataataatatagcttgacaagtatacaactttgtcaacatcccttgctcgtacaagagtacgggcttaatatccacaaggaggtgctttataatggcaaagctcagcgaaaagtatgaggcagttgttgtattttcactcaagaacggtgaggatgcagtaaaggctctcgttgctaagttctctgatctgatcaaggaacacggcacattagttgacgttgatgaatggggcgctcgtaagctcgcttacgagattaactacgaaaccgacggttattatgtagtttacagcttcgacagcaagcctgatttccctatggaattcgagcgaattgactccgtaactcgctctcatgtccgtctcgcatcgataactctcctgaataaatatcatttgcaaaggcggagcgtattttttctatcccgttgttagtcagatacccctctttcggatctttcgagtaaatcataatatgtacatgaggatttgtttccttgttatgaaaagcagcataccactgtaaattttcaggtttgattttcgtctgttctgccatagtcagaatatgccgtcggacaagtgaacgccatgcgtcagctgttatttgttcatcattataggcatagccggaaagctcggcgtcagagcggcgcaatgatacaacgtgcgtccacacgttgccccggtgagcagctacttcttgagctaccttattcagatctacactctgaccgtcctgggagaatagtccgtgttcaccgtcctttacaacaccggggcgttcgcctagatagtgggtgtatgccgattttcctattactatatctgcatttctgtctattaccgctgaaattaaatcgcttgccgtcccttgcgtagggttattgatataatcctcatattcaaacagttttttagcatctttaaaatcttgcagaagttgatctatcatctgtttttgtttttcacttacgggatcattaggattggacggcttctgaggttcgataccgacagagttagtattatttatcactacaccgggacgtgtagcaatatattttgtgtaatactccaggtgcgattttggtacagatggagcaatgtatctgcttgtaactattatttttggcattattcgtcaccattctgaaatttagttgcgtcttcgagcgttagtataccgttgattttcgatacttcctgcacgcagcgtatatgtaatgattttaatgtgttatcatctaaattgtgaaatgccgctgtaatatttgcgagctttgccgtttcaactgcttctttgaataataagcgtgcaagacgctgttctgttgcgtaaacagtcgatttaatcgtatcggttataatgggtgcgatgaaattaacggaattctgactttcaagatagccaatataaaattcgactgctttctgcacgaattctgtcattgtactgcaattatcacttttatacataccacggattttagcttttaatgccgggtcaagtgcaacgttcatttgttcttttttcatattattgtcctttctgcaaaatggcaaaagaaaaacctgcgatagcaaccgcaggttaatttgtatcataaaacttatctgtttacaatcttgcattttttcagtatctgagggtcagcgtttatcatcgaaataagtctgcaagcagttttcatgggcttattggtacctgtttcccatgcttcgacagtcttagcagatacgccgattacagacgcaaacgttctctgtgtcatattaagcttgtttctgactgctttaatctccttaggagaaaagtcatcagccggggtgacagttactttgaccttcttagcacttacgttacccttttcgtattcaatagcttctgtcagaccttttgtaatgctatcataaagtcccataagtaaacctccttataaactttcttccaatagtttaaccaattttttgatttcgttacattcttctttgctcagattttctttcttgtttttaggatatgcagtgattaaataaatgcgctcttttacaacaaaatcaatatagcacaccctgacactgccgctttttcctctgttttcaaaagcgtaacgaaatttgcgaagtccgcctgtgccttttattacatcaccgattttgggcgttatagtaagttcgtattgcaaagagcttaattctttatcagaaagacccatagccgaccactgtttttcaaactcgggcatgattacgaattcacgagtcatatttaacctccttactgttattattataccctattgaatagggtttgtcaagcggctgttctgaatgctttaaaccataataacggattgactttagcgcctgtgttctttactgataatccgttatatgtatgaggtttctgatattcctgtctgacaacttcaccatcaacaaatgccgcttttatgccgagatggtatacattcttttcgctgccgaatgtatgataccagcccgttgaatcaaatccctcatctttttctttactgtgagtaccgctatgtgagtatccgattatcatttgtgagttaccgaatatatcacgaagcgagtgacctatatcttcttcactgatagcaatacgctccatgcagctgtattcaaccagcatggtaattgtatcgccggccttaaatgtattgccgtttgtcattactatagtcgggaattcaaacccatactgttctttaaaggcgtcaacgtctataatatacgcaatttcgacagcggaacagttgtaagtataatttggggtgctttttattatattgtgttcttcgctgttataaacgtcatagataaatgcgtcctgtattacttcatcggcactcggtaaaatatcaattcttacaggaatttcagaagctttcagcgaaagcgttacaccgccgtcataggctgtatatagcccattatgatgaaaaaattgctcagcattaagcgatgtaagaataactctgttttcaagttcactgctgtttacagatcggaagagcacacgtctgaactccagtcactccgcgaaatctcgtatgccgtcttctgcttgaaaaaaaaaaatatttccggcaaaaataaagaaaaatacgaatgtgaacaaaagcgggtaatcaactgcggcaagtgcttttctgtccataacgataagcgtcagcgtgatgaatatcatacctatcaggtacggaataaaattgaacacgataattatagctatggcgaacaggaaaagataagcggctgtgcgtttacggtcgattttttcgggagcggacttaagctctatcggctcaggctttacaaagataacacagcatagcgttatcattgcaacggcaaggataaacggcggaagcattatcagcgtaaattcgcctatcggaatattgaactttgaataaagataaaggttctggggatttccgaagggggtgagcataccgccgagattagcggcgatattctgcattatgaacgtgaacgccatatagcgttccttgcctgcggtatgcagtacatagtatcccagcggaagaaaggtgagcagagccatatcgtttgcaatcagcatagagcctatgaaggtgacccatacaagcaccactgtgcaaaggcgtatattgcggaatttttttactatgttgcaggcgagaatataaaagaactgtacgtttttaagggcgcatacaactgccagtacgctgaaaaggcaggcaagcgtcttgtaatcgaaataatcgagatatttctcgtcgggcggaactataaatgatgtgataaccgccgccagtaaagctatcaccataactgtatttttctttataaaacttatcgcagtattcattgttctacactcgttatcttgatcaaaccgcacaaaaccctcccgtaagggagggtaaaggcttgtttgttatgtttattataccagatcgtcctcgttgaaggggtcgccgcattcggggcagaacttcggaggatgttcgggatcggcaggtacccagccgcacttgtcgcacttgtacttcttgggaactgcaggctttgacttgccgcattctgcacagaacttgcctgtgttggtagcgccgcattcgcacgtccagcttgaaggagcgggagcagcgggagcgtcgccttccttgctcttgccgcagttagcgcagaacttgcctgtgtttgactgaccgcatgagcaggtccaagcctcaggcttcttagcgccgcaggaagaacagaatgcacctgtgtttgtagcgccgcacgagcatttccatccgcccggagtaggctgctgaggtgttgtctgctgaggagccgcaggcataccgccgagaacgttgttacctgcgttcatagccatattcatacccataaagcccatcatagcgccgttttcatttgagcctgccgcttcgataccacgagcaacggcacctgtcatcatagcacgctgaacatcgccgccgagcattgtatcagccttaagacgatccttaagaagctcttttgtttcttcggaaatcgtgatagggccaagaccgatatttgtgagcatcagacctctctgtgcccagttgttagcggtttcgtccttagtcttgttggtaaggttgttgagctggcttgtaatctggttgtagctgtagccttctgctgaaagctggtttaacgctaccatcagtgactgcatgaactcgttcttgtactgctcgttcttgaaaatgtccttaacatagacctgaggagcgtttacacccttgctgagaacctctgcatagaacttgcaggcattctcagcatcgggtatctgaacctcgaatgtgccgtagaaacgcagctctactgttgtattataacggggatcgggatagggaactggtgttcctgtaccgaaggggatgccgggcagtttctgaaggttgatgtagattactctctgctcggtggcgggtgttccgccgtatgtgaatcttgaaataagatccttgagcgaatcctttatctgacctgcaaagattgaaggtgctgtcgagttgtcaagtatgtaacgtccgggttctgtaacaacgtttgttatcttgccgttgtcaagggtcagcatacaggtgttttcttcaaccatgattgccgagccgttgctgataacgttgtctgttccctttgtgttactgcttcttgcattaccgttgtgcatcttctcgccgttaacaacaacagtatcgttgccgataacagggcagtgaatggcctctttccaggtatcgccgagagtacccgtgagtgcgcctacagctgctttaataagtcccatagtaatatttcctttcgtgttgagtttttaatttattttactaaattaaaatcgttgaccagccatacacggtcggcaatttctgtaatgccgcttccgcagtacggacacttcttgccctttgcagacgcatcaatgggagcgccgcagttggggcagttgcttgaaaatacaatgcttgtcgtctgttcgtgcagatcctgcttgtaagcgagcgttacgctgtacgctgtctgcgtaagcgcaggctttgcgctgtctgccttttcttccgacacctttgcatattcatactggagagaaatttcaaaccttgccgttgcctccttgcttctgttctggtagtttgcgattccgcaacggtgaatttttatgttattgaaaatctctttttcgttgttcgcattaagggtggttatacggttattgaccttgtttataagatcctgcgtatattcgcttgccttaagcgattcagcatttttgttcattatggcattgagaatagcagaagacggcatacgagatttcgcggagtgactggagttcagacgtgtgctcttccgatcttcctcaagtcctctgtccgcaaccgtcctgtatctcagcttcttgtcctttatcctttcggggagaggcggaagtattcccatattcgcccccatcggctgaaagtccttgttctccgtgcttatatgccttgccagtgccgctgtcatgcaggtttcgggcagttcgagcggcttttcgccgtcaagcgcccttgcaagatttattccggcgataatgcccgatgccgcactttcgacatatccctcaacacccgtcatctgacctgcgaaatatatgttgtcgctgtcgataagtctgaaattcttatcaagcagaccgggagaattaaggaaggtatttctgtgcataacgccgtatcttacaaattccgcattctgaagccccgttatcatcgagaatactcttttctgctctccgaatttaagattcgtctggaatcccacaaggttgtaaagcgtaccctcgttgttttcttttctcagctgtaccaccgcataaggccgtctgtctgttcttgggtcgataagccccacaggcttcatacagccgtagcggacgctttctattccacgctttgcaagcacctctacaggcatacagccctcatacactttaagattctcaaagcttttgagctgtacgctctctgcgtttacaagctcgttataaaaggcttcgtattcttcctttgtcatcgggcagttgatataatccgcttcgcccttgtcataacgtgtagcgaaaaacgcaaggctcatatcaatgctttctgcggtaactataggtgccgccgcatcgtagaagctgagcggacttccacagcgctcctgtatcttttctgcgaatatatcgcttgtcagcggacctgtcgcaattacggtatcgcttttgggaaactccgttatctcgccgtttacgatttcaatatacgggtgattagttatcatttcggtcacagtgtcggaaaactccgtgcggttgaccgcaagagcaccgcctgcaccgacctttgttttctctgcggctttcatcgtcacagagttcatataacgcatttcttccttaagcataccgcaggcactggcagtatccgcacttttcagcgaattactgcacacaagctccgcaaagcccttgtacttatgggcaggcgaatacttttccggcttcatctcgcacagccttacatgaaagcctctgtttgcaagcgcccacgccgcctcaactccggcaagacctgcgcctatcacggtaacagtctttttatccaagtttatccaatccttatcagttttcgttcttcttatcctcatcggcaggacgcacatatccgcagccgtccttggtgcagtatacctgaccctgcttgccgaccttcttgaaaagcgtagaaccgcacttgggacatttatcctcaagcggcgtatcccacgtcataaagttgcagtccttgtagttctcgcatccgaagaatggcttacccttctttgatttctttgcaagcatcttgccgccgcagtgcgggcaaagtccgcctgtttcgtttactattctctttgtattcttgcactccgggaatcccgaacagccgaggaactttccgtaaggacctatctttatgaccataggctttccgcacttgtcgcagactatatcggtaggctcatcgggtatcttcaccctcttgccctccatatccttttcagcctttgtcagcatcttgtcaaagcctgtgtagaactttccgagtacgtccacccagtcagccttgcctgcttctatcttatcaaggtcgctttccatctgagcggtaaactttgcgtctactatacgctcaaagtgacctttcataaggtcggttataactataccgagcgaggtcggctttaactgcttcgcctcacgttcaacatagtgcctgtcaagtattgtggcgattgtcggcgcataggtagacggtctgcctatgccgttttcttcaagcgctttgataaggctcgcctctgtatatctcggtggcggctgagtaaagtgctggttgcctgtaagctcttttaccttcagcttttcgcctacttcaagagcaggcagagcgccgccctcctcttcgtcattatccttgctttcttcatacagctttgtaaagccgtcaaatttcacggtatatccgtttgccttgaacagacactctccgcaggtaatatctaccgcctttgtatcaaggagctgattttccatctggctcgccataaaacgctcccatatcagcttatacagcttgtactggtcgcccgaaagcgcagactttaccttttcgggagaaagcgtgattattgtcggacggatagcctcgtgtgcgtcctgagcattgttcttcgacttgaatactctgggctttgagggcagatattccttgccgtatgtcgattctatcatctgtgccgcagccgcttttgcctcatcggaaatacgcaggctgtctgttcgcatataggttatgatacctactgcgcccatctcgggtatctcaacgccctcatacagttcctgtgccgctttcattgtacgtcttgcattgaacgacagctttcttgacgcttcctgctgtaaggtagatgtagtgaacggcggtgcaggtgttctctccctgtcccttaggttttctccctcttgctccctctttccttacccatacccacaccccgtcggggtgttggcaaaactcgaataaccaccaaaacattgtatatcctgtaagtgcagggacgcttaacgctacacgtccgcaggttagtacatatatctcaggttagtggcgtttttttgaagagtcaatgtcagtgcagttgcattgatacactcacgaaattattagtgccttgtccgtacggaaaatgttttaagcggtgttggcgatatatttcactgtgtggctttgtaataacaatcagtttttcgacagactggggacatcctgtgcatactgcacgggatgtcttgctgttgctgaagaatatgaacgccgatttagcaaacaaaagaaaataatcaaatttagctaattaacctaaattttcgtgtgtaaattgtgctatttacacaaaacggtttagctaaattactgcaatttgtttattgactggatgactgcatatttgttataatattatatgtaacaattcgcaaaaacccacttgcgtgtgggaaatttacaggaggatcagaaatgaaaaagtatactaaggcaattgccggtgcaatggcactcgtatctgccgttactgctttctcaggctgttccggcagcggcacacctgccgcaagcggagcaacaagcagttcgaccgcttcaacaacaggcgagacacagaagcagatgtcggagaatgaaggcgtacagagcgctgtaggcaatgtatctgcagctgaagactataaggacatcaaggttgacacaaagatcaagtggatggcctggtgggacattcaggaagcgtctcccgcagtagaggtattcaagaagctctacggcacacccgcaaacaagccaaagggctatgagtcggttgacgatgcaaacgtatttgtaaacataaaggttacaacatacgcagacagatacacaggtcttgcaaagctggtacagtctgatgattcgcccgactgcttcccctttgaaatatgcaactacccctacagcgtataccagaaccttttccagtcgcttgacggtgtaatcgactttacaacagatgactgggctgactataaggaggctatcgacaagttcaactggggcggaaagaattactgcccgatcatgagccttactcctacaagctatctctggtacagaaagagcgttgtggaagaagcaggtcttgacgatccttgggagctttacgaaaagggtgagtggacatggtcaacattcatggaaatggcaagaaagttctccgaccccgaaaacggcaagtatgttcttgacggttacaaccccgagaacaactttgtctgcacaacaggtacacctcttgtaagccttgagggcggtaagctggtaagccatatgaatgacgcaaacattgaaaagtgccttgatatgcttcgttcattcgataacacacaggaacagctccgttaccccagagataccgagaacagctggacacccagctataatgaatgggctgacggcaatacgctcttcttcgaggacggttcatggagatatgaagaaacatggagaaagttcaagaagaaaaacaagtgggaagatgacgaagtcaactttgttccgttcccccagatggacggcgcagataagtattatcagagcatgaagcaggattctataatgctcgttgccggtgctaagaacattgacggctataaggcttggatctattccaacttagtagcttcaaacgatccggaaatcgccaaggcaggcagagagcagtcaaaggaagaatatgactggtcagatacactgcttgacagaattgagatgatgaatgatcccaagacattctcaggagtgtttgatttcaagaacggtatcggtcaggatattgcaagtacagaaaaccaggataaccccgtagagcagctcacaaagggtccctacatgacaggtgaatcctatacttcgttccgtgctcagtaccagggtcagatagacgctcgtctcgcagaactgaacaagacggttgaataataatcataaaacagctacggcggctcttttctaagagccgccgtgtttttttgaaggtattgcggtaggtgcgtttgtcgatgacaaaaagtcgggaaggtatcttaacgcaccgttctttacagggcttactctaaagcaagcggtagagaaggcggagagggaatttgacagtccgtatgataagtaaaaaatcgggacgcatcgtgtggtgcgtcacgtttcagtctgtcgataaactgattattattaaatcccacacagtgaaatatatcgccaacaccgccgaaaatattttccgtattgacaaggcattaatattttcgtgagtatatcagcgcaactgcactgacattgactcttcaaaaaaacgccactaacctaagatatatgtactaacttgcggacatgtagcgttaagcgtccctgcattgacaagatatacaatgttcaggtggttattcgagttttgccaacaccccgacggggtgtgggtatgggtaaggaaagtgggagcaagagggagaaaacctaagggacagggagaggggctgtcaagtcccttgtcctgatccctttggttgtctcaacaaagagcgaggtaaggctgtcgctgtatatggcaataaagcgcaggggagagaagctcccttatctgctcagccgttacgcaaaaaccgatccgcccgttccgcagagcatggataattattttgacaatgataattttgtacctcagcatcttataggactgctgaagtaagaaagtgacgatatatgactatagatgaaaagctgaaagcgttttttgagggaaagaaagttgttattttaggctttggcagagagggacgttctacattgaagctgctcggaagctgtaattgcaaaagcattacggtagccgatatgaaccctgtacctgaatcggaagcggagggctgtacgctttgctgcggagaggattatcttacctgccttgacgactgcgatgttataatgaaagctccgggtgttattctgaaaaatattgtgagcgatgaaataaaggcaaagattacatcacagaccgacttgtttttacgtttttgcgacaatatgataataggaatcacgggaactaagggaaaatcgaccacgtcaagcctgataaaattctttatcgaaaaaagcggcaaggatacgatgcttataggaaatataggcgtacctccgcttgaaagacgtgaggaattcacaaaggattgtgttatcgtatgtgaaatgtcctgtcatcagcttgaatatgtcaaggcatcgcccgatgtggcggtactgctgaatatttaccccgagcaccttgaccactataccgattttgcggcttaccgaaacgcaaagctgaacattttccgctatcagaatgaaaacgatacgctgataatcggtgaagaagtaaagcagtatgccgatacgaaggcaagggtcattacagccggtttttcctgcggtgatataggaacacgaaacggcggtatttttatcggtgatgaattttaccctgccgatgtgatagatacaaagctcaaaggcgagcataacttatataatatagcgatagcgatttatgccgcaacaaaggcaggctgtactgtaaagcagtgccttgatgcgcttccgcagtttaatggtcttgaacacaggcttgaatatgtctgcatgctgaacggtgcggagtatatcaacgacagcataagcacagcgccgcagacggctatagccgcacttaaagcgtatcctgataccgatacgctgataataggcggaatggacaggggtataccttatgatgaattgtctgactggcttagcggtgatacttcggtcagaaatctgataatcctccccgacagcggcaagagagtagccgagaaggtcacaaatccgcttgtaaagctgatctatgccgatgatatggagcaggctgtgaaatatgcgaagcaggtaacgaaaacacgttgcatcttatcgcctgccgccgcaagctacggcttttacaagaactttgaagagagaggaaagcacttcaaggagcttgtgacatcaaataattgatactagcccaaaaactttttgtaacaaatgacgaaatttccccgatataactgtggggattgacaaaatcggttttatgtgttatcatattatcgtgatagcacattagcacgctaaagtgctatgatataaataaagaaacaaagccgacaggcatgaaaggaaataaccatagatgaaaagctacgatcttattacacctgagggtacaagagatctgctgtttgacgagtgtgtagcccgtaaagaagcagaggacaaattaagagcggtgttcaccgcacacggatacagcgaagtgattactcctgcgcttgaattttacgatgtgttcaataacaagacaaggagcttccggcaggaagatatgtacaagctgacagacggcaagggcagacttatggtaatgcgtccggacagtacaatgcctatcgctcgaatagttgcaacaagactgcgtgacggtgttttcccgttaaagctgttctgctcgcagaatatctaccgctgtaatcctaaaatggcaggcagggacgacgaatttatgcagagcggcgttgagataataggcggcgacgagaagcgttccgaccttgaggcgctcagccttgcggcacaggtgctgaactcctgctcaagcgatgatgtacgtcttgaaataggagataacacgttctataaactgcttcttgaaaagcttgatattgatgatgaagaaacggtaagaagccttattgagtcaaagaacactcccgaccttacacagtttatcaaggaaaacgttgacagcaatcccgaaaaacgcagatattccgagatacttttacagctccccgatctgttcggcggtgcggaggtatttgacaaggctgaaaagctgttcgcaggcacagccctctcagacaggctgaccgagcttaaggaaacgtttgacgcactgagaaagcttgaagcagaagataagataacagttgacttaggacttgtaaacaaggccgagtattatacgggaatcgtgttcaggatcggaagagcgtcgtgtagggaaagagtgtgtcaggaagtatacggcgaccttacggctttttccgtcattccgattatcttgcttctataatctatgaacagtgattctataaacgcactgtatatatcatcctttgatttaaaatagtaatagaacagaccgacctcagcgcctgcctcattcattattttccttattgaagtgccctcgaatccgtctgatataaaacagtttgccgccgcactgagtattttgctttttttagcgttatcctttacagcctttttctgcaagtcaacacctcccgccaaatattacctatttaattataacactgcatttatcaaaaagcaacaggaatatgtacaaacaatgtaagaatattttgttgcgaggtgatattatggaaataaccgaagcagagatagaaatcattacaaggcagattgttaaaatcatcataaatcatcaatgtgacgcatcagctgtgggtcctgaggacgcagacgatgaataagctcagagccgcagcctattgccgtgtttcaaccgaccgtgccgagcaatccggatcgcttgcttcacagcggtcgttctttgatgattatatcagaaattccgactctatgactttggtcggagtgttctatgacgagggtacaagcggcacgacaacgctcaaccgttacggcttcaacaaaatgatctcccttgccgtgtccggcggcatagacatcatcctcacaaaagaggtcagccgctttgcaagaaacactgtagacacccttaacatcacccgtatgctgagggcgaagggcgtaggtattatctttataaatgataatatagatacccgtgacagcgacggcgagcttaggctttctataatggcaacgatagcgcaggaggaaagccgcaaaatctccgagcgtgtaaaatggggacagcaaaggaaaatggaacagggcgtagtgttcggcaggagctgtctcggatatgacgtaaaagacggcaaaatcactgtcaatgcggattcggcagaaatagtaaagcgtattttcacagagtataccgtgcttttaaagggtgcagaaagcatagcggacgaattgaacgccgagcagataagaaccgtcaacggcggaaggtggagcggtgcgtttatccgtaaggtactgcggaatgtaaaatatgtcggcgaccttgagcagaaaaagacctgcactccggattttctcacgcataagaaaaggctcaacagctcggagcatatctatataagaaatcatcacgaaccgataataagccgtgagctgtgggagcagacccaagccgagataagccggagaaagcctacggacacaagccgccacagcgaccgatacgtcttcagcggaaaggtatattgcggtgtatgcggcagtgtgatggtatcccgtgtaaaaacgctgaaaaacggcaagatataccacgccctgcgttgctcgggaagaatcggcgggaagtcctgcaacaacgaaacgcttaacgtgaccgccctaaaagcctgcgtaaagcgtattttcacagatatacccatcgacaaaacagccgtcataaacgcagtaataaagggcttatcccgaacagacaagcccgacattcctgcactgcgcagaaaaatcgaaacgctcaacgccaaaaaacgccgtgcggttgatcttatgctggacggattgataacacagcaggagcttatcgagcagaaatcgtactatgacagtattatagaaaagctgtcgcaggaaatttcaagcgacagatccatttttgaaacggataaaatcagaaaaaacgcagaaaagtttcttgatttcacaagcgatccgatatggctcttggtcataagagccgattatatccacggcactcttacagtgtatcttaatggtatagaaaaaggcttcaccacctgctttaccgcaacaggcaggggggacagctaccgtgtcatcacgggaaatacagtgaggtcgcaagggatcattccgggaacgatgcaggtaccgaagaactatcccatctcgaaatgataggctctatagtatcccagctcacaacaggcgagggcgcaaagagctttgaccgatacggagtaggcgcatattatatggatcacgcaaatgcggtttacccatccaatgccggcggtgtgccgtttaccgccgcatacatccagagcaaagccgatccgctcgccgatattcacgaagatcttgcggcggagcagaaagccagagctacctatgacaacatcctcagagtctgcgatgatccggacgtaagcaatgtgataaaattcctgcgtgaacgtgaagtagtgcattttcagagattcggtgaggttctcgatatacttcagtcgcagataaagtaaatataaaagctgtggcagcaatgaaactgccacagctttttcagcatactgcaatgcgtaagttttcgctaaaacaaaaataaaggacattcgaaaatcgaatgtcctttacactggtgcgggaaatgggacttgaacccacacgccaatactgacacaagcacctccaaagcatagacagcgaggctctgtctgtcgataaggtgataagcaatgtcacaggtatgctgtgggaaagcatcaaaagcccgctgaaattacttatctcgctgatttcggtaacgcttctttgcagtatcgcaaacgtatttgcggataacacaagcggaaatctgaaaactgtgttttcgcttgtgtcggtgcttgcgtgcagtacgataaccgtgagtgccgcaagcgattcgctgacagcggcatcaaaaacgcttgagtcgggaagcgtatttcttgcgagctttatacctgcatttgccggaatacttgcaacaagcggtcacgtcagttctgcggcaatgttcaataccgttgtaatgggcggtgcgcagggctatatgcagcttgcgtcaaagatacttatgcctgtatcaatgagcatactcggaatatcgcttgcagggagcgtatgcggcgaactgaagctggaaacgcttgcacaggcggtgaaaaagacggttatatggatactgggtcttataatgaccgtattcgtggcgcttcttgcaatgcaaagctttatcactgtgccgtccgataatgtcggaataaaagccgcaaggtttaccgtttcaaacggcgttccgtttatcgggggagcggtttccgactcgctgtcggtaatgtacggcggcataggaatcatacggaataatttcggtgttttcggaataatcacagggggagtgcttatcctgccgtcaataatttctgtgctttgctataagctggcattctcgcttgcggcatcgttcagcgatctgttcggcatatcacagctgacagggcttatgaaatgcgctgagggcgtaagctcgataatcaccgctatgctcgtttcgtttctcttaatggcggtaatttcgatttcactgatgatttttatggcaggaggtgcggtatgacggaaatcaaacaggcggctctttgtatatgcatactcggtgcggctacagggcttctgagaatgctcatcccgtccgaaaaatataagacacggataacatttctgattgcctgcatattctcgttatgtcttatcaatgcggtaaaaggcatcataccgtctgtcagcattgatacgcaggcgattaatgttccgcaggtggatttcagcgaaaagctgtccgaacaggcaagggtcactgcggcgagggctgtaagggagaagatagagcagctgctttgcaataacggttttgattatgataaagtatatgtaattgcgcatattgacggtgctttctgcatatctattactgaggttgagcttgtatttaacgcagacgcagacgaagcttacatatccgatgcggtcgctctggtgcaggcggcatcgggagatgaaataactgtcagatattcaaaatcaagataagaaacagaaaaggcattttatgaaagatctactgaaatccgataagctgataaaatttgcgtttatttcaggcatagtggcgatagctctgatatttctctcagacttcgggaaaagcacagaaactgctgttaccgatgagcaggcgctggaacagcgtataaccgaaatgctcaccgctatggacggaatagacgaggtgccgaatgtaacggtgcggcttgatgaagataagcacacggtactcggcataaccgtagtctgtcctcaggcgataagcaacaggacggcagaaagggcaatcaatgcggtaagaacggctcttgacgtttccgcatcgaaaatatgtattacaacataagcgaggtatttattatgaaaagaccgagaatcaatcttatacttggcaaaaagcatctggttgcggcaggacttgcacttgtgcttgcggtggggctgtacgctaattttgccataggaagcagtgccgacggcaagaacgtttcgggagataactacggcgacacaaggcttgtttcaaacgaaaaatcaaaaacgcaggcagataccgacaaggacagcgacattgtcgcaaccgccgctaagagtgacatcagaagtgacagtgcgtccgacagcgaggaatactttgcaaaagcccgtattgataagcaggcgagcagagaagaagcaaaggaaacgctgaagagcatttacggcggcggagatatgaccaaagacgagcttgccgttgttgcacaagacgctaaacagctgaccgaccttatggaagctgaaaacaagatagaaacaacgctcaaggcgcagggctttgaggatgttctttgctatctcagcgacaacagcgctaacattatcgtaaagtcgagcggacttgataccgcacaggcggctcagataaagagtgcattactgtcagaggtagaggtagcgggagaaaacatcactatcgttgaagtgcagtgataaattgcgtacagccagacagaccgcaggctatgcctgcggtctgtttgtagaaaaagtatgttttttcaaaaaaagtgcttgttctctatccctataagaacgctttgtgggctttgcgtctttttttttcaagcagaagacggcatacgagatttcgcggagtgactggagttcagacgtgtgctcttccgatctatatttgatgtgcatgcggtggcggtaaacaccgaaaccgtaagcacaaaagccaaaaaacttctgcttttcttcatagagtaccaattcacataataaatattaatgatatttataattaaagcggcgactgcttttaacattcgccgctttgatgataaattttagcctgttcccaaagcctttttagcactgttccagctgttatcgtcaatgatatagtcatcaccgctcttgtcaccgtaaggaatatagaaatcagtcacgctcgacttgttctgcgaaagcgtatagacgattgccttgacctttgcgtcataatcgctctgctcgatattcgtgttggtgaaattgataataaagttaatatattcgtccagagttttactgcttgtgccgatgaaattctgatcgataaacgatgaaatgaccgttgcgttcagcttgcagggataaagctcgtccttgactccgtaatcgggcagtgtaaggtaagcgtacatctgctcggcagtaaaaatctgcgtaccctgctttataatagtcacggtgttatcctttttattctcgtactttatctcgctcggtacggtcagcgttgtgtttcctaccatatcgaacagctctgtaagcgtggattttgtgaagcggatatatttgtttatgctaagaccggtctttgatgagagcagttttgcaacctccgcttctcccgattgctcacatatctgctttatggtatttccgccgtcaattacggcattcggaagatacggcataagaacaaatgtgttgttcttggctatgtatgtgattgtcatgtatttatcgggcgtcttgtcattatcggcggaaagcgtcacgagaacagaaaaatcgtaggttgaatccggagtgaaaatagccgtttgattctgcgaaacgtttactgttgcgtccttatcctgcgagtcatagaatgatttgagcaatatggatgaaaccaatatcagaagtagacccgttaccacaaatgtgataacgtagatataccagttgcttcttctttttttattcaaatttatcaacctccgaaggcttgaaatttactcagaaaaatagtataatactataatagcataaaaagagaaaaaaaacaaggcttattttacaacggattttgttgtcgcaggtatgatattcttgctgtttttcccgatattacgataataattatataaagaggttttgtaatgaacagatttctgaaacgtgcgtgggctgaaattgaccttgacgcacttgagcataattataacgagataaaaaaactcgcaaagggcaaggatatacttgccgttgttaaagccaacgcttacggtcacgatgacaaggcggtctgccttaaattgcaggagcttggtgtgaagtattacggcgtttctaatctttgggagggcgaaaagctccgtcagcacggcataacgggcacaatactgacattcggttataccgatgaagattattttgacgaattacttgaatacggcattacccagactgccggaagtgtgcagtatgcaaagcagctcagcgattatgctgtaagcaagggagtaaagctccctgtgcatatcaaggtgaataccggtatgacccgtgtaggaattgactcacagcaggaaatgcttgatattcttgctatgcccggacttgactgcaaggccgcatatactcactttgcggcggctgacagccttgacccgtcagatgtggagtataccgacagacagcaggaaaagctgatgaagatagcaaaagacaaggggcttcttatccattcgcagaacagcggcggaataatctatcacggcgatttcggcggagatatagtccgtgccggtgttatactgtacggtcattaccctaactatccgcttgaagtgccgtttgatatgaaaagtgtgatgacggtaaaatcggtcgtttctcagcttaaaacaattcccgcaggtacgcagataagctacggcagaacatataccgccgaaaaggaaatgacggtcgccgttataccgataggatacgctgacggatatttccgtgatttcagctccaagggaaaaatgctgataaacggcgtgctgtgcaacgtagtcggcagggtctgcatggatcagactatagttgatgtaagcaatgtgccggatattaaaacaggcgatatagtttatgtttattccgataaatgcagggaaacaagcgtagattacaatgcgtcgcttattgataccataggatatgagcttacctgtgcggttgctctgcgtattccgagagttatcatcgaaaacggcagaataaaggaagtagtccgttacgggcttatataactgccgtaaaagttaaaaacgattaagccgtgagttataagaagatactcacggctttcagtttgtcgaaaaagctcttggctgccgggatgcggttttcgcaggtttcagaaacggctttgcgggctgcccgtgcttgccgtattcgagaatgttggcaagtttggcattgctgccgccgtccgagcgaggctcagcgaagccgaccttgatgtcgtggttgccgtcccggttcagcttggagggagaaaggccgagtgcgccttccagttcgcccgtggtgcgggatttgaactttgtccctctgccgataacgaaggagagattgctcttgacctttttcagcaccacctcgccaccggcctgcaggacggtatctgccacgctgtcaaagttgctgccgagcttggaaattttcagaaggaactcctccggcattttcatgtcgcacttagccaacggtcggcacctccttttttgccagtacttcaatgtacatcccacggcctttgacatcctctacggacacaatgtcgtagcggcagtcatcgcagatgagaaactggtcagccgtgaccgtcagccccggaatccgccgaaagcggaacaggtcagtagcttcactgaatgcagcgaggtttgcccaacgctggctgccgtgtcgaccttcccggtatacacggacggaagcgaggacttcatcctcggaatgggtgaagccctcgctgtccttgacttggcggatttttacgatgtcggcgaagccgtttatttttccgaaactcatgctcacaccttccaatcccggtcaagccgcaacagcagattgaccgtgttccacacctgctgtgccgctccggtattatccgcaaagaagccgcccgtgctgccgtcccggctttcgtagaagtgggatgacagcatgataacggcttgctctgtggtggctggcatggggttctccttatagaacccctccgggatgtgctggtagctttcggcgtaagaaacagcggcggtgatgtagcttttcagcaatgcatcatccgccgtgtgttccagaatgagattggctttcactttggagagaagctcgtccatcaccgccgcctcctttcatcaagacgccttcatcttcagaagctggataccctccggcaggatgatcttgccgtccacacgctcggtggcaacaaagccgacctgaccgttggtggaatacagctcgttcagacgctgaacggttctgccggtgcggtcagcgatccagtagctctggaaatcgccgaaagcgatagagagcgcacctgccgccagcgtgggagcatacgggctggtgtaaatctcgtaaccgagcagtctgtccggctgacccgcctgcagagagggctgccacagatactgaccgttggaatccttcagcttacgaagtgcggaaacagtagcatcgttcatcaggaacttggcattcttgcggtaaggtgctttcagcgcatagattagggaaatcacctcgtcggtggtgacggcggtcgcactggctgcggtaacgccgaccgtgccaccgttggtggtgaacaggccggtgggctgacccgtaccggtgccgacgcagaatgcctgttcctcggcagcaccgaaggcgtaggcaaactcacgggcgatgtactcttccagatcgaaggcactgtcgtccagaagctcaatgctcaccttcacaaggtcggtcagcttgtaggcgtcaatggtcttctgtgcgaaggtgggattgctctcggtgtaggcggcgttctcagccgtccacgcagcggtggaatgggtcgctgcaacggggatcttacgctcgttatcggtagtgatgaccttgcacagacggcgcatcacattttcctccttgagcgtgtccacgatgaacttctcaaattcggtgggtacgaggtagccgccgttggcatccacgccctcggagagcacattgtggagcatacgtttgccacgcagatgcagaccgaagtcctcgcggtaggcgcccgacgctctgccagtcttggcttcgccggttgctttctggggctgctcggtaatgggagaggatacgggctttgcaagctctgcggcaatggcgtcgcggcgctccatgcgtctgacctcattggtgagatcattcagctccttctccatattggcataaacggcatcgtcctcggcggacagaacgccttttcggtcgcggtgggtgtcgagaaatccctccatcgtagcccacagcttggcgcgcttttcgcgcagttcaacgatagtcatattgaaatacctccatattaaatgtagtttttgatggtgttcagcttggctctgagttcatctacagagcgtcccgtgcgctccggcacggcgggtttgggttcaatggcgcactttgcggcgattttctccatgagggagttcaccacattcgccttggaatacagcatggaaactgtagggacaaccatattgtcaagagtaacatggtttacactttgtgcaagcacatggtttacatgttatcaataacaaacgaacataaaaatgcaaatgtatcggcaatatcaaaaagtacgaacagtttatggatgcattctttggtaagagcgtcattgtgcagacttctgcgaagaatatagaatatatctgtaattgacttggcggtaagaataccgtcaaactgcctgtttgaaacggctaagaacagcttttgagcgtctgccgaaaaaggctcacggctttgaagagcgtcaatgataacacaggtgtctattacggcggtcatatattatccagcctttcgtcacgggcttcttcgacggtgacatcagcgggaattacgccaaacagcgatttcgccatttcaactctgtcggcattcggattggtgagctttgcaattacctttccgtttttggtgataaacacatcttccgtttcggcaagcataaggtatttgcctaaattcatcttaagttcggttgctgtaactgacataaaaatgcacctcctgcttttagtagcctgtatttagtagtatccgtttttctatttacattatacatcaatcgttcgattttgtcaatgattttgtgcgatttaagcaggtttactttgaaaatgtggttgaaaaaagtggaaatgcgtggtataatgagttggatagggcgggttaactgcccggcaaatcgtatttgtgggggaatataatataatgaaaataatagctattggagctgtgacagcaggcggaaaaacaacagtcgtaaatgcggttaaagataggcttccgagaacatcgtcacttcactttgataactactcatttgaaggagaagtagaagatttttcaaaatgggtgtcagaaggagcagatgttcatgtatgggacttatcgccgttaaaaactgatattgataaaatagtccgcagtggtgaatatgactgtttactgttggactatccgtttgcataccagcatcagatgataaaaccttatttggattgttgcatatttattgatacaccgttagatatagcaatggctcgaagaattcttagagatatgagagaggctacgtcagatgaaatttgcaatgaaatggatacatatttgaaatatgcaagaacagcctatattcagatggtgaaaaatcatttggcaacttgcgattatgtgattgatggtgctaaagaacttgaaagcattatcaatgaaactgttgaaataatttcaagaatctaaacttccgataagtcgagcagtttaacacacaaaataagtaaccgtcactgttgctcctttttatatttctgagccgcaaggctcttttttatgcggtttacgatgtcagcccaatggcaatttgataggaaaaacggttgaaaaaagtggaaatgcgtggtataatgagtttatggggtagttagtctgccctacaaatcggaatttaatgtagtaggtgaaaatatgaacgctgatttcagaataaacggaaaagtgatagaaacagaaaggctcattcttagaccattcagacaaaccgatttggaagatttttatgaatatgcgtccgtcgaaggcgttggtgagatggcaggctggaaacaccatgaaagtattgctgaatctcagagtattatgaattcatttatcagcaatgataaagtatttgcaatttgcttgaaggaaaacaataaagtaatcggtactgttggcatagaaaagtatgggttagaagatgctttaacagaattcaaggattactacggcagagaattaggttatgttttgagtaaagactattgggaaaacggacttgtacccgaagctgtaaatgcagtaatagattatttgttcaatgaattggattatgattttctgctttgcggttattataactttaatgaacgctctaaacgagttcaggaaaaatgcggctttaaaccatatcgttctttggctatgacaacacaaatgggaacaaaagaacaaggtactttaatgttgttgatgaatccaaagaaaaatatcaaattggttttttctcatcgggaaactttaatcttcgaataaacgttaaattcctatttatcgagcagtataacacacaaggagcaaccatcacggctgctccttttatatatctgagccgcaaggctcttttttatgcggtttacgatgtcagcccaatggcaatttgataggaaaatcggttgcataaaaatgtatcgccaacactgcttgtaatcgtttccataccgacaaggtattgataatttcgtgagtgtatcggtgcaactgctctaacattgactcttcaaaaaaacgcactaacctgagatatatgtactaacttgcggacgtgtagcattaagcgtccctgcatcgacaggatatacaatgttcgggtagttttacgagttcctccaacaccccagcggggtacgggtgtgggtaaggaaagagggagccacgagggagagaacctaagagatagggagaggggctgtcaagtcccttgccctagtctccctcttataatataataacctcagacagataattcgtttacacggattatcccgtgcaaaagcacggtcggcggataaccgcctgtctgagaacattttatcatcaaatccttttgtcaaaagacaaaagtacggcgtaccgccgtgtcggcttgcgccgatttgatttgtgatataatagaagtgggtttggcaaccacagaatatcaaaaggaggactgtcaaatgaatgacaatcatggtttatcacatccaaagagaaattgcaagtatcttatagtattcgcaccgaaatatcggaggcgagtagtatacgggcgttagaagcgtacagcgaggaaaagatataattgacagcccaaagagcaggtaaatccacctgatttttttattttgcaataaaaaattattgaaaaacaataaaaatctattgacaaacgagaatgttagtgctataattcaaaaaaacaaaggcagtgccttatgaaaggatatgattttttgaacaaaaagaatttttcggttactttatctctcgtgcttgtcaggatagtattcgtgcttataatcgtctgctgtatatttgcacctttaattgtccgggtctacgataacggtatcattgcactgacaggaagctcggtgtatctgcctatgataatcactctttatcttgcggcggcggtagcacttgtgatagttacggcgcttgaccgtttgctttcaaacataaggcacgacaaggtgttcatacccgccaatgtgaaaatattacggcttatatcgtattgctgttttgccgtaagcgttatctttatctatttcagctttataagaccgtttgcgtggcttgtggttatagcggcggcatttttcggactgatactgcgtgttataaagaacgtttttgaacaggcaatcgtaataaaggaagagaacgactttactatctgagctgtgaggtactgatatggcaattgaaataaatcttgatgtaatgatggcaaagcggaaaatttcatccaacgagcttgccgccgcaataggaataacacctgcaaatctgtcggtgctgaaaacgggcaaggcaaaggcgataagattttcaacgcttgaaaagatatgtgaggtgctgcagtgtcagcccggagatattctgtgttataaaggcggtggagaagatgaatgaatactataattatgcggaaaatgcggagcagtgcggtaacgttccgccggtgaatgtatacggcagagcggacgggcagtttgtacagcctcaaaggcagctgcaaggtccgcccgaagcgaagaaagtatacggcatccgtgacttcatattcgctgtgatgaccgttataatcggctttataacactgaagctgttctttaccgagggagaaatattcccgtttgcagaggttatagcatcgggctggtatcacgttatagtggcgacccttgcggttatggcagtaatatatatcggcaaaaagccgaccgcttcacaatgggcaattttcggctgtgtgatgctgttttgcacagttcctgtgttttcatcgacagggcttgtacgatttttgtcgtgggtatatgccgcaatactgctctgttactttgcttacagctttataacctcaaaaccgctgttttcggacggattcttaagggaaatatgcgaggctgtattcgcagtgccgtttgcaaactttgcagcagcaccaaagtgcgtggctgttccctttacaaataaggaaaaaggagaaaaaagcaaaacagcgttatatattctgcttggagtgctttgctcgattcctgccgtgattatagcgtgtacggccctttcgagcgccgatgataatttcggaagattgttatcaggtataacaggtggatttttcgacaactttttcactaacgttataatttttgcggtaagcataccgctgtcgttcctgctgttcggagcaatgagcggtgcgaaaggcagaaagcgtaaaatgacaggcgacctggggagagcggcaaaggtgcctgctgtcgcaatatgttctgcgctgacaccgcttatacttatctatcttttgttctttgcctgccagctgccgtactatctgagcgcattcggcggagttcttcccgacggctacagctacagcgaatatgcaagacaaggcttttttgagctgtgcggagtggcagtgcttgacctaatggttatatttcttgcgggtgttcttgcaaagagaaacgaaaacggcagaaagcccgttgctgtaagaatatattcggcggttttcagcctgattacgatactgcttatctgcagtgcaatgtcaaagatgataatgtatatcggtgaatatgggcttacagggcttagattctatacatcgtggtttatgatacttctcggcatagttttcctaagctggccgaacagctgaacactttgaagatcaagcgaaagatacttgaattttcgattggtgattactttatccgtcagcccgtcagcacagacgaaatagttgccgaaggtcagaaactaagtcattgtgtcggcggatatgccgaaagacacgcaaccggcaagctgacaattatgtttcttcgccaaaaatctgtgccgaacgagccgtattacacgatagaggtgtcaaacgactataaaatagtccagtgcagaggttataaaaacaactgggtcacaaacggcgggcaggaaaagccacaggaaataatcaatgtagagaagaaatatcagcagtaccttgacggtattgcggcgaaaaaatcaaaaacaaaatcaaggaggaaaacagcatgataattcccggacttcgcacaccgcctgcggatacagaaaaggcggtaacagacgattacgtcaaggcagcaaaccttaattaccgcatcaaagcggcggcacaggtggcacaacagagcttgtacgagatgtgcatggacttaaaggaaatgagagatagtaaactttataaggagctgggatatacggaatttaatgattactgtaaatctgaaataggcttttcagacagacaagcatacaattacatttcagctgttgaaaagttgccaaaagaattagtgaactcgagttcactaattggagttaagaagttgactcttctcgccaaactttcggaagaagaacgtacagagataaccgaaaagaccgaccttgagaacacctccgtccgtgagcttgaacagcagatacggcagataagagcggaaaaggacaaggcggtagccgataagtccgccgcagaagccgaagcatccgccgccgctcagcaggcgaaatcactcgaaaaagctaaaaacgcattgtcacagcagatagcggcgctcgaagccgagataaaggagcttgaaaaccgtcctgttgaagttgcggtcgagccggctaaggacggcgttatggacaagacagcgtttgataatatctgcaagacttatgaacagcagcttgacaaggtgcaggaggacgcattacaggacactatccgcttaaatcgtgagcatacagagcagatgaataacctgaaagccgagaacgaaaagaagcttgaagaactccgcagtcaacttgaagccgctaagcgtgagcagtcagagcttacggtgagcgtacccgacagcaaggaaacgtttaaagcgtaccttgcaacagctattgatgcggcaaagcggttatgcgagtttatcggcaataattccacagacagtaatcacgaattattcgtgacaaaagcaaagcagttttttgagaaaatgacggaggaaatcgtatgagcagtacattatatgatataaccggcaggtttgccgaacttttcgatgcgtttgacgctataaatgactacgaaccggacaccaatgctgacggtgagtatatagacgatgacggcgaggtcattgctgaccttgaagcatacaaggccgatatgctgacgatgtggtttgacactctcgaaggcatcgagggtgagttcagtgaaaaggccgaaaacgtcgcctgcttcataaaatcccttgagcgtgaggcagacagccacgagcttgaagctaaggaacagacggcaagagcaaaaaccaagcgtaaaaaggcagagttcctgaaaaagcgcctgctacaggatatgcaggcgatgaaactgaaaaaggtcgatatgccgagagcaaaaataacgttctcagagggacgtgacagtgtggttattgacgatgagcggcagtttattgactatgccgaaacattcaacgaatcgctgataaagtgcagcaaaccgaccatatgcaagtcagaggtcaagaagctgctcgacagcggagaaaagctccctgccgtacatcttgagaaaaagccgtatataacgataaagtgaggtagctatgagcaatatatttacacccgtaacaagaaagaaatcaaaggcgagaattgcggtcatgggaccgtcgggaagcggtaaaacgctttcgtcgctctatctcgcaaaaggcataacgggcaactggggcaaggttgcccttatagatacagaacacgagcgtggcagattctatgccgatcgtcacgatctcggcacgggagaatttctctacgccccgcttacaccgccgtattcgcccgaaaagtacatagagtacgtcagacaggcggctgaggcggtcggggaggacggcgtaataatagtggacagcttttcacacgcatgggataacgagggcggagtgcttgacatcaaatcacagataagatcggaagagcgtcgtgtagggaaagagtgtgtcagtacgtaatcgcaacagcattatggaacaagcctgaatgggctgacagtatcgtcagattcaattatgataacaagatcaaaaacgattgcttcaatgttatcgctctgaatgaaacaggtgatgttgtaggcgggatgttctgtatacaaaatgccgaagatgcaggtttgtggtactatggcgatttgttcgttgtacctgattacacaggcaagcgtatatcgaaaagattgcttgaaaccgccgaacaggcactgtctgataaatggtgtcacacattgagatgttatgtagagcctgataataaagtatcactgcatttacaaagagaatacggatttaccgaatgtgaatataagacttttaataatcttataaacagcggtcaattaatgtttgagaaaccgattgtaacattcaatgctgctcaggttacagaaaaaaacgaagcaagatatataaccgatatttttaacgaaaacgctcatttgcttcacagcgagataatcccttatagcgaatggtgcagtttgatttctgcgaatgatactgacgaaaaacattttttgattcgtaagggtgcggtgccgtgcggatacctgaaaatcaacggacttgaagacggcaatgacgggtggatttcaatacttgctgtagcttccgcatttcaaagaaagggtataggtaaatatgccgtttcatatgcggaaagtttttttaaaaagcagggaaaactatgcgttaaaatacatactacaacggataattatcctgcacgaaaattatacgaaaagtgtggctatttgctttgcaacagcacaaacacatatacagccaaagataaactgacatattttaagcagatatagccgacaacgattctgcggttctaatattgaaggaaggttttaattatgtataaaatactcttcgtctgccacggcaggagttgggtatcagtttccttggtggctgttggttgggcaaatcggtgcaagatgtagtggttgagcaagccttaaactactaaaatactactatctgttgattagcgaaaaggtaatgtgaaacttcagaattatgcttttgaagtttttctatggtaataaaaatgatgttgtataataaaacattgatatgtgtcatctcgaccagtgaaacctgcgaccgtggggaataatggaaaccgcccgtttggaggatggtttttattatgtacggatatgctatatttcataatactaagaattattataacttgattattttatagaaaaactgtataatgtaattgcaccattacaattatttctgttatgattaggaggaccatttcaatgaaatgcgattatgaaagcaggcttgaagccctctacacagaatactatggcaacggcggctgccaattctttagggaatgtgaaaaaggcatttctaaaagctgcatgttcagatttgataaagcaaaggtgggcgcaaagtatggtgaaaaaactgaaatcccgaaaatagtttttgtgggtttagagggacttaacggacatcagggaattgaaaggacggaaaccgacaagtgttacaatccccattacaaaggcgtaagatatgttttggcgtatttattaagtccatatattggcaaggaacgaccggacagcgtgttaaaaaattgtcttaaggactatgttgaaactatgaaatattttgcgttgcttaactgctacaagtgcgctttttgtgataatcccaaaggtcgtccgcactctgagtcaatgaaagagcattgccaagagattttgttcagtgaaatagaagtattggagccggatatagtggtttttcaagtcaagagcaaaagaccgactaacttcgagaaaaatctcgctaacaaatttggcaaagaggaattgatatgtggaaacgagggtacaggagctttttggtattcgcttcggtccggtaagcggtttatctggatttggacttatcacggcgatggaaataaatatccacgaaatcaacaaaatcaacaaaatcaacgaaatcgaggttgggctagtaatgataaaagcggtaaagattatcgtgaaaaagaccttgaccctgttttagatagggttcttgatgctatgcgacaactaaacttaaacgagaccgcagcggggaacgaatgaacaaggcattgcttctgaattatcctgatttaaggtaacattgtccggaattgtaatacttgtaaggcttgtacaaccttcgaatgcactgcttccaataatggtcacgttattgggaatagtgatacttgtgaggcttgtacaaccttgcgcaaaatccttagtagtaaacccgcagatttttactactatctgactactacacacatccgcaatttgccccgatttcttccgatcttatccttcaagcattgggagtcagaagtgaagggataatggcaccaacggaagtggtaagggtctttgttatcagagtaattttaataagggcggcaattttggcaggcattattcgatcaaaggtttatttctggataccatcttttctgttgatatttgttggctttgcgatttattatcccgatattcttccaagagtcggaaaaaacagcatagtgaatttgccattgattgcagaacatttaggttatggtactataatgtattctgctatctgtcaagctgtattttcgttcttttatcagcttcttccttatataattacccgtatactgttacttcggaaagaccgtaaacaaggcgaacgcactcactgacgaaataaaacaaatacaaatacgctgacatcacgtccgggcaaatcagcggctgatactttctgggcatcagccgcatttttgcataaaaaaagaagccacaaaaagtgacttcttttggcgcagaaagagggatttgaaccctcgcgccggtttcccgacctactcccttagcaggggagccccttcaccacttgggtatttctgcatggcgaattaataatataaaatttaaatggtgccgctgatcggacttgaaccgatacggtattgctaccgagggattttaagtcccttgtgtctgccgattccaccacagcggcatattctgttgtgcggtgattaaccttgatatattatacacttattttccctgcttgtcaagtgctttttgaaaattttattaaattattttctgcttttccatcttgtattttattccgaaatagtgtaaaatattaattgaaatatacctaaaaaacaggatacaatttccaacaattctatagttatcatgaaaggggaatacaaatgaggatagctctgtttacagaaacatacctgccgagcatcaacggtgtagtcacccacgttaaaactttaaaggaaggtcttgaagcgctcggacatacggtactggtggttaccgccgattcaagagtaaacaatcacgttattgcggacgatgtaatgtactgtcccgccgtaaaactcaagaaaatctacaattatgatatagcgccgcctataagcaaggaacgtcttgataaaatcaagagctttgctcccgacataattcatatccataacgaattcggagtaggcatttccggtgtacttattgcaagaactctcaaagtaccgcttgtatatacgctccatacaatgtatgacgattatgtatattatgtagcaaaaacaaaaggcttcggcaagattgtaacttccgccagccacctttacgcaaagatgctcgcatcaacagcttcggctattacaggaccatcgcccaaggtttcggaatatttcaaagcctgcggcgtaaagaagcccgtccacgttataccgaattcagtggagcttgacgtattcaagcccgaaaacgttgatagaaacgatgctgtcaggatgagaagaaagttcggatttgccgatgacgatatggtattctgcttctgcggcagactcggcaaggaaaagaacataacgcttcttcttgaatactgggctaaaaatgtcagacctgaagataagataaagctgttcatactcggtgatggacctttgcacgaacagcattgcaaggaagccgatgaactcggtatatccgatatggtgaaatttgcgggcagggtagaacaccccgatttacccgtatattatgcctgctgtgacgcatatatcacagcgtcactctccgatacctgctcaatatccatgctcgagggtatggctatgcaccttcctgttctcagccttaaggacgatctcaatgtcggacaggtaaaggacggcatcaacggctataactttaccgatgccgacagtatgtacgagcttctgaaaaaactccgtgatatgcctaaggacgagcttgccgagtttggcaggcgtacaagggagtcaataaagacatccggcgctatacgccttgctaacgatttgctcgatgtgtataaagaggcgatggaggtttacaagaagaagaacaaaaaacgtaagctcaagaaacgctatcgtgttatcagacacagatatgttaagcgttccgtaacaaaaacaggtaagtctatataataataagcggcggatataaacaatccgccgcttcagtctgtcgaaaaacctttgtgttttctgaaaatggggtcgcaggggcgtagcccccgacagggtctaggggcggtagccccagcaaaatagccccttcccacggggaaggggtttggggtttcggcaaggatgccgagatagaacgcccaaaggctttgcaggaacttcacggttctcgtttgcgtgcgcctgataaaaatcgcctaaaagccccgcaatttcttcgttacgaaaagcctccaccttacatcactccctcgttatattttttcatgaattgtctgaatgtttcctgtatcataaagttatcggtaagataacgccaggagttgagaagcacaggcatctttaccgtatcaggcagcatatttacgcataaacgcagttctgcattcttgttatctgtgataaagttctcaaaagccttttgagcggcttttatgcccgccgaaatatcaagcgtggagcattgctccttatatgaatggtactgctcgctgtacagacattcctcaagcgccgttccgccgagcgcaactatatgctgctgatcgtccaggtagagcagtgctccgctgaagcgttccagtgcttcctttatcataggcttcagcaccttttcttctgtggaggtgttttcctttattctgttttcgagaccgaatgcacggtagattttatccagcttcagctttgtatattcgtgcgtctttgccgcagaggaaatatctatagagggtgaaatgttgtaatcgcctttgaattgcgttattacatcgtgacagtttgaaacctcgcctgtgtaggagcagacgtactgcagatcccgtatagcgtcggttataagctgtgcggcattaggaaggtcaaaaagcacgtttcgtccgggaagccccgctacaatgctcttgtatatctttccgaacagaacctttgacagcattcttgcatcgaacagattgttcttgtcgcacataactataaattctcttgattgttcgtttctgcctccgtgacgtgcggcacgctgttcaaagataacagggctgtcgggaagctcatagttgaatatatgggtaaatctctttacctgagggtttatcgagccgattttgtcaactgtaatcactactcttgcgttgtcacgcacatcgtttgtgaaattatcgtagcgtgtgttgaatatgtcgcctctgtctattttcaaaagaccgtttatattaggataaagagcggatataactttcttcagatactggatggtcgagccggtaacacagtaaacgaccgctctgttttccgagcttttcagcacctcgtccagctttgtgaggaagcagtcgagcttcttgtcgacctgacgaagctcctgcacatcagctatattataggagggcttggtgtaggttttctttgcttccagtccgtattcctcgaagacgttaccgccctgcgcataaagaggaaggcctgtctttatgtcgataagacgtcgtgagttcgagatgaaatcctgcgggaattcatattcgagcatcacaacatttcttgctacctcgccgttatagacagatttgtcgaaataacgcattaccggagtgtaggggttgaagcatattgatttttcgtcaaagctgatgtcatcgaccgcattggctttattttcgtcggcaagcagtgtcttgacaagtgactttatctcatcgtagctctggtgataaccgcacggtacggggctgagaataacgagcttgttcgtttttgctttaaggtgttccgaataaagtccgcactttatgcccgatgtgctgaggcctgcgtctattataacaaggtcccatgtaagacctgcatccgcaaatttctgcatcagaggattgtctgcctcaagcgcttcttcggcgattatatatgtatttgacgctttttcgttaaaatatgtgatagccttagacgagccggagatcatcttgaagtcaacgccgttacctgttacgacacaacggtaccagctatgcataaggtgtctggggcatatcagcagaatgttcggtgtctgaacctcaagcaccgtatcaagtatacctatctgagcctttgtcgctttatccgagccgtattcgtcaaggacaagacaaaagccgtatttatttaatttttcgtgaaaagaacagcttatcgcacttatgtccttgccataatacgatatccatttaatctcttcggtattcaacaaatcaccctccgctctcctgcatctgccgacgcagattaaataatataactattataatacatttgagcattttttacaactgatatttcacattttatagaaaataaataaaaaatgaagtgcgattttagcaaaaaacaacaaacgtatctccggatttataaatacattattaagaaaaaaagtcagtaatttgaagtgaaccccaaagtttagacaaaaatgtattaagtattttgagaatgagttcggaattgtaccgggctcattcgctcttccgatctttctttacagacgccagcgaataatcatactgtgttatatcagattctgtcattacaatgacagagttatcgataactcttatacgctttacatcggaggatacctctgcctgggcggtcacctcgcacttttcgtcaagaagcaccagcttctttccgccgtccgtataattatcaagcacaaaagcctttttcgatgagagagcgtcaaagttctctatcgttccctgatagctgtaattaccgataagctcaccgctgtcagtgttataggtgcgtatttcgctgtcgcccgttacggtcagcgtaccgccgtttaccgaaagggcaagtgaaacgcagtcgcttatcgtctgagtccacagctcagtgccgtcgcccgaaatatcgtatttagagagctttgtgacaatatcgccgttatccgaggtcactcttgtaacatagataaacctgttgtcatcggagaatgcgacctgcataacattatcgtcaatgaaacgctgtgtatacagccattttccgccgccgtcataaacgtagataacgtttgagtatcttccgcccgatgtcacaacggctgtatgctcggagctgccgagaaaaacggatactatgacttcatcggggatattctgcttgaatatctcgctggtcttgttgaacagagaaaaatcgtgaccgcccttatcgtaaataaccacacgttttgagtttgaaacggtcatagggtgaacatagccgtgctgtaaggcaaaattctgtccgccgttctcattatacgaataaagataagtgtcgctgagtagcgcaaagctgtcattcatagcgcagaagctgtagtctgacctgccggtaagacttatcgggtagcctgccgtttcggtcgtggtagtctgtatccttgaggcaataccacgcagaggctcaaatatcgtatcacggtatatccatacaggaataagagccagaataacaacaagcagaattataaggtttcttatccgctttgctttcttcttcttttttctataaagagaaacatcgtttatatcgttgtttttatccgtttcaagaggatttttttcgggtactttcatatttaccccactttcatttaaacatcgttttcgtaaaataccttgttgagatacagtccgcaggggggaacggtctttcccgcaaactccctgtcgggctttataagtgcgtttattatatcctgctctgtacgttttccctcgctgatataaataagagttcctactataattcttaccatattgtgaagaaagccgtttccgcagactttaatttcgacaaaatcgcccgtctgctcaacatctatcgaatagacggttctgacggtggtcagcagatgctctttagcctccgccttgcagaaggacgcaaaatcatgctcgcctacaataagctgtgccgcttttcgcattttctcaatatcgggcttatagggataatgaagcgcagtatccgccgagaaaacatcacgcacatcacctgtgtaaatcctgtatatgtattcctttcccttgctgtcaaaccttgcgtgaaagctgtcgggcatatcttcgcaggaaagaaaggctatatcctgcggtaaaagtgcgtttccgccttttataaagccctcacagggaatggggcagttcgtttttacattgaacacaaacgctcttgcgtgcacacccgtgtctgtccgtgaacagccgtttatcgttatatcctcgcagagcagttttgaaagcacttcctcgactgtctgctgtatgctgtttgcattgttctggcgctggtagccgtgataggcagtgccgttatatgccattgttactttaagattacgcatagttcaccttaaattccgggtacagccacataaatgttcataagaatgattaatgtgaacattacagccattacaaccgttgcgacaatatcccttgctccgaatttaagctgtttcatgcgtgttctgccctcgccgcctctgtagcaacggcactccatagcaagagcaagctcgtttgcacgcttgaaagcggacacgaacagcggtatcagcacgggtatcagagcctttgccttctttacaagtccgcctgtatccaagtttgcgcctcttgccttctgggccgacattatcttatcggtttcttcgataagagtagggataaatctcagtgctatagtcatcatcatagcaagctcgtgaacgggaaagtgaagcttcttgagcggcgacagcagtctttcgattgcgtctgtcagcgctatgggggaggtcgtataggtaagaagcgacaatcacttacggcatttgacataagcggcgattatctgataggtcagtttgaacgccttgcaagcgacgacgaagaaaccgctatcgacgcttatacaaacatagcacggtatctgctgacaaacgacataacgcttgccgattacctccgtgagcttctcacctacgcagactcaaagctcatcgaaagctacatcagaaaagaagataccaacaaacaatatgcggttgaatatgacgtatcggtaatcaaggagcttgccaaaatgtcggctcacaagctgaaggattatcttttccagaagttcaacgagaattttattttctcgctccccgaatatgtgacaggcggctttgactgcaacgccgaatacttcatccgccatataagcgagaacggaagcggcatttacgcaaaatataaagcgtttgtatatgataacggcttgcttcatccgatagaaaagcccgacgcaatacgtctgtccgatctgaagaaatacgaatctcaaagaaagcagataatcgacaatacaagagcattcatagcaggtcaccctgccgacaatgccctgctctacggcgacagaggcacaggaaaatcatcgaccgtcaaagcgcttctcaacgaatatgcaaatctgcgtatcgtacaggttgacaaaaaggatgttgcctgcctgcccacgctctacaaaacactcagcgaaagcccactgaaattcataatctttatagacgatctttcattcggcgaaaacgatgaaggcttcggtatacttaagaaggttctggaaggctctgtctgcggaaggccgtcaaatatactcatatatgcgaccaccaaccgccgccatcttatcaaggaaaccgaaagcagccgtatgggcgacaatgttcacagtgctgatgaaatcgacgaaagtatgtcgctgtccgacagattcggtctgtttgtgacattcctcgcaccgaacaaggaaacctatctcgaaatagtccgcagtcttatccttgacagaggtataatgatagacgcagacaagctcgacagatgtgcggaaagatttgctcttaagagaaacggcagatccccgagaatagcaagacagttcgccgacagcctgcaatcaaagctcgctctcggcatagatccggagaaaatgtgatgaagaaaaaaataccgcttttaatctcggcactgcttatgctgacctttgcgataagcggatgtgaaaacatcgtactcgtaccgggcagatcgtccggtgcgataacggaaagcagtgaggcttccgagccgctgagcgcataccccgtgacactcaacggcacagaaatattgaaagctcccgaaaaaatagtatcgcttacccccgcctacacagagatcctttttgaaatgggctacggcgacaggatagttgccgtcagcgactactgcgactatcccgaaagcgtaaaggagctgccgaaagccgcaagcagtgcgaatcccgatattgcggcgataaaaaagctctcgcccgaccttgtgataaccgctacgcctatcgtcacaaaggacagaatttcactggaggcgcaaggcacaaaagttctgacaattgcgtccccgaaaaccattgaagaatttgaaaacgtctacaaatttttcgggcttgcaatgaacggcatttttgacggcgaatctgcaggcgaaaaagcattcgcccccataaaaaaacagcttgattcgattaaaaagaccgacaaaacttttatatatgtcaccgccgcaaatacccccgcaggcaaggatacgtttgaaaatgcaatactcagccttttcggcacaaacatagccgagagtacgagcggttatacctataaccccgaaatgctgaaggacaatcagcccgaccttattttcgtaagtgacactataggcaaggatatgcttaccacaaacgaaaattattccggacttaaagcggtaaaggacggaaaaatcaccgttgtgaaaaacaaatattttgaacgtccgagcggcaggattaccgagcttctgacagagattgcaaaggcattccctgccgaaaagcccgaaaccgcaagcagtaagaccgaaagtaccgacagcaaagaaagcgacaaggaaaacagcaaagaaaccgaagacagcaagcctgaaccggtttcatccgatgtatccgaataatttcaattgcatataaagagcctgaacataaaaggctcttagactgtcgaaaaacctatatatttttgaaaatggggtttggggcgtagccccaagcggggtgagggcggcagccccacaaatgtcagtgcagttgtaatgatggactcacgaaattattaatactttgtcggtaaggaaagtgttagcggcggtgttggtgatacattttaatgtacagctttaataataattggtttttcggcaaactgaaacggctttcgctcttttggcgagagctgtttttattttccgttcaagatgttcaagcatcagcatcccgagaaggcataaaatcggtgtgagtatcaggtaaattataaaaagcatattgtttttcctttctgttgcacaaaaattgtcggtttgtttctcttacacacatataatagcagataagctgtactaaaaaacggacttaaatacgatatgccgctttaaattgcgtgtgaggtaagccaaaggaaatcttgtatcgtgaaaataaaggcattgtatgaattttattcgtaaataacttgcaaaattattgcagatgtgataaaatataaattaatgtgcggatttaccgctaaaaatacgaagggaaaagtaaaaatggaattacaacagataattatgctgataacaatagccgtttatcttattatgatggtagttgtcggtgtaatatgtgcaaagaaaacggataatgtaggcgacttctatttaggaggaagaaagctgggtccgtttgttaccgcaatgagtgcggaggcatcggacatgagcggctggctgcttatgggtcttccgggcgttgcgtatgctacgggtattgcggacgctgcctggacaggtataggtcttgcgataggcacatatctcaactggcttatcgtatcaaaaagaatcagaaagtattctcatgtatgcaattcgataactataccggatttcttctcaaacagattcagggacagcaagaagatacttactcttatctcggcgctgataatcatagtattctttattccttatacaggctcgggattttccgcctgcggcaagctgttcaacagtcttttcggtgctgattatcatatcgctatgataataagtgcggtagtaatcatcgcatataccactatcggcggattcttagcggcaagtacaacagactttatacagagcattataatgtcggtagcgcttattatagtagtggtattcggcatttcatcggtcggcggtgttatcgaggtaatgaaccacgcaacatcaatgcccggatatttctcactgacacacacgtttgatgttcttaaacagcagacgggcgattatggtccgctgactatcttctccacacttgcgtggggtctcggctatttcggtatgcctcacgttctgctgagatttatggctataaacgacagcaagaagctcaaggtttcaagacgtgttgctacggtatgggtggttatttcgcttgctgttgcaatattcatcggcgttgtcggtcttgctatgacgaagaacaatgtaatagatcctctggcggatcccgaaacggtaatagttgtaatagctaatcttcttgcaaaggcaggtcctcttgcggctatggtaggcggtcttatcattgcgggtattcttgcgtccactatgtctacagcggattcacagcttcttgcggcatcatctgcggtatctgaaaatctgttcaaccaggtattcaagataaagacaagcgaaaagacggcaatgcttatcgcaagaatcacggtcgttgtaatagcgattgtcggaatcattattgcgtgggatcccaacagctcggtattccagatagtatcgtttgcgtgggcaggcttcggtgcggccttcggtcctgttgtgctgacggctctgttctggaagagaacgacaaagtggggtgcatttgcaggtatattcgcaggcggcgcaatggtattcatatggaagttccttgtaagaccgctcggtggattattcaacatctatgagcttcttcctgctttcatagttgcacttgctgctatagtagttgtatcgcttcttgataagaagccctcgcaggaaattattgatgagtttgagtcggtgaatgcggctgaataacagaaattaaataagtatgacagccacgatcgagtatcgtggctgtcagcttttagaaaaagtctttagtttgatgtgcttttattatatctttttaatatttatctatcgtggtaagctaccgatagttctttttgtcagatagcacttctcgggttcgctattccatttaataacgttgctactattcacgcgggagacaaccaaagggatcagggagagtctgagcctcgcttacgcaaggctcgtgcactccgctaaagctccgctgaagacccgaggctgataatagataagctcgcattgcttataaaagattccgtttccgatgcgttgaatcgtttcaagctgtgagccgtttttatcaaaatgtccgttttgataaaaatttatacaatttacagtgctgtgctaaagattttagcacggcgctttttttgtttattgaaagaagtcggaaatgtggatataataaggacagaaaataaattttcaggaggtttttatgtattactcagcaggaacttatgaagcattcgcacatcccgaaaagccgaaggatgtcgacaaaaaatcagcttatatcattggcacgggacttgccggacttacggcagccttctatcttgtaagagacggacagatgaagggcgagcatatccaccttcttgagaaactggagcttgcaggcggaagctgtgacggacgcaaggatattacaaagggtttctatatgcgtggcggtcgtgaaatggataatcatttcgaggtaatgtgggatacattccgtgacgttccctctatcgaaacgcccggtgtatcggtgcttgacgaatactattggctcaacaagcacgaccccaactattctctctgtcgtgcaacggtaaactgcggcaaggacgcacacacagacaagaagttcgagcttgacaaggaatcggcaatggcactctcaaagctcttcttaacgcccgaaaaggatcttgaggacaagaagatctcggaggttctccctgacagcttctggagcacgaatttctggctgtattggcagacaatgttcgctttccagcgctggtcgagcgctcttgaaatgaagcgttatctttgccgctacgttcatcacatagacggacttccggacttcagcgcactgcgcttcacaaagtacaatcagtacgagagtatgatacttccgcttgtaaaatatcttgaggctcacggcgttcgcatcgagtacggaatggacgtgaagaatgtcatcatcaaggatgacggcggcaggaagattgcaaagcagatagtctatataaaggacggaaagcagcaaacgatagatcttatcgaggatgaccttgtgttcatcacaaacggttgctgtaccgacacatcctgctacggcgatcagacccacgcccccgatttatccggtgtaaagaacggattcggtgaatcgtgggatatgtggaaggctattgcggcacaggcgaagaacggcgaatacggcaaccccgacaagttctgctgcgatgttgacgctactaactggatgagcgccacagtagcgacctcggacgatgagataatcagatatattatgaatatctgcaagcgtgacccacgcatgggcaaggtaacaacgggcggcattgtcaccgtaaaggacagcacggaaaactggtatctttcgtggacgataaaccgccagccacagttcaagtcgcaggataagaatatggttcttgtatggctgtattcccttaatacaaacaaggaaggcaactatgtaaagaaagcaatgcgtgattgcacaggcgaggagatctgccgtgagtggctctaccacatcggtgtaccgacagaaaaaatcaatgctcttgccaaaaactcctgcaacaccacaacgtgctatatgccttatataaacgcatttttccagccgagaaaggaatccgacagacctaaggtagttccggacggcgcagtaaacttcgctttcatcggtcagtttgccgaaacgccccgtgacaccattttcactaccgagtattctatgcgtaccggtatggaatctgtctacaccttgcttgacatagaccgtggcgttcctgaggtatggggaagcaaatatgatgtccgtgagcttctgcgtgcttgctactacgctatagacaagaagccgataacggatataaagctctcattcaaggaaaagatgctgcttaaagtcgtaatgaaaaaagtcaaaggcaccgatgtcgaactgctcttaaaggagagcggccttatagaataacatctgccggcggcactgcctgcagaataaatatcagcaaaggctccgacttgaactgtcggagccttcagattgttgataaactgattattattaaagccacacagtgaaatatatcataaacaccgccgaaaacagtttcggtaccgataaggtattaataatttcgtgagtgcatcggtacaactgcactgacattgacccttcaaaaaaacgccactaacctgagatatatgtactaatatgcggacgtgtagcgttaagcgtccctgcattgacaatctcatggttttcagtcctttctttttctttacagctatattttaacccgccgtgacggtttatacaacggtcaatcctgcgccactgttcaattttagggcaatcgatataaaatgaccgatttttaggcagatgcgactttttgcctaaaacttgaatttttgacgggaatgttgtataattataaccgtaaaatagaaagcaggagaaaccacaggctaaaacggaggtaatatgtccgaacttaccaaaagagcaatacaggaatcgtttaaaaaactgctgagcaatcagcccttggataaaataacggtaaagaacatcaccgatgactgcggagtaaaccgcaacacgttctattatcattacagcgatatttatcagcttctcgaagagatcttccttactgaagcacagaaatctgtagaaaagatggaggtcggtcagtcgtgggaggaagggctcaagacaggactttgcttcgtaaaggagaacaagaagcttatataccatgtatatagctcgcttcaccgtgaaactatcgagcgttatctttacagcgtttcacttgactttgccggcaaattcattgataacgtttcaaagacactgaagctcagcgtttccgacgatgacaagaagtttatcgtatcattctataaatatgcaattgtcggcattgtccttgactggctcgagggcggtatgaaaaacgagcccgacgagcttatcgaaagaatgtccaaactgctcagcggcactctcaagaccgtacttgaaaacgccgtaaaaaagtaataatcgcttttcgcacggtcggcaacattgacagttaacggtacttactttctttataaaatatttattcagatttttcaacatatttaccgtatttcttctatcaattattgacttttttgtggaagtattgtataattgaagcagtatactgtgatattctgtcataaagtataaaaatgtcggcctgcattttgatgcagactgtttcgataataagggagaaatttatgaagaagattattgtaacatttattgcgacaataacagcggcgcttctgctctgcttttccgtaagtgcgtttgacaataacgactacggcggtggcggcggttacgatttcggaggcggcgactatggcggcggatatgactacggcggtaacgattacgacagcagcagctacagcggtgacgccgaccctgtttccgttataataggtattggcattgtcgttgttattattatcatttcgacaatcggcggaaacaaaaagaaatccggtggcggcggcacaacacgaccttcatcaatgaacggcgcaaacgttgtactgcccaacagaaccgaacagatagaaggtattataaagcagaaggatcccaacttctcggcttccgaccttatcactttcacaaagcaggtatacatagatattgaaaatgcctggtgcaagcgtgatatgacccctgtaagaccggttatgcacgaaaacctttacaacaccacctgcaagcaggtgcaggcaaagatagaacagggcgttatttaccactacgagagcatcgctatagatacggcttacctcacatcgtatgagcgtgattcgcagtttgaatatgtaacggcatacctcacctcaagaatgatagattaccaggtagacgaaaagacaggcaagattataagaggtgacaagactacacgctgggtacagaagtacaagatgaagtttgtacgttcgctcggtgtcgaaacaaagacggaaaccggcaagatgaccggacacaactgccccaactgcggcgcaccgcttgagatttcttcttccggcgtatgcgaatactgcggctctgttgttacaacaggtcagtattcatgggtactgacagatttctcaggtataagaaacgatactgtagatgacggtataaagggagtataatgtggatataacatcgttcattctttcaatattaagctggctcgctccgcttatagtcatcggtatcatcgtacttgtcattgtgtcgaaggtgcgtagcgcatcgcagaaatatctcggtatgtcgccgtcacaggcaatggaactgataaacaagggtgtcaaggaggaagctaccactcctaagggtataacagccctcagcgaaatgtacggtcctgccatcacccgtgattttcccgaaataggatacaagggcatggaggtcaaggcaagaaatgcaatagtcgcaattctcaatgccatgatagatcggttctgacttcttatatgtaaagaactgtacaaatcaaagacttatcataaataaggtaagccagaacttcaaggacgaggaaattctctacgaccttgatgaagttatggactctgtaggtatacagcttcttggcgttgtgcctgaggacaacaatatcaaggtgtgcggagcaaagggtatgcctttacctccgacttgtcccggtgctaaggcttacgccgctatcgcaaggagaatacttggggaagaagtaccgcttactatcaatatcaactgataacatcagggacggtacgaaaagttaagaaaaagaggtataatatgaatattgcactaattgctcatgattcaaagaaggaattgatggttcagttctgtatagcgtattgcggcgtacttagccgacataatctatgcgctaccgctactaccggcaagctcgtatcagaggcaacagggcttcatattcagcgttatctcagcggatctcaggggggagatcagcagatagccgcacgaatttcatgtaatgagatagatgtgctgattttcttcagagatcctttaaatgctaaagcgtacgagcctaatgaaatgaatcttttgcgtctttgcgacgttcataatattccgcttgctacgaatatagctacagctgaagcgcttattcacgctcttgaaagaggcgatcttgactggcgtgaaattgtcagaagataaagtaattatgcaggcgtacttatgtacgccttttttatgcagaaaaacgaaaggacaacaaaaagatggagttactaaccaaaaaacccagaggaaccgaagataaactgccaaaggaaatatataaatggcacactgttgagaaaattgcaagaaatgtagcagaggcatacggctgtaaggagatccgtacacctacgtttgaacacaccgagcttttccagcgaggagtaggcggcactaccgacgttgtacagaaggaaatgtacaccttcaacgataagaagggcagaagcataacgctgaagcctgagggtacggcaggtgctgtccgtgccgttatcgaaaatggacttcttaatgatgtgcttccgcttaaaacatattatttcacacgttgcttcagatatgaagctccgcagagcggccgccttcgtgaattcaaccaggtcggaatcgaatatttcggcactgcttcacctgcggcagatgctgaagttatcgcacttgcaaatgacattatcaaaagtcttggcgtaaagaacataagtcttgagataaacagcataggctgtccgaagtgccgtgctgaataccacaaggcgctgaaggaatattattctcagtataaggatcagctttgcggcacctgccttgaaagacttgaccgcaaccctatgagattgctcgactgcaagagcgagatttgcagcagcttcaagaaggacgctcccatgatactcgattatctttgcgatgattgcagagaacacttcgaaaatgtaaagaaacgtcttgatgtactcggagtatcatataccgtaaatcctctgatagtgcgtggacttgactactacacaaataccgtatttgaatttatctcgaatgagatcggttcgcagggcgctgtatgtgcaggcggcagatacaacggacttgtagaagaaataggcggaaacagtgttcccggactcggattcgctatgggtcttgagcgtatcataatggtaatggaaaatcagaagctggaatttgagcctgaaaagaagtgcgacctttatatagcttcatttgacgatgaaacaagcatatacgcaatggaacttgttcagaagctccgtgaggaaggcttctgggctgagtgtgatatttccggcagaagcttcaaggcacagatgaagtacgcaaataaaatcggcgctacttactgtatggtaataggcggcgatgagatgaataccaaatccgctaagctcaagcgtatgtctgacggcacagaaacacccgtaacactggatgataaattcagcgagaagctcaacactatgatacttgaaatagtgtaatgttcatcttaacttgaaattatgaacgatacttggaatccgtggcacggttgtaggaaaatcagcgacggatgtaaaaactgttacgtctacagacgtgacgcacaatacgatatagacagcacggcagtagtgaaaaacaaaacgttttacgctcctgccgagcgttatacttccgatctcgcttatcggcagcttcggagcggacgatatgccggctgtaggctttgcggtaaacgtaaacgctattgcggcggctaatctcagaagcaacagaagcacaaaggcacgtcacgcagaggttctggtatttgccgcagatgaggatctgatagacggtatcagccactgcacaaagcttatttcaaagggcatcagtgcggagttcagcacctgccccacgcttgatgcggctatggaatatgctaaggctaacaaaatcggcagaatagatataatagataaagaaaagaacgaacagcccgttacaatgacgctgtaagaagggatatacataaatggacaagaaaacaatcagaatcgctcttactaagggcagacttgaaaaggacacggtaaaccttttcgataagataggatatgatgtttcacagcttcgtgacaagggcagacggcttatacttgatataccgggaagcaatatcgaggtagtccttgcaaaagccgcagatgtactgacttatgtagaacacggtgtatgtgacttaggcgttgtcggcaaggacactatagatgagcatggcggaagatttttcgaggtatgcgatctgggattcggacgctgcagatttgctcttgcgggcaaagtcggcaacaacttctatgagggctgcggtgtaaagactattgccacaaagtatcctaatatcacaagaagattcttcgagtcaaaggctatggacgttgatatagtaaagatagaaggctctgtagagcttgctcccttgcttgagctgtctgacggtatcgtagatatagtagaaaccggtacaactcttaaggaaaacggacttgaggtatacgaatacgtttcacctatatcagcccgtgttatagtaaatccggtaagtatgaagctcaagaagaacagtattgaagatcttatagacaagatggaaagcaacatataagaaaggacgctaagtaagatgataaagactatcaaagcagacggcagtgaaaaagaattcctcgcaggtatgaaaaagcgcagcagtgaagtaaacgcagaggttgaaaagaccgtaagagcaattatagacgatgttgccgcaagaggcgacgaggctgtaaaggaatataccgcaaggttcgactgccccgatatgcagtattacagagtacccgatgaagtcatacaggacgcactcacaaatgcagaccccgactttgtgaactcaatgcttaacgctcaggagaacattacggcattccacacccgtcagaagcagaacggatatatgatgacagacgagagcggctgtatcttaggtcagcgtgtaagaggtcttgacagagtaggcttatatgttccgggcggcacggcggcttatccttcgtctgttcttatgaacgctatccctgcaaagattgcaggcgtaggcgagattattatggtaactcctcctatgaaggacggtacgcccaacaacgatatacttgtggcggcggctctgtgcggcgttgacaagatattcatgtgcggcggcgctcaggctgttgcggctctggcattcggcacagaggagatacccaaggtatcaaagatagtaggaccgggaaatatcttcgtagcaaccgcaaagaagctcctttacggaacggttgatattgatatgatagcaggtccgagtgaaattcttatagttgcggacgataccgctaacccgaaatatgccgccgcagaccttatgtcgcaggcagagcacgacaagctggcaagctccgtgcttataacgacaagtcagcgtgttgccgatgaaacagtaaaggaaatcgaaagacaggttgcagacctttcaagaaaggatattatcaatacctctcttgataactgcggtgcgataattatatgcgacgatatggacaaggcttgcgagatagcaaacgaaattgctcccgaacaccttgaggtgcttgccgcaaatcctctcgaatatataggaaagctgacaaactgcggttcgctgttcctcggagaatatgctccggagcctctcggcgactattacgcaggacctaaccacgttcttcccacaagcggtacggcgagattcttctcaccgctttcagttgacagcttttcaagctcaggcggtatatcggcactgtacccgtcgattattacgctttcttcggcataagccctgtaaggaaacgctgcagccgtgagcagtacgataagcagaataaatgttttaataacagctgttttcatagtccctcactgtaaaagttgttttattacctccataagtctgctgaataccggcaacgccagtatgactatcgcaaacttgcctgcaagctctatcttagacgctatcgacttttcacctgcgtcactgcagctgtccgatgccatttgcgttatatagcatacggcaagcgattttaccagcacgtcagcgtaggacgaatcgggaacggctgtttcgagatagcccgatacggtttctatcacaggctttaccgccgacacagccgcacccagcataagcatacccgttatcagcgttatatagatgctgaattcaggcttgtactgctttaataccgatgacagaacggctccgataatgccggctccgacaaatgcaattatattcatatttaccgttccttgctttccgcctatagattgaaaatacttttgattgtgtcgaacaggttgcttatttccgtgacaatcatcatcagcacaacgataagccctgctatagtagtcatcattgcctgctcctctctgcccgagcgttgcagaagctgattgagaacggctacaacgatacctatcgccgcaatcttgaaaataaaatctacattcatactacaccgccgctttctatatcagcattattccgaccgccgcaccgagcattatcccaagcgttgtgtacaatctgcccttgcgttttctttcctcctcggcggttttcagctgaaaggaaagacgctgtcccgcaagtgcgagtacagccgtttcgccgtcggtattgcttttgccgatagtcctgccaagttcggataatatctgcctgtcatcctctttcagataaccgctttttgacacgcatatatcccactcatcgcttatatcaccgccgttttcgctgagttcaacaagtttgtccgaaatgtaacagccggagcttttttgctccgctctgaaaatttcagccagcttgtatccgctgaagcctatatagcagttcatactctgcacaagcgaaatataagagtttattaccctgcaccgctcactcagcctgcccgaaaaatacatacccgtcgcaccgccgctgagcgtaatcagcagaaatataacaattcccgtcataccgttcatatcgtacacacggcattcgcttcggcagtgataagctgttttaccgccgttatcctgtggctttgcacaagcgctatatgctgtatcgctccgctgtcgataaccgtccttataccctcgttgcgataagcttcctcgatgctgtctgcgtgagccgtcataatcagccccgaccccgaattcaccgcctgtcttatactttttgcatcagctccaagctcatcggtcacgatataatcgggcgacatacagcgcaccgcccttattatcccgtccgacttgccgtatccgctgaaaacatcggtcataagccccacatcaagacacggcttcccgttatacactgccgcaatctcctgccgttcatcaataagcgaaaccctgaacattcctcctatgcatctgcataaatcacgcagtatcgtggtttttccgctcagcgccctccctactataagaagtcccctgctcctgcactcgctttcaaacaacggcagcagatcccttgccgccccgtaatgctgacgtgctatccttatgtttatcgaactgaaattcttcaccgtctgaagcccgccgttgctgtacaccgcagtaccgcataatcctgccctgtgaccgccgtacagcgttataaatccgttggctatatctttttcgtaagtatggagcgaattttgacatattgcgcttatgcactctgccagcatttcgctgtcgggcgttatctgcgttatatggttttgcattcccgtgcggattattatcggatagccgctccttatacggatttcttccgctgtctgccgtatcgcattcggcaccgatgcaagaccgggaaaaattcttaccgcacaacgagatctacacgtactgacacactctttccctacacgacgctcttccgatctaaatgaacgtcattgccgctatgcacataagcagtaatgggtctgtcagcagcgtatctgtggcataagcaaacgcatcggcggcaggctcatatcccgttatctgcagtataagacagcacacaccggcgctcacagccgatatcaatattcgtgaaaatataaaatacagcttatttaccgtaaaatccgcaagagagaatatctgatatattacacagaatccgccgaatgaaataagcgcagaggttatcggcaaagagaaaataacgccgtctgtctttatatttgttatttcggttactgccttaagaaaggcgggtatctccatattaaagacagcgtgcagcaaatatcctgcaagctccgttacgcagttgaacagcaatatcggcagaataatattcagcattgctcttgccgctgaaataagagaagccgatatgtcggacgaagaaaagccgatctctgtcctgtgtagctttgaagcggtatttctgacattcataacaacagccgcaaggaaatttgccgtaaggcaggatataaatacgataatccctgcggttacatcgttatacacgcctatccccactattcccgtaacaaaggcaggtccgctgttgtagcagtagcataaatgctttgagtaactgcggctattgtcggagtcgttaccgtaaagctcactcagaagccttacaccgacaggataaccgcctatctggctgaggataaatacggcgaaggtctttttgtcgagcctcagaatgtatcttgctatgtaccacaaaggcgttgccgtgacttcaccgatattggtttttataataagcgtggcaaaagccataaagcagaataacgacggtataaggctgtcaaggcaggtgccgatacaccttcgtaccgtgtcggacgttcctctgctgtcagcggtcagaagtatgcatatgattaccgataaaatacagattgtcgcttgtctgatacgttttgctataattatccctcacttcttttttgcttgtacctgcatataaattatatgaaaggagagcggaaaaatgaacgtcgataagttagcaatgagatatgaacagcttaaaaacaaaacacgcaagcattcgtttatcacgctgaaggacaacaggagcgccgagcttgaatgctgcagaaaaatactgaaattcgaggataatataatagaacttgagattccgtgcggaatagtgaggattatcggtatcgggctgaaattcaagacattcggttatgacagcgtgaaaatatcggggaaaatacattcggtcgggtttgaacaggcaaatcacggcgaagcggaggaattatgaagagaagaaaagcaagggcgacattcgccgcatatatcacgataaaggggcttggcggttttcaggagaagtttataagcgagcttataacaaacgatattcagatatatgaaatatgtcaggacaaagacggctttacggctgtcataaagccgtacagctatcttaaaacggcgagaatagcaagaaaacacggaatacgacttaacgttaccgaaaggcaaggctttatattcaggcttttgccattaaggaaaagatgggggcttgttaccggcgcattgtgctgttgcgctgtaatagtcctgctatcgcaatttgtatggaggatagacatcatcggaaacagcgaggtcacagacacacagatatgtgccgtgatggagaaaaacggtcttatgcccggctgcagcaggaagtcttttgacgaatgggtatgcgagcaatccgcaatggctgaaatcagcaggctgtcatgggtggcggtcgaacggcaggggagcagggtatctgtaaaggttgctgaaacaaacgatcctgagcctgcggaaattccgatagaaacaccttgcaacgtaataagcgactttgacggtcagcttatctatacggaaatatataagggcaagctagatcggaagagcacacgtttttaatgatacggcgaccaccgagatctacacgtactgacacactctttccctacacgacgctcttccgatctgaattcagcgactatgccgttgagatagctgatctcggtgcaggaataatcggcggctgctgcggtacaacacccgaatttatccgccgtacagccgataaggtaaagggcagaaagtacgagcctaagaagatagagcgtgtctgcacgatatgcagcggcacaaatgttgtagaggtaagccagccgaggataatcggtgagcgtatcaaccctaccggtaaaaagctgttcaagcaggcacttataaacgatgatatagactatatcttaggtcaggctatagagcaggtcggcgcaggagcagatatacttgacgttaacgtaggacttcccgacattgacgaaaaggcaatgatgataaaggctgtcaagagtattcagggcgttacgaacgtacctctccagatagacagcaccattccggaggtactcgaagcggcactgcgtgtatacaacggcaagcctatggtaaactcggtaaacggcgaggaggagagccttaaaaacgttcttccgctcgtaaagaaatacggtgcggcagtagtaggtctgacacttgacaaggacggcataccgcctaaagccgaacagcgtgtagccattgccgaaaaaataataaagcgttgcgagaaaatcggtattccgaaagaggatatagcgatagactgcctcacgcttacagcatccgcagaacaacttgcagtaaacgaaacgctcaaggctgtgcgtgcggtaaaggaaaggttcggagtaagaacggtactcggcgtatcgaatatatcatttggtctgccaaaccgtgagctcttaaaccacatttttcttacgatggcacttgaaaacgggcttgatctgccgattataaaccccaacgtagcgtctatgacaggcgctgtaagagcattcaagctgttaaaggcaatagatgtaaactcggtagaatacatcgccgcttacggcagtgataccccaacggcagtcgcaaagccgaaatcctccgaggtaacgcttgaatacgccatcgacaacggacttaaggcggatgcggcgaagataaccgaacagttgcttaccgacaccgacccgatggtaataataaatgagcggcttatccctgcgcttgacaagacaggtactctgtttgaacagggaaagatattcctccctcagctgattttatcggcaggcgttgcacagagctgttttgatgttatcaaggcgcaccttgcaaagaacaattccgaaacggtgagcaagggcaagatagtgcttgcaacggtaaagggcgacgtacacgacataggcaagaacatagtaaaggtactgcttgaaaactacggctacaccgtaatagatctcggcaaggacgttgagtatcaggcggtagtcgatgccgcaagaaagcacgaggtaaagctggtgggactgagcgcacttatgaccactacgctcaaatccatggaagaaaccataaagcttatccgtgacaacggacttccttgcaaggtggttgtcggcggtgcggtactaacacccgagtacgccgaaaaaataggcgcagacttctacgcaaaggacgctaaggaaacggtagatattgcgaagaaggttataggataaaatataaaaaatacaacctgcggaaaaattccgcaggttgtatttttatgctttctattgtaaaattcaatcaacaatttattcagaaaagattcctttcgataacctttttctgtttttcctgtagcaaatagttccagacagtttcaaagaaattcttttcttcctgtgtttcagcttctgttataagctgtaaaaaatcatcggaatgcagatttttaaaatcttcatatacctttgtgtattttgaaacatcgcacatacaatcgcctcatttccttatattgctgtaaaacaaatacatttagccgttaacttattataacaactctactccaaaaaggaagaattgtgccggagctgacaaaaggcgatattaagcaggtcatagaaacgtcatccgtatatcttgcaaatgccgtcaaagataacggacagtttgattacggcgtaaatcccgtgaacgattttcatttcgttacatataacatactgcgtcattccggtactatctggagtcttataatgcagtacgacaccacaaaggacgagaagcttgtgccaaagattgaaagcacgatagacttccttatgcagagcatagaatattccgacagcgatcacgcctatcttgtggagcgcaagtctgatgaaataaagctcggcggtaacgctatcgctatagtgaccttgtccacatatgccgccgtatttgacagtgacaggtatgataagctgatagccgctcttgcaaactctgttcttgatatgcaggaagaggacggcagctattatcacgttttatccttcccagattttcagcgcaaggaacgtgacagaatcgtgtactatgacggcgaggcgacatttgcgcttgcaagagcgtacagtatcacaaaagacaaccgttatcttgatgccgcagaaaaagcgctcgattatttcatcaagaatgattatacacgtttttgcgaccactggatagcgtatgcggtaaacgaggtcactatccacgacccgaaggaacgctatctgaacttcggtcttaagaatgcaaacgataatctgaacaagattttcaatcaggatacgaccttccatacattccttgagcttcttatggcggctttcagcctttatgagaggataaaagagaagaatatatatgtgtcatatatgcagagattcaactttgaagcgtttataaggacgatttaccgacgtgcgcattatatgcttggcggctatctttatcccgagattgcaatgtatatgaaggtgccggaatcggtagtatatactttctgcgtgcgtcatgacagctacagaataagaatagacgatgttcagcattatatcggcggttattataatttctacaggaattttgacaagctgaacgaatattacaagcaaatcacagacaagccgaaaacacggcagagcgaaacgcccgtagacagcgagagggcctcgtttgtcaactggatactcagcaatatctgattttgagaggatagcttatgaacttcatgcaacttcgtgaaagacagccgaaattccccgttaccgtaaagacgggagagggagtagtagagcttatctggaataaaattgaatatgctgacggataccgtgtgtttgcgtcgcctgtcggcaagaatcattttgtcggtgtaattaacgtaaaaggcactactgccgtgatgaaaaaacgtgcaaacggcgttcctatgcagtataaggtcaaggcgttcagaattgcggacggtccggataattttttcggagagtccgaaatcgtcatagcgtgtccgcttgaaaccccacgcagactaaccgcaatagtcggaagcgacggtatatgcacattgtcatggagatacaactcgcagtgtgacggattcaagatctatgccgattcgaatgaaagcggaaaatattcttttgtgtgctacagcgggaagaattcctgcaggcttgacagcttcacaaaaagcggtaaggtttcgtttgttgtacgcagttttataatgaccggtcatatggaaaagctgggcgtttcttctgctcccgccgaagccgttcttcccaaatccaaaggcgctaaggcagtgcagttcgaccattcgatgataagaaaaacggcaggtgattataatgcaaggcgctttgccggcaaggacggcaggctttgcaacgatcaccataaatgcaccgtgatgataggcggcgatattaccgtttcggctgaaatgcagaaaaatgcggcaaagggaatgcccgtttttgacgaggctttttcatcgctcggcggaatattcggttcgtttgatttttccgttgcgatgcttgatacggatattaacgataaaaaggcgtgcccctaagctcagaaatatgcatgattacaccgccaagcgccccggactcggcagtgataaatccaaatgggtatatgggcaggattacgtctattgcttttgtattgagcatggcattcctttgccgaacagcggcagctacagcggttcatccgatccgcatcacggcaataaatatgaaatgctgtcggaaagtcagaaagacctgttatctcttgcgcttgcctatggctataccaatcgcacagatctgaaaacgagtcaggatgctaacgcctgctacgcagcaacgcagctcattgtctggcaaatttcattgggatttagaagttcacccacacagcttgccgataaaagctatccggcctccggctacaccggcaccatgaccgagcagtattgccgcaataagtattttaagcagtggtatgatttaatcctgtcggatatggcttcacacagtgttcgcccgtcttttacaagcaatgtctctgcttctgccaaaacctatgaaatggaatatgcaaacggcagatacagcgtaacgctcaccgacgccaatcatgtgctgaacaaatactatgtttcagtcagcggcggcgtgtcggtctctgtcagcggaaatactctgacaatatcctctaatacgcctgttaatgatgcggttactattaaactcaatcgtcggatgccttcgaccaatagtaccaccgggtttctcatttggtctgtccccggaaaagaagcggccaatcaggatatggtttccggtgtacctgccgacaatgatcccgtcccgtcttatttaaaagtgaagacagcctacggttccgccaaaatcgtgaaaacctccgaggacggcaaggtggacggaatcaatttccatgtgcagggcaacggcattgataaaaccgttcagacgaaaaacggcgggcagattcagatagataaccttacccccggtgtttatacggtaacggaactcaccgaggacagatacgagccgcaggaaacccgccgcgttactgtggtcagcgggcaaaccgcaaccgtaacctttaacaatgttttgaagcgcggcgatctcaccgtaaccaaaaccagtgaggacggcctgaacgaaggcgtgaaattccatctttccggcacctccttctccgggcttgcggtagacgaatatgccgtaaccgacagtacaggcaaggcatatttccgggatgtcctcatcggctccggttatgtgctggaagaagtagatactgccatccgctatgtggtgccggacaatcagacggcagccatcgagtggaagaaggtaacgaacaagagtgtggataatatcctcaaaaaattccaagtcaccgttaccaagagcgacagcgaaaccggtacaccgcagggagatgcgactcttacaggagcggtttatgggatctacaaaggcgaccagctaattgacacttatactaccgatagcgacggcagtttcacaacaaaatattatatttgcgattccgattggttgatccgtgagatttccgcaagcgaaggttatcttgtaaatggcacttcttatccggtgggagcggaagcgaaactgtacaccatcgaatacaacacagcgcctgctattgatgccctcgaaaccgtgcagaaaggcaaaatcgcagtgatcaagcattgcgatgacggagaaacacagattgagacgccggaagttggcgcagagtttgaggtattcctcaaagcctccggcagctatgaaaacgcaaaggaatccgagcgcgactatctcgtgtgcgatgagaacggctttgcggaaacgaagcctttgccttatggcatttataccgtcagacagacaaaaggctgggaaggtaacgagtttatggaggccttcgatgtgtttgtgagcaaagacggagaaacctatcgatacctcatcaacaatgctgaggttttaccgcagccggtaggacctacaatagctatctgctgaccgctctttacatcaagattaaggtccttgataagctctttttcgggaacgtaagagaagtcaacgtggtcaatctttacgtttccgcttacatctgtaagcaccttgttgtcagcgtcggatatttcatcgtcgctttcggtgagggcgaatatgcgtcttgccgacgcaaacgccgattgtaattcggtgacaacgcctgaaatttcgttgaacggctttgtatactggttggcatatgataaaaatgcggaaagctgacctaccgtgataccgccgcctatagcactgagtgcgccgaaaattccgacaccggcatatacaagaccgtttacaaatcttgtggagggattggtaagagcagagtagaactgcgctctaacgccgaccttatacagctttgcgttaagctcttcgaatttttcttcgctgtattcttcacgggagaaagcctttacgaccttctgatttccgatatattcttcggcaagtccggtaatctgacctctgagcgccgcctgctccttgaatttctttgagcaaagtcttgctatggtagaagccacaatcagtgatacaggggtaataacgataacaacaagtgcaatgcctacgtttatcgagaacataaagcagagtgttcctattatagtgacagagcctgtgaatatctgctgaaatccctgcagcagaccgtcagatacggtatcaatatccgcaacgactctgcctattatatcgccgtgcggagtagagtctatatatttcagcggtacacgctggagcttgttgaaagcgtctgttcttaaatcccttaccgttctttgagtgagtatgttggtgcaataacccataaaccactgaaatcccgcacctacgattacaacaacggcgagctttataattatcggcaggatttttttaaaatcaacgttgttaatatcaatgataaagtcaacagcctgaccgataagcacgggcgcatacagcgttgctattgcgcttataacagcgctgactatcgtgaaaacgagatagaacgtataaggctttgtatatttcagcagctttgcaagaactgtaaaaccgctgtcgttagtttttttactcatcgccgtttatctccttttcaagttcttctgcactgaactgagtaagacagatctgacagtaatcggtacagctctgtaacagctctttatgtgtgcctatgccgactgttttgccgtcgtcaagtacgattatctgatcggcatttttgaccgtgttcgctctttgagaaatgataaacaccgtcatatcagagcagttttccttgattgccgttctcagctttgcatctgtagcaaagtcaagtgcgcttgcgctgtcgtcaagtatcagtatctccgggtctgcggctattgcccttgcaatagtaagtctttgcttctgaccgccagaaaggttcttaccgccctgaagtatctcgtaatcaagtccgttttcgagcttttcgacaaactcataagcctgtgagattttcagcgcacgccatatctgctcgtctgttatattatctccgccccacttcatattttcacggattgtaccgctgaaaagtacggctttctgaggaacgaccgctatctttttgcgaagacggttaaggctgtattttttgacatctgttccgtaaacttcgaccaaaccttctgatgcgtcatagaatcgtgggataagatttataagcgttgatttaccgctgcccgtaccgcctattatgcctatcgtctgacctttttcggcggtgaatgatatatcttcaagtgcatattcactgttatcgtgatagctgaaatataccttgtcgaattttacggcttttttggttacgttgttgctttcatcggtgtacgtttaagatgtatgagagtttttaatgatacggcgaccaccgagatctacacgtactgacacactctttccctacacgacgctcttccgatctaagattatcagtaaaattatataaaccgcaccgcccgaagctatcggcaaaaacagagccgtcacagcattgacgctttccccgacaaagccatacacaatgcgtgatacgacagcgcatactatcccagcactcagaggaacagccattcttctgataatgtgaaaatctatcccggtaacattttcaagcgcaaaatatcctcccagtgcgaccgccgcatacataataaccgttgaaacagccgccccgtttatattgatagccggtacagatattgtaaacacgttgaatatcagctttatcgcacagcccggcatcattagcttcacaggaagatccgaccgcccgatgacctgaaatattgaaataaacgtagatgacaaggtcagaaaaacaccgccaagccccagtataaagagtgatgttgcactcaccgtcacctcctgctgtctgcccgaaaacaaaaattcaagtatctgcctgctcatagccgacagcccgagatacagcggaaacccgataacaaagtttgaacgcagaacgaccgtcaccttgcgttcgaattccttcctgttgccgagcgtccacgcacctgctatctgcggcagtgcgctcctgccgaacatagccgtgaaagaaggtatcagcatgaacatcgtccacgaaagtccggtataactgccgtacataaagttcgcaagccgcacagcaccgccctgtgcttttattatgtccgaaaaacacgccgcaaaatatcccggatcggacgaaagtgcaaaattaagacagcgtggtatcgtgataaggtcgatgaacgaggacagattcacaactattgcggcggcggaaacaggaatgcaggattttataagacgctttgcgattactgccaccctgtctgtcgaggtatcgcccgcagacgtgtctataatccttttgcagacttttttcctcacaagcaggcaaacgagtgcgcacagctcgctcaccgtaacggcaagaaccgcacctgccgccgcataaggcattataatatccacagcctcgcttttacttcctgcaatcacaccgaataccatttcgccgcctgcatagcatttcattccgtattctattataagatgcgacacagaaagtcctgtcacggcacggcagaccgattctgcgacctgcgacacagccgacggcatcatattacagcacccttcgtaatagcccttatataccgatgatatacagcacagaaagaccgacggcgctattgcgattattccccatacgctctgcggagattgtgcgaccgtatccgaaaacggccgtgcaagtgccagtattgccgcagtgccgataagacctgtcgctccgaatatcaagacagccgttctcagcaccttttgcgcatttgcgaatctgcgtaaagctatgttatccgcaaccgcttttattataacggtaggaacagccgccgcagtcatagcgaaaacaggcgtgtagaggctgtacgcagtcgagtagtagcccattccgataccgccgagtatattggtaagcggtatcttgaaaacagcgccgactatcttgcttatcaccatcgaaacaaagaggattattgtgttttttacataggtatttttcaaacaatcagtcctttccggttaattctattatccttgggacaagaatataccggatacggctacaactgcatcgctatcggcaaaaaaagacgctcacccaaaacggataagcgccctttgatactattctttttctataccttgaagtcaaacggatgcttttcttcgggaacggcagacggaacatactgttcatatgccggctgtgcatttccgctgctgaagtctatttttaatgatacggcgaccaccgagatctacacgtactgacacactctttccctacacgacgctcttccgatctaacggcaatcttctttgtgtaatccttgattgttgtgacttgcttttccgtaaggttcaaagagggcaggatacaagcggagtcacctgagtgaacgcctgcaagctcgatatgctccataacagcgggaacaaagcagttcttgccgtccgagatagcgtcagcctcacactctgttgcgtggtggaggaaacggtcgatgagtataggtctgtcgggggtaacgccgactgccgcagacatatagaccttcatcatttcatcatcgtgaacaatctccatacctctgccgccgagaacgtatgaaggacgcaccattacgggataaccgatgcggttagctatttcaagcgcttcgtcaacatttacagccattccggattcgggcatcgggattccgagcttgtccatcatagcacggaagtgatctctgtcttccgcaaggtcgatagtttcgggagttgtgccgagaatgtttacgccgtatttcttaaggtcgcttgcaaggttgagcggcgtctgaccgccgaactgagcgataacgccgagcggcttttccttatcgtgaatcgaaagaacgtcttcaagagtgagcggctcaaagtagagcttatccgatgtatcgtagtcggttgaaactgtttcggggttgcagtttacgatgatagattcaaagccgagctttttgagcgcaagtgccgcatgaacgcagcagtagtcgaattcgataccctgacctattctgttgggaccgccgccgagaatcattatcttgggcttgtcgctgacagggcttttatcctcgtcaagatgataggtggagtagtagtaagccgcattgtcagtaccgcttacatgaacgccttcccacgcttcctttatgccgaagccgatacgggcatttctgatctcttcctctgtaacctcaagaagtgagcttaaataacggtcagagaaaccgtccagctttgcctgctttagtacagccttttcgggaacagaacccttgatcttgagcagtgcttcttcttcgtcaacaagctccttcatctgctgtaagaaccagtccttaatctttgtaagggcgtgaatttcttcaatagtagcacccttgcgaagtgcttcgtatataacaaactgtctttcgcttgtggggtatctcagctgtgctaaaagctcttcctttgtcatatcgtggaagttcttcgcaaagccaagaccgtatctgtccttttcaagtgaacgtatagccttctggaaagcctctttataggtcttgccgatgctcattacttcaccgacagctctcatctgtgttccgagcttatcctctgcgcccttgaacttttcgaatgcccaacgtgcgaacttgattacaatataatctccgtcggggtaatacttgtcgagtgtgccgtacttaccgcagggaatatcccccagcgtcagaccgcaggcaaggagggcggaaacgaaggcaatagggaagcctgtagcctttgaagcaagagctgaagaacgtgatgttctggggtttatttcgatcacaacaatacgtcctgtttcgggattacgggcaaactgacagttgcagccgccgataacctcgatggattcgataatgcggtaagacatttcctgaagctctttctgaacatcttcgggaatagtcagcataggagcagagcagaacgagtcgcccgtatgcacgccgatggggtcgatgttttcgataaagcaaacggtgattttattgttgtcggcatcacggacaacttcaagctcaagctcttcccagccgaagatacattcctcgacaagcgtagtaaccataagtagcagttcagccgccttgataacgctgaacaccgagcttcctacacctgccgtgtcgatgattatgtaatcgaaatgctgacgcatttcttcgcaaactcccataatcttttcggggtttatgtccatgaacgggtttctcgtagcacagacaagatataagttctctactgtttcaacctttgttgttgcagtaagaatgtctatctttccttcaaggtactcacctatatcatgctttactttatccttgatgccgagcattatatcaagacatcttaatccgaagtcgagctcaacgagaagtgttcttttgcctaatgcggctaacccacgagcaacgttagccgaagtggtggatttacctgttccgcccttacctgcggttactgctataatctgtgacataaaattcgctctccttgcgctgatacgcataatttgcttatcattgttctaattgtttttattgtaccataaaagcgagcataaataaagacttttaagtgaaaaaaataaaaatttgttaaatcaatatgttttacactcgtttttttgtgcatactgcataataattgtcagttgtttgtgttgcttgaggtatctgaattgtttttatcagcctctccccttgcaggtcttcccggagtgttggtactctgaccgccccacggaagaataatatcgcccttttcgtttgtaaccggcttatagttattgtagaaatatgactcgatgatatttctaaccataagtctggagaactcgcccttttcaagaacgataccgaaacatatctgtgggtcttctgcgggataatatccgagaatagttgagttgaacgtatctgtggttacctgaggcgtacctgtttttatcgctacgccgtagggcagatccgcaagctgtgttatacctgagcccataggccactgtacatcgtccgcaaccattatcataccttcacgcactacctgaaatatatgcttatcggcatctattttatacgctacagtaggctcagttttctttattgtctttgtgccgtcatagcttgtgacgctgtctacgagatacggctgatagcgtgtaccgtcgtttgcgagtgtaagtgctatcacagcgagattaagaggtgttacggtcgtttcgagctgtcctatacctgcctgtatagtcgagccgggcgtccatgttccgccgagcgattcaatgtattcgggcgtactcatattgcctgtcgccccgcctatttcaaggttgaggtcctgaccgacaccgaaccatcctgctaccttagcaagataatcaatgcccatctgacgagccatatcatagaaatagatattacacgaatatctcagtgcggttcttaccgtaacatcgccgacaaagcccatgatacaacccggctgatagtcgtcataatatgtgtagataccgccgcagtaaacctccgtgttctcgttggcaatacccgaaacaagtgcggcggtcgccgttattgtcttgaaggctgaaccgggacgataaagaccgtatatacatctgttgtaggtcggattcgggtctttcggattattgataagatcgatataattattaatatcatagtttggatagttcgccattgcaagaacggcaccggtctttgcgtcaagtacaactacgccgcctgcgtccaccttgtttcctcgtgtaggatcattattgtaatggagccattttatatggttttcaagaatcgcctgaacatcgttctgaaaatcgctttctatagtcagccttacggaattgcctgccgttgccgcctttgttatttcgtctgaaaccaccatacccgatgaatttcttgttatggagcgtattcgttgcctcttttgccgatataatcaattactccgacatattgcagaattttgattgcgatgcctgcatcgcctgaacgcatacaccttttgaattccttgagtgtaaaggtttcgggtaatccttcggggataaagcatcggtagctgtcgctgtcctcaagaaacgtaaggcgaagcagggaagtgggaacggctacctttctgtctgtctttctgcgtttcatatcctttgcgcagtagcgaaggttttctacggctatatccgcaatgcagacggtcagattcggatcgttcaggtactgcctgattcggtacagctcaaggaaaaaatcggtcatatcgcttgcggtaacgttccttccgcttttcagtatctcacctgtagccttatcgacataattaagacggctctttttatgaaaagggtagactatcgtaacgtgcgaggctttgaggaacgtattcagcttaggtacaagatagctgaaatttgccgtctgtatctcaaatattccgttctcggtaacaaggtcggcaaagtaactgcctatctttatttccttatcaaaaagagtggtggcaaaatagcttttcagcgtagcgtgtatctgcttttcgttcagtatgcccacaccgtcgccgctgtcggcggtagcagtacaggcgctgaaccgtgcgttgtcgggcgaaacgtaaagaggctgtttatcatactgcctcaccgtacagctgtcgcactgtatgaacacaggcacaccgccttgctcgtttgaacggattatccccgttgcaagttctttgagcttatctgttgcattggatacggcatagcatctgtctgctaccgtaaacattgatatatcgtttgtgttgtcgccgaaaactataagctcatcagcaccgacaagctccttcagcttcagtgccgcatttgcctttgaaacgtcctcacggtagatttcataccaatattcgtcggtatcgtatgtatcgggctgatagtttcttgaaaagccgtttgttttgtaaaaatatcggtcaagctcatcgggcttcattacaggctcaataagcgttatataataaatatcgccttcgaacagctcgtcatagctttttgctcggtgcattcttctgtctccggctctgtcctttaaataacgctccgcacccttgttgagtcggtttttaagatagcttactctttcgtaattgtctatgaccgagtacacaagcacagattctttatgttcatagaaaaatgactttatgaacgattttgattcttcgctgaaaaaatgcgttacgatacgctcctttgtgacagggtcgattataaaagcgccgttatgagttatcactggcagcttaaaattgatacagcttactttcggctcggctgaatgcactgaacgtgcggtggcgtagcttatctttatatcatcgtcaataagcctgttcatcagcgcctctgtcattcgtccgatttgcgccttatggtcaagaagcgtcccgtcaaggtcggtaagatacagtttcatttgatttctccgattacaatttatttatatttatatatctcagtatggggtttggggcgtagccccaaggcgggtcgcagtgacgccagtccccgtatcccccggcgtggatgccgggcgtgtatgcccaagggctttgcaaggacgcaaagccaaccaagcatacacagcctttcatggggaaagggggcagttcggcatggatgctgaaataaggacacaccaagctttgcacgaggcaaagccatcagagtgtcctaaggggatagggataataaatcagaagatgagaacgcccggctatatgtctgaggttctttacggtatcttcatatactgggtattaaagcagagaaagtacaaggtaaaggaaaatcagcttgtattcttcagagaaaccaatgccgcaaagtgcaaggttactcctgtaaaaacagcggctactcccaaaaagccctaaaaagtcgaaagcgttttaaagaagataatgagaaacaccttccctgcatatcgtgttgctttacgaaacgaggaaagactcggcgcactggttgcttctgttaacgatcttcagaaaaagtctacagaacacagcgtgctgcttgcgagaaccgtaaaggtttgtcagagcactgctcctaagagcgtacaggcagcggttgctaagtctcctatcatcgctaccagtcttcgcaaggatatatgggatgcaaaaacgctcacttcaaatattaatctcaatattgcctgccttgctaatgagatacacgaaactcataagaagtcattcggcgagttcagaaatatcaataccggcagagatgttgttgtaatggcatcaggaccttcgatgagatactacaagcccattcccggtgctgtacatataggtatgaatgcttcattcttaaatcctgatgttgatattgattactattttactaccgattacgaaagccgtgctccgtggtttgaaaagctgaaggaatacgattttgtcaagttcttcggtcagtattctactggtgaatacagagataaattccaggtatcagagaagattatcagagagaataacggtagaagattcttccaggcggctcccagtgaggatatacatattaatatagaattctatccccttatggcattctattcaattgcgttccaggctatccactttgcactctttaccaatgcgaaaagaatttatcttgttggttgcgactgcaccaatgcgggatattttgacggcagcaagcagagattgtcggatcttgtagcaaagacaagtgttccacactggttagacggttatcagaaggtcaaggcgtttgttgaacgcttctatccggatacagagattatatccgttaatcctatgggtctcagaggactttattcagacgtttatacggatgacttcatagcagatcatcctgaaatagatagcagtaaagtaacacgtcttaacagcacacaggaggaaaaatgaaagttgtaatactcgccggaggtttcggcacaagaatcagcgaagaaagccagttcaagccaaagcctatggttgagcttggcggtatgccgataatatggcacataatgaagctctattcttcttacggcttcaatgaattcattatctgcgcaggttacaaacagcacgttataaaggagtattttgcagactactttctgcatacatccgatattacatttgacttcacaagcggtaaaaacgagatgattgttcaccgcaacagctcggaacactggaaggttaccgtagtggacacaggtcttaacacaatgaccggcggacgtgtaaagcgtataaaggactatgtcggcaacgagccttttatgctgacatacggcgatggtgtttccgatgtaaatatagctgagcttgtcgagttccataaaagtcacggaaagctggtaacaatgtcggcttacaaccccggacagagattcggcgttcttgatattgatgaaagcgggagaataaatgaattccgtgaaaagacatccggcgacggaagccttatcaatatcggctatatggtatgtcagcccgaattcatcgattacatcggacgatgttcttaagaactgggacaagctcaaaaagaaatccaagcaccaggacaccgttgcggatacccttgacagcgtgccgatggtactgcctgcgcttatgcgtggcgagaaggttttcaagcgtgcgtcaaatgcgggcgtagcgctttccggtacaagtgaagccgttgatcttgtgaaagaaaagctcgcaagccttgagttggctattaatgacaaaaacgaagcgcttaccgaagataattttggggaacttttactctcttgctgtattttatcacgttttatcaaaaaagattgcgaaaaagccttgacttttgctgtaaataagtttataatgcgttttagagagcttgagagtaatacgaggtcgcaaggcaaaacgctcgacaatctgtcagatgagcagataaaagcgctgtttttaaattctgattaaccgtaaagcaattagtcggttgaccgtattacgtctgttagcttttatgcttaacaatattaataattttaattggaggattactcaaatgacaaaagcagaattagttacaatggttgctgaaaaggcagatcttacaaagaaggatgcagaaaaggcaatctcagctttagttgagagcatttcagaaacacttgccaagggcgaaaagatccagctcgttggtttcggtacatttgaagttcgtgagcgtgcagctcgtgagggcgttaacccccgtacaggcgacaagatcaagatcgctgcttctaaggttcccgctttcaaggcaggcagtgctttaaaggatgcagttgctaagtaattaagtctggttcaatagcggaggcggtatttttacagcctccgttttttgttttgttttaaaggaaaggtttattatgcggcttgataaatttcttaaagtatcacgtcttatcaaaagaagaacagtggcaaatgaggcgtgtgacgctgaaaaggtttcggtaaacggtaaacctgcaagagcctcttatgatgtcaaggtcggagatgagattgagataaatatgggcaaaagcccgcttaagatccgtgttcttaaggtagtcgaggtagtcggcaaggacggagcctcagacctttacgaagtggtataagcataatacggacataccccgaatattatttatcatgcggtaaataacattcgggggtgttttttatggaaaaatcactgcagaagctgacgctgaccgacaggagaaagctggaggtgggcggagtgcttgaaatcatttcctatgatgatgagaacataactatgtatactgcgctcggcaatctgcgtatcggcggagagaatcttgaggtgggtacagcgttcagtgaaaacggcactgttgagataacgggatacatacgcacgatacatttttgtgacggcaagtcaagatatgcggataatttcatatcaagaatattcaggtaggtgggtgtatgaacgaagaaacatcgctgatgtggcagattgcctgcttttgcgtctgcggggcattgctgggagtcttatatgagccgcttcgcatattacgtctgataatccctcaccacagctttataacgggagtggaggatactgcttatctttccttgtgcggcgttgtcctgttcgggctttcgatggaaacgggaaccggaaatttccgcctttcgtatcttttagccgccttcgtcggaggggcagtgtattttcttactgtgggcaggcttataaagattatttattctgccgtgataaagaccgttttcaaggcggtgaaactctgacaggcagagtgtctatccacttctgatcattattctgaagtattttcagcgtttttgcaatgacatcgttttctgtgcctgatttaaagaacgccttctgcacgataatcttatataccagtctgttggtatttactaccttgccgtccttggtgaaaatctgacctcgtgccgcctgcacagtctgatttgccgtatatgtgtttgctgtctggtctttataatactcaccgtcaactatctgtatctgcaaaagctctatagtgcacgcaaaggataataacacaacaacaagtacaaaaaccagatttcttatctgtctgctaagtttgctcactccgccctccgttaatatcttactttgtcttcatcgtcttcgatatcttcaaaagcggtcagaatatcatcggtattattttcgactcccagttttttgtttatctgtctgattatcaaataaagcggtgcggacagaattacggtcgctattaaagcgggaagcacataattaatcagcactacatcaatctcggggtttctccatattatatatttgaataatagctccgctgactgcaccagaataactgcggtcagattcatccagagaaagttcagaatatttctgtgaataaggtttacaacaagcagagtaacaaaaagacagcacggcatcagccatatcgacgtaaacccgaacagcgagcccatcgcaagatcgtgcatcatccctgcaaaagccgcaaagacagcaccgctcagttcttcgctgaaaaacgatactgccacagctgtcgtaagcgtaagatagggctgccatgacgcaaacggcatagtcacttcaattgtgtatgacaccagcaaaacaagtgaaaaaagcacccactttgcaatacttttaaaaatctctctgcgtgtcatggcagaatatctgagaattctgaatttcatcagtcaacaacaccctgccctttgaaatctgttattacaacgcaatcggttattgtacggacatcgacagcaggctttataaccgcatgaacggaaagtccgttttcgtcatcgtataccttttcgacagttccgataagaagatttcccgggaaaacaacaccggcaacggattttactatctcgcctttcttgatgccgctgttctttgtgatatagctcataaggcagttaccctcacttgcattctttatatcgttgtcaagtataccggtaaccttgctgtcaaaggtcattacacctacgtttatctcatcggagagtatggtagatacctttgcgtaatttggcgctatctcgctcaccatacctataagtccgtttgatgtcattacagggtcgtaaagcgaaatcccgtcatccgagcctctgtcgattgtgaagcctgcatacgcatcattagaattatgtgcgattatattacagggtgcggaaaattcaaaatcagagttttcttcttttatcttcagtatttctttaagctgatcattttcgtgcttgacattttcaagctcgattatctgacggtattgttcattgagcttgtctttaagctcctcgttctcagacttatatctgtctgcatttgcaaatttgtccaaagtgccttcaacccactgcgatacggcatttgaaactgtaacaaacggctttgctattgttgacagcacattttcggggaaggtagaaaaaccgcccgaaaccgcagcataaataacaacgccaagcaccaacgcaaaagcgcaaactattatttgaacagctatgcgtgacacgatgggaaatgcggcatcgcttacgggcggatacggcaacagctatgcggttactgcatgccgttgaaatgaatgtatgcggtcttatgaatatgcagtacgctattgaagacgatactgtctatgttcttgaagctaaccccagagcatcccgtacagtaccgctggtatcaaaggtttgcaatataaacatggtacagcttgctactcagataatcacatcatcgctgacaggcaagccctcccccgtacccgagcttcacgacaaggttatcaaccactacggtgttaaggaagcggtattccccttcaatatgttccaggaggttgaccccgttctcggtcccgaaatgcgttcaacaggcgaggttctcggaatcgctcccaccttcggagaagcgtactacaaggctcaggaagcaacacaggtaaaacttcctcttgggggaactgttctcctcagcgtatgcgacagagataagcccgaactgcttgaaatcgcaaaatcattcagcgagcttggtttccgtatccttgcaacaggcaagagctatgatatgataaaggacgcaggcatcaccgctgaacgtatcaacaagatgtacgagggcagacccaacatcaccgatgcaatagcaaacggcgatattcagcttatcatcaacacacccgcaggaaagacgagtgcaaacgatgacagctacatccgcaagtcagcaatcagacataaggtgccttatatcacaacaatggcggccgctaaggcaagcatcgagggtataaagtcacttaaagcaaacaaacacttcggcgtaaagtcaattcaggcacaccacgcagatataaagtaaataatatgaacccccgtcacatgacgggggttctgattttcacttatctatatcctttacacgcttaaatgcgtaccaccgaatcctcaggtgaatttttcattcttttagagccatagattgccgtgcatctgtacttcagcctcaacttatcggcaataagagcaacaaattcagagtttgtcggctttcctctcgatgtatgaatagtgtatccgaaatagctgttgagcgtgtctacatctcccctgtcccacgcaatttctattgcgtgacgtattgcacgttcaactcttgacggcgttgtttcatacatacgggcaacggtcggatagagcagctttgtgatacagtttatcatgtcaggatcctcaaccgaaagcatgattgcggttctgagataatgataccctttgatatgagcaggtatgccgatctgatgtattatctccgtcactacgcactccatatccgattcgtccgatgcggtattgcgtctgccgtttatcttgtcgttatataccgacagaacctttgacacaagcgtttccggatcaaacggacgtatcatataatagtccgctcctgcgtccatcacctcaaactcgacctttgccgaatcatagttcgccgttacgaatataacaggagcatattctccgcttcctttgagtgtcctgattatatcgcagacatcaagaccgggtgtttttgcgtcaaggataaccacagcaggacgctccgtaagcacataatcaacaagaacctttcccatcttcggtctggttatcgcatacaaccctgcctctttgaaagcggtggcccatgatattccaagctctaacgaatcatcccctataagtactctgatagattgtgacattttcttacctccactctgttcttgccgaaagcataagtataggagtattcttgaactttcttatttccttgcaggctgaaaagccgtcaagccttggcatcataacatccattattattatgtcgaaatcctgctccttcgccatatcgacagcctgcataccgtctaccgcctcatataccgtatggccctcatattcggcatattccttgatgacctcacggattttctgttcgtcgtccgctacgagaattttatacatattctttattcctttcttttcggctatccgtttattgtaaaaaaaattcagtttaacaaagtaaactgaacggagataaaataatgcacaaatcaaattatcaatgaaatgttgggagaggaaattatgattattgaattattcaaccaccataaaatctgtcagttttacctgacgcctattattatatccgccttttatgatgaaaatgtgtttgaagtctaaaaaaacgataaatcgctttttcactttatttacttattttttatccgctatgcctctcatgaatactcctgcgagcttttcacaggtttcggggggaactgcatataacggactgttaagcgttgagctgtcacccgttggaatagcgatctcaagccttcctatgctgtcttttatgttatagctcatcttaccgccgatatatccgatatacagctttgcactgtacatttcgaaatcgtcggctatcattcccgtatgcgtatcggctgaaatcgagaaggacgagctgatgttgatgttgttgtccgaaacgctgacgctcagcacgaacagatttctgtccgagcatctcaccatagctttgagtacgctgaacatacatacatacaacagcttttcgcttatgttgacaggtatatcctcatatatcggcttgtcggtgctcagcttgaaaacgataggaatatcactcatttccttgttggcacgctctattattttgttcagcttttcaaagaaatatatggcaggcgcagggggtgtcttacggtaaatgaccgtggcaagctccgacagaacctcgatattgcgctgtatgctgttcagtgcattatcttcattgcagctctgcgtcgcttttgcaacatcgcttcttgcctgtgaaagcatataacatatatcggcataggtgtttgtgcttccaagctgcatcagcacatcggtaagtgtattgacacgccacaggataaaacgcttatctccgtcagcaaaggaagtgccttgagcagagtattccttcccgtcgatatttatctgttcggtaagaatatcgcagtttatccctttcgggaaaacgattgtttctccgcaggctgtatttttccatttgatattaccgaattcgtcacttaaaaagaacggtgttcccgatgagccgtaaagcatttcgagagattctgttattttctccatagcaattgtgtcctttacggaattttatttgttttcgttgtcttttatcagcttctgctgttttcctttatcgtccacaacatacaccctgtcaagctcggacataagacctcgtttgaaggaagccctgtattcgttgcgaagctcaagctgttcctccttctcctcggttgtaagctcacgctcccttgattgacgggcaagataatttatcctgtctattttagctttatccataattaaatttcctttattcaagattttttatttttgtgattattctgttcggctttttaagtataaaccataaatgatatttattcagaagaattatcaatgctaaacgaacatcagaccgaattgcgtaatcaattgcgttcatcggcggctatggcatttgacaaaatagcagcgcagctcagagccggaacattgccgggtcagcagaatttatacgaaaatatcacgaagctcaaaaatatccttgattctaccaaaggcaaaaaagtgtacaaatttctcaagcctgaagctaaggctgttgttgacagcattacacagcagatttgcagaaacaaggatatacagtcattatatgaacaatggtgcaattgtcaaaaagatcgtataggcatttatacttcgaaaattccggatttcccatcattagaagaaaatccggaattcaaaacgataaaaaatcatattatcagagctgtagcggaaatgtcggatattatcgaaatccaatcagataaaattcacactgaaaatccggtgtttgagaacataccgttacctgataacccgcctattgtacatgaaaatgacgaaaatatcaaggaagttatcaacaaacaaactgctgacactgaagaaaatctcaaagaagaaactgccccgactatagatcctgctgtcggtggcattgctatttctctgtttggtcagctcacaaggatgatgacgcaagactcaaatattgatcagtcacaatttgttaaccattctgttgagacagaaatattaagaaaagtacttgagagaaaattagctcaaggtcaaaaaatagaataaggagtgaaagcgcagtgttaaagttggactatttcaaattgcctaactatatatttgccgcagatcttacccacaatgaatttgccgttctcgtctatctcatttcactgcacacaaatatacatagtaaaacaggcgattacaaacgagtacgacaaacaactattgctcattcctgcggtataaaaactgcgcaaaccgtatcgagaatcataaaatcgcttcatgaaaaaggttttatttctcatataatcaaagcataccgtcctgacaatctgataggcacgtatacttatgttcttaacacagaaaaactatgcggtgaatacacacctataaaacgctctgtgtttacaagaaatcttaatgcaaaacagcttaaagtatatttataccttttaaagtgcatagataaaaagttgaggtactgttggaacagcttcagcgatatatcaaatgcgcttaaaataaaaagagatgatgttatcgccatagtttctgatcttgtctatgaaagatgtatcagaaaaacgagaaaactcagatatgataacaggaacgtatattctgacaacgtttatagcattaaaacagtaaaaaaaaaaaaaaaacgtttaaaaaaagaattgcagttcctaatttgccctcagaactgcaatcacatatcaacatacaaaaataaatttgtacacttgtataatagcactttatccgaactttgtcaatctatttttttgagggtaaggggtagcccccaaaatcgaagttctatatataaaccagttgttttattgcgaaaataagtataagtgttgattctattctttatattcctgctatattaacgatacttataacgaaattttcggttttatttttcgctataagcgcacaatgatgttattggattattctgtatgcggttaaatcactaataaagcgttgctcttgaactgatcagcttgagtatgatctcgtcatatgctccgagcggaaacgatattacatcggtgaccttgtttttgtcacggaactccttattgatgcgttttatccgctcgttgtcaacaagcgttaccgatacgtctgcgtcaccgacaaaatcggtaactctcagcgtttctgctatgcactttcttataacagtgcgaagaccgttaggtacttctattgctttctggttgtttctgaaggacatatatatttttggtgttttcttctcagacatttttactttcctcatttaaaagcggtcagcttttctttctttcattgtactgctcataggctcttactatatcctgtaccagcttgtgacgcacaacgtccttttctgtaaaacggttgatggcgatgccttcgatattcttcaatatctttgtcgcctcgacaagtccagaacgttttgaatcgggcaggtcaatctgggtaatatcgcccgttatgaccatcttgctgttaaagccgagtcgggtcagaaacatcttcatttgttcgggagtcgtgttctgcgcctcgtcaagtattataaagctgtcgtcaagcgttctgcctcgcatatatgcaagcggagcgacttctatacagcctcgttccatattacgctgaaacgcttcagatcccatcatatcgaaaagtgcgtcatacagcggacgcagataaggatcgaccttgttctgcaggtcgcccggcagaaatccgagcttctcgcccgcctccacggcaggacgtgtaagaattatacgttgcacctcgtgtgccttgaacgcccttaccgcaagcgctacggcaagatatgtcttacccgtaccggcaggacctactccgaacactatggtgtttttctttatgctgtttacatatttcgattgaccgacggttttcgcctttatcggctttcctgtatggctgacgcagacacagtccgcagtaagcgtctgtacctcctcgccctttccctcgtttgtcatagaaatagcgtatcttacgctctgctcggtcggcgtttcacctttttcaacggttgaaatcagcgtttttattacctgctctgcgttatccacagcgttttcatcgccttttatgcgtatctcatcgtcacgggtgaatatcgaaaccttatattccttctgaataatgttgatattgttgtcaaagtcaccgaaaataaggtgaatccggctcatatcctgaatgctaacagctttttctgtcatttatcgtgatatattcctttcaaatcctgaaattcatctgttttatgctctattctatgatagtatatcacattccgggctttttttcaatacaattttacgctaaatcaatataaaacagtaatcggttgctttacgccgatattacgctccagcttatatttcactgtcattctgataccgttttcttccgtacagacctctctttcatccgaaagtatcctgcactgcgaaaggaaattctcttcataatcctttttctgcttttcaagctgtgtcattatatcacgggcggtatatctgacggttttctccgacagccttgtgtaaactccccttttatatctgtacggcgtgtctgcgccgagaatgcttacattatatgtatcctcgctgtaggtaaagatcggaagagcacacgtctgaactccagtcactccgcgaaatctcgtatgccgtcttctgcttgaaaaaaaaagatagaaacaaatcttggcacgataacggctgttttatatgccgaatttgctcccaaaaccgtggcaaacttcaagaagcgtgccgaggagggattctatgacggaaagccgttctttgcgttacagaaaggtatttacgcaattaccggcgcttcaaacgatgaaggtacggaaggcgttaccgacgacggcaagttcattgagaacgaatgctcggtcaacctttggccgttcaagggcgcacttttaggatacagctcacagcagggctactcggacagccgattcttcttcacgggagcacttgagataaccgaagaaaacaaaaaagagctgagaggctatacagaccaggaaacaagcgcacaggtaatccccgatgagcttataacagcctttgagaaaagaggcagtgttccgggctttgccggcacttacacggttttcggtcaggtgataaacggctttgacacgctcgacaagatactctggtcggcttccgacaagagcacgatgaagcctcttgaggaaatcaaaatagtaaaagttacacttgactcctacaaggacggaaagttcaccatagaagaacctacttccgacaaatatcttactgccaaagaaatcgcagaacttcaaaacgaatccaacggtacaagcggcagtaacagctcaacggcaggttcttcggattcatcatcaaactaagcctgcaggcgaaaggaccgataaaaatgaggtttaagtctttatgcaaagctgcagcggcggtaactctcgccgcagccatgataacggcaagcggctgtaataacgagaaaaacgataacaccgcagaaataaccgtaggacccggcgatacccttgccgaaatgacaattcagataggcgaggaaacgggaaagatacgtttcaaactcttccccgaggttgcgcctaagggcgtcgataactttgtcaagctggctcagagcggatattatgacggcaagacaatccacagagtaatcaaggattttatggtacagggcggctcgctcaggggtaacggcacaggcggaacaacagccgacaagaccgaaattccccgtgaaacgaacaaccgtatgagagcttattacggtgcgctgggatatgcggaaggcagtgacggcatcaacagccagttctttatcgttaacaacaaaacgccgtttgacattgcaaagactgctgcgaatatttcctccgaccttgaagaatacaaggacagactgaaggaggaggacaaaaagacttataccgattatctttcaaagctcaactccgttccggacgatgtaaaagcaaaatacctttcaagcggcggtgcgttcagcattgacggtaactatacgatattcgggcaggctatagaagggcttgatttccttgacaagataagtgctgtcgaagtttcgtccggcaattccattgacgatgaggccggcatcgcctctaaacccgcagtttcgataataatcaagaaaatcgaaatcgccacaatcccgacaataaccgaaacagaggctaccaccactacaagaaagagcatccgcccgtcagcgactactccagctccgagcgatacgaccacagcggaaactcccgctcccgacaatacaactgcggcagaaactactgctcagtaacgaaaacagataaaacccctgcgttgcgatttaatgcaacgcagtacagccgtgacaggataacggcggaggatattgctaggtttgatgaggagatgaatgagtatgaggcagagatgaacgaggcggattgcactgaaatttatgaggaggttatatgagcgaaaaacagaaaaacaaggacaaggacagcgctccggtatataagagcggatacggcaacgcactgaaaaacaatcttgcaaaggttatggaaaagaagaacttcacctatgacgcagataaggacaagctgttctcgcagtataagaacagctatgaaaagtcgggcagaacagctatgcgtgacacgatgggaaatgcggcatcgcttacgggcggatacggcaacagctatgcggttactgcaggtcagcaggcgtacaacagctatatgtcaaagctcagcgataagattcccgaacttgaacagagggcgtatgaacgttataaggatgatgaggaaagtgcgtataagcgactcaatacgcttatagggcttgagaagtcggactacggaagataccgtgacagtgttgacgattataacacaaacaggaattttgaatataataaaagcaaggacgctttggcacagcgtaatttgcaggcgcagtttgaacgggataattacgagaacgacagggattataaccgcagggtatatgaaaacaacagggattataaccgtagggtgagcgaaaatgacagggattatgctcagaaggtgtatgacagcgaccgcaattatcagataaaactgaacagctcgctgaaagacgctgtggagaatgaggaaaccggcagtacgaaattttcgccgagagacgcttatgattttatcagcaagtacggggataaaatctatacggatgaagagtatatcgaggcactttatcagctttacggtgataaggagggcttctttgactgggtggagcagatggagatacccggtgacacaaatggcacaacgtatcttgagctgttgtatgagatacatccggagcttaagccgacaacgtttaagaaaatgggtatgcctgatgacgagcttataagaagaaccgcaacaggcggcggagctacgcctcctcattcccagagcttctggtggttgaatcaggggatgacaaaaaagtaaaaaagtcaaagcaaaggaggggaaatatgagcaggatacagataattatagacagcatagcaggtgctgtcggagcggtgctgggatttatgtacggcgaggtaaacggtttgttccgtgcgcttatcgcttttatgatcctggactatgtgagcggtgtgcttgcggcgatagtggagaagaagctgtcaagtgcggtaggcttcaaggggatagcgaaaaagctgctgatacttgtgttcctgtcggtaggtcatattgcagacacatatgtgcttggcggtgtgcctgtcgctatgacggcggtaatgcttttctatattgctaacgagggaatcagcattgtcgaaaacgcatcagcactgggactgccggtgccgcagaaaataaagaatgtactaaggcagataaaaagcaaaagcggggaggacgacagtgagaacaaagggcattgatataagcagggcgcaggagcagttcgattttacggcggctgtgtcggcaggcgtgaagtttgtaattatccgtgccggcatacgcacggacccacgcatgaacaagatttacaagacgctgataaccgatgttggggttaagacgctttacaaggtcaggacgctgttcagagtgggaattcggcggactgcctgcttggttgttaaaagaccgttcaatgcgtctgagatgctcctacaagccgtaccttaatgcagtggacagttattacagcgttcttatgcccaagcttgcaccttatcagatcgataatggcggcaatataattatgatgcagattgaaaatgagtatggctattacggaaatgacacatcctatcttgagtttctgagagatactatgcgtaagtatggcataactgtaccgtttgtgacatctgacggcccgtggagtgaatttgttttcaaatcaggtatggttgacggcgcattgccgaccggcaatttcggctcttctgctgaatggcagcttggtgaaatgcggcgttttatcggagaagataaacccctcatgtgtatggaattctggaacggctggtttgacgtctggggcgaagaacacaatatcacagcacctgaaaaggcagctcaagaacttgatactctgctcaaaaatggcagtatgaatttctatatgttcgagggcggaacaaatttcgggtttatgtccggaaagaacaatgagaaaaagacaggcatagtgacatcgtatgattatgatgcgcccttgacagaagatggtcgaataaccgaaaaatacgaaaagtgcaaagaggtgatttctcgttataacgatataaatgaagtcccgcttacaacacaaataagacgtctggaatacggagaaatccgatgcaccgcaaaaaccgatcttttcagcacacttgacagtatatcagacccggtaaagtcggtgtacccgctgagctttgaggaactggactgctattacgggtatgttctttacagattacacatcagggaaaacgaaatagtcagcactgtgagatgcgaaaatgccgcagacagagtacaaggcttcagaaacggcaagtatgcgtttacggcttttgccgagacgatagacgaacagtttgagattgctgaaaaatccgcaggcggaacaacagatctacttgttgagaacatcggcagagttaactttggcacagggcttgagtgccagcacaagggcgttctcggcggaataagaattaatgatcacaggcagtatggatttgaaatgttcacacttccacttgatgaaaatcagcttggcaaaatagactataaccgtggttacaatgacggtgtaccggcattctataaatttgaatttgaaataagcgaaatcgctgatacatttctggataccgatggcttcggaaagggtgttgcgtttattaacggattcaatctcggcagattctggaatataggccctcagaaaaagctgtatatcccggctccgcttctgaaaaaaggtaaaaatgaaatagttatttttgaaaccgaaggaaacagcgcagacagcatcactttgtccgataataactgatttatgtaagcctctgctttttttgcagaggcttcagtctgtcgataaacctttgtgttttctgaaaatggggtcgcaggggcgtagcccccgacagggtctaggggcggtagcccagtgctcgaagttcggagttgtaaaatcttacgattcatgcaagaagtttgtttattctcctctcaagcgtattcccaagaaggagatacagcttgcaaattcggatgtaaacaatatcaatttctgatgcgtgaaagaaaataataactttgatacggagcttgttttaaatgagttccgtattatttattatacaaattcacctgagtttctcggcgtttgttttataatatgattaatattgaacgcgctttgcacaaaatgcaactatttcaagcagaaaaatacattgcagtttttctgctatggtggtatagtataaattaagttaaaccaataaaaaattaattggaggtattttttatggtaaatttaaaacgaataatggcaggcataattgcaggtgcaactgtagtttcaatggctgcctgctcaaacggcactacagacggtacatcgacatcttccgataccgaaacaacgattgatgacgagattgaaaatccggtcagcgttggcgatataagtattgacgcaggtgaagaagtagaaccggcagaacttgaatatctcggtggttatgatataacaaccgcaggcgatgttaagccggcatacaaatatttctcggagaattacggctgtacaataaaatgcacgttagtcggttctgggcagattcaggaaaagctgactacagctatttcttccggtgagtcaccggaccttgttgactattcagacgacactttccctttacttatgtcaaaaaatatgtacacaccgcttgaagaatatatgaatatgtcagcacctcagtgggcaggagttgagtcgtatataaaccagtacaagtggggcggaaagaattattactacccctgggcttataatgtttccccaaacttccttgtatataaccgtggtgtttttgagcagattggcattgaagatcccaaagagctttacgacaagggtgaatggacatgggatacaatgacggactgcatcagaaagttcattgattctgatgctgacggcaacagaacaggcttatacggtgcgactgcatattcagctcagtcgtttataaacagtaccggtacggcacttatttcagtcggagctgacggtaagctggtgcagaacttcagcaacgcaaatgttgacagagccgctaactttatgcagacgcttaaaaacgaaggtcttgcatcgttccaggaaggtgtcatggatgttgacatcacacctatcaaggaaggcacagcggcattccagggcatgggcgaatggattatttcaaactatgcaaaattaatgcagaaagatgatacgcttgattatttcttcgttccattccccagagatccggaagctgatgaatattattattcaatgtctacattcggatatcttgttccggcaggctcaaaatatgctaaacaggcgtctgtatttattaactgctgccgtcttagctttactgatgaagatctcagggctacaacaaaaggcagtatcatgagaaacaagaagtacaccgatgaaatgtacgattttcttatgagcttcaatccgatctcaacgctcacattctttgcaggaaagtcgctcaccgtgacaggcaacgcttttaaagaggagcttggcgaaaaattcgacagcctttcgggaaaggcgtatgacatatccgcaaaatacaagaacgatattataaatgtttattcaggcgatcataccttgttcagtatcgttatgtacggaagcgatatacttgccgtttgcgcagacagcagcgaccgctatccgcagattttcttctaccgtgaaaacagcgatgagataaaaagagcaaaggaaatgctgaagctgaaaaaagaaaaagccgatttgctgagcgcctatccggataacgataactggctgaacaatgccgaatgcggcgatatattatcccttgcggataaggattatatcgacaagtgcgtccaaaacggatattttaccgcaggaacgccgcaggagcttgcgagctttgtttactatgtgaacactcagcctgtagagcagggtcagatttcgcttgtgcttacagccgatattgacctttccgactataaatgggcgcctatgggctggagcggaggcggcaattcagaccatccgttttcattttgtgtatacggcgaaaatcacaagataacgtatatgacgatatattcggactacagcaacgcaggctttatcggctggggaacagtatgcggtgtgttcgatctcgatattgaaaatgccattgtaacaggcgatgacaatgtcggcgttctcacgggtcaggctattatgggaaattaccaaaactgccacgtcagcggaacggtaaacggaagcagtgcaggctcacttctcggctatgaggcaaactgcgataaagaaaactgcaccgcagatgttgaggtaaacggcaagaaattcgatttcctttcgtggaacgaacagcagaaaagcgagataaaaatagacgatcccgttacaataacgatagatgaaagctacaccgtcacacgtcccgaagtcacaggttattcgaacctcggctggatggtatatgaggacggaaaggagatgctccacagaaacgcagagaacgagttcagctattgctatttcggaaatgaatcgggacacagctatgaaatttatctctcggcatacgtcaagggtcagtatgtgccgataagcaatattatcaagtatacagtggaataaccgaatctgagtaccgcaattattatgttgcggtactcagactgttgataaactgattattattaaagccacacagtaaaaatatatcgccaacaccgcctgaaacgctttccgtaccgacagggcattaataatttcgtgaccttatcagtgcaactgcactgacatttacctttcaaaaaaacgccactaacctgagatatatgtactaatatgcggacgtgtagcgttaagcgtccctgcattgacaggataaacaatgtacaggtggtttaacgagtttaaccaacaccccagcggggtacgggtgtgggtaaggaaagagggatgccacgctgagcattgctttagcaatgctcccgctcctcacgtcgctcaagagctaccgtgcttatgcacgggataatccgcttatgcggtttatctgtctgaggttattatatcacaaatcaaatcggcacaagccgacacggcggtacgacgtgcttttgcctgtggcaaaaggatttggtgataaaatgtcctcagacaggcgggtatccgccaaccgtgcttatgcacgggataatccgcttatgcggtttatctgtctgaggttattataccataccgttccaattaaaccattacccaaatgggtaaaataaaagcaaatgcaagaaatttctgtcaaaatccgttaacaatcagtttttttgatgttacaactgcggcgagctttgtttttgatgaataaccggttttagaaagcatactgctgacgtgtgcctttacgcaatcgggagtaacgcaaagctcctgtgccatctccttatacgtcataccttcgaccagcagtcgcagaactctgatttccgcatcggaaaactcgtagctggtagcgtttcctacgggtatttcgggcattttatcgggatatacgctttctccgtctatcgtcctctttataacgctgagtaactcctctgcgcttacatccttgaaccagatgctctccgcacctgcttttcttgccttatcaagatagctgtaatcaagcattgaggttatgatgataatttttatcgaggggaagcgtttttttattttttccgcagcgacaaatccgctctcatcattttccgtacatacatccattaatatcaggtcgatatttccacgcatacagtattgctcggcaagcgccgcacaagacaacgagcctgccggagaaagatcgtctgcctgggctacaagattttcaaggctttcccttatcattttctggtcttctacaatcagtacctgcgtcatagtgttacctccttgttgagcggaaatgaaattacaagctcgaaatacggatatgaattaatgctcatagttccgccgcttttttctactctgtcgtgcagtgacgaaagaccgccgccttcagtgacggcgctgaccggtgcttttccgtcattagacaaggctatccattgtctgccgccgcttttactgcatttaacattcaattttgtcgcccctgcgtgacgtaccgcattcgtagcgcactctctgacagccgttacgaatattttataataaaacgggtcgggaatatctccttcaacgtttattttgattccgagaacggaagatgtttcctttaactgaccggatatatcatagctgtttgatccgtagcttttttcgttgtccctcataagaagtcttacagcattcttccacgctgtaagatccagctcgcttgtcggtctgttatttgacagcagattacgggtcgcaattacgctcctgcctatatcatcgtgtacacgaatcttcatactgagtatttcttcttcacggataaccgttcttatattctctgtcagctttcgcattcgtctgcctgcacgctcgagttttctgctgctttcttcaagctgaagctgacgtttgtacagctcaatcacaagaggttttccagtggatttatccatgaggacacccttcagcacatattccttgccgggaatgaggtgcttataggagacggtatcggtaagggtgaagacctcggtggcgcagatctccttttctccgtccacggctgccgttgtcccgatctccgggatacggtcgttgactacggtgatctcaatgatttcttcctctgccgtaaccgtaacaggatagagttcctcattggggaggaagccctcggcaggcttcagctccttaatcagccaattgccatacggtacattctcaaaggtaaatacaccgtcctcgccggactcggcggtcaggattgccgtttcttccgtgaactctgacgcatccgttctaaacaggccgaacagagcgcccgtgatggaatcctcggtttcacggtcaatcttcaagcctttaatcgtgccgtagatgatatcgttggggattgtttcgccgttgcttacggtaatgctgaccgtagccacatcctgtcccgcatactcgaagtttacagggtacttttcatcggagaggatatactgctcgttggtcgctatctctttaacatacagctttgcgcctacgggaatatccgatgcaaaggcagccttgccgttttcatcgcaagatacaatttccacgagtccgtctgccggaattacgctgccgtctgcagcggtgagatcctcggcggcaaacaatccaaactgtaccgaaaggatttcaccgttcatgccaatctggaattgcttgtcctgcttcatgattttggagaggtcaatccgtatacgctggcgctcgttgtagaaggaggcggcggtttcggtgatctcgatttcctgtcctgcgtaggtgagctgtaccgatttcgtttcaggattcagcaccatgccatagggcgctttaacttcacggatttcatagcttccaagatacagcggctctgtggtggctgttcctgtactgtccgtttctattgtggctgcaacttcgcccttgctgtatcgcagcgtaccgtcaggggtgatgatatcctcggcggcggtgatttcatagacagctccggcaagcccagccgaagcataaaccggctgatacatcccgtccgcttctgtaacagaggagaatacctcaccggatttgctgacggtaattgtgcctttctgcgacatattcgggcgttccactttaacgatggttaccgcattttcctccgtgctgttatcctccgtaatatcaaaatacacgggatcgctgttcagcacataaccgtaaggtgctgacacctccaccagcgaatagccggtgccataatccagcacttccggcgtaatgagcgtaccgtcctccgtggtgtagaaggtgtcgatggtggtaatttccgggtaagtgaaggtcatctccaccttattgccgctgggatcataaatctgaaaaccggcgcccgcataggggatgctctttccggtttccgcatccgttttgatcaccttgacatacgccttgaactcagccttctgccgaaaagctatcaaaagacctcgggaagcagactattctgacaggtagtatttctaaaggcaacggaggcaaaaacagcggtcaccaatctcagcaattacagatgacgggacgagaattaattacagccgatgagctgaagtgcttgccaaaaggaacatttatttgtactaaaacaggaatgtcgccgttcaaagtgcagcttctgttttatgaaaaacttggcatacgctacgatgaaaagctgaacgctgagattaaagaggttaaaacagtatattatgctgatcgaaaatcgattagcaaagtaattaaaaaacagcatatcgatgagcaggagaatgaaatgaataaagaagaaaatgtaagcgatattaacgagcttataaccgattactcgcttgaagaagatgatattttcacagaaactccttcaagcaaaaaaatgatacgaacataaggagggtttaagtatgggctggctatttgacgtactcggaatttcagttgatggattcgtttcaagcatatttaatggtattattaactggatttatgaagttattttcagtgttataaaagttgttttcaccaagataaatgaaaccggatctgatctgtttcgccttccttgggttcaatcacttgttaatttcttctacatactcggctgggcgttatttgcaatcggattagttgtatcaatatcggatatggttatcgaatacagcaacggcaaaggcgacgtaaagacaactgctataaattggttaaaagcggttttggcagtaagtctatttactatattgccggaacgtttatataattttgcagtatatactcaagattctgtttcccgttcaataattgatcaggtaaccgatgagaattattatcatcatcttgtagaatttaacgtcaattttgttaatgtgatattcattttaatgatattgtacgcaaccgtgaaggtgttctttgctaacgttaaaagaggcggtatattacttactcttatcggcgttggctcgttgtatatgcttaatctcccacgaggctacagtgatggattcaatggttggataaagcaagttatagcattatgctttacgtcatttatgcaaactacacttttctttaccgggttaattacaattcaaagcgattggctcataggtacgtgtcttatcctgtctgctacagaagtcccacgtatagctgacagattcggattagatacgtctattcgcggaaacatgatggctgtatcaatgacagctaatacagcattaagcggcatgagatttattcgtgcagttgcaaagtaggtgaaaacaatgaaaaattacttgtacccaaagaacctcaaatcgaaaacaaaaattctcaaatggcaggcacgagattttattgttattgtatttttctctataatatgtgttacgattctcgcaaacacattaagagccgagcaatttgtttttgatcggaagagcgtcgtggtagggaaagagtgtgtcagtacgtgtagatcatattttacaggagatgaattatgccgttagcagacagaatacgtccttcaacgcttgatgaggttgtgggacaaaggcacatcttagcgcagggaaaaccgctttacaatatcatcagcaggggaaagatacccaatatgatattctacgggccgtcgggagtgggcaaaaccacggtggcgaatattatcgcccaaaaaacaagtatgagcctgtacaggctgaacggtacgcaggcatcgacatcggacataaaagacgttgttgcgaatttagggacattcggtgcggcaggcggaattctgctattccttgatgagatacaatatcttaacaaaaagcagcagcagacactgctcgaatatatcgagagcggagaaataacgctgattgcatctacgacggagaatccgtatttctatgtatacagtgccgttctttcacgctgtaccgtgtttgaattcaagcaggtgacggcggaggatatacttcctgcggtggaacgtgcattcaggcttatgggcgaggagatgcacacgcagttcacgcttgaggaaggcgttgtaagccatattgcttacggctgcggcggcgatgtgagaaaggcggcgaataccgtagagctttgctgtctttcgagcgagggcgatacggtgacgatggaaaccgccaagctgcttacgcagaagagcagtatgaactacgaccgtgacggcgatcatcattatgatattctgtccgggctgcagaagtcgataagaggctcggacgaaaatgcggcgcttcattatgcggcacgtttgcttgcggcaggggatattacctcgctttgcaggcggcttcttgttatagcaagcgaggatatagggcttgcgtatcctatggcggtgccgatagtgaaggcttgcgttgacagtgcgttacagcttgggcttcctgaggcgaggataccgctgggtgaagcggtcgttctgcttgcgacatcgccgaagtccaacagtgcgtatctcggtataaatgccgctatgcaggatgttgaggacggcaaaacaggagatataccccgacagcttcagaacaagcattatgacggagagggcaatgcggtgaagggtcagcattatctttatccgcacgactatccggatcattatgtaaaacagcagtatctgcccgacgctataaaggacagggtttattatacgttcggcgataacaaattcgaacagcagtcaaaggcgtattgggataagataaaagggaagaagtaaaagaatccgacggcgttacttgctgtcggatttcagtttgtagaaaaagtcttgtatttgatgtatttctgttatatcattcagcttcggctacgatagtaaactactgatagttctgtttgtcggacagcacttctcgggttcgctattcgaatcaatgcacttgtcaatattaacgagggaaagaaccaaagagactaggtgcaagtctgagcctcgcttacgcaaggctcgtgcactccgctaaagctccgctggacttgacagggtgcggcaaggctgagccttacaggcacgacagctttacatttgacactttcgtatcgtttgcgatatatgaaacgagtgaaggcatatcggctgaggaagtctgcacaggcgctgtgggaatgctcaacgagcttgacgatactctttcaagaacaaaagcggacagcgaaatttcaaaaatcaacaaaaacgcaggttcaggaaaagtgacggtcgacatatcgacatataatctgctcaaaagctgtacagagctttcacgtcttacagacggagcttttgatataacgctcggcgatatttcggatatgtggggctttggtaaggaaaacccgcctatgcccgacagcgatgaactgaaaaaactcgcaggaaagcatagttaccgcaacattgaatttgatgatgagaatactgctgtctgctttaccgacggcggcttctcgctcgatctcggtgcggcggcaaagggctacgctatggatatgcttgactcgtatctgagaaaatccggagttacgtccgcagtggtggatttcggcggaagtatccttactataggcaaggataacggcaacagccgcagaatatcaatcaccgccgatgaaacgaacacgcctgtaggcactcttactgtagacgagggctacatcgccacttcaaacggcgcaaaccgatatgtcgagcataacggcaaaaagtacatccacataatagatccgtccacggcttatcctgccgacagcggaataaaaagctgtacggtctattctgcaagcggtcttataagcgatgcgctgtctaccgcatttttcgtgatgggtgaagaaaaagccgctgagttttacgaaaaatacaacattgcggaatatatcatcacaagaaatgacggtaccgtttcggtttcggacggtatatctgcggatttcaaagcatcatgagcaggtttatcggtgacaagcgcaaggtcgtatgccttattataatcgtatgtatcgtttttctttcactgctcggcattctgtttgtcggcagaacaacagcaggacacacagcctgcatttacagtaacggcaggctgataaaaactgtagagcttgacagcgaaagcgagcagacgtttaccgtatattccgatgacggcggctataatgttataaaggtcagcggcggagctataagtgtttcggacgcagactgccccgacaaaatatgcgtaaagacagcgcctgtatcggacggaatccagcctatagtatgtatgcctcacaagctggttatccgtgttgaagcaagacggggagaatacagctatgacagttaaaaaaacagttttctctgcgcttcttgcggtaatgtctcttacgctgtatattgtcgagggaatgataccgccggttgtcccaataccgggcttcagattatgtcttgcgtacttccctgttcttttctcgctgtatctcggcggtcggtaaatctgctcggacttgatcctcttataggtatgtgtacaggctcaattcctatggtcggcggtcacggtacggcaggtgcgttcggtcctgttcttgaggatctcggagtatcgggagctaccacactatgtactgcgacggctacattcggacttgtcacaggaagccttatcggaggacctatcggcagacggcttatagtaaagcacgacctattaaagacagtcgtacccgaagatgacagcctacttgtcgaagaaggcaagaagcacgagcgtcacttctctatgtacgctcccgccgtatatcagcttgtactcgctgtcggcgcaggcacggtaatctcctacctgctgactatgacgggaatgacgttcccgatatacatcggtgcgatgattgttgccgctcttatgcgtaatatcggcgaatacacgggcaaaatcaccattcatatgggcgaaataaacgacctcggcggtatatgcctgtcgttatttctcggaatagcaatgataacactgaagctctggcagctcgccgaccttgcattaccgctgataattatgctcggcggacaggtactgctgatgttcctgtattcctattttgtcgtatacagaattatgggcagagattatgactcggcagtgctgacagccggtatgtgcggcttcggtatgggtgcaacaccaaatgcaatggccaatatgcaggctatatgtcagaggtatgcaccgtctgtaaaggcgtatctccttgttccgcttataggcagtctgtttgcggattttctcaacagtatcaccatcacgttctttataaatatgttgtaaacctgcagtggtttgcttttggaggggtttatatgttcggcaaagataaagacaagcagaaaaagaaaaaagaaaaaatgaatgataaagcaggacattcggaggaaaactacaatgttctttatgacaatctcgcttttcccgaagtatatgcaaaacagcaaaaacaaagcgataccgaggaaacagacgaagagccggtaaattacgacaatgtggctattcccgaaatcaatgtaaagaaagataagaaataattccgaccgctcttaatgagcggtttcagactgtcgaaaaacctcttgtaaatattaaaaatggggtgtcgagtgttgcttgctctgctggttttgcatcgtgcaaaacttttggcaagcaaccaaagcatccttgctttggggcgaagcccccgtacaggtcgtcagccatttgtaccactgcgtcgtgcagtggctttgtgcggctgactgcaagcatccttgcttggtctaggggcggtagccccagtaatatagccccggcacggatgccgggcgtgtatgccaaaaggctctatgcaaggacgcatacaagtggtcgaacaaagtcggtgcaggacgcaccgacaacaaacgaccacgatttcccttgtgttatatccttttccctcatgttacgaatgctcacaagggcaaaattaagggaaagaaaatccagtaaaaggcacaaacagcttatgccgaagttcgacaaggttgcaaagttcatcacaaagcgttcgtggatattccttataatattcgcagtgctgataggacctgcggtttacggctataacaacacacagaaatattacgatctgagtcagacaatgcctcaggatatggacttcgttatcgccaacacaaagctgaaggacgatttcggaatgtcaaatgttcatatgatactcgcagattcaaagctgtcgcagaaggatgcaaaggcgatgcttgacgaggtcggaaaggtcgacggcgtaaaccttgcggtaggcttcgattcgcttatcggctcggctgttccctcagagataattccggattctatctcggatgtgcttaagagtgataagtaccagcttatgcttgtaggcagtgaatacggaacggcaacagacgaggtaaacaatcaggtaacagagataaacaacattataaagaagtatgacagctcggcaatgcttatcggtgaagcaccctgtacgaaggaccttatcgaagtaaccgacagggacttcaaggtagtcgatgtaatttcgatagccgcaatcttccttatcattctggtaaccttcaagtcggtttcacttccgctgatacttgtagcggtaattgagtttgctatattcgtaaacctcggtattccgtgttacacaggtacagagcttgcgttcatcgcacctatctgtatcagtaccatccagcttggcgcaaccgttgactatgcaatccttatgacaacaagatacaagaaggaacgtaacaagggcagtgacaagaacgaggcggtttatacagcgcttaagtcgtcaataccctcaattatagtaagtgcgctcggcttcttcgccgctacattcggtgtaggcatttattcaaacgtagatatgataagctcactttgcgcacttatggcaagaggcgcaatcataagtatggtatcggtaatcctgttattacccgctatgctcaagctgttcgataagattataatccacacaagcctcggctttaaagaagcaagacaagccggcaaaaagacgaactgagaaaggacaacagtatgaaagagataagaaaaaagataataaagatagtttcaatagttcttgccgccgcaatgataggcacatcttccggacttctcgcattcgctgcacagggcggtaacgataataatacatcgtcatccgtttctgacagcacagaaaccggaagcagcgaaaagagcagttcggatacggacggcaaggaagaaacggtatatatcatctcaaacgcagacggcacaacaaagaaggtcatcgtcagcgactggctgaagaacggctcgcacaacgcaagctgcttgatacacttgcaggtgtaacggtaatctttaagtttctgctttgtcattctatcactccccatagtatccgaaatcgtacaaatcatcctcacgcacaatttttaactcaccatctcttgcctctacagcccacagctgaggataatcttccgtcataagagctgtgacaagcgtaacactgccatacctattgtggctggcaacgcaaccgggtctcatttcgcactcgtaaaaactactcattcaaatttctcctttcaaatccttcctcgccggtcatcagctctatacacctcagcgcaagcatcagcttgacatcgtgatttcttgtgctgttgatctcacatctcagctcgtccgaccttcgtatattctcctggtatccgacctctgcctcgtgatttttccgtgttttgtctgcgtccttgcgataatcacaaagatatgcgtccttacgctctttgcaaagtcccttcggaagctgaccgctgcggtagatactaccaagctgtgacagcttatcgaagtatttatactcggcaggcggaaagtcggtataatcaagcgtgttttcgtatgccatatgctccagcttttcaaatgttgccggatcattgaaatttatcttcttcataatcattcggtgtaaggtggtgaagggttttgcccgttttccaacaccttttatatatatttatttttttcattttccgtatgaaaggttagaaaaacccttaaacccttcaccacccttcaccctcctttcagcttatagctattccgatgtaacaattaccgttttttgctcgcaccttaggatactttttcgacaattcaacaccaaacttcgtatttgacatcttatactcgttattgtcatcgcaccactgtgcatacgccgcataaagcacgttagcctgcgcatagcagtccttgccctctgtacacctgtcctcgacaaaagcggagataacatccatctctctgcggtactccttgaccatagcgactaccgccttcggcatatgcagtccctcagcctgatacagtacgcacccctctactgcccagcggaagatagcgggcagctcacggcacagcttatatttaagacgtgggtctttcttttcttcgggtatctgtacagtgaacggtatcatatgcactctgcgccagatacctgtgtctgtgcctctgattatcggcttatgattagtcgtcatccacagcttgaattcgggcttgaactcaaactcatcgccgtacagcttgcgggcagtaactatatcatcgcctgtaagctgcttcagcagaccctcgttgatacgcacgccctcgttaggctctacagacgtaacaaaccttgcgcctttaagacgtgctatatcgctgtttatggcactgctctgattactgcgtaccattattgtttcgataaaggcggcggcatgggcggtgctattctgcttgtcgtgctgcttcttgccgcagcgggcggcggcgcgttctacgacgatatatccaagtcttcctatgccgaaatcattgccgtaaaaatctaacgcgctgattttattttccgcttctcttagtataacttcgaatttgtccgcaagcatactgactaccaatgctgaaacgtcttcggtctgctttctgtctttcaatcgaaagataataaaattggttacatatttgttacccaccttacagatagcatccccatattcaaggcgggggagttcatcctctatatacattgtaggaatacccgtactgatactgatctcctctactgtcaaaggcttttcataagctgcgaggcaaatagcacgggaaatctgtgtatgaagatatgcgtcggaatccatattaccgttacaagttccggtattccaattaattctctgatagaccttatccattttatcttctcctatcctatctctgattttttggcgtcctacgttcagtcgccatttgattgtggtttcggggagagaatacttttcggcaagacttctgagtgacaatttgccaatatagtagtccacaaaaatatttttgtactcggaagataacgtgtgcaaatagcgaaacaccgtttcatattgctcctgtgtgttgtcctcatcgacattggaataatcagcaatgtcaaaaagttcatcttcgcatgacaatacgatttgatttttattccgattgtcaataaaccgggcatagcggttatgagcaatacgccaaacccatgcatcaagcgattcgatttgatatttgttcattccttcaaggatatgacaaatgatctcactcgcaagatcctcggcatcgtagcggttggataaacgcttataacagaaacgaaatatcggttcgatgtacgggataattttgttctcgtccaagtttttctcctcctttcttttgggacgcaatcatgattacacccttatagtgcatcaaaatcagtttggataggtagttttatgaaaatttttataatttataaaggaaagagagtagtggcgggagataagaggacgctccatccaaccgatacttgtatattccttcttcctctttgacagtcaaaccagtcatttatacaatccttgtattttccacggtataagaatccaagctccgttgtttttccaaggatatcccacgtttccgtcttcttgttgatatgagcaaccaaattcaaagtgttcagtatgaacgatgtcattacttttccatttcaccaatacaacaattttagttagagcaagagcacgttcttctatttcttccaattcataagaaatcagatttttgtgatcaaaaagttttctacattctcctgctcgttttttgtcagaagattcatcgatctctgaagcaaaagcgaaaagcaaaaaaatttaaaaaaggtttcaaaaaggtattgcaattatggcgggaataatgtaaaatataatagatagaatatggggctgagagataaaaaacaaaaacggctttcagcggcggtatttttccgcataaacccgataaaatatacggaggtattttaaaatatgatcacagcaggcgatttcagaaacggtatgacctttgaagaggacggcaacgtaatgcagatcattgagttccagcacgtaaagcccggtaaaggtgccgctttcgtcagaaccaagatcagaaacgtaattaccggctcggtagttgaaaagtcctacaaccccacagctaagttccccacagcttatgttgaaagaaaagacatggagtacacctataatgacggcgatctctatcacttcatggattcagagacatacgaggacgtgccgataaacaaggcagagctttcggacaacttcaagttcgtaaaggaaaatatggtatgtaaagttctttcatataagggcaaggttttcggtgtagagcctcccaactttgtagagcttgaaatcacagatacagaccccggcttcagaggcgatacagctacaaacgtaactaagcccgctactcttgaaacaggcgctgaaatccgtgttcctctgttcgttgagatcggagatataatccgtatcgatacaagaacaggcgaatatatggagcgtgtaacaaacaagtaatcatataacggttgcttgaagtaattgcagacagtaaaaggaggatttttactatgacagttgcagaaaaggtatcatacatcaagggacttgcagaaggtctgggtgttgatgattcaactaaggaaggcaaagtgcttgcagctatcgttgacgttcttgacgatattgcactgacactgggcgatattgacgaagaactgaacgatgttgcagacgttatgaccgatatggaagaaagcgttgactgccttgaagatgtcgtttacggtgatgaagaagacgattacgatgattgtgattgtgacgaatgctgcgatgaggacgattacgacgatgatatgtacgaagtaacctgccctaactgcggaaacactatcacagttgatttcgacgttattcagtcgggtgagattccctgccctaactgcggagaaaatcttgaatttgatctcagctgcttagaggacgaggaatgcgactgcggttgccaccacgattaatttaaagcgatctgaaccgccggaccgttccggcggttttgttttgttcaaaaacggactgatttactcttttaaggcaataccgcataattattgtcgtgcgattgcttagtagatttttcgtcagattgtataaattgagtgcgggcaggctgacgcctgtcaagcacgccattacgccgcccttctttaccgcatcgttcagcattgcaagtgcggctgttgtaccgtgtgcgccgcagctctcaagaccgatttcctcaaggatatgtgcaacactgtcgcctactgcgggggtaggagcaagtgaaaggtcaacgataccgaagggtacaccgagcatcttgcttgcctcagcgcctacaagctgacccatacgggtaatcttgaatgcggttttctttatctgctctgcgacctcgcttatgcttgcgtcaggcatcttggaaagtgccgaacgaacaacgccgggtccgcttacgccgacattaagaacgcaatccgcctcgccgacaccgtggaaggcacctgccataaaaggattatcctcaacggcattgcagaaaaccactatctttgcggcgccgaaacaatggttatccttagttgcttcagaagcctgctttataatcttacccataagagcaacggcatccatattgatacccgctcttgtagagccgacattgactgaagagcatacgtttgatgtttcggcaagcgcttcaggtatagagtttataagctcaagatcgcctgccgcaaaacccttctgaacaagtgcggaataaccgccgatgtagtttacacccgtaccctctgctactctctggagagtttttgcgaactttacggggcttcccttagcggctgccgcaagcatcgagataggtgttaccgaaagacgcttgttgattatcggaataccgtagcgcttttctattatctcacctgtttcaacgtgatgctcagcaacacgcatcatcttctcgtataccttttcacaggatttgtctatatcgctgtcgatacagtcaagaagcgagatacccattgtgatagtacggatgtcaagattttcttcctgtatcatcttgatggtttcaagaatatcttttgaattgaacatttagtttctcccgtatgtaattatatattgtgcatcgaattgaaaatatcttcatgcataacgtgtatctgaagacccatattgtttccggcttctttcagcttgtctgcaagtacgttgtaatcaacggaacactttgttatgtcaataagcattgtcatagcaaaaagatcctgcattatcgtctgtgtaacgtccataacgtttgcattgcactccgcacagatattacttaccttagcgagaatacctactgtatctttaccaataaccgcaactactgctctcataaaataaacctctcttttcaggataaaaaatatatctcttgctattatacaccactcggctctaaatgtcaaagcattttttaaaaaggcggaaaaagatcggaagagcgtcgtgtagggaaagagtgtgtcagtacgtgtagatctcggtggtcgccgtatcattaaaaaaaggatgcttgcagtcagccacacaaagccactgcacgatgcagtggcacaaatggctgacgacctgtacgggggctacgcccctgcgaccccatttttatataatcaagaggtttatcgacagtctgaccgcaggcatagcctgcggtttctttttgtctacattgcgttaaaatgtcctcttaaacaaacaaattttgcaacataaggttgacaagcgaagaaaacagtgctataatacctatatcgacaaattgttgattatttttgtgccataagaaaggggaaatgtaaaaatggcagaaaagcggctgttttcaaagcaggtgttatggagcgataaatttatcgatctgccatcgccggcacaggtgctgtactttcagctttcaatgtatgcggacgatgaagggtttgtcaactgcgcaggatatgtacgcaggcttacggggtgcagtgaaagcgatatagaagcactgtgcaaaaacggctttattatcccgtttgagtcgggtgtatacgcaattgctcactggaagataaataaccacatacgctctgaccgtatgaaaaagacctcgttttcagatgagcgtgacatgctctatgtccgtgctgacgggatgtatatactcgatcccgaaaaagcggcggagcagaggatatcagccgtgcaggaaaaggcttcgacaacaaaatgtagtcaaacgtctgacatctgcccgtcagatgacggcacaggcaaggaaagttcagataaggacagcacagttaagagcagttttgatgaggtaagtgccgttttgtcggacgaaaccgacaaaaaatcgctctccgccgccgcatacaaagcaaaattaaccgaaagattcggtgcggacaacgttgagcgatatattgaacgtttcaataaatgggcagatatgcacgggcggcagaatatgcctgtataccctaccatcgagaagtggatgaaggaggataacatcagacggtacgaaagcgcaaacagcagttttacagacgaaatgcttgacgaatgtctgatgatcgactacataagctcagacgagaaacgaacagaatagagtaagtacaataagaaagctgaaattgaaagcggagaattcagctatatatctgcctgtcttgcctgggcagagcgaattgtatttgctgagcgttataaggcttgcgagtgaagctatcagcgttccgacaccgcctatattcactccgagcaagaggctgtgataatcgtttgtaaactgcgagagcagtattgccgaaggaacgttgcttataaactggcaggaaattacactgaaaagcagggggttaagctgcagagcagatgaaaacaggttctttattacatctatccttgccatatttccggcaaaaattgtatagtgtgataacatagtttacagaatgtgcaaggacatagtttacatatttatgataaaatagaggcataaaattcgaaaggagtcaaagtttatgccttgggaagagaaagtaatagtaactatgagagaagaatttgtaaaaagagtgttgtcacacgaaaaaagcaaagccgaattgtgccgggaatatggaataagccgacccaccggtgacaaatggattgaacgttacctgaacggtcaaccgctatgtgatcaaagtagagcaccgcatattgttggtaacaagacaaatgatgaagttgagaaattcattgtagaatacaggaaaaagtatcctgcgataggtgcaactaaaatacaccgtatgctccgtgatgagggaataacagatattccttgtccaagaaccatcaatgatatttttaaacgcaatgggttgataacaaaggaagcaagtcagattgcaacgccttatgtcagatttgaaaaaagtgaacccaatgaaatgtggcaggctgattttaaaggacattttgccatgagaaacggagtaagatgtcatccgcttgatatcattgatgattgctcaagattcagcctttgctgtgcgccgctcgccggggaaacatacatagaggtaaggcagcaaatggagcatatttttttgaaatacggtatgccgttttcatttctttgtgataacggcacaccatggggaacatctcagtctacgggattttcaagatttgaagtttggtttatggagctgggaatattgactttacacgggcgcatattccatccgcagacacagggcaaggaagaacggttcaacggctcattaaccagagaatttttaaagtatgaaagctttgaagattttgaagacgcaaaaataaagcttgacaaataccgtgatttctacaacacaaaacgtccgcattacgcattaaatcttgacacaccggcaaaacattaccatccgagcgaacgggcatacacgcccgacatatcagaatgggaatacagcgatgaatataaattgagaaaggtaaaagagagcggatatgtcaccataagaaatcaaggttattatttaagcgaggcgtttagcggaaaaactattgctgtaaaagaatccaataaaggacagcatctcataaatctatatttcaggcaattcagaataggacagatagatatagaaaagagagtgtttacctttaaaaaagcttatctaatcgaaaatgacccacgtttcgccgaggcgaaacataaaaaatgaactttccattcgggcttcgccctcatttcaagttcatttttatgttcgtttgttattgataacatgtaaaccatgtgcttgcacaaagtgtaaaccatgttactcttgacaatttcaatgcttgcggtatgctatatgctcggaatagcggctatagtattcggcattgtaaaaatcacgggatatttttcagccgacccctacggtctggcgttccagtttgactttgcattcggtatcatagcgattctgctaggacttgtagttattatccatccgggtaatataatggctctggtgcctgtcataatgggcatttattttatgatcgacggcataatgaagatacagacagccgttgatgcaaagcgtttcggcgtaaaaagctggtggctgattcttgtcagcgcaatagttacaggcggaataggaatactgttactcgtaaatccctttgagagtgcggtagcgcttactgttctgctcggtatcacattgcttgcggacggcatttctaatatatggattgccgcatacacagtcaaggctataaaaaaagaaatacacgccgatgacaaaatctatgtagaaacaagcaacagggaggacaaagatgattaagctaggcaaatggataacaaagcacagagtaatcattcttatagttgcggtcgtactgctgataccctcggtactcggtatgatagctacaagaataaattacgatatgctcaattacctgcccgacactatggaaaccatacagggtcaggacattctgctgaatgacttcggcaagggcgcattcagtatgataattgtggaagatatggagccgaaggacgtttccgctcttaaagaaaaaatagaagcggtagatcacgttgactcggtaatatggtatgattcgatagcagacatttcaatacctatggatattcttcccgacaagataaaagacgcattcaacaccgatcattcaacggttatggcggtattcttcgatacatcgacatcagccgatgaaacaatggacgctatcaatacgataagagatgtaactaacaatcagtgcttcgtttcgggtatgtccgcaatggtaacagaccttaaaaacctttgcgagcaggaagagccgatatatgtcgctatcgcagtagttcttgctgtagtggtaatgatgctctttatggattctttccttatcccgataatcttcctcgtaagtatcggtatggctattctctacaacttaggcagtaactacttcttaggcgagataagctacataacaaaggcactttccgctatactgcagcttggtgttacgatggactattcgatatttctctggcacagctacaacgagcagaaggtaagatttgacggcgataaggaacgtgcgatggcacacgccatttcaaacagtatcatttctgtagcaagttcttctatcacaacaattgccgtgtctgtgtctgtatcggtatccgtgtctgtgtctgtgtctgtatcggtatccgtatcagtgtctgtgtcagtatcagtatctgtgtctgtatccgtgtcagtatccgtatcagtatcggtgtctgtgtcggtatctgtatcggtatccgtatcagtgtctgtgtctgtatcggtatccgtgtctgtgtctgtgtctgtatcggtatccgtatcagtgtctgtgtcagtatctgtgtcagtatcagtatccgagtctgtatctgtatcggtatcagtatctgtatcggtatctgtgtctgtatcggtatcagtgtcagaatctgtgtcagtatctgtatccgtatctgtgtctgtgtcagtatcagtatctgtgtccgtatcagtgtcggtatcagtatccgagtcagtgtctgtatcggtatccgtgtctgtatccgtgtcagtatctgtgtcagtatctgtatcagtatctgtgtccgtatcagtgtctgtgtctgtatcggtatcggtatccgtatcagtgtctgtatccgtgtctgtgtccgtgtcagtatcagtgtctgtatccatgtcggtatcagtgtctgtatctgtgtctgtatcggtgtctgtatccgtgtcggtatctgtatccgtgtccgtatcggtatcagtatctgtgtctgtgtctgtatccgtgtcagtgtctgtatcggtatccgtatcagtatcggtatccgtgtcagtgtcggtatccgtatctgtgtctgtatcggtatccgtatccgtgtcagtatctgtatccgtgtctgtgtctaagtcagtatccgtatcagtatctgtatctgtatctgtgtcggtatccgtatcagtatctgtgtcagtatcagtgtctgtatcggtatctgtatccgtatcagtgtctaagtcagtatcggtatcggtatctgtgtcggtatctgtatctgtatctgtgtcagtatcggtatctgtatccgtgtcagtatcggtatcagtgtccgtatctgtgtctgaatcagtatctgtgtcagtatcagtgtcagtatccgtatctgcatccgtgtcagtgtctgtatcagtatctgtgtcagtatccgtatcggtatcggtatcagtgtctgtgtccgtatcggtatccgtgtcagtgtctgtgtccgtatctgtatctgtgtcggtatctgtatcagtatctgtatctgtatcggtgtctgtatcggtgtcagtatctgtatctgtgtctgtatccgtatcggtgtcagtatctgtgtctgtatcagtatccgtgtcagtatctgtgtcagtatctgtgtcggtatctgtgtcagtatccgtatccgtgtctgtatcggtatcgacagctttatcaagaagtcaagctatatctactatacaagagaaaagctgtacggcgctaaagaggatattgtaagaatagcaaaccgtgaaagacttacagcacacgcaaacgctatcatggtaagattcgaggactgacagatgaactatacaacatgggaacagcgtgtccgcaaggtcgagccgtatacacccggcgaacagcctaagacggacaatgtaataaagctgaacactaacgaaaacccttttccgccgtcacctatggtggaaaaagtgattaaggaatataacgaggacgcactgagattataccccgatacaagagcgggactgctcgttgacgcactggcgaagcgttacggcgttgacagcgatcaggtgtttgtaggtgtaggctctgacgatgtaatatcgcagacattccttacattcttcaattccgacaaggaaattcttttccccgatattacatattcgttctatgacgtatgggcggatctttacagaataccgtaccgtacagtacctttaaaggacgattttacaattaatcccgatgactacaagtgtgacaacggcggtataattatccccaaccccaacgcaccgacaggcgtacttgaaagccttgatacgatagaggagatactgaaagcaaatcccacatcggtagttgtaatagacgaggcgtatatagacttcggcggaacaagctgtctgccgcttatagacaagtatgaaaatctgctcgtagtacagacattctcaaagtcacgctctatggcgggtatgagaataggctttgccatcggcagtaagaagctgataaagtatctgagcgatgtcaagttctcggtaaacagctacacgatgaatccgctgtctgttataggcggtgcggcggctgtagaggacgaggagtatttccaaaagacaacgcaggaaattataaatacaagagaatacagcaagaaaaggcttactgagcttggctttactttcccggattcgatgagtaactttatctttgcttctcataagaaggtacctgcaaaggaaatcttcacaaagcttaaagagcagggaatatatgtacgctactgggataagcccagaatcaacaatcacctcagaatatctatcggcactaaggaaaatatggacaaggtgtttgaaaagcttgccgaaatagtcggctgaataccgaaaggataagaatatgagcgttatcgaaagaaagacaaaggaaaccgatataaaggcagagcttaacgtttacggcagttcaaaagccgagatagacagcggtataggctttttcgaccatatgctgacggcactttaatgatacggcgaccaccgagatctacacgtactgacacactctttccctacacgacgctcttccgatctcatcaagttcaatgcccgttgcattttgaatagtgctgttttgtgctacactcaacagggcagagtaaaacgcaccgctgccaacacacggttctaaaaatgagatttcttttgttagtaacaatgtcaatccatatgaaacgatttcttttgctaaatcaatcggcgttgaaaattgccctaatttccgccgttcttctatatccttgctattatcaatcgtttcttgaagtgcggaacgggcttcttcaatggctttcagatttctaatttttccatgtcgttgattctgtgttcccatatccaatcaatcccctctgccgcttcatatcctaaataccctgaatcaaagtaaccgcataaaaacaatgaatatgagacatcaacaccataggtgttgcgaagttgttgcatttttacggcttcctctttgcgacgtttgtttacatttgtaaaatctccggctgattttgcctctaataataggggcatgtcccctgtattggctgtaagaggtaatattgctacatcaacgggaatattcacttggtcgccctgttcacctgcaacatataccggaacattcgtgtgaaaagaaaaagagccgggtttcatttcatcgtaatgcactccgctttctgccaatgtataacctttactttcaagcaaggttgttatggcggcaagctgccttttctcttgcgcattacgaataatagggtctgcaacagctccgcataatctatctgcaacgatggttgacgaacgcataatttcagtttcatccgggtttcgtctttcagaaagccatgtaaaaatatctggatccgccattttaatgataatgtcggaaatgctctgcaattcttcaatcaatttcgccctttgcattcttggcgaaatatgcggattctctgaatcttccatgttctgcacaagactttttgaaacgcctgcaagtcctaccaatctgtctcttgctattggcggacaagtagacattctcaaaatgggtaatacttccgggtgctctatcagtattgcgggggatacgttgttcagatagttggtttcttgcaacgcctgttcaacgctctttgcagttgaaacacgtatttctctaaacgctttaggcgcaaaatccataaaccatgtgttatataaatctactgacgcatttatatcccgtttccacaaatgtggtttatcaaggtttattcccattttcacacttcctgaccaccgagatctacacgtactgacacactctttccctacacgacgctcttccgatcttttctcagtagcagttttaaaatagtgttccgccatttcagcacttcccagtgaaagcgcagctttgccggcgcacacatacccttccgcttttgagtcatctttattgattgcttcctgcgccttttttaatgacacttcaaattggtttcctgcaaatgcaaggttaacatcagaaatcagtttctcgtagttcatatacttttcaccgcctatttttcacagtcttatttaccgttttcacttatcgtcattttgaatattatacctcatacccatctactttaactatatgaccatgaaggacataaatttgcatggctaccgattccatcatatcagatgtgtattcgtttccactctcgaagaaaaaatcaaactgtccagccatttcttgctgattagagtgagaatagcgagcatcaatcatagcatagcaatagactatactatatagttttaagcccttaaatatcaactcaccatctctatcccggaactcatcggttttcaaccatgggataaaacgctctttaattatattatctattccttcttttttcagcgtttcaaaatcataaggtaaacgttccatgcttgcgtctatattgtattcgacttcgacaggtatttccccgtagctataatttgttataatgctcttgggaacagcttcattttgaggtttaggggacagttttttgaacagattcattgcaatctccttctttacgtttgttttagaaaatatccagtagttgctccttttacaatagaagtatgcttttattctttattttctgtttccattcaatgaacacttgttcgggctgaaaatcacttggcaaatccttctcatattttaactcaaatttaaatttactatccttgcatcggaatttcattttatacacgatcggtttttcgcaattttctgcttcaaatagattggacaaccgttcagcatcttttcgtattaaatcacaaaaataagacatcgtagcgggagggtactccaattcatccatatcctatgtttctttaccaaatctaaagataacattaaaataatacttgttttccctgtaataaaagaccgctacagatacagaaaaccacagatacattataagagtagacggtatagatgccacatacgctccgcagtttatacagcctgccgatataatgtgcggcatatagtcgattatctcgaatacgccctgtactccgacaagcagtgacagcatgaagtgaaccccaaagtttagacaaaaatgtattaagtattttgagaatgagttcggaattgtaccgggctcattccttttagtttgagagaaattctttcattgttgtagtaatgaatgtatttcttcaattcatcaatgaaagcgttaacgctttcaaatttttcgccataaaacatctcaaccttaagcctgccgaagaagttttccattgcaccgttgtccatacagtttccttttctggacatactttgcttaatgttgtgttcagctaataggcgttggtattctgtgtgctgatactgccacccttgatctgaatgaaacaacggagttgcaccatcaggcagtttgccaaacaagccatcgagcatttctctgacttgttccagattaggacttaatgaaatggagtaggaaataacctctcggttgaatagatccatcacaggagacagataaacctttgtatcacaaacattgaattgagttacatctgtcgtcagcttctcaaatggtttttctgccttgaaatctcgctttaaaagattttctgcaatcttgccaacctcgcctttgtacgaattgtattttccgtttttgcgttgtttacctttcagaccgagcaacttcatcagcttaaaaacggttttgtggttgatcacatacccctttttacgcattatcatcagtactctacggtagccatatctgcctttgttggcgttgaatatagctgttatctcctgcttttcacattcgtatttatccttgattggatgactcagatagtaatagaatgtgctacgagccattcccgatatttgcaacaggtctttcaacggatatctttgccttagttcagaaattatttccgccttttcccgttctttcgctcgtccgcaagaactaaggcactcagtttttttaagtattctatctccattctcaaacgttgattttcggcgattaaatcttcctcgacctttttatccagcttcggcggtcttcctttccttgttccgctagcggaacaagccttgcctcgtctttctttcataagaccttcggctccttcttccaaaaatacgcgttcccatctttggaccatactggctgctgaggcttctgactgccgtacaaggctatactttcttgccgtttctctatatcccatatgatgttcccgcatatccattataacattgactttgaattctgtcgagtacgttttgttttttcttcctgttttgcccataaaaatatgcacctccaaatgtgtctaacttttggggtgcatatcacggagagaaaatgaaaaaactgaaatcaataataccgggaacagccgtatgtgccgtcattgccgctgcggcaacgctgacaggcgggataagcataggcggattttcctttgagcttatcggagcgcctgtgatagcgatacttctcggtatgatactgacgcttgtatttccgaagctcgcaagccttacatcgctgtctggcggaataaagttcacgtcaaagaagattctgcagtgggctgtggtaattctcggcttttcgctgaatttaagcactatagcacaggtcggcgcaaagagcctgccggttatagtcggcactatctcaatatcgctgatagttgcgtttataatgatgaagctaatgaaggttgacccaaagaccgcctgccttataggcgtaggctcgtctatctgcggcggctcggctattgcggcaacagcgcccgttatcgaagcggatgatgaagacgttgcacgttcaatatcggtaatattcctgttcaatgtgcttgccgcacttatattcccgacgctcggacacgctataggacttggcacggaaggttttgcggtatttgcaggaactgcggtcaacgacacctcatcggtcactgcggcggcatcgacagcggagggcatttacggatacagcggtatactttcagccgctgttacggtaaagctgacaagaacgcttgccattatcccgataacgctcgtgcttgcactctaccgcacagcaaaagccaaaaaaagcggcggcagtaaatccggtttttcgataaagaagatattcccgtggtttatccttttctttgtcggtgcgtcacttataacaacggtctgcggattactgcccgaaaacagcgtcactctgttctactcatctaagtttgtgccgtttgcaaaatggctggctaaattctttatagcaatggctatgggcgctatcggactgaacaccaatatagtaaagctgatacgcaacggcggaaagccgatacttctcggactgtgctgttgggtatccatcaccgccgtttcgctcggtgtacaaagcgttacgggacttttcacaagcaatctctgataatataaaacccgattattattaatgctgttcagtaaaacgcatcaccgacaccgccgaaaacactttccgcattgacaagtaattaatattttcgtgagtgtatctgtgcaactgctctaacattaatctttcaaaaaaacgctactaacctgagatatatgtactaacctgcggacgtgtagcgttaagcgtcggctccctctttccttactcacacccccaccccgtcggggtgttggctgaactcgaataaccacctgaacattgtatatcctgtcgatgcggggacgcttaacgctacacgtccgcaggttagtacatatatctcaggttagtggcgtttttttgaagagtcaatgtcagtgcagttgtaatgatgcactcacgaaattattaatgccctgtcgatatggaaactgttttaagcagtgttggcgatatgtttaacggtgcggatttaataataaccggtttttcgacagtctgtgatccgacggcgttacttgctgtcggatctttttttgcacggtttatttgtaaagctgacgtatagctgatttatgccgatatataaaacgaatatcccgaacagctttcgcagaacagccacatccgtaattcctgcgacatagcttccgacaatggcacagggaagtccaagtataagatattttcccacaagctttaagtctgtcagcttgtttttaatgtgtatgacaagggagagcagtgcaattgggaggaagaaaagaaggtttattccttgcgcaatatcctgcggtatttcggtgaataccgaaagatacacgagtagaatgaagcctccgccaagccccattgacgcagtggctccggtgagcattcccactaaaatattcataatatcatcctcactccgcttgcaatcataagcagaccgaatattatccttatcagcctgtcgggaatttttccgagaagaaaagagccgagtatcgcaccgataagaccgtagggtatatattcccacgctgtgccgaaatccagtttcccattcattaaatatataacggcggtgacaaggctcagtacgaatatcagggcgaccgaggaagcgtgggcttttttcggctctgtgccgtttttctcaaaggcaggtacggcgacagttccgccgccggagccgaacagaccgttcagaaagccgcaaatcgagccgtaaagcagatgggcgtgctttcctgtgcggtcggattttcgtttacgtttactgttcatagagatagctttcgcagaaaaaagcggattatgcaaaatgaaaagccgtactgtttttaagcagtacggttcagattgtagaaaaagtcttttgcttgatgtacttctgttatattgttcagttgtgcctacgatagtaaactactgatagttctttttgtcggacagcacttctcgggttcgctattcgaatcaatgcacttgtcaatattaacgagggaaagagcctgccgcagccgccttggtggtaactccggggattatcagcagatctccgcataaaagacgctcgatagcatagtctgcaacataagcctcgttctcactcggtattccgaagctctttacgcctgcaacgctgttgaattcggtatctacgggtccggggcaaagtgcgcttatcactaccctgctgcctgtgcttctcagttcctcgtagaccgccttggtaagctgtacgacatagttttttgtcgcatagtatgtcgcaagcagaggtcctgccataaagcctgcaacagacgcagtgttaaggatatatccgctgtttcttgcggcaaaatcacgcaggaacagctttgtcagaatatgaacggcctttatattgacgtttatcatcgaaagctcgtctttaagatctgtttcaaggaacggaccgtacagaccgaatcccgcattgttaaagagaaaatcaattttatattcctttaccctgtcgtaaagctcgaagcactgatcttctttcgaaaggtcggctgtaattgtcttgacctttatttcgggacagttgtatacgatttcttccttgagtgccagcagacgctctgttcttcttgcgacaagtataagattcacacctcttgtagcaaggtttttcgccatttcttttccgattcctgagcttgcgcccgtaataagtgcgatcatgtcagattcctttcccggtcagataaccgtgttcatcaagatattcttcaagtatatcagccgccatacagacgattttcggacaaggccgttttttataatactcattcgttctttctgcgggtatatatgtcttttcgggctttgacagtccgagaagctccttgcagattatactgccgttttcttttctgaagcgtgaagcaagctcctgtattgcggcataggtggatttcttgccctgtgcgtccgaaggatcgctgtagcctgccactatgcccagtacgatgaacattccgcttacagcgccgcatacctcacgcatacgtcccataccgccgccgaagcccgatgcaagcatagccgccgtcttatcgtcaagccctgttatatccgaatagctgagcaataccgcctgtgagcagttatacccttccataaacagttgctcggctcttttgccataatcgcccatagaaatacctcttttctgtttttgctttcacacagtccttacggctcggcttatggatagtatatactaaaccgccgccgatttcaagccctgttttttttttcaagcagaagacggcatacgagatttcgcggagtgactggagttcagacgtgtgctcttccgatctgataatcaatatcttgtatcatcgtctgtgagaacgtcaatcagcttgtcaatgttctcaagaaccttacctgtaccgtcagccacgcagtcaaggggcctttcggcaacctttaccggcatacctgtttcggcgtggataagaagatcaagacctttaagcagtgcgccgccgcctgcaagcattattccctgatctattatatctgcggcaagctccggaggggtcttttcaagagttacctttattgcctcaatcacatggctgagaggctctgaaagcgcttctcttatctcttcggatgttacggtaatgttttcgggtaaaccgttcagaaggtttctgccctttatatccattgaaggctcattgtctgcatagggatatgcggagcctattgcaatctttatattctcggctgttctttcaccgataagcaggttatatttcttcttgatgtagtttatgatagatgaatcaaactcatcgcctgctactcttacggaacgtgatgttacaataccgccgagcgaaataaccgctacttcgcttgtgccgccaccgatgtcaactatcatactgccggtaggatcggctaccggaagtcctgcgcctatagcggccgccataggttcttcaatgatagaaacacgctttgcacctgcgttctgtgttgcctcttttaccgctctgcgttcaacagctgtaacgcccgaaggaatgcagatgataactcttactcttgagcctgcaaaggctctgcctttaagagcttttctgataaactcctgaagcatacttgttgtcatatcaaaatcagcgataacgccgtccttaagaggtcttacagctactatagagccgggtgtacggcctataacgtccttagcctcctgaccgacataacgcactctgtccatttttacatcaactgcaacaacgctgggctctcttattataatgccctttcctctcatataaacaagcgtgttggctgtgcctaagtctatacctatatcttttgaaaacattcgtcaaacctccgggtgtttcgtatttacaattcgatatttattataccactttttgaaaaagcatacaacaaaaatgccgaaagatcggaagagcgtcgtgtagggaaagagtgtgtcagtacgtgtagatctcggtggtcgccgtatcattaaaaaacgcccaaaggctttgcaggacgcaaagcccacaaagcgttcttatagggatagagaatttgctctatttttataaatacagactttttctacaaactgaaagctaccgcaatgaactttacggtagctttcttttatgatgttatacgagtttttcaccggttattcgcttacaagcactttaactatctcgccgacatacatctcgtggaaatcacctgcggcatagcacttttcgataagcgacttgtctataaaagaatcgggcgtcataggctgtctgtacagcttcttgcagacaagcacaagctttgcctgctctatataagcgtaatcgtccgttgcagtgcctgtaaggtcggtctttgcaagcttatcctcatctctgcccgaatgcgagccgagataactcagcgcttccctgtgtccgtcggggaggaatgacaatgtgtaataatcgctcttgtcaacaaattcctttgtgtatctctgagggcggatatagactaccgttgtgggcttgttccacagctcgcccatctgtccccagcttactgtcattgtattatagccatccttgtttcctgccgtgagcaatgcccactccttgccgataagcgtggagggatttattttcagttcttctaccgatatttctttcataaccgtaattcctttcttattcgtaatagggttatacttattttagcattttttcgcccggatgtaaagcaatatcttatcttcagacaaaccgttaaaaagttgcatcatgcttaaaaggggtttggggcatagccccaagcggggtgagggcggcagccccacactcagccccggcatggatgccgggcgtgtatgcccaaaggctctgcacgatgcagagccaacaaagcatacacagcccttcaccgatgggaaggggtttggggttagggattgaaaatttgcacttcgctataaaattgttttatcttcaaatataagcctcttaaactttacattctgccacaaaaaaccgtgattttcacccgaaaattttacttgcatttttccccgtattatactataattaattttgtatgttaagcacactgttgaaaccaatcggggctgtgggacgaaaccccaaacagggacgaggggcggcaaccccgttaatctagcaccattatcccgaaaaccgcatacattggattatacctccaaaaaaattttcaataaaatactcttaacctattgacaaagtaggtttgtatcggtatcggtatccgagtcagtgtctgtgtccgtatcagtatctgtatcagtatctgtgtcagtatccgtatccgagtcagtatctgtatcggtatcggtatccgagtcagtgtctgtgtccgtatcagtatctgtatcagtatctgtgtcagtatccgtatctgtatcggtatccgtgtcagtgtcggtatctgtatctgtgtcagtatccgagtctgtgtccgtatcggtatctgtgtcagtatcagtatcagtatctgtgtcagtgtcagtatcggtatccgtatctgtgtctgtatctgtgtctgtgtctgtatccgtatcggtatctgtgtcggtatccgtgtcagtatctgtgtcagtatctgtgtcggtatctgtgtcagtatccgtatccgtgtctgtatcggtatctgtgtccgaatcagtatcggtgtctgtgtctgtgtctgtatccgtgtccgtatcagtgtctgtatcggtatctgtgtcggtgtcagtatctgtatctgtgtcggtatccgtgtctgtgtctgtatcggtatccgtatccgtatcagtgtcagtatcggtatcagtatctgtatctgtatccgtgtcagtgtcggtatctgtgtccgtatcagtatccgtgtccgtatcagtatccgtgtctgtatctgtatctgtatccgtgtcagtatctgtatcggtatctgtgtcagtgtcggtgtcggtatctgtgtcggtatccgtatcggtgtctgtatcggtatcagtgtctgtatctgtatcggtatctgtatcagtatcagtgtctgtatctgtatccgtgtcagtatccgagtctgtgtccgtatcggtatctgtgtctgtatcagtatccgtgtccgtatcggtatcggtgtccgtatcagtatctgtatcggtatctgtatcagtgtccgtatctgtgtctaagtcagtatcagtgtctgtatccgtatcagcgtcagtgtcggtatccgtgtcagtatctgtatccgtgtctgtgtctaagtcagtatccgtgtcagtgtcagtatcggtatcggtatccgtatccgtatcggtatcagtatcagtatctgtgtctgtgtctgtgtctgtgtctgtgtcggtatccgtgtcagtgtccgtatcggtatccgtgtctgaatcagtatcagtgtctgtatccatttttatgttcgtttgttattgataacatgtaaaccatgtgcttgcacaaagtgtaaaccatgttactcttgacacaagcccctcccctacgaaaagcgagagggatagtgtgggtttttggaagggtcaatgtcagtgcagttgcattgatacactcacgaaattattaataccttgtcggtacggaaaatgttttcggcggtgttggtgatatatctcactgtgttgctttaataataatcagtttatcgacaatctgaggctttcacgttttgtgaaagccttttgctgttatataagcccgaaaatctgaaatgccgcaattccgcttatgcagacaatactgccgatgatattgagcggctttgtgctttccttacggataagaccgataaagaaaagcgctaccattatcataggctgtatgaatgaatagttggtcatacttgtggcgataacggcattttcaagcacaagtccgagtgcgttcggtattttggtcagcgctacaaatgcacagcccttcggcttgtcttttatcatccttatcgggtgaacgaaaggcgcaagcacggcggcaagcaggataagtccgaaaagcagggcaaagtatgaggatatgtacggcgcagacgcagtgataataaagccgtagccgaactttgaaagcagatagaagaacagcggcacagctatttttttatagctgatatgctctctttccgaccgtgctatcataaatagtcctgcggcggtgacaactatcgccagtagttttaaaacgctgaatgtatccgttgcggttattatatcggtcgcataggacgcaaacaggcaaagaccgagccacgccttaagctcgaatgcagacatctcggtaagcacaagtgcagacatcttgaattcaagcagcttcgacaccataataagaacagccgcaagcacagactgccagcaaagctgtaagtgcatatcggaaaaaggcataagcggcagtaaaagcaccgctgtaggcaaagccataagaaaagtgaccgctgatctctgagagcatactgcgtacacgttttatgaagtagtcacgggtatacatacctgtgagcatatcatcgttctgatggattaatcttggctcaacctccgttaccggcggaattacacaaagtaataaagcagataagcggtcacagcatttcgctgtgaccgctttcagtctatcgaaaaaaccaattcattatagctgtacagtgaaatgtaccgccaacaccgcttaaaacaatttctatactgataaggtattaatattttcgtgagtgtatcagtgcaactgctctgacattgactcttcaaaaaaacgctactaacctgagatatatgtactaacttgcggacgtgtagcgttaagcgtccctgcattaacaggtcatacaatgttcaggtggttattcgagtttatccaacaccccagcggggtacgggtgtgggtaaggaaagagggagtgcgagggagaaaacttaagggatagggttaggggcggcagtccagcggagctttagcggagcgcacgagccttgcgtaagcgaggctcagactctccctagtccctttggttctttccctcgttaatattgacaggtgcattgattcgaatagcgaacccgagaagtgctatccgacaaaaagaactatcggtagccttactatcgcaatcagaactgaacgattgttgtctgccacgcaaaacgcaaaaagtgggaaaccacggaataagccgaaataaagcgggataaatcagcacaaagctgattgttatgcggtttgttgcgtgttgcaagtggtttatccggcacggcgttgaaaaatgagttgtcaaaaaaatcggtgcgtttttgcaccgattttttatatctgttgaaaaggagaagcgttttaaataaccgtttcaaactgttttaattgcattttaaaagccgttaaaacgcattgttaagcgttttaacggcttttcttctgccttagtgcagatttaaataatttccatttattgaaaatgttagcaaggaagtcaaggaacaaaatcaaggttgtcaaggaactacttccttgacaacttttttgatatgattataagaaattctctcaagaaaaagttaatattgtactattttattcgttgtcaccgaaacggttctttatcaccattaaaatgatacaatcccagcttaagcagtagaaatcaactacagcacccttaacaacggggatagaaagctgaccaccgtcagcgccgacagtgcctacccatgtttcggtgccaacaccgtctttagtatctccaacaccatcaccgtttacatcccaagcccatgctatgctggcaccgccccactgatagtacttaactgtaccgtcggggttcttaacagcaacgcctgcagagcagtaatcgttccaacctgctccagctgctactgcatcagctgaaagtgcaacatcaaccttaagcgcatcaatgtcgcccttaactgtgtatgtgtatgacggagttttaccatctgtaaatgaaatatctgcctttgtctgaacaggcttaggcttagcgggatcattgttcttaaggttaaccttccagttgattgtgtaatcaacgccgtcgcccttgcttaacattacgctgaaagcggggttaactgttttgccttcgatttcctgcggagcgagaactgcatccgaaactgtataagtgtcagcagcagtcgcatcctgcttccatgtgctacctgtcttttcatcagttacttttgttgagttgtaaccgatgaggaaagtagtgtcgcttgtgaatgtgattgattcgacatcttcgggcttgttgccttccagaatatcttcaatctttaagtccttctgtgtccaccatgctgtatcactgaatgtgatagaaccggcaaaagcacttactgcaagtgaagaaactgcgattgcagcagcgcaaacacttgctaaagtttttgtaaacttcattggttttgtcctccataaaatatttttttagcttttaagctattttttatcatactatatcgcagttttttttacaagtgtcattttgcacaaaaaaaactttttcgttttggtgaaacaatataaacagtaatgtgattttgtgcctttacagcattaaatttgaaaatatgccaaattatatgataaaaaaagcccctccgcaataagcggaggggctgtatgctctttaattaaagcatctcatcacttaaaagtgattacttgcttctcttcttaagagaatgccggtgacgcaaaacagacctttgttgaaaaagtacctcttaaattcatcaagaaatttgccgaaaagactatcctttcagaaaaaggtgtcacggtaagatataaaaatgacaagctctatattgaccttcacatttccgtaatgtacggtgtaaatgtgtctacgatagtaaagagcatcattcataaggtaagatttgcagttgaggacgaaacaggctttaccgttgacaaggtaaacgtttttgtcgatgctgttaaagtataatatcaaggagagtatctgactaatgctaagcggaaaaattctcagagatgcgatcatctcaggtgcaaacaatataatcaataataaagaaagcgtagacgagcttaacgtgttccctgttcccgacggcgacaccggcacgaatatgtcgatgactataagaaatgccgttgctgagcttaatatgctcagtgacagcgtaactgtcgaaacagtggcacagacagcggcttctgctatgctgagaggcgcaagaggtaactccggagttatcctttccctgttattcagaggcctttcaaaaggtcttgcaggaaagcacgaggctactgttgaagactactgcaatgcacttaaattaggtgcagaggcggcttataaatcagtaatgaagcccactgagggtactatcctcaccgttgcaagagttgccgcagaaaaggcaaacgacgctcagtgcaaggatttccccgaactgtttgatgttcttacaacagccgcaaaggaaactctcgatcagacccccgaaatgctccccgttcttaaaaaagcgggagttgtagacgcaggcggtatgggatactatactatcctcaagggtatggcatccgttatctgcggcggagtgatgatcggtgcaaaggaagaaacggcaacagaaaaagcggtcgtaacaaatgccgcaggtacatttgaaaccgatatagaattcacctactgtacggaatttatcgttgtaaaaagcgacgttaacaaggacgcaacaaagctccgtgctttcctcgaatcaataggtgcttccgatctttcacgttttcttctgccggcgttggaaggcgtgatattgccgcagcgatattttcggctttcggaatttcttctttcggttcatccgcatcgtaactgagccttgctttttcggctgttcttattgccgcctcggcatattctttctgcaaacgctcaaattcggcttttgacattcttatattactccattccataaatttactccttttcatagtagattatcaaacagaccgctgtctttaagatagggaagcagtgaaatcagcctgaacagctttaccgccgtatctatttttgccctgttttcttctcttaagtgaggcttcagagcaagcagcagacctgtatttctgtcctgctcgctcatctttgacattaactcgcctatcttcataaacatatctatgtttattccgccgaaaatatcatcgctgtcggtatcggtcgtgaatttttcctcgttttccgtaccgcttgtttcttctgaggttgcattgtcgtttttattatcggacagcatcgctttaagaatatcatctatctcactcatactgccctccgtccattactgatttttcatagattttttcagctcctgtgcctgtgcggatttcatcatttttttgataagctccgggtttccgagtatgctttttagcttttttgcgtctttttccggcattttttcgagtgctatcgaaatatcgcccttctgcatcgcttctttaagacgctgaggcgtgatgccgagtttactgctgaccgcctcaagcattgaatcaacgttgttattcataactgcctcctgaaattatattgtcaatgcggaaaatatattcccgttaagactgccctaaaaccgtatctgatgaactttttgccaaaatcaacgataaaaggatacttacgttatattcagttcatatttttttgtaaaaatatacaaaaggttgtttttgttttgtgtaagatcggaagagcgtcgtgtagggaaagagtctgaccgctccagttggtagacagaatagctttcacacggctttcgggaattaaatcaaaagccgcacggtaatccgcacccttcgtcacatcgaaaaccgtctgcatatacgcactctgaattatatcgcccagatgcgctgtatcaacgcctatttcggcgtttgcaaggcgccgatgttgtggttttcatccaaaatgtttttcttttctgtaaaacgggtaatagaaaaacagcaccgtgaaagtgctgtttaaacgttaatatgtaagccttatctcatttttaccataagaaaaacactccgaaaagggtgcttaatctataaatttaacgaatttaatgtcatcatctattaaaagtactgttgtaccgtcatcatcttgataacgaatgccgtcttcatcttcaccgtcatcatttgtaacgatacaatcaccgatgcatcgccctttgtatattgccccatccttgcaatatacaatagatttacggtcatcgatttctaattgaactatatatggtttcactacttatcacctctttctttttttgtgaaaaatgttgttaaatcgaactctgactgaatataaaccgcacctacataataactgttatgaaccgtcactttcttgccgtctttgaaatagacagcgatttgtgaaccatctatatctattaatatttcgctctttttcaagtccggaatgtttttctccaaagccttgcattgccttaaaaaaatatccgaatcaggtgcattgcaaatcgtataatcaaacataatgatttactccgattctgattttcgtttacattcttgcttttgaagcatttttattctcggcgaaaaaattcgataaaaagctgtgacgaaatatttgtgttttgtcgcatcttcttttcggcagccggaaacgccctctaaaatgtgctaaacgttgtatttatctcttatggttttaatccgtttacgaaaagctacagttaaatccataagttcttttgcgagtgactggagttcagacgtgtgctcttccgatctgattctggatgagtgctctgtcccgaacacccacacttcctcgcacagcgccagcagcgcttgtccgaagagcagtccaagttcgcgctgttctgggtcgccgtcatccagaatctgcgggtacagcaggtgactgaccacggggaggcgctttttctctatggcaaagcgggcgtatcggatcgccgctgccgtgtttccttcaatgtccccagcgtacttcgagacgacgtacaccttgggtcgcgccttgatctcggagtgcttgcggtagatgcggcgctggttctggcggtattccttcatgatcgtcgccatcgctgcgcctgccgtgggatcggtgtaaccttccttgttcttatacatggggcacctccagctcatgcagcttgccgaagcagatgccgtgttcgccctcggcgacgatcgggatatcaaaggccgcaaagggctgccgctccatcgccgtgcgaatgatgcggatcgcttcgtcttcgtgcccgtcatctacctcgaaaagcagctcatcgtgaatctgcaggatcgggcggatatacggcttgtccgcaagctctctgatcagctccgccatcgccagcttcaggatctccgctgcggtgccctgaatcggcgtattcatgctgcatcgttcagcaaaactccgcttgccccagtcggcgcggttattgatgttcgggagatagcgccttctgccgaaggacgtctcgctgtacccattgatccgagctgctctgaccgtctcttcctgccattcagacaagcgaggataaccggtcttcaggttagcaatgatacgggcgcactgatcctcggtcttttcgagccccgccttgaacttgagtgttcgctgtagaccgcgcggaaacagaccgtagaacgtgccaaaattcacgtttttggcgattgtccggcgctccttgtaatctggatcgtccttgtcctgcgcctcat
